United States Patent 9,487,797 (GENOMIC PLANT SEQUENCES AND USES THEREOF) - sequence listing, part 82

SEQ ID NO: 78763 - DNA, 44455 bp, Oryza sativa
gtcgcccccaagaccccctcccccatggtgaccaactcatgctgccaccgcgctctacattctaatcggttgctcttgctcgctcgctgctcgatccgttcattaatttgatctttctttttttggttttatttcttttttcggcggagcagaagcagaagaggcgtaggatcatcgaggcggcggtcgtggctccctcgcctccgaggaggtctcggcgcctcgctaatctccctgaggtcaagtatgcagaggtaactgctttgctttggtgttccatttacacagtaataaatgtcaaggagaaaaaaagattcagtaatattcagtcatagaaaaaaaaaagaagttcagatacacctgcttcttgttctgatgcatctggttctaagtttaaggttacaaattattgagcgtgattttcatacgttctagccgtggctgtcaatccagctagtgcaagctgtaaaaacggcctattgcacagtgaagaagctgtatttcacgttttctgaccaactgaattgataaaaaaatgtgcaaatttggtaggaactactgagcattaaataagtctctgaaacaaaccattcttagcagaacttaacaattttcagtaaatggcattttaaattgtgccattgttcctagcatccacatatgtaagtatgtaaccatcataagaaacatcttttctgtactaagaagtagcatttgtcggcaggtagcaccagatggcgcagagaggatgaaaaggtatgtcattatgtgataacaataacattaccacatgagcgtatgaagcctgtattgcctcccactaagtagcaaaaggtgcaaaactacatcccgttgtccgatttcttctgcaggtctccacgaaaagcaattgacagtatctacctggcaacccgtggatcaatttccatggaagctaggctcgaggcagcaagaaaagcagaggaactggaatcacaacttgaccctgaatttccctccttcgtgaagccaatgctacattcacatgtggtccgaggattttggttggtgagtactgcactatcacattcccatccctgcaacccttctttaaggggaactgttgtcatgtggtactaatacttgtttggtggcatgatcaaaagggcttaccgaggcatttctgcgagacttacctgccaaaacatgatgccattgtcactttgttggatgagaaagacgagcaatttgataccaattaccttgcctacaagaatggcctaagtggtggctgggctggctttgctttggaccatggattgttggatggagatgcgacagtatttcagttggtcaagcctacaaccttcaaggtattaatttttactgaactgaacaatatgtctgaataaatttgtacctgtaacttaagcatgttttatatatgaataatgtgaataatccttgaaaattgatttttgtccaggtgcatattatccgagctactgttgatgatggaaatgaggtaaccaagtgacatcaacaaagacggcactactaacacatcggcagacgaaaaattgcattttgggtaggtttaggcctcatctgttagtattaccattaggcacttaatctgttactctgctagtttgcagagcatctatcatgtagcccatatctatgttgggagaaggaacaatttgccactcttatgttgtttgtaattggtgtgtccacaattactgccaattcgacactcgggagtttattagctgacagatttggagtatctgctgtttatgtgtctggctactgcatgtttctgtcctaattaagttttgatggaacatggtacaacttttggcgtttagattggttagattatgaactgcttctttgacctaacaattatcctacactaatgccatctaatgcagcatgtacaacaaatactaataacacaaaatggatcaaaaggatgatgctaaatatcacatcaatctttcaactcacatacagcatcatacatgaatatcatcctacagtttctgaagccttcgctcttctcccttcatcatcaaactgtatctttctgtacataaatgtaacattagattggaaatgatcatctcagatattccttcctttccagcctcaattaagtttgttcccctcagtcctgtatatatatatatatatattttttttttatgcaaaagcaataccatcagcatataaaatggatccaaaatgtgaagactttgttccccaatcatacctcatgtcaagttcaggtttgtttttcaggctctctggtatctggccggtgagattgttgttgttcaggtatctgtctttcgcaggagcaaatgcatgaggcaagtactaagagttatcagctgtttggacatgcaacaaaaagagggttaggatacttacagctccttgagattggtgagtgttcccagcgatgggctgattggtccacttaactgattgccctcaaaatgcctttccaaattcagaaaagttagtatgatggaaatgagtctcctagctaggatgagtagtaatcaatctcctactgcctatccattgagcttacaattcttccaagatgtgcatgctgctcaaatcaggtatggagcctgtgagtttgttgccaccgaaatagctgcatacaatttcaacaggaaaattagacccaagtgcttatcccatttgatcattcggattcactctatatgatcgtgtcaatcttacatatttttcatcccagtcaaatttccaatactgtcagggagcgatcctgaaagaccatgattttttagatccctgtagtatacagaaaatggatcatatcatcacagcaacaaccaacatctcggtagcttattcactgtcaacaccatatgagttcataggtgccaaaccatgtcaatctgaacacttacagtgatacgacgcgcacgggtgatccctcggagcagataaccccggtccacgaattctgccgcggcaggcaaggatcgccggcccagtccggcggcgggttcttgatgctcctggcaagttcctccattgcaaccactgcacaagcgaagatcctaaaccttctcatcacccaaaaattaatctcacatactgaatctagctagcacaatgatgaacttttaaaattttgctttgctcaaattttgcagaaagaaactgcttgacatttggagatcagcctgtctatcgatctggagcagggtttttattttcgaaattgctttttctttgggggttgggttggagggggggggggggcgaaatttcagaaagttcgattttttttggccgaaattatttgaaattttgactgatttttaataaaatttgaccaaattcacacaaaaaaaaaagcaaaaaaccgaaaattttcggactgagatataagattgccggtggggggcgaatttcggaaattttgaaacgaaatttcaaaccctgatctggaggcgcataccatctctggtggccgtccggccaccgagcggcacaatctggtagatctcgccggcgttgatcagcgggccgaccggcgacgtctcgttgggcgtgagcacgatctccatcttgccggagagaggcatcatggtggagtacaccatgacgccggcggccgaggcgttgagctcccggaagaactccttgccgttgacggcgacgtcgaagacgcgccagctgtaggggctcgccgtgcgggagtcctggaagtagagcgccacgtagtaggtcgccgccggcagctccaccggcggccactgcaccgacagcttcttcccccggctcgtcgtcacgccggcccggagcgccttcgccggcggcacgttccagaactcctccggcgtgatcgccgagtggctctccaccgtcgggttcgcgtccgtgaacggcgcccagtaccggttgtactggtcatctggatagctagaaattccagccatgtcaggttaatcaggacacaacaacgcgccgtcgtggcggcggcgagcggcggaacgcgcgtacctcacgatctcgcccttggcgccgaaccggctgcgcgccaccgtgctcatgacgtacttgtcgaagtcggtggtgttgtacatggagtcgtcgaggctgacgagctcgagcgcggagatgaaggggctggaccgggtgtcggcgcggcgcgccaggcacacgctcatcgtcttcccctgcgcctccgccaccatctcgaagtaggtcgacatgccccgccggaagttgtcggtggtgttcacggcgctccaccgcgtcccgtcgacgatctggtcgaacaccggcggaacgtcgccgccgtcgaacccgccgtagaagtaggtcgtccggacgaggtaccgcgaccccttgacgacggggagctggtagcagtacttcctcgccgtcgcgtcggggaagtagcgcacggtggcgagcagcggcaggatgttcggcttgtcgacggcggacatgttgccgacggcgatgaacccctcatcctgtatccacttgatgctccctatctgctcctccttctccgatccacagtttatatagaaccctataataacatttcgatcacccaccattacacgtcccatttcttgcatgcaagaatcaattactccgtgtttgtgatataattagtggcttaaacttttttttctgatcagttagatataatcaagtttacataaacaattagcaacatatacaacaacaacaacattagatatactatgattatatatgtttgttttgtagaaaatatttttatattcttttataagtttaacaaaattgattatttaataaaaaagataaaatttattataatataaaatggagggagtaccatgaattacctcgaggttgtgggacgacggaggcggtggcatgggaggaggcggtggcatgggaggaggcggcgaggaggagggggaggaggaagaggaaggcaatggggataggcatcgtaatgtcataataggattgggtgggaggggagagagcaatggagcgcgcccacgaaggggaggctccgcgaaggggacgacgcgaggaaagggggctcacgaagggaggccactactgtttatggatcaccgcgcgccacaaacgggtggtttttgcttccttggcttttcaacggcttccgcttaaatttagcaaacgttagttgaactggtcaatcttaggtgtgcgtcatgggccttgaaacctctttcacggcccatgagagaaatgaggcccaagtgatcactggatcaaattattgcgagtggattgtgatttgggcctaagttttactttggaccaccctcaaatcaatcttttcactttagaatcagatagttttgtatattttttagtttggatgatcagaaaattttatcaattttttttaagtttggatcatccttaacttcttcaaacacccataaataacctcaatcaaatcggtttcggtataatggtgaacttccccttttatatgctgctcatatctatacatgaatagtaaagagagtggggtgatccaagccaaatactataggcaaagttatccggtctaaaatgaaaagattggtttaagtgtgatccaaagtaaaactttgacaataaaaaggtgacttcattttactcaattatttacttgtgattgaattattcaccgagggcttagtaaatctatagtccctgtgcgtgtatatatgaacagaggttaaagaagagagaattaacggaggcccaaaattctaaatgcggccagccagcccatcccagcccagcccagctaagctagcaagctgccacgtcgtacggggacgggacggcggcgatcgccggcgaggcaatctactcccacttgcgggggtcggtgatgttgatcttccagtggtggtcggagaagccggcctcctcggcgaggtgtcggtcccaggcgatctcgatcttcctccgctccgacaggcggcacggcgagcgcatggcctcccccatgtcgtcgtacacctgccaccaccgcgcgtgcgcggcgtcgctggcgtacacccgctggtcgccgatgttccagttgcagtcgtagtcgcggtagcacgtccacggcttcagccccaggtagtggatcgaccacacctccgcgggatccgcccggaacagccgctccttgagcgcccgctccgccgtagtgttcgcccagaagttcttgaggtagttcacccgccgcggcagccggtgccaccagacgaacacctcgttcaggaacccctgatcgccgccgttgtaggaccggatggtccgccgctgccggatcagcgactggaacgtgcactgcgacggctcgatcaccatcaccccggagttgaagagcgagccgtcgttgcccaccgccgtcagctgcgggaagccgaagagggcgtcgaggtcgcggaggacgaggatgtcggcgtcgacgaacaccacgcggtcgtagtcggtgagctgccacagccggaacttgctgtagttgtactcgttgtaggtgccgcgctccgcgcgcgggttgcggatgcgcttgatcttgcgcggggtccagccggcggcgaccagcgccgccagcgccggcttcgacacggtgtggtcgtggaggaggacgaggtcgcgcgtcgacccggcgcgccggatgctctgcgccagcacgatcgcgccgcacaggtacgtgtccgacgagtggagcaccgtcgcgtacgcctcccgccgcggccgccccgccgttgccgccgccgccgtcagctccgacacgttgaacacttcctggatacctgcgttaattcattaattaattgcttgattagttgactgcagcttacgccagagaagaacacgtgctagattcttgcgaaactgcactgtgcctgatctgacaatttacctatccatgaaaacaaatttactccaagtccaaggtgatcagttctaaaaaaaaagaaaaaagtccaaggtgatctgaactcaaaaactagtgcgtacgacgaagaatttttcctaatcttttagcagatcaataaatctatttcttaactatatagtatatgtactcgatccgtagtgcgtggcacatgcatcattcatgcacttcttgaactattccaactaagctaaaaaaaaagaactattccaactgaatagtatgaatatactgtataatcttagcttaaaacaaactagaagtgtcagacaagtcaaaaccaccaaagaatcaaatcgaattgcacaaggtaagatcaagcaataaacttaatttgcgacgatattgcgtacggttggtatagatatctggtcatccgccatggagacgaatgtagtagcatgcaatgcaagtattaattggttcatgcacaagctatctctatctatccatctagagtagtatccatttagctacacgcagctgtccggccggctggccaccaaccgaatctagtttaatcagccctgtcgaccgatcgatgtagtatgcatttgttgccatcatagtgttcgactgatcggacggttggaggtgaaaggcttccaaccagcttagctgcatgcctatcacaagttaggtgaaagaggccccagtctctgcccatttatcatcttcttctaattaatctatgagtggtcgtcatcctcttctaattaattaatcttttcttgattaatctgtcaatgctcatccatcgatctccatgtgcatcctgatctattaacatgtacaaaccgtactgtgcgtgtggcatcctatgagcaattgagtagtgtgctaggagtacttatcatcagatcaatcccttaagtaattaatatttagtgctagtatattttttttatcaactgtgaataatgtgtgttgatcgattggtttaggcagtagacctaggccctagatggctagatctatctgctcttgcaaggacaggttttagcttaattagctctcgctagctagcttgtggataacactgacagtgatagatccatgattaccagtagaagcttccactcaggtgggatgccactgtgctgatcaacgataggctagctagctagtttctgctggtacacactctaatcaacctagagcaattaatcaacacctgatgaaccgtataatctgaagaccaacggttgcaaatgcagttacgaaaaaggaacagatttactgttgcaccaaccggatcgatcgtcagtactcctatgaatataatagagcgtcgacgatcgaacaggactaaacacaattcaagttgattgattggaggcttcagtttcaacctgaatcaacgaatcgtcacctcgatcgatcgatcgatcaagctatagctagcaagggatcagattcttcaggtttggtaggaataatggggactactcgatcctagtgtatgttttgctaaagagaaagtcgagtgatgatgatgaattgatgatgagaaccttgtccattatcagctcgtggcctttggcaacatttcccgaccagattcctacgctctttgggtggctttgtcccacacacaccctcgttaaatcgtcctcacacactgatcatgcatatattcacattccaagcgcatacatccctacaagtgattatgggacaaaagctgattggttaattatgctgtgcttgcttgattaattgtgtgggtgtgctgtattgatgctgatcggttttcattaggtgacatgttatgcgtctaaccagcagttgggaacacttctctgaattgaatcatgtcttagtctgatgctaatgttctattttccttagtctgatgctaatgttctattttcctgcatccgttttttttttgttcttatgtgcatgcatggccttggcatattgaagtatttttttttcaaacacaaaaagtagtaaaatccacaatagatttttgttttgcataaaaacttgtaatggaaaaaaatgtcccctttaaactaggtgtttactaccttttttataattcgcatatcctattggctaaaggttactgtaaaccattaattgatggttggagtaataattaatcattcagtggccagttctccacagatactaacggaacagactgaaaataaacctaagctattgatctctgaaacttctttagctattctgcatttctttaaaatttctcacatgtgtatcctgtctcagtgtgatcatgatatattctctcttttagtttctagaagctgaaccacatatgtgccaccaatttttctcttttttcccctttatcacctgtcatatttcccctactttgttttcatgcttgactaacatgcatgcatggcgtgagcgcgtgcatctcacggagaagaaaaccaattaaccagggtgcgagcaaaaaaaaaaaaacaagaaaacattttgatccctcaaagaacaatatcatctaaatagttattatccctttgtttcatattataagttgtttgactttttttcttagtgaaacttctttagttttaattaaatttatagaaaagatagaaacaccgacactaaaccagtctcactaaattcaacattaaatatattttgataatatgtttattttgtattaaaaataaacttaaaaaaaatcaaacgactaataatatgaaagagatggagtattgtgcttagcttacctccgggtccccacagaggtagggcgaggttgcatgagccgacaggaagccggagcttctcctccagccgctcgacgtcgaccatgtacatccaccactcgccgtccctccccaccgcctcgtcgcaccggaacaagtccatcatgggctcgcactcgctgcgcaccaccacgcgcacccgcccgccgccgccgccgccgccggcgtcgtgccgcagccccttgcgcgccgccatgtgcgccgtcacgaggtgcacctgcagcctgaacacgtcgcggttccacgcggcgtccgaacggttgcacggcagcgacgccaccaccacgtcgacgtcgccgtaccgggagaagtccggcatggggagctccgggcaggacgggccctcgtcgtcctcctcctcgtcgatccactccgggaagaggtccgaccaccggaacatgtcggagacgcgctcgaagtcgacgccgacggcgtcgccctccacgccgagcgccagcagctcgtcgcggccgatgttcaccaggcccatccgcagccgcccacggagctcgtcgaacatcgccggcgccctcccggcgttcacgatcctctccgccgccgccgccaccgccttgttcgccgccacgcctcccagctgcaaaacacaggtgtagccaattcctcgtaagcaatctctcgaacacatggtgggtcggaaatcgaagcttagctttttgacggacgtcggtcgcacgcacgaatggtggactcaccttaccttccgagagagctgggcggtggtcgtcgtcgccggggtgcaggcgtcgcggaaggcggtgcagcggacgagggaggaggcggcgccgcggtcgaggaggtaggagtacttggggtggaggaggagcgccatgtacgcgaggaagaagaaggcgaggaacgccgcgttcagcttcacgatggccgccgccctcagccccgccaccggcgacaacgacgacgacgacgacggcttgacggcctccccggcgccgcccgtcacccccatgccaatggcacaccgcgccgggctagcttgtcctcgtgtcgtgcttcggcggcgaggttggcgcgcgtcgcgagctgaggtgcgcgctgttttgcctaagccggggcggcgttgcatggcgcggggttatatagatcgacgcgcgcggcatggcgcggcgaggcgcgcgcgaaggacgcggtgtgcgctgtgcgtgcgtgcgtgcgtgtgcgcaacagtgtcagtacgtgagaggcaagattgggggcaagtggttgggtacggtgagaaaggatgggggtgcaacgaactgagatgccacgtggcgagagttccattcaatccatgccttctcgaatctcgaggacacttgccacttcagtccccctccctgatgatgatcaagctctacaaattgcgtgtactagtgccaatcatgacgtgcgcgttgtgtgcaggagtaattaggatctgtttagctgatcgagctgaaatgcaactaaacagtttcttcatcgtctgaaataggagcgaaattgggtgtagcattttcattaaatgaactagataggtggtgctgagttttgttttatttttttcccttcagaaccatagatttatatttttctccagctatattaacatataaaactcgcactgactttcgtttaaaaaaaatactccacagctccactctatatataacacctaaaactaaatttagaagttggaatttacaaaatagatccttaacaacaatatttgagttaattttgcatcgcggtgatcccatcccctctatctcgatctctacctaggatcatggctcacgacctcggaatacaagagcatatcatgaattaaaaaattggcttaaacaaattatctcgctctatacaaacatttttttgaaactcacatggattgtggggctcttttttatatacaagaggagcatttggtaaagccaaaattttagaaatttctaaccgatgatccttgaacgtgcggacgttgatacctggtctaaataaaagcagatcgaaccttaattcccatggtcaaaaaggcacgaatcgctatgcagaataacaagagtgaaaacattattactccgtaccagctaggttcctgctagcatattgcactgttagttgacaggagccagcaatcaactttgtttatgtggtaattaagcctagctatgaaagggtatgtagcctagtggttatagtgacttgagtagtaccccaaggttctgagttcaaatctcctatggagcgaattttagattggattgtttgcggggctaagtttcctatttcaatggccgtatatatccggttaaatatagaggatgggtaaaaaatacccttctctagaaaaaattaggcctagctagagcacatattttaactttattgttagtattagtactagctctggttgtctatcactctgctgcctctgcacatactgatctagaacacacatgttctctacttctctgcagtcactgctactgacatgtgggccctactctctttgggccagcatgtcagtgtcagcagaggatctcattcctacagtcaatccatgtgtgctactccgttaaaaaaacgaattccaagctacaaacctaaacacgtttttttggacggaggggtatatataaacaaagaaaaagcactgtaggtacataatatagtactagatcagtcttattacagctgttcaaaaacagttcagtatatagtgaatctagttggtctgttgctactgcagttaattggctctggttgcttttgttgatctgttgctactgcagttaattagctccggttgcttagttgatcaagttaattagctctggctgtgccctaatcaaaattcatatatagtagcttcaagcacgacataccacctttcctaccttctggtggatactcctctcttttataatttctgcagtaagcttgaaacataagtagacactgccattaattaaacaagcacagtgaattaacccagatatgtgtaatctgcatactaattaaattaggttcgtgccagttcaaggcagccacaaccacatacaggcgatccatatattgatttatatatctgatccgtttgttgaggttggtgcatcaatcccccctgaagcagctatgtcgagcctaattgcgatttgattaatcaatttttctcatccaacgatttaattatgcgtgattttaatgattcgatcggtacagttttttttctctttcttcagtgctagtgcttctactagtattcgtgacaataacctgtcggatttggaatatatgattgctgatgtggtgtcgtttttattaacaagcccttgtacagcaaggtacggttcggttgccttgggtcaatcaagagaccattcaaactgttcagggacaggaacaagaacagcttcactctgaatccgacgcaatcttggccgtccgattctgatccgacgtcgctggattagatgaccgacaaaaaaccagagaaaatgttttttgggcgccaagaacatgtacaagtacaatgacgccacacctaggagaagtgatcctaaggcttcctcgatcagcttcgtggaatgaaatattttgtaattaatggaggaaaaataggatcgaaattggcccaaaaatggtcattttccgttgcaaacagtatatcatttcactggaatatttggtaggaacaacatacctctctgacaagaacttccaaggaatttgaatattccaactcaacaaagctagcatgattggtttaatgccaaatacatgaaaattaagtattactcatttcctggagtaccttaaataagtacagttgatttaaggccaaaattaagtgtctaatctagtgagcagccatccgtaactatcataattaaggagaaaaaatatcaccggtgccctgatgtgccacatcccgattaatgctgatatgcatccatctatccagctattatcagtacacaacgtttcatctctcgtaccaaactgacatgtaagctttggtttatccctttcccttcaccttcaagaatcccaatagaagatggtcagatggatggataagctacaagcatactagccacactgttgctgattcgatcttctgaaatgctaagctgatgatggtgccaacaatctcttctctgcacttcggtccttactgcagcaaaagataaagaagttttaaccatcctgatgacctgatcagaatcttcctttttcttctgttcttgttttctagtgatctttcatgatgcaatgaatgagaagaaatatataatatactacttgagaatggagatcaggtgtgatgaacacaaaagctttctggatttaaaagtgcttcctgatatgcattataagccatgtgttcccttttgttttcattgccatctgatcagatgcttccatccaagttacagaggggcagagatgatcgaattggttctggtcgtacatacacgtcgtgctcaggcttaaacactgcgtggttttcacacgtggaaagacgacgacgcacaaagctggaagtaatccacatttagcagcgatcataaaaaaagcagctaattagttggaaccaatgcttcgaggctgcagtacgtctcctttggtttcttttctctttggtgttgttcttctcatttcctttttatctttttccttctcctttcggtatcagtgatactttcagaaactttactccactgtaatgtaagaggaataaatttcagacaaatctatgtatgtgacgttggagagagccgtttgaggggattagtgaagttacatctcacctagaatgactgtttaactggtgatttgaggcataagaaagcattcctaagtgccagctaagtcatgtaaaaatttgcttacacaccaattatattctaatcttttaaccaaagaaatgctacacatggtactattaggtgaaaatgtgttctcctttattatttgcactttatgtgcatgttctacttctactactgctggttccctactctcttttggtcttgatatactgttacttgcaatcaatcttaattaatggccgacaatatctttacaaaagttttaaagaaaagaaacctctactggatgaattttcagggtagtgcttgatcaaatctaagaggtcgattacacatgtacctttactaattattggcagtagtagctgaagaaaggcaaaggcaatgttccattctttaatcatatggttttgaatgcaggtggcatgtatttggaattattaggctatagtcacaaaatgttttttggctggcacataccatgaaggtgattaaacatgcatggttggttgcatagtctaggtccctctactacagcacacaagatttaacagcaaaagtttgataaaaaggtgagagtgaaatgagattcagatgagagtagtaggattgctggttacaaagccttgaaggcaactccatgcccaaacctaacctaccccctgcattcttattcctcttgtgcccatggatggatgatcacttgaacaatagttgtctcaattttttttctcaccaaatcctgttggatttctttgtctttcagttaagaaagtttggggatgaaaagttctttgttcttccaacatcctccaggagagcacaaaaaaaaaaagggtgataggttgatggatgatttgacctggatgcttggagggctctaaaggctttatttcgtagtggaaatatggttgtggattttttttgcctcatatattcatttctcttgaagaagacgatacattcagtatatttatttgtctggaaaaatttatacgaaaaggctctgatgatcgattgagctataattgataagccgtagaaaaataatcgaagcattaaaaaaataattattggtaaaactttatgtgtattatcaacggtttaaaaatcaaggctgtaaaatagacttcgatggacaatttaccttttaactcttttaacttttattagtggtttaaaaaccaagccttaaagttaactttttaaaatgtaaattgcatctatggtatgacaacttgacaagtggatgtgatatagaagaacttgagaattgacgttcgagtgtaacgacttggtaagttggtgcgttctaatacgagaacttaaaaattttagtattttggtgtaacaacttggctaagtatgtgatgttttagttaatgagtgctaggtgaattttttttcacgatgttaataatctaatataccatcacgtagcaatcctattgatattatattataatcttgaatataatatttaagaattacattggagatctaatttgcaccaccggtttgaattttttttcttaccttctcaaatctcaacagaaatataatatcttctacatagtaaagtttaattgactagaatccttatttaaaaaaatactcggtataattaaattgttgcaccacttttttatttattgtatcaaaatcacacctacattgtaagttattgcactcgtacaatcacttataaaattcttacactaaatacctgtaagttgttgtactaggatactcatttaccaaattgcactcaacttaggtagtttatgcatcatgaatgtaatttactcctttttaaaagtttaaactttggccgtagctgataagagacgacgagagccaaagtggtagctcaaacaagatcgagaatgctggtacagtttagctcaagtcaaaccaaatcctgtactactacgcaatttagacgatttacctactgctatgtgattgctaaatggaatcctcttcctgtctcgtcattacagtatgcaatgtaaaagagaaatacagagtaaacgcaaaaccaaagaaattgtgtgttggggattgaacaggtgactttggagttcaaaccacgtacctctttacagtgcattatgctgcgttcatttctccaacaagagttgaatgaaattttagatattcgtggcacgctttcaaactgttaaacggtgtgtttcgtgcggaaactttctatgtgaaagtttctctaaaacatcagattaatttattttttaagtttataataattaaaactcaattaatcacatgttattaccaccttattttgtatgaaacactcaattttaatcatcttcaggagattcgagtgcatgtcgaaatcggtgatacacgcggttctggtcgacggcgacgagaatcttggtgcgattgccgggttgctttcggcatcttttcgcctgggccggcggcggatcgacgcaattaagttaacaaatcggcgtccggcgagtggccggctagccgccagcttcaactgctcgttcagagtagagatcgacctgtcagaatgttgggtggagcggagcgagctgaggcgcgtcctgtctcgttctcgtctcgtcgccgtcgacggcgcacctgccgatctgatctgatcacgttttttttttttttttgctccccttaatcatgattgagttggcgtgatctgatcgcacgggaaaccgcgagcagtgtgaccggcgatctgactgacggagtagtggctactggctagagcttgatagctttgcagatcttgctgtcaatcagccaccggtgtgagtacgctgtgcttgccgttgcgacgtcccgtgtctccggccaccgcgcggaggcgagcttattcgtcatcgtagatttttacgtatccagcgcagcaagaacgaacaagatgccgtcgtccgcgcgttccgcttcgcccatcagaccgcaaccaacgaaaatcctgcgcccccggcggataggattttctccgaacgcatagcctccatgtctgccgccgccgccggcaagagattccccgtcgacgcgaccatctcggtcggggctcctacttctccgccgatggggagacgaaggcggcagacggaacgctgtactagccttgtttggagtgcttaaaattacgataatctactgcttggtagctaacttttgaaaatctggtttatggtttcttagtttattttctgtattcaaaatttgggtgataatttggactgtatagggtgtgttcggacccaatgattcctcaccctctccatcgtattccgcgcgcacgcttttcaaactgttaaacggtgcgcttttttaaaaagtttttatacgaaatttgcttaaaaaaattatattgatctatttttgaaaaaaaaaatagctaatactctctctatactagtaaaaatgacgtttagaacagcatttagcataccaagaagtgattaattatgggtatttttccctgtctacccctattaaatatggttgcgcgtaagaatcttggcagggacaagttggtttctaggttttgcatggcactgttttgggcaggcttggatacttggttggctgcatggcgctcgtgcaggtggcgtttaggcgcgttttttgtttcgcttttttagtttgggttcactgccgcgcgtgatgctgaaatttttttgcatggcgctcgttaccgctattcgcgcgcctatcccgtggtaattttttcgcgtgggcgtgctgagaatgccgacgcttaggttactgcttgcccatatttatacgctaacttgctttcacgtttggagtactgagccatctcatcttctagttctaggcttctagctagcttcctctcactattgcagtacacatggccgaagatggcgatggcgagtttgcctttgatctgaacgagcctccgttggagcacggcaatggtacttttcttctctgtttgacaggatttttcttctcttgtgcatgtttgtacggcaactgtgctatctcttcttctctatatcgtttctcatatcattgttttccattttttttaactggttttgatttgaacttgccactaaatgaatttggtgcagtcgatttcgattatgtacaacaccttgctggtaagccaacttctttttgatacaattagattttgctagaacatgccatggctatttgtactatcaatgaacttgattttcttccttttgctagaacatgtcatggctctcgttgaagtaaaccatcgaaggaaggaaagacatgaccgaagaagtgagaaaacaagtttatcaagctttgttggctagaagcaagaatgggaaactaggcaagaaagatacaagagttgttgcagatcagtttgtcaaccatctttcctagatgaagccaaggctactcttgctgcattgaacatttagaatgaagctagttaggttccgcactcaattaatagagacatccttgtaatgcgattattaagttgtgttatcttaccatttctttggcatcatccttcctgggagtgagctcacgttcgcgcttctcgtcaagcatcttgagcacaatgcgagcggcggcggcggcgtcgagcgtgagagagcacggccggtgagcgcgacgcaagcgacgagagcggggccggcgagcacaatgcaagcggcggcggtggcgagtgcgacgagagcagcggcggcgagcgtgacgagagcgcggccggcgagcgcgacgcaagcggcggcggcagcggcgagagcgacaagagcagggccggcgagcgcgacgcaagcggcggcggcgagcgtgagcggcgaggttgagcggcgtgctgcatgcctgcatgcgacgcttaaggaattaaacgaggcaagcgcgggcgtgctgcggattaattgcgggagcggctatcgaacagacaagggtaattccgtccacatagcctgctgcggttcagaatgtcgttaaaatcgcaaacgaggttatggctagaacgacgtttttttcctatacggagggagtatctaattaatcacgcgctaatggactgcttcatttttcgtgcttaggtgatatgttcctatccatcagcagcgaacacacccttaagagagttggagattatgtgagaaactgtagctgctagaagcttatgcccgtaaagacaaagaaggtgctagttcaaggcgccatgctgggccgacccaggggatcagcccaatcaagggctttctacaaaggaataagtccgatttgactccctttatgtataggctcaatctaattcatattcctcaacaacaataccacataataccaggtaatattttgacatctcaactgttaaaaccattgtaatttaactcccttagcgattttaaatgtggtttcctaacgtactctctccgtttcacaatgtaagtcattctagcattttccatattcatattgatgtcaatgagtctagatatatatatctatctagattcattcacataaatatgaatgtgaaaaatgctagaatgacctacattgtgaaacggaggaagtaactcgtttcatacgagacccacatatcagcatccattcttcttcgtcttcctctcctctaacttccttcccgggcagcagttccttcccctcctcttctacaagtgacgaatagcaccacgagctcgccgccaccggcgatggccccccctcttcatagcgaacctccactcaactctcgttttctttctccggttttcctcctctttgcctctttggtttcccctcagtcggggtctttggtaaactcttgcgaggacggtggccaggagtggcaaatatgcgtaccatcatacctgtacacagcgctgaatgttggtttgcacagggaagtaagaacatgtatcatcagtaattcagtacttctcaaaatttgcactttacacaccatgaacacaattatatatggtcattttacagatgttggatatcattctgcaaaattggtgatctttcattctcaatatcatgatgggagtacatgtatgtacaatggaattatggcaaaaggaatgatgggctttgcatcattctcatcttgtggcaaacataaacatattactcacattgcaaacaaacagttgccagaacacagcaacacacacaaaaaaaaccattacaacaatatgatcaaacaataaatctaccatgttgtgagtgatcgatcctattattcttctaccaagacagactctacagagttcagaactatactactaaatcgccaatactaactcatccagttctcattgactgcatattcaaccagatccactcttgcatgccttactctggagcatctttccttccatcagcttttgtggaagcaaacagtttgtcagatggaacaacctgcatatatagaacaaaccatgtcagtgctactgatactctgattttttttttagtgtgctgtcttcatctcaatatttgcaacagaataagctaattaaaatcctgagaaattacttggtaattccgtgtaagagcacttcttaacttccttctcttgcatgctttgcttgattctgcatcaacctccgcctcatcatcagcaaaattctgatcagagacctctgtataaaaggaaaatggaagaaaggcgttagagactaggttcatcacattacgctgttttggagcaaccttagtagaactttaacttttttctgttctttctgttcttatgacaagagacatcacccaaaaaataaaaactatacaagctcccgggcttaagaacaatggatttggcatgccgcataaaaatcagtagtgttgataaaacatttgtatgaaatatgacgcaccaccatttgatcccaggaaaagccattgaaagctattttagataaaccgcattaaatcataacctatgaagtgcatggctattcagaacaccttatatagttataatgtgaccgctgatagtcagaaaaagatgatgaaacaaggaattcagacttttaagcattcttcaatgtgaactaatgaggtaattgagttaaccacctgtactttcaccaacagctttttcttccttgcaagcctcccactcccttccatgtgacaacggagtcctcccttggatagtctgaataccagattcatgatcacccactaaagcctccgccgcatcattccttgcattgctactgcattcgcgcggcctgaaatgctggatccaggggcttgcgggcaggcagtattttctcccgatccgtgagcaagcactggtccgatcaaatttgagtttctcccacaccccaccacggagaaccttgaatccgttgccagcatcattttgttcgtgattgtagagttgctcaacgaaagaagcctccattgagcttatataatgcatgtgccgctcatctgtccaccctgacgacatcatgtccaggattcgattgccctgtcaaagaaaaagagacaaccattttattcttcagagttcaggtatttgtaacaacgtcagataaaagagggcctgaactagtgaaattcatgtcaaaaatatcagagtagtgttgattgcatggcttaaagttatactccacgagcagagtaattatgtgtcttcactgcaccatgggcggattatattactatttcgacatgacagacatttcttgaacgattgcatgacaaattcagataaacaattaactgtacaagactaaacactttttactaagaaaaagaagctaatggcaataattcaaggaagcatgcattctgtatgacagaatcatgagcccaacaattgctacctgaaattaagaacaaacacgatggtaaaaagaaaaaactttctgttctaatacctgagcaatgccgcctgcagctggctccgccttgatcggtcgattgactgacacatcacccatttgattcttctcaatgaaccaaggaacccacaaggggaggaaaatccgaagaaattgccaaaaatcttctcgaaccgtatcagaaaccagcccaaaatttcctctcttgaaatatgtacagctacagagaagtagggggaggtctagggatctggaagcaaatcggcgaacaaaccaaagtaaatctcctcgcgaccggatgattacgaagagggaaaacaaaaaaaaacaaacaaacacggacaagatttcaacttcaagaaacaaacaagagaaacaaaaatcacacctctcgctcgatttcacccgcagatcgaacaacccgcctccctcgcagcgagaaagaagagagaacgcatccaagatttggtctgagcggctcgatctatggacagacaagaggaggtgaagaagaggaggagagagagaagcaggagagagaggagaatggaattgcaacggaagaagcaaagggagacgaagaagaatcccctcctgtttaaggagcaaataaatgcggtgcgagagagcgagcaaaaaaaaaaaaagaaaagaaaaagaagaaggcgcggtggctttaccgcttttaccgcctacgtgtgccagcgcttttccacgtggcgaggcgaaacgtggcgcgggggggaaagaaaatatctcgcgcgcgcacacgtgccgggccgcctctcagatatttcgtggccgctctggcgtgggcgtggcgttgccaaaaagatctctgaagctgggccccacctccctgtgcgtaagagaggctaggaaaacaaacaggagtagatttttgagcttcaatttctcataaaatttataattcttgaaatagctttttttaaatctagattttgagagtcgatagctataaaatctagaaaagaattagaagccacaaaaataaaaagaactactttttaaaattttcactaactaactactattatccacatcttaaaatcttttatctccttttgtgaaatgaacatgagttaactggttaacttttttttaatggaaccagtccactaacttttaatttctagatttgatatgagtgctcgtatttacgattaattattattttaactgtatcgatatggactaatctttttaagatgctcaaaaagatagggatagtatatttttgtattttgtttcttaaagtaatcttttatctaccagacaggaagaagaccatctacctgcgaaaccacgagcaagcaggcatgggcttgtccgctcgtagttatctccacggcgacgccttttatattcagttaggataagcaaaagtgtttttcaggtgattctgcagtgaacaaatctactactactactgtccgagatttttctttttcttctgatgcttacttcagtcattcgttatccaaagagagtcttcaggggcaagggatttatacacttttatcacaggcatctgtacataatatctgcaagatatatccaggagatatggcttggaagttgtgacccatagtttgttatgctagtctcaaaagtacaattattgaatcagctaagaaatatctcagggaggagagaaatatctgagggataatccagcaggtgcccctgtttttctaattgcaacttggtgaactgaatataatagtacagtatgacccatgttgacgcaaggacaggcaaactgtttttagactgcccatgttttcttctctgaccctttctgactaaacctttggttcagtgaatatgtttatactattgtttacttaacagtacaactatgcgttattccctgagtatcaaaatataaggattgtgtgtctgttctaatccaaactattataagttcaagcaactttataaaaaagaaaaataatatttatgatcgacaccactagatcaattatgaaaattattattttcagaattcacttcttgggtgtggtaggtgttaagactcttctctacaaaactgaatcaaatttaggataatttgacttgagccctatttgatatagctccatagatccacactggatttaaagtttgaatgctaaattacaacggtttaaatctttatatttcaactataacaggagcaaaatgatacatttgaatgttatcaacagattgaagatctatggatttgtagagttagaaatacctgacttcaaaaaatcaagaatccggataaatacaaaatatcttctttttttttagggaggcagtaacaagacaggtggtggattgttgattcattttaactgaaacaaagtgggcatatctcccaggtgtgacataagcaaccagtgagtgcaaagggagataaggtctcttaatcccttcacatagaaaaaaaaggtcgctttaccccttttgccttttgcaaaagtctaagaattactatgcaggtcgttttacataatgttctttttctccagcatggcatatcggcatcagctctcagtcacaaatcaactttacagaaatatgataagaccaaaataggcatctttcaagttccatcatgtgtaaattggtggagagttgggcacccactaaatagaaaaaaactgactaggggatgatgacacacacaccattgggaatagtcctgactacaactaggaggcaacaggaacttcagactgcagacttttcaggctcctacgagatagcattttataatcctgaaatcagcaagtgataactcattagcctacaaaactgaatcattgtgaactgcaccaagacaacaatacaagtctgatgcatctatgtacaaacagaaccatggagagcagcgtttacctccactacagactgagcacaaagcttcccagatagaactgcaccctccatcgaagccaaatatttctgctttgtgtagtcaccagctagatagaacccttcaatcggtgatctttgcagaggtcggcaaggttcacagtccgggatagtcttgtaaacagatctgtaacagtgagacagaaaagaaaggaacgtgagagaagtgtgcatccaactattagacctacctatgatatatcagatagggggcgctcttgcaaaatgtcctcaccttggtgtcttcacaacatgatacttcagaatctttgctttactctgatcagcagcaatttcatcaggaaatagcttggctagctcttgcatagttgcttcgatgatttcagtgtcactccgtccaacccattcctctgcaggagcaaagaccaactccagcattgaacggtttggatcatagtattcctgtaaagagttcaaaacaaaaggaaagaaaaccgttcagtaggcatccatgtctttaatttcctgagctattatggtccataaaatctagactctagagccaagtgacatgttgcctaaatgaatctgaaataaaatatatctactttccaagtttaataattaatactggattccttctgtaacacatgcacttttgggccttttgttacagctactaaaataaatatcatgtgatgcttgaagatggtaaacccaagaacaaatacacaagagcaataatacatgacagatagttactatttcgtaacatataatgtctcctagttagtaccttgcaagttactgacatgtccgcataaacacttaaaagtgaactcctgaaagaaaagggaacaagatcaatacatgggacatatgatatttggtattaatcaagaatgtatacaaaatcaggatagaatgtgcccaatttgggcaatacaaatcgttttagttcataaaccagtcatagcacagagcaaatgcatgaggcagtgaaaggacagcaaaactgatgaggaattagaagagacacctgctgaaaagaaggtggtcatatgtgttcttcagttttctatcaaacctgaaatgttcaaaccaacagaaatactaatatgagtcataaggagaaccacaaactcgatgatgagtaatttccgacttggaaccaaataattcaaccaaccaaccatatatgaacatttataacaggaactcccaccaacttctccagcttcttgaaataagatatttctttccactcttgaggtacaagaagcttcaagatatcaactaaatacaggctagtcagttaaaatgagtagccgcatatatataatttatgaactgcagaagaaacaaagattgtagaaaatcacctggtgttgcaaaaacataagcatctccagttatttgagttccatcagtaagtgcaaagtgtttcactgttccatcaggattaagttctattttctgaatacgagaattcagccgaacctcaccacccaaagagcgaacatggtcaacaataggcatgcataacctttcaggaggattaccatccaagaatgccatcttagaaccatgcttctcctacacatttgcataattttttttaaaaggcctctaagcgaaaattcatttgagtttcctcaaggtaggaaacaacagagacaagaaacactaagaaggatgtaatacgtaaggtactactccggaaagaacagaagaattactcatatgcaacacacatgaccatagagcaacataataaatacctgaagaaatcggtttaaagcaatcagaatgcactgcatggataactcatcaggatttatgaaattaagtgcctttgacattgcaatgaaaacctcatcgttcactcgatcaggaacaccctgtgctgatcaaacaactgtatcaggcaccatattaatccgttatcccaaaaaaagggaaagagattgataactatagcatatgtattgtgttttctgtataaaacagttctgtatattagctcataaagaatatagtcaacaggattgtgtgctttgtcaatatgtgcaatggcttttctaggtggaggaagaaatcatgcaaggttgttgacctttaactgaaacagtggtcttaaactaaaagcatagctcaagcttaaacctgtgcaaaaggatctgggcaaaataaagggcataaacttgagtacatgaagcatttcatcctcagaactgccagttcttcccaatgtgaatgcaacaataaagggcatcagtttttttattagaaaataaaaggttttctagcttacaacaccttctcctatatccattccaaattaatgaggtagaaatgtgtcttgtacacagagacttgacaaactgatattgtgaacttatacctgctttttcatccactcagaaacagtaaaaccatcttgagcttcaacataagcttggccaccaaccattgctggcaaaagtccaagagcaaacttcaccttctctggccaagttagcatttcattgtttcttagtatggcccatattcctgttaaatgcacgcatgatcaatgataaataataaataggcatcaattgacaacataaaagctccatggcatgatctattgatctatcattaacgttgctagtaatataccccctaattacagtcatgtgttagtaaaacaaaagtaaccaccaatacgatgtacttctgggaatcttggtttaattaaacaactccagcgctgcatatgatctcaccatttaagggtgcaggcaatgtttcaggaaaatcaaaccggctgaattctcctggcttgtttggcatggcaaatatcatggagtgttccttccattgcaaccgatcattaataccaagctcgccaaacaagttctgtatgttgggataagctccaacttaaaccaaaaaggtatatggttacatacaggcacaaaatgaacaatgtcacatatgtactgttgtggacgacaaaacagtgtgagcatggaaggaaaaacagtatctgtcatattcatatatgtttggaagggaatagtaggttgaaagaagactatgtatgaacaggaggatttatattcaattagctcatgatatttatgtgacgttaaaatttatcaaccatataagctagtaaaaagttactttttagtactgtgaaaaaaaccaatctaaaagtttcttacaaaataaaactaccatgtgtgttaatcctcagacatcacttcatacttcccgcatggcatttctaccttatcgatgaaagagtttgatacatgtttttttgttcaaaacccttagagatatctatcagtgctggcggtaataacctaaataaaatatagcacaacgagaaccttaaaaatccagagttattacttacaaaagatatgaagcccagtttcataccaatctccatcttcatccttccaagcagctatctgttcaaggcatttccccaaaaaaaaaaacaataatccacaaatgctactaacagtgaatatgagctattaagataaaggcaaccaaaaaaaaaaagaatgaataacaaaaaaaattaaatgcaacataaaagcataagagtaaaacctttccacccaaaacatcccttgcctcaagcaatatgggtttatgaccagcatctgccagatattttgccgttgataaaccagctaatcctgaaaaaaaaatcaaagctaaaaactacaatgctaagaccacgatgtgactgctatcaaagttagatatatatgtaaattattcatctgtcaaatcctagaattatatcatacctgctccagcaatcacgacctgtaatggtttagtgggttgttcactgtttctgaaaaatgaagatagttgtccagcttccaaaaagtttattgtgttttctagtggaggtcttggaaagtcctggcaaacaacctgcagaaaagccaatcaaatatattttcacaagagatggaatgtgaggcaataatagagtacaaaggttgaacctgtagagcaccgagcctccgacggaatctttttcctttattccttaagacaagagatttcactccaaagctcacatgctgactacttttcagtgcttggatgctgctacttgcgaagcacctatgagtaggaagttgtcccgcaaaagatcttgcttggctggttccagttatgttcatagatgacaggcagccagtatccatgctgaagcaactcctaaaattatattcagatctgatttgacaaataagcacgcaagagcgtctgcaaaaacaagaggaaccattaaacacacaatacacaaaaccgtttgttatgaaagtcagccaagtatcactgtatcagtatgtaaatttatcaagtttgtcatcactatttgatgaaaaaaaaaaaacgagccaaagaaacagattctattctagtccagtcgtcaaatggaaacatagcatgacaataacaaactgatgccaaaaggaaaaaaagagcaggaccagctgttagttgttaaagctatgtggacagtggtaatattggtttactccctaatcttccgagtttctctatgtggctgcggccaatcaaacttttatagttggagagaaacatgaaaggaaaactgcatatgacccgcataatttggttagtgaagtaaatggattggaacagatcaagcatggcacaaaaagcatgaaaggctcaaatgatatcacactagggcagggcagctggagaggacctcgtttgcctcctcatgcaaaagtggtggttagcgcaaactgaactcacaaccatgcgcccgctagtatctaaagataagcccccaaactaagcactaaatcatcatatgccgcatgctcaaagccagcagtcatctcagcatctctcctactacctatttaccaggaaactaccgccctcccgtcaccgcagtcaatccaacaccttagcaaccccgcaacccggaatgaattcccccaattctacggaatacagatacgtacccccgccgcccgcgcgaccgatccgatcctgctgctgggtacggagggggcgagcacggagtggaggagactcaccggcggcgacgacgagcgggcggcgacgtgggagcggaggcggacggcggaagctgcggggggaggagtcagggagggggtgggtttttggggcggtgggaaagggacaaaggggaggcgggggtgaggattgtggaagatgtggtgggggagatgccttttggcgcctgctgctctctacgttctacgtggtatataccaccatcagccaatcagtccatcaccctcaaaaaaactcatatttctgaagggaaatcataggagtattttccttttccgattacacgggagatgtatacgtgcacacgtaacactacactcactctatgaatacgcctcctaacatatattttaagagatggaaaccaacatatccctgattcatgaaaatttcagatgcatgaaaaattctttcctgggggaataagtgtaacagtcatgaagtaatgaaaagatgtgctgctacgaagtaattatctgatgaacagtataatcactgtataagtaatgtttatcaaatgttcgcgtttgccatagcagagacagaaactgtgcgtgcatctgcacacgagagcatgcagtttctcagttctcacggtaatcggaggcgactgtttggtttcaggtgaccgtccgctcactaactggaggtttgaacggtggttggatcagcccaaattcaggtcttctcactgtaccagttcagtccaagctgccatcttcttaacacttcaagaagaaccaaccaaaacccacctcgctaacgccacttaaatctcctgtgatcttgtccatcagattgtctaatgcgtggtgagatcttcactgcaacatttggaatgaaaatgacgatgctgtagccgtgttcattatttcacattctgttccgggcgacagattttagctgaaggcatggatgaaccaggtgaacctttgcttgggctagagaatttcttcgacgaagatgttgatttggtaagtacatttgttaggatgtcgtggatttgaagcattctttgaaaaatgccgtgattcttgtggatatgtgacaggagaatctgcccctggaagacgtttttgagcagctgaatacgtctcagagtgggctctcatcagcagatgctgcagaacgcttgaagttgtttggtgcaaacagattggaggagaagcgtgtaagttgactgttttctttctgatcatcgtttacctgaaactgaaacatattccttttctgaactcctgaatttttttttttaaaaaaatcttttttgtcaggagaacaagatcatcaagttcctcagctttatgtggaatcctttgtcctgggtgatggaggcagcagcagtgatggcattggttctagcaaatggtggtgtaagtgcttgctttgtgttattgaaatattgacatcaaatcgtcgaaaatttgtgcaagcaactcaatggattttctttattattcactcatttactgtctttggtcagagccaaggtactgactgggaagatttcctgggaattgtctgcctcctgattatcaattcaacaatcagcttcattgaggagaacaatgcaggcgatgctgctgctgcactcatggcccggttggcgctaaaaacaaaggttttttttttctgaacagaaattttaaaaatacaggtgaatctattgtgttagtctgatcttgttgtgttcatatattcatggatttacctccaggttcttagagatgagcaatggcaagagcttgatgcttctacattggtacctggggatattatcagcatcaggcttggtgatattgtccctgcagatgcgcgcctacttgagggagatcctctgaagattgatcaggtgactcaaattgccgcgcaccgttcatgtggaagatatcgataattggaatgactgatttagttgatctgtgtagataatttgattacattttgtttctcctccatcttgtagtcagctctcaccggtgaatcccttcctgtcacaaaaagaacaggggacatagtgttcactggctcaacatgcaagcatggtgagattgaagctgttgtcattgcaactgggatacactctttctttggcaaggcagctcatctagtggattccactgaggttgttgggcattttcagaaggtgattcatcgatcttcagactgtaataagaatctcacaagtggatgtgctgtaagctatttctgactactgaattttcaggttcttacctccataggcaacttctgtatctgttcaatcgccatcggtgcgattgttgaggttataatcatgttcccaatccagcaccggtcataccgggatgggatcaacaatgttcttgttcttctgatcggagggataccgatcgcaatgcctactgttctgtcagtcacacttgcaataggttctcatcacctgtctcaacaggtgtgccaagatattgttatcatgtttctgcaattaacagacagcatatcacatatcattgttacaaaaatacgtagtaatttggcgaaagcgatggcggaggaagccatgctttggaagtcggcaaatgcaggggtcccttccgttacctctgcgaggtcgtggtagccaaatctagcacgagatatccccattagatccccagcctccaataccggtcccgtgcttgtttttcttttcgcattgtaaataacttttatttctcttaatggaaaaaatacgctccttgcgtattcccggaaaaaaatatgtagtaattgatttttggcagggtgctatcactaaaaggatgacagccatagaggaaatggcaggaatggatgttctctgctgtgacaaaaccggaactctcaccctcaaccatctcactgttgacaaaaacctaattgaggtagaaaaattaattaaaaaaatgcaacgtattgaattcataattattgactagctatacaacttatgatccatccttgggtaatttaaggttttcagcagagaaatggacagggaaatgattatcctgctggctgcaagagcatcaagagtggagaatcaagatgcaattgatatggccataataaacatgctagctgaccccaaagaggttctgaactcatctttgcttgatttgaccatcctacatatatttcagaatggttcatggatatcatctttgcattgccaggcacgctctagcatcactgaagttcacttccttccattcaatcctgtcgataagaggacggctataacatacgttgattctgatggtaactggttcagagtcagcaaaggtgctcctgagcaggtaggaacttttcaatccatcactgtaaatctcactgctgttaccatcagaattcagaaaatagtaatacagaccttgatcagataggaagaacatctgatgtctctcatcttcagatcctcagcctatgctacaacaaggatgatatctctgaaaaggtgcagctaatcatcgacagatttgcagagagaggcctccgttcactcgccgtcgcttaccaggtagtcgtagcaccatcaagttcagttcagttcagtttacttgttgctaatgaatatctgtctgatggttgagttcatctgatctgatggcttgagtgaaggaggtgccagagaaatcgaagcacggccatggcggaccatgggtgttctgcggcctcctgccgctgttcgacccgccgcggcacgacagcgccgacaccatccgccgagcgcttgatcttggcgtctgcgtgaagatgatcaccggtataatcacgcgatgatcgtactgcttcttgatcgtcaatggagcaacgccaagaagcttcttgatcattgcaggcgatcacctggccatcgcgaaggagaccggccgccgtcttgggatgggcaccaacatgtacccgtcggcgtcgctgttcggccgccacggcgacggcggcggcgcggctgttccggtggaggagctcgtggagaaggcggacgggttcgccggcgtgttcccggagcacaagtacgagatcgtgaggatgattcaaggggggggcggccacgtgtgcgggatgaccggcgacggcgtgaacgacgcgccggcgctgaagaaggccgacatcggcatcgccgtctccgacgcgacggacgccgcgaggggcgccgccgacatcgtgctcaccgagcccggcctcagcgtcatcgtcagcgccgtcctcaccagccgcgccatcttccagcggatgaagaactacacggtgagctagttcttggacactctcacctcatcacctgtaaaaattcacctctcttttgcttgattcacattctcacagagttcttcttcgctgcagatttatgcagtgtccatcactataaggatagtggtaagcgaaactggaattcatcatcacaaaattctcccaaaaatctcgtcattgatcgtcttgtttggatgcagattggatttgttcttctggcatcaatttgggagtacgacttccctccgtttatggttctgatcatagccatactaaatgacggtgatgatcatttttctctgaattttactgcatcaaaagcaggaatagacactcgatttattcagtacttgatggttgggcatctactttgatcaggaactatcatgacaatatcaaaggatcgcgtgaagccatcaccaagcccagatagctggaaactgaatgagatattcgcagctggagttgtcataggaacctaccttgcattggtaaccgtgctgttctactggacagtcacaagaacaaccttctttgaggtaaaatcttgcaacctctgaagaatctgaacctgaacatgagaacatcttgttggtaaatcaacagccgaagcttttgtgtgtatgaattgcagtctcacttcaaggtgagatctctgaagcaaaattccgacgagatctcgtcagcgatgtacctgcaagtcagcatcatcagccaggccctgatattcgtcacacgcagtcagggcttgtccttcctcgagagacctggagccctgctgatttgtgctttcatcctagcacaattggtaaatctgcagaagattttctgaactctgaaacaatcaaaaaaaaacttctgctgctagtagaaggtttctgaatttttctcagtaacggatgatgagtttcttgatctgcaggtggctacactgatcgccgtgtacgcaacgatcagcttcgcgtcgatcagcgcgatcgggtggggatgggcgggcgtgatatggctgtacagcctggtgttctacgcccccctcgatctgatcaagatcgccgtccgctacacgctcagcggcgaagcctggaacctgctgttcgacaggaaggtgggtacagtagcagcatgatctgttcttgggtagttggattccttcctcattcagagctcgcccatggcttcagttcagatctgtgccggccatggatgaataatgaatctgttcgttcttcaggccgcatttgcgagtaggagagactacggcggcaacgagcggcggccggagaccaggtggccgcgctcccatcatcatcatcatcaacaacggagggcgctttccgatcatctcctcagcagcggatggcggcctacgcggatcgcggagcgagccaagcgacgggcagaaatcgccaggtacaagaactgtttgaaaaactggaggattccccggtctttccttattaagattcagattttacctcggttttcggtagtaaatttttcaaactactaaacggtgtgtttgtgcgaaaactttctatatagaagttactttaaaatatgaaatatatccatttgtcaagtttataaaaattaaaacttaattaattatgtgctaatgttttttttcgtctttcctttttttttggttggcttgcagattgggagatgcacatatgctgagagcgcatgtgcaatctgtgatgagactgaagcgtgtggattctgacgtaattcgatcggctcagacagtttgatttgcttgggttttagcatcatgacgttgtatcttcagatttcagagtaaaattaccatagctttttgcatgcaaaatgtcagaaacttgtacggaacaggtcgaatttttgttaaatgacaagtgatgatatatgagcttgtacctgatgattgagtctcttgtaacctccattgaagcatttgctttgtagttgtactactggtcttgttaacaaccagtgaacctgatgctatacttagcagcactatgcttctttggatctttcagatgatataaccaaataatctactaccatgatggcattaatgaacaatcaggaattcagaatactgttctgtagacaggatacaatggcacacctggtcctacaatatatcaagcaacacctgtgattatgtactgatgaaactgactttcttttctatttctccttccattcttctctccaataggcgataggcgaacaaaataaatacaatttgagatgtaacaggaaaagctaggggtgtagtttttgtcatatgaaatcttgttcttggtcgtctgttcggcgcgacgaagtatctccgtcgagcattctcttcgtcatgttggccctctggacaagacgaaccaatgcttgcaccacctctgacattggtggcctgaattctggttcaggctgtaacatgaatttgtttcataagattcagacattctgttccatgtattaggtaattagtattgcatagctcatctgcataggatggtgaaatcctacctggacacacaaagcgagcacgtcggcaaaccgggagagagacttggcagggtacagacccttcagcgcaggatcgaccattctgtccaatgcatcgatgtcatggagctgtggagtcgcccaccgcacaagtgactgctctgacctcggtctagtgctgtaatgcaaagtcacacgattataccgaggttcatcagttagcactaaatttatagttatgcgcaagctggaaactggttacgactgatgagaagatcaagttacctatcgaaaggtctgcgtcccgtcaaaagctctagcatgactactccaaagctgtagacatcgctcttcagtgtgtactgaccagtcatgtccacctctggggcagtgcacccagcactctgttgcgctgcctgcatagttttttttttccgtgacgaacattaatacaatcactagtgaatcaagatgtataaaaggtgtgacatcattgccataaacttctcttttcaattaagaaaattaatacagcctctacatgactacatcaattcgccaacaatttctgtaagtccagtagtcagttttcttggtagtttagcaagcgaaggttcatctcagtgctatttttttttaattaacacacaactgtccaaacaattgtcctcttaaaatgggtgcttggatatatcagcaagagccatacctggaattctgcatcagaaataaagcttgcaagtccagcatctgaaaggtgtggattgaattctgaatccagtagaaggttggatgacttgaaattcttatggatgatggatggagaacaaatttcatgaagatatctacagattatattttcagaggaaatgataagatgtcacatatcatatttcaaaatgagcatagaattctatataaaaggactattattccataatgtataactgtcatccacattcaaacaaagcatgaaactagcaactgtcattctacacataaacacaacatgcaaaggatatttccaagtttagcgagattctgatggtacgatatggttgacagcagtattcttacttcaattgccatgaacaaaaggattgctaattaaatttgtgaaactagtaataaatcagttggtttgtaacttttatggataatgaatgaaaagaaacaaggcccttgtttagttcaatctggacacacatgatggctaaaatcgtacaaaattaataacatgtagtataatgccaaaacagcagatcaacataatatggagagatttttcacttactccagtgcacgggcagagcctagtgcgatcttgacacgagagttccagctaagtggcttgctgtattcgtctgaaagatggagtagatcatggagtgacccattcctgtggaaatcgtaaacaagcaagtgttgcccatgttccatgcaatagcccacaagctcattgagattcggatgatgcagttttgaaatgtctgagaccagttcagcaaaatcatcagatgaatggaatggcatcacggtactatcaagtttcttcacggccagaacctgaatagtgtaaacaagaaaagtaagctctcagaattttgcctatatctaaatgtccaacctgtatcaccctcgaaataacttcaaaagcaaaaaggggaaatacggtaacataaaaactgaaactaacattaagaactatacggcctccaatttatgaggaatacttctatgctcaattgtttctgttcatgaggtcatgacagattttaaggcttttttttcttagctttgcatttccaccttttgactaatgtgataatgaatacacatgctacctttcatttactttgagaaatatacaggaatagcaatagaaaaaattgtagcatacctttccaccagtaaactgtgccctgtatacacgtccaaaagtaccttccccaacaaggttgtccatgctaaagctttctgttgccatctgtagatctgcaactgaataaacagttgcctttataggtgccacattggttttcttcaagacaggcttgtttgataaatcatcatcatcgaaagacttgtggcgttcaatcttggggggtggcttcagactaaatgaagcaggggatggcaaagactctacatctattgtagtagactcttcaataggcttcatgtctgcacattttcagaagcaaattttcagataattgtacaaaatatataacaaaactaaagtatgatgatcagcaaggcatcaggcaaacagacctttaacttcgtttgaagggaacgaagtgaatggctggtgctgttcaaaatgttcttccaatgccgctctgcgttttcttcttcttatcacaaagaatgcaacgactgctccaactaccagcaatgatatgataatgcctgctacacctccaccacctatcccagagcttccaccagaacttgaaccaccattgttttgacctgggctgtttggacggtttggtggaggtggagctgaatacggtggaggtggtggtgctggtccattactccaagaatttccgtcagttctgtacacagggatcttattagttcagggtacatctctcatacatttttacatgtttataagcaaagagaactcactgtagattgtttatcttcttaagttgactaggaatccagccagtgaaatgattgtttgcaacattcctataggaaagcaaagatatgagatgtggtactgcacgtgcaaataaaatattaattacttataggttgatttcttacagatcatcaagggggagattagcaaggacattgatataaccagtaaattgattgttctgcagatatctgagaagaacgagtatgggattacaggcatgtcactccaaaaagacatatctatgagagaaaaacaatcattttcttacaatttcttcaggcttgacaatgatgtgaacccttgtggtaggtcaccagcaagagaattaaaggaaagatccctgcatcacatcacatagggaaatggaaagtgaatatagacattaggaatatgaacaacaaagaaggattttacaatacacaagttaagacccgtctacaatccacgcacacaaaagtactcacagtgttgtcaagctatagaggctggaaaatacatcagttatatttccttgcaattggttatgatttagatttctgcacatacaaagagaaaacatttagctctaccaaattatacaaatttaaaagcaaaatcaacttgatgtttgcaaagatactcacaaatacttaagattagacatcgagaaaatcgagtagggtaaatttccagtgaactggtttcctgcgagattgctgcaaacaataaccacttagcacacagacaccagaaaagctgatgtactttctaaaccacaacttcatttgaggaacttacagcctctcaagcttattagtgggaagattgtactgtatctgttggccaccaccaaggttgttttggctcatatcgctgcattaaaaaatcaattaagactgttatcaactgaattgtcacttgacaggatcagatatgaataatctcagatactcacatctcaatcaatgaacccatggtattcatattgtacgccaaattaccggagagccccaagcttggtaatttgctacaacatcaaacacaaagaaaatattgtaagaagtaagaaagaaggtggtcgagtaagtagtaaactactttgcttcatgatgaggctcacattgcagtaactgatgatcctgagcacgtgataccctgccatgattggccacaagggtctccaccacttgcctgccaacctttgagctgccccggagaattcaggctagtgaagagcgtattgaggacagtaactgcatgaaaaagagcaaataattactacacgtttttcgccgggcctaattgcaacactgtataatgcatgtcagtatgtcaccaaacaaacacattagcaaacttgaaatttgaagtgcccatagacaccaatgcatggattcagatttacaagagtaaatagcatgacatcttaagaggaaaatcgcaaaaaagaaaagaaagaaaaaaaaaagaaagctgaaatgctcatagcaatttttgaccaattcttgccatgctccaacgaacaataaggcaaaaaagaagagaaaaggagggtcaaatctagaggtaggtgtaaggaaaacgactgcattttcttcttggaactgctaaactaaaatttgttctcaaaaattgcccctcgcaatccagacaatgttttgcacgaaattcctcctcaattgagattcagcaagcaaaagtgcaaccataactgagatagctaggtacatagcataggccaaatttggttagtagaaacagcagaaaaagaatggacatgcaagatttccaaccgaatccagtgtatttccttactcggattagcacaacttaactaccccaggggcagaaagaccccatttttatcaacccaaaaatgagaattataagctgccgaaattcacacaccatcttgttcactatgtcgaacagacgtaaatcaagagcattcttgcgcaaagaccagatttcgcaagtaaaaaatgaagaaagattcggttaatcggaagctttcacatccatttccccgttccaaaaccgaatctacagaaaactccgtacaaacagcgccagaatcagcaaaccagccggacgaaccgcaacagaaaacacaaacacagacatcgagcgaagaactccaccgattaatccagcagctctgaaacaaaaacagaaaagaaaaaaagaaagaacaatcgcgcaaaaaggggagaagattccagattctagcttaccatcattagggtcggtgtctgcagcgaccaagatttgcttctggggccaaatgcagaagcagcaggaggagcacaggagcagaagcggcagccatggcgcatccgctcttcccatcttcttcttctccccccacaccaatgctcacacgctctccccactaaaaacgcaaagaaaggcgctttcctcgcatgaaagatcccttctatagcctcctccccactgatttctttcttccaattaatttacttatcttatctcctcctgtatctgctgctgctttcagagtttcaaccttcctccgtgttcttgaatcgcgcagtgggaagtagcggagcagcagctggcaccaggacggggacaagaacgatgaggtcaaatcaattgcaaggttgtcgctttcatcgaggggctttcttgtgaattcagcagccgcgaagggctcacattcaataggagaacatcagattcggagacgaattctttttcttcaaagagaaaaggtaaaaggaaagagctgattttttaaggaaaagctgacacattcgacgtttttattaggatgcatctacaacattttcacgaacaagaaaacaaatccgttgctctacttagctgtactcctatcattcttgggaggttggaataaaaaaaaattgcagcaaaaccgcgcacagattctgctgtcagcgccgggccgatgggcggtgggttggccttggcctgaactcagaaccgcagaatttgggttggaatgcgtgacacatcttttgcatctggtactcgtactataaacctccaccatcagctgatgcaaaagaaattcttgcgtcagggttactgctgctgtacaattttggactccattaatcatctcagagtactactagtacttacggtacgtcgcatgcatgcagagctgtactagcagtctacagtagcacttgattgtcaaattcactaattgtacttagtgctaatgggcaatgctacttagggggtgtttggatcaggggctaaactttagtatctgtcatatcggatgtttgaacattaatttggagtgttaagcataacaaaactaattatataaatgagagctaattcgcgtgataaaaattttaagcctaattgatccataattagcactaatcatgaattaattatgctcaaagttttgttaatagtctatatttaatacttctaattagtatcaaacatccgatgtgatataaacataaattagtccgtgatctgaacaaggccttgtattattttctaagtagaaaatgaagaagaaaggcatcaattatgcagggtggagtcgccgtcgtggcaaacatgggttcggagtaatctgcatgtctgcataattgcatttttctggcaccgcgtgtcatggcgacaagctggatggatcctactcccaataatggagttctttttaaaaaaaacaaaaacaaaaggagaagaacaaaaataaatcttggaggtcaaacattgtacactactcaagggcggatccaacccctacacccacaagacccatagatacccccgaaacaccttttttgatttttttatcatgaatggtaaactaaaaagtccctaaatggctgaagattaaagaaagttacatgtaactaagtctcctcaaattttttgttacttggatctgcccctgttcactgctgtatatttatatgtatgtatgacatgattgtatttcaacagcgaaattcacaaaaatgtgatcagctggtagtggatcgggactccttacgcgcatcgtgagtggcatgatcttcatgtcatggcaatttaattactagcattttgttatttgcttggtgggaatttgtgacctgatggcccatcgaaaatctctcagaattttatgccttttatcagaagcaaaatctccaccagccgattaaccctgctgaacaaagtttcccttttatccaaaaaaacaaacttaggggctgcttagttcctccaaaaacttttcccaaaaacatcacattgtatctttggacacatgtacgtagcattaaatataagtaaaaagaaaaactaatcttttaagcctaattagtccataattagccataaagtgctacagtaacccccgatgtgctaatgatggattaattagggtcaaaagattcatctcgcggtttccagtcaagttatgaaattagttttttcattcgtgtccgaaaaccccatccaacatccgatcaaacgtacgatatgacaccaaaaattttcatttcaccaactaaacaagcccttagaattgaatatgatatatcctagtacaacgaatttgaatgataaggatgtgtttagttcacgctaaaattggaagtttgatcggaagtggaatgatgtgatgg

SEQ ID NO: 78764 - DNA, 10935 bp, Oryza sativa
  unsure (1)..(10935): unsure at all n locations
tcatgatagtgtgataaaagacgatacgttttgaccagaaaagcccatgccgttgttggacgaaaatcggattcggtgtaaaattaagagaccccagatgaacttattccaaaatccaatgcacgccgttgttgggcctttggggtttatgggccttaaataactagatcaagcaacaattgcttacacatgtaatggaagaagaaaaaaacgtatgcagagaataatcagaatattgtgctacatataaagaataacaagtatggggatcctgcagcatagatctatataatttaatgtttcctttttgaagtgtttaacttggttctgaataaatgacttgttgtttgcccttgtatatttagccatctttctgagttttctctcacttgtactgactgttcctaaacttgttgattgggtcacaagatagctattgctaattaaggttacattcagacctacctctcgtcccaaaaagaaactaatcctaaccataaaactgaatatatgtgtgtccagattcgtagctaggatttgcttttttgagaaaagtacgaattaccccctgaactattaggtgagtatgaataacacccctaaacttgaagaccagacatcgctcacctcgaacttttaaaaccgaacaagaaaccccccctgaacactgttgcgagcggtttagagttttaatattacacgtggcagtccagtcagcaatactttttttaaaatagtgtgcccatttgtcagattccccacccatcttttctctctcttctccgtctccttcagaaacgcgcggccgccccgctgtcccgcacgcgggagagagggcgaagcggcggggtgcctgccgaggccggcgtcatggagacggaggcgagggcggtgcaaccggagacacggtcgacggcgaaggtgcagcggcggaggcggccatggcttgtgtcagcaccgtgacagcgacgcatcgccagctaaccaccgtgccgtcggtggggcgacgggcgttggctgccggaagtccatggggcggagagctataaaaaaaagaaaaagaaaaacttcttccttcttggtggcgtccaagctctgggccaccgtgcatggcggaggagctcaagtgctcaactgtgaatcgatttgaagcaacaaacgttccgaattccatggacacatcagatcgagatcgattattatctccacctcaaaaaactgagtaatgattttatcgaactcgggcgaccgtggtacatggcgttgtgcgtggtggtggcctgcgccttggtcctctcgttcgccgtctttgtctgcggccacagctccggcgtcgttctcccccggagaggttgtggtggtggcggtggccgcaaaagctatggtggtggggctctctatctccgccgccccaccttcgccgtcgaccgcgcggcactcgcctccggctccatgccactggccgcgccccgccacgtcaaccctctcccgcgccgccgtatttctccgcatgcacatcgcgctactcctccagagcgggccggccgccgccgccgcactcttcagaacnnnncgaggagagaaatagaggtggggattctgacaagtgggcccgctattgtttttagaaaaaaattgctgactggactgccacgtgtgctattcgaactctaaactgctcgcaacagtgctcgtggggtttcttgtccggtattaaaagttcggggtgagtgatgtctagttttcgagtttaggggtgttatcacactgatcacccaaaaggtaggggggtaatttgtacttttctcttgctttttttatgggacggagtagtatttgctactaccggtcttctgttcctaaccatgtacgtgcagttaattaaacactcaatcgtcttttggatcgtcgaaagtccttgcctgacacccccagtctaagaacacacacacctatagcatgccagtgagcataaatgtagaaatttacaatggtaacacatgtctaggattattgtctatatattaattgatcgatccaatcaagttaaacattcatttattatgcaagtttgaacattcattcatatcaaggtacatgtgtgctgcgtagtacacgatcaatcttaaccattaaaatataaactcactataatcaaacagttaagtttttttttctttttcttcaattactgtgagaatttctagcctccacagcaaatatggtgcttcctttcaaacttatcttattataatataatagatagataattaatgtaaagtaaatcaaataattattgttgactagaatgtgatgatgcatacataaaggttatgacctatcaacttgaattgacaaattacaagtccatgcatcatcatatcttacaatcttcctctactccatggtcgtgcatgggacgagttgatcttatctaggactaaatatatagtgttacatgtcacaaacgtgcctcccatgaatacaccataccaaaatgagtgtaaataacattcgtaggtattgtagcgatccaaaaagcggaagcaacaaagatatccaatctcccaaataactcttgctaatggatcggcatcctgatcccctaatcgagtcatatccttgcatgaaagttatgtacctgaaagcacataggatttaggataaataacacagcagttaattacataagaaaaaaatggcactaaagatgtcatccaaaacacaacaagcccaggccaagacaaagtagtcaagccactcaatagtttttcaagttaacttgcaacagcgatctggatatgtataaacaaattaaacttttttttccaaaaaaaaagatttaaacgaaaactaggaacgataaataattaaccagcctatgaattagtggcaaggtaacaaaattaacaaaagaaggtaacaaacactcccaaaggtgtaatggaattaatttcgcggatacctgatccacctaacacaatagtaaccgatatagcctacctaaaaaaatgaagtggcttatattagtaaaaaaaatctttttttgatcattagtaaaaaaaattctcgatgacataaattgcaacataaaatttacaaaattataaaaattccttccccctaacattttttaatctcgttagaaagaaatcaagcgacaaggagctgcaccaactgttgtgagagggaagtagaatagaagaacataaatgtaggactcggtgatggtacttgtcgctggtgaccgtgcacgaccaattgggggagagaaggttgtagcggggaacatgatggaagctctggaggaggatagggcaaggaagaggcacactttgggatgatctgcattatacagcagcggtgttggttggctggttgcccgatgaggaggaggggagaggtgtaaggatcgaacatggacaagaacaagtctaccagaggaagctaggatggtgaacggtagcaaaaaccaaacaaccaaatcttttagcagaaataaaaagaacaccaaaacttaatggactaacctgttgatcacagtgtgatcgtccttctcctgctgatccgtctgcttacaaaataaggaaacataatttgactaaagttttgaaagtgcccacaaaaaaccctctctcatctattaaactcaagtcgttaccctagataaaccctagcttttctctattcctgtagttacttgctcttgggttgagcccttgtctatttataccgaacatctcttgccgtacggatccctgtttcgtcgcgcgcgccgatctcctgtcgactacgtacacgctccggccttttgtcagctgggcttgcagccatgggccgcctccagctgctgttgccttgcttccgataaaataagttcatttaaggtcccttctctgttgctgagtttgacattcttatggatcaagaaattgggtcttgaggagaaccgtttctacaagggacccacatcaacggccgataaaagctggcaagccgcaagtctagcctttcctcgtcgtcttcccgtctccttgcccgaaatcccaaaatcccccaaccgcccacctcgccatccacgactatcaccatggatgtgtctccggcgccgccatgggcggagctcccggacgccgtcctgctcggcatcgtccgccgcatcccatgcgcgttcgaccgcgcccacgtgggagaaatctgccgctcatggcgcaggacgctgctacagatcccgccaccgcggccgctcccggggatcctcctcctgacaccccacgggcctaccctgtccttcgtcgtcgccggcgacgcctggtgcacccaccccgccttcgtccccgaggccttccgccgcgcgcgctacttcggctcgtacgacgactcgtggctcttcctcgccgttggccaagacaacggccacgcgctcttcaacctcaccgactcccaggaggaggaactgcccaactggggcaccttccaactccacgaccgcgagcttggggccgagattctcctcgtcgccgccaccctctcgtcgagtccaaatgtacacggatccgtcgccggcggcatcctcacggctgaccttccgcccgccaactccatggagcacatcgcgttctggcgcacgggttctgatgtgatgtcaaaggccatcagggcaagcggggttgggccattggaggacgtcacataccacgacgaggccttccatttcctcaccctggacgacatcattgtcgtgtgcagagcgtcgatggcagagccagggtcaccaggcaagatcgtggtcgtggatgaggtgcatgtgagtatcgagctgggcaacatcgcgccacgcgatgaactcggttatcgcgacctgcgcatcgtagccagctacctcgtggagtcccgcaatgacctgctcatggtcgagaagctagctcccaacttgctgtcgccggcatcggcgttccgggtgttccagatgatcaaggagaggttacacgacggccaggttcgttactcatgggaggagctgacgaccaagctggatggccggatgctgttcgtcggacaaggttgctccagatcatatgaggcggctaactaccccggtttggacgcaggcgtctacttcttggatgatcggagcacccgccacgaccccaagattccatttcaagaagcccgcgcacggcggtatctctgcagcgacaacgggaaatggtcaggaacacctccccagatcaagctctgcgttccggatccaggcccatcgaaccactctcctcccgtttggtttttcccttgagacgacagatttctgacaccttgttactctgtcatgcttcatctgcactgagttttctgtttctgcttgctgagttcgttggctctcctcatgttgatagttgcctgattagtctcatgtagttgtatgtgttttgtttctgctggagtagaactcctacagtgcacaaatcggcaaatcacttgcagcagatcagtgtgtagttcagttcctgtactttacatcccttccaccattctggaaccttttctgatgataaccatgagcccgtacatctttgcattttcattgataactgatgtctttttttgaacggaactgataactgatctctgaacatctgcagttgtgcatgtttgtgctcgtttttggggtggatggagttttacttagcttttcttgaaattgcaatgaatctgacttagttttctgttgcactcattctgtatgctttagctttctaaaatttatttagtctcatgagagctctctgataagtaactttttttttatagactctgataagtaactgaagaaagtgagaacattgatgttctagctgaatttcagtctgatcaatggccattgtaaactactctgatcttaattactttctccccttattgtttcttggcttggtttggccgttgtaaatgactccgaccttaattactttctcccctttcttttggtttatccactgtgaattactctgatcttaatagtaattgtacaaagatacacaaagtgtattcccggaaaagtatcagactcatcaatggccgaatgatgacttattttataatcccttttccatacattgctagtagaattttaatgtcaagcttggtcatgtgttcagagctttgtgcacatctcacctgagtgtgtataggctcaaattattttatgtttggtgcctgcagattattctgattctttcagtgttgtggagttggtagcactaatagtccttttctagcagagaaaacttgaaactaaaagatgtctggttcagtaatcgttcttacaactttctggttctattgttcttgatgaaattgtatgcagaaataactgggctggcgttacatgatctttgtgttgaaatggataattcagtgtgagaatgtgatgttaattacgtaaaaaaaaaaggaatgtgatgttaatagtgtttagacattcctgatagttgagggtttcacttgtgaaccgggtttacatgcacggattgtgaagtgtgattacgttataagctttctaaatgataaggcattgctgcatggaatattgttctatttattatattattaaaacagttttgaaagtagacatcacatttattctggatgctaaaaattatcacattaatcgaagaaaaaattcaagtaaaaatacaatttaaaaataactgaaattcaaatggtctccctacaccgccacatgagctaagcggggacaacgatcgacggtagtggcgcgacgacggctccatggcctcgtccaatgggcaggatgaattggatcatcgtgacaccggcctcccttctcaacattgccatccttgttcgcacttcctccttccccaaaggcggctgacgtggagcataggagggtggtcgtgcaagggtggcgggggtcggagtggcctgactccatctccctcatctagtcaggtgtgtgtacaagctcaccccctccaacgagttcaatgtcacccaccttgccttttccacgtcgcgtgcaaccctcattctcaccgcctcctgttcaaccttcgtgctccttttctctggggatctcctcttgtcgcttccttggatctccatctccgaggaagtcacctatactcgccgtcgttttgcttcaagtaactgtgccctccttgcctttagcgaaaagaagggtgtcatccacgtgttctgtgtcgacaagtagccatcattggacttgcccacatgctcaacgcccactccatcgagacacgggttgtccagtacccctatcgttggcggtgacaaggtccacctcttttccgctggcaatgtgcgctcctcctctattaggatgtgtccttcgagatggttgtgttcaatgtccccgcctctcaccgtgactacatccgcgccggcatggtgtcccttgccaaccacaacaacttcgtcgcaggatcctacgaccacaacatcaaattgtgggatgcccgcattgggaaaaccttgatgttgtcttctctcgtggcaaattggtggagaatgtgttgtttcggcagttcaacaggatgctagcaatcgttgggctcgtgcgaatcttggcccatcgtattgatacgagggagttaaattacaccacttttaataatttagaggtgaagatatccagtattacggttgagaggtaccttggatctttatatgagagagtcaaagtggacttactccaaaagattgtcaagatccacaagaaccagacaagagaccattgaggcccatatcggtagaaaggattttcaggcctacttctacgctcaactggatttgtttacggccatgagctactaccgaattcgacttcgctcacggcccgtcttgacggacaagatatctattcaaatttgaacgaaaggggcatgacacgtgttactgccagctcagcacggcaccgtcgttccggctataaatggccccacgcttcagcgtctcgtgcagaaagtccattactctcctccccgcatcagaacacagagagagagagagagagagagagagagagagagagagaggtaggagaagagtggaggagcgccgcgaggaggccatggcgggaggaggaggagagctccagtggatcgtgatccatggtgtccgcgatgcggtcctcagagccgccgcgatcatcggccctcgcctcgccgtcatcggcgacgttcgcgtcagcgacgcccctgcggtgctgactctgctggagaaggaggtcgtgcgccaggactgggagatcgagcgccgccaccgcctggacaggcttgccaggctcgaccacgagctcgccatcattctggaggccatcgtgccgatgctgatgcatactccgttccacatcgtcgccggccgggagctgcagcgctacgggtggtcgattcagcatctagcggcgtcgatcttcggccccgtccacgccctccacgccgccgtcggccccgtcggacgcttcctccgccgacatgctcgacatcagcaccacggcacgagggatgctgcttggctcgccggcaacatcctggaggtgcgcgatcgggtttcggccctgaggtccctggttgtgatgttcccggaggaggaccctgctgccgctgcagccgctgcgggcgacgacgaccacgacgacgacggtgcagagttcgtggaggacgatgctggttctgatgtcgagggaggaggaggagagctccagtggatcgtgatccacggtctccacgatgcggtcctcagagccgccgcgatcgtcggcccgcgcctcgtcatcatcggcgacgttcgcgtcagcgacgcccctgcggtgctggctctgctggacaaggagggggtgcgccagggctgggagatcgagcgccgccaccgcctggccaggcttgccaagctggaccacgagctcgccatcgttctggaggtcatcgtgccgatgctgatgcatacgccgttccacatcgtcgccggccgggagctgcagcgctacgggtcgtcgattcagcatctggcggcgtcgatcttcggcccagtccacgccctccacgccgccgtccgccccgtcggacgcttcctccgccgacatgctcggcatcagcaccacggcacgagggatgctgcttggctcgccggcaacatcctggaggtgcgcgatcgggtttcggccctgaggtccctggtggtgatgttcccggaggaggaccctgctgccgctgcagccgctgcgggcgacgacgaccacgacgacggtccagagttcgcagaggacgacgacgaggagtagagactagagaggatgacgacgagcattaagcaaaggttcttctaattacttctctccgatcaatttactgtcatctgcactgaccactgagttgtttttttgagtttgttggcgctcctcatgttgatagttgtctgattagtctctgtagttgtctgtgttttgtctctgccataagctgaagcacagctcgtttactgcagaaatctgtaaatcacttaccatcattgctttaaccattctggtaacccttcagatagttcatgagcctacttgatcttttttttttttttttggtattctgaactttctatgggcatctcgcttgcttaggaactaaaatgcaggttatttcgtcttagctgcctgcagattataatctttgtgttgctacgatgttaaatgaatctaggaatcctcctctctgaaatctgaagtaaaacttgtgattcaatccctgtatttggtactttctggtacccttttgttctctgtgaatctgaatgctgatggttgtgcatgatttgtgcgttgaagagttgaactgtataattcagtttctacgaactgaaaatgtggtccttaggccttagctaatacgcatccatgataaatgcaactactcattcactggagtatcccatgaactggatttacatgcatgggatgtgttctggcactgcgctcaaacgatcaagttactttgtcacccatgcttcatctgcgccttgtctgtttgtcagtttaacatcttttaacctgtgtggaatgcagattatttcatctttgattcctgcatattctagtctcagaagaaacaacttgaagtcttgaactaaaattgtatgagatgtttaagttcagacttcagaatgcataaatagttggactagcattactccactgttctattgaaatagattgatttaccatcaaattagaaatgaatcaaattaactgacttaacatggaatcattttctgcttatatagtttataagattgcttgtcaatcttgttttatatccctgaatttgcaaagaaacccaactgtgagcacagatagttgtacctttgatatatgcagatcgatttgcttctttatggattgctaatccctatctgaccactctattatcactaccaaataggtaccttttgatacctatttgagcacagaaaattgtatgtttgataaactatacattttatttctactgtaagctgaagcaggactcctttactgcataaaccacttgctgctaagaactttacttatcagcattgcctctctggggaaatttcatggttagtagctctcggtgtctcattggatgattgaagtgcggacatatgcatgtttgtgcttggactttcagttagcagtgctcatcattttcttgctaattggaattatattttaccatccagttgcaagagatctgaattagactggtgctgtaggtctttctgtacatattatattgcttgaatttgtttactgtatgcagggatgcctgagaaataactgaagaaaatgagaacattgaggtttcaaaattgaaatgcagaaccctgcatgcaggggcggatccacaatgggggcggagg

SEQ ID NO: 78765 - DNA, 6441 bp, Oryza sativa
cagctaagctagggcattggaaaaacactgctccgtgcatcataaaatagttcaaactttatcccaaataaagcaacccagtattataaaatgtgacttttaccactaaatcaaccatattaattatcccaagaagaggcaaccatgcattattcttttacctctctccctaatagccacttattatattttgggacagagggagtataaaataaccttacattattattatttttgaacatttgtttactaactaattaatcccaaagtccatacaaacaatatatgtttctaataggctttaataatccttaatttgtgagaacagtggtggactagatgacgataagataggtggctcgtaataaagagtaagaaaaaaagtaactatttcatcatagcacttaaccacctaaacttttttttttctcattttacacctcgaaccccctagcagtattttttattctctctatctaagtcaattttgctctggaaatttggtagaacatagatgcgttcacaatttaggtttcaacatttttttttaaaaaagaattatcactgtttacttaggttgaaagcacataaaacagattcaaacatcaaaattaagttcaagcaaaaatcggttgaaaaaaatttgaaaatacttttgaacttcgttaatggtgccatctatggcttctaacaaatttcagcttaaaatactgcttgtaaattttagcttaaaatacaacttgtatgacgggtaagaaaatgtatatgttattaagcactaaagtgaaacatttttaacggtttaggggtaaactaccaatctaacttcactttttcaagtttgcatttgatcctatttttcaaaattgacgttgttgtttggccgtgtttccattacacattaaggttttgtcttaaaaaaaagcatgcatttattagccaaaagtaccaaaatgcccatgagtacacaacaatcctatctctaactttcttctcatcccctttcatatcaggaggctggcgtagtggacgggcggggaacgagggagcgacgtcacctgcatgtggagggagaagagggcggcggcacacgtggagggagtaggggcgacgacgatgtgtgtgaagggagaagcagcaatgaactggtcaggagaaggagggagcgacgtcaccggcgcgcggagatagaaggggcggcgctcgtgcgaagggagcagcggtggtgacactgcgcacagagggagcaaattaaggtggtggcgtgcggaggaagcagatgcacatatcatacgtgtatatgtgtgtgtgagtgtattttatatatacgcatacttttgatgtataaaaaatgtaaacacgtatgcaaagtttgtatatttagagattcaaaaagtttatataagtatgtatataaaatttagacagatgggctgacctgatctcgcgggctgggctgaaaaaagaaaacccaagacggaaagtggacgcgcgcggtctggcgtcacttgggccgaaatggaaaacgcggggtggtggtcgcgcggctagctgcaaattagctatctcgcccaccacgaccagctctgcaatgtaaccccagctatcgtctgccctagagagagttgagaccacgctgcttagtaggttgactccgccgcctcgaccagcaacgctgccgccatttgcacacgctagctcgacctcttgctctgttgtcgtcgttctcgcttccgatggcggctgcaggcggcggatcgttgctggatcagtcgaggcacgccatgcgcagctgggtactcaagaatatgtgagtagtatttctctaataatccctcatccaattatgtgaattacttttgctgcttctgcagctttttttcccgctgttcttgtgatgaattttgttgttgcataattattggtttctttccagtttcttgattaattccttcgaattgttccatgctagctccacgccctatactagaagattctcctactacttagagcggagtatctgtttttgcgttgcctacaaatcgatcgatttgccttgattttgggttaattttcgttactttttcttgattgaggatttacatctactacttttgaaaggatttttatcactaaacggctaagattagatatattttgctcgccaggagggtagttaagagctatagccaacaagcttgtgctcgttgatttagagctgccagcaagagctaattgatcaaaagctcaagatcgagcgaggcttttgaaacttggaacgcaagatgtagatcacatacctcagctggtaacgtcacccaaaatgattaacgcgtcagcctcattgctgcaaacaaattaaaccagcagaaattaatcaagcttgtgctcgtggacggccggatcgcagtgaagcaggaacgcttcgatcggacggtgcatgttgcggcatagctagcaagctcgcgcgatcggtgggatgagaagaacgcgtagtaggttaccaaacactacggctttctagttttatacatataataatgattctctctcggctgcatcgtcttagtactagctattttcttctttcctctccttcctatgcataataaaaaaaaaactgttatgcctatgaatattactggcatgtgatcagtaggtgggggcttttcataaaagtttagcaaggacagagatttattataattaatgctatactactatgtgtgttaacataatcgtaaaatttgtgatgctatgtgtactgtagaacgcgcgctaaaagaatatgaaagctgaattagatatgtgggttgacttggaaaaagaaccagaatcggtgtttggcttggctcttggaaaaagccatgtcaaacattcatgcagctaaattgaactgctcttgactgaactgttaaagttgcatgatttatgttgcggtacaagggtgcgagagaggtttgattctcattgattgtaatgttcaatttatataaggggatacggtcggtaccgcaggggcgcaaacagtggctgagctaggaaattttcaaaccagggcaaactacttagctaaattgaactgctcttgattgattattaatgtttagctaggaaaaagctcggagtatctagtatttgctaaaatatttctaactttaatcctttcaaaataataaaaattcaatggtgtatttgatggcgagcctgggcggctgcccgtgcaagcctggtggtggccccgcttctgggtgcaaagtgcaatccatcgtgccagttgtcaagaagtgccgaaggagagaaggggcgtggccgcctcatttccttctctaccggttgtggtaatggggggcatggccaaccgcaatgcctattccatcggatggatgagatcatacatatatatttctcaacaatttcgttgtcaactactttaaattaaacaaaaataatgctttcctccgggtgtctaatgtggacacagaaatcaaattgctgtcacccatccatgcctttcccgttcagtatttcataagcaagtaaaattttcaacatggactcacgtgccttctttccgtttcatcttttggtgaatttctgtttttcagacttcggatttatcggcggatcagtacacatagccgcagtttaagatagatggtgatggtgaagttgtatgtgtatgactttacccattagagttcaaatctaatgtccatgaatactatgcaaatgcaggtcgacttttagcatggttatagtaagatcagaaatataccgctgatttccgtttatgtcttttaagcgtgtgttagaggcacattcgtctaagtgtgtagtgatgtagtttgcatgtgcattgttgtgtaataataaaataaaataaaattgaaatgagcagtttagaataagaggtagtttattgaaaaatcatatacttttaatcgcagaaaaacatatttttttagaagtgtcaaataaatactccatccgtcctaaaataactcaacctaggatagaaacctaggataggatgtccgtatccacgtacatccggacattcccatcccatccccttctcctctcatcttgtttctcaagctacaattaatggtggatcctagcgggcgcgctctctctctctgggtcatgaatcttctgatagaattcctaccattgcagcttttcttaggctatgatgcgttacaccggtgagttgtacatggctcacctccattccataatgtgcttttatgcaccagcgtaaaatattggttgctcattgggatatcgacatatcgtgcttcgtttaggctgtgttcgatgcaggagttcccaactctccctctcattttccgcgcatacgtttttcaaactactaaacggtgtgtgtttttttgaaaaagtttatatacgaaagttgcttaaaaaaatcatattgatccatttttgaaaaagagctaatacttaattaatcacgcgctaatagaacgctctgttttccgtgtgtgggttatgggttcccaacacccaccactgaacacaacctaaatgttccctactacataaaagcacgtacagaccggcactataggtgccgtggaagtgctaaaactggcacctatagatctttttcacctctgcaagctgaaaacacaaaaaaaaccgataccaatatatagttgctagataattaaagaaccgacacttataatatattataggtgcgtataaaaactgagcagagctaagctgttggtccttatcctcttgaggcagataaggggaggaggactcggtctctccccggtctcctctctctcccggtctctctctcgctctcctctctctggctctctctctatctatcgatctctctctttgtcgcttaaagtcaacaaatagttgcatcaaaagctttaattttgtctgctttgatgtatgatctcagtcctttacttccttctggattgcttcagtacttcctttgaaattggaaaattgcattgagcgtgtgtggtgatacattctgtgtgtaacaaaatcacgtgtttatgaggaatcatttaattacttgttcatcaggcaggtatagacatagtaggaacaggttctggaaacatataacatgacactaggtaggatctcattgtggcatcaattttttttgtcgacatttatctgaatttctgaaccctattctttttgttcaatcagagagaaattggcaggacattatggtgcagagttcaactctttgcgggcatttgaggacagggtattcaatgagaccagcagcattgatgattatatttctaaaatatcaacgaagatggctattttggagcgaccgcagtcttcttcaggtatgcagcatcaagggcagatgggaaatcaaacgaggctgcctactacagttatgcaagaacagccacagccacagcagcagccgcatttgatgtcaaataatcatcaccaaacacatggaggatggcagagcaatgttgcaagggtacagatgatcactggtgttggagaagtgaattggagggaggaaatgtttcagaagatcagcgttttaaagaactctttcttttccgagcttacggattttgaccgtttacttcacaattgccaaaaaacagaagaacagttgcagtcactacctaaaaagcaagctgaccaatacaagcggataacaaagctcaaggatgcggttaggagtgctctggatttattgcagctccagaagagcagcatcgatgaaggcatgaaggtgaaattctgcaagtacgaaagctccatacatagcctactcagattctacagggaaacaaaagctaaaattaatgagatgaatgcaaatcgtcataacaatcagcaagagcaacctgcaggcctgccgaggcaaagaattactgacagaactccatcgtcagctcgtcggcaaaaccgcaatgacaacgtgataggccaatcagaggataaattgcgatgcagggttgaatcagttgtagccaagaagaagcccatcgaccgcctaatcaacgctttgcggcacagtgtagaggatgaccgtacggacgtcaagaggcagaaaacacggcatgttaacagtgccctggcgaacgagatcgacgccatgaacgccaagctgatcgataccgtggttagaatcgccggtgagaaagatggtgggacagagattgaattcagctacactgcagtgtctcttgcactagacatgaagcagctatttgcagcatatgggacgtcttctgtcaagccggtgaaactattcgtccctgctgattacccctcgaaggtttctcgtgggcttcgaccaacaaccatgattgggaatgaacaccggcgaagaaatgttggccagaatctggggcttggcaacgcgggtttttactggcgccctggtgagccccc

SEQ ID NO: 78766 - DNA, 7671 bp, Oryza sativa
  unsure (1)..(7671): unsure at all n locations
ccccactaccgcccccgggacaatggagacccccctaagcccccactaattttttttccatagatttataggatatggggactggagtttcaatttatgctgatgtagtttattcagtccccactactatatttttctagatccgcccctgcctgcatggctgactgatgatttgttggctattattttattttccatgtattggtacaaccttctgtcatgcttggttatgcctttctggagtaaacatttaacctgtgtagaggcagattatttcatccttggttcctgcagtttgtagtctcagaagaaataacttgaagtatttttttgcgaacgcgcaagagtcttgaactaaaatgtgtgagatgttaagttcagacttcagaatacagaattggttggattagcaactagcattaccagtctactacggcactctctcacagtgtgagctacttttctattgaaatagacagatttacctttaaagcagaaatgaatcaaattacccgacttaacgtgaactcgtttttctgccaatatggttattaataaatttattaataatatgagcacaccacagataattgtttacacctttgaatttattaataactagccgggaccccgcgcgttgccgcgggcataacaaatacttcctccgttttataatgtaagactttttagcattgctcatattcatatagatgttaatgaatctatctatctatttatctatgtgtgtgtgtaaattcattagtatctatatgaatgtgggcaatgctacaaagtcttacattatggaacggagggagtatatatattcaaaaccgtgagaagatgagaaggttcccctgattcatattaagcttcaagctctcaaaatatctccatcaaactttataccgaataacatcattgaataccatcacaaagtttttggccatagttaatttaccaaacttttaaacgattacatcatttgcaaccataagctctgtagcacacatatgcctgttacgccatttacaaccacacgcaaccgtgttgaaggctctggtcaatccaccccaaaccattttgttatcaattggctagcggataaaccaaacaaagctattttgcgtacaaattggccttctgaaaactatccatagatgaggctgaaagtttcttaactaaaggccaccaccaaaatggaacatctgttacttccatatgcactcaattgtgatggattgacaactaattgtaaaatattaacataatcttgactatcttgtaagtgatatttacatgtatagttatggtatggagtagcccatagggtaacacgctgtttaactaagctgcctttttgttttaactttgaggaaaccaaactgacctaaaatggttagattgcggcaatttgtttctagaaacggttgaaatcaatctgcaagagtataggagaatgtgcatatgtagctgtagaaatcctctatttcaaaagtagctctataaatccaatagaatagttggtaaacaaaacgtattgtacgcttgcaactaaatgattatatgtaaattagaataatactatactctagagcctgacaaagggaactattaagattgcaggaatctaaatgatgagccaataacagtgttaaggatctttctgtaaagtcaacatatgcattatgaccaatcactggataaacagcaaggatgcacacatgacattcatcctttttcaaaattaataactgagctatcccaaagaaattaaacaattgctaaaataatttgaatataatttgtgctcataattacaaatggtgctaccgcggataaatgtgttcttttcttcagatagaagaacttggaagacttgcggtagtttactcccttgctgataaacatcagttactgaaagaaaatgcagaaatgttagaacaaatttaattattaccttgatggttattatgaattgaagcctcatggtgataaactgttcatatggcctcatttgcacataacagcagagtttgtactatgcaaaatgaagaaatgccatcaacttatgtgtattcactcaaatgaaggccctcatcatcccataaatgctacaaaagcatatgcaaagccatggaacctacaaaagcaaggtgttacacatgcagttcaacaaatatatcactcactgaagaccatgaacctgacagtccatacataggccttgtaatgtaagcaatcatggcatcatactacagcaagcggttgcgatcaagttgaattgtgtgccttctgtactaaacatcaagattatctatgaaatagtaaattatcttctagcttgaatcaacacttcattcttctcatttgtatcgccatgaagccaattaggaacactgaagcaggtagcaaaaaaaacaatcttatgtacaccaaagcagtaactaattattcctatgcatgcacaaatagaacatgtgcaatcggacaagtagcacaatgattttttataggtttacccttcatggtgcattgttttgtggcatcctgcactaaccataggtatatggtcacatcgtacaattacatagggaaaaaaatcaggccaatatctctttgtgcatgctattttgctgtgtgtaaaaaaatgaaaatatgtgctataaccacattgctgttaaacaaatggaatcccagcaatatatataaaactatcatgcatccctgaaacaatggggaatcatgtattatgaaagaaataggataaccttattgttgtttgcattttaggccgattgtacaggtagcaaacatatcagaagaaatatttatggattagtaggaatcatacctatatagagagcaaagcaaaggtaatctgagtagtaaaatacctactgcagaaaagaacagttatgcagatcaacaatacgaggaaaacaaaatgaacctaataagtattagtgcatacagagtggtagaggatggcagtaccaattggagaggtgtggaggagccgacaagcagcagtcacaggaagcgaggagatggccatggacgagatgtttggtggcagtgctgaccattggctccacgagaagacgacggcggatgttggctccacagggggtggcgcagaacagtggctccaagggaagggagcggcacagctggctcgacgatgacgaagcgacacggggtcgccggcaagtaaggcgagaagacgacaatgttggctggctggctcggcgacatggaggctgtagtgctcgctgcttgctccgcgagaagacggcggcgccggtcggcggcgaggatttttggggcggaggtggcgaggattttgggatggggattggggatttgggagtagcatgggtggggaaaggtggggaatggggaatgggagagagaatctttcggagccacaacgtgctgatggacggccggatggaatcaagatggcgagatcgcacggtgcatgcatacgctggtactgttaccctgtagcaaaggctagctgtgctgtggttcaccggaagtgggttacgaaaactaaggatttaatatgatatgacgtgagcactgaaatagacaggcttgtttacacctctgcctatatgtctatatatgatgctcgagccagccacaagaatgtcaattaagaatgtatagtaacaagcttactagatagacactgaaactaaagagataaatctgaagctaacttatccaaactaatcctgcgccatcttagttcctgtggtgtttgcctgttttttcttttcccggcgacggcgctgatactgaaggccccacatgatgagacacagcataattagcatgatatacgctgtaaaccttttgcatggcacctactgcagggctccagaacagttaacttaactgtagttgggactatcttttcaatgtacctcctaatagctgagagcgctctaggggcttccatgagaatatcctcctctatgtgattacaaaatggagaagtttttaggtaacacctacaatcaccatgaatggtgtccaatgtaagagactcgagtgacaccacgttcttcagaatataacaagttagctcaaccaagctctttgcagagcagaaaccagagatcttcacagtcttgaggctgtcatggcggttttcaggaatttgcctcaaacccgaggattttgcaaaaaccgattcatgctccatgcttcgctgctgcccctgaagatggaaaggagaacacgattgagataaatggacccagagtgaacagctatgttagcaggacagagttaatggacagtgccttacatcaagataaaagtttccaacgaaagagaagcgtcaaggaaagaaaccagagaaaaataatcataggacggggaaagtgtcgatactgctatcaaactaatgctcaggtgcttgaggtagaggaatttggtaggcagcactggtgtatttaccgcctgtataacaaatatgacacgtctaanatcatacacaggtatgactaatgtaatacgcatatatatgtaatactagtctataacacctaaagcttctggatatatatatacatacctcangtcctgaacgtatgttaagagtttcaagatttggcataatggaaagcaactcaacacgagcataatgcacaacattcgcacggcccatggcctacttcttcattttcagtgtttctccagtgagagctttgccccgactcctctacagaaaaaactggagagatttggagttttattctctaatattctcaggttagagcatccagaaacaaaaaaactggagagatttggagctttgttctctaatactttcaggctgcacatccaataacagtaaggttgctgagcttctgcagggagcaaggtatcttcaagcaaactatctccgtgcaactagaaatgcgcaactgctccaacgcaggagaattggaaagaagacactgcaattcttcccccctgatactcaccgaacgcagacgcaggcttgtaaggctttgcaaggggccgagttcagcagtgggacgaagggcacaccaatcgagtctgaggtacctaattgaattttgaatcccatcagataaaagtgagcatgggaaattgtactctctcttggttttacacaacacaagggtcagctcttcaatccctggcttaacaaccacctgaagccaactgtcaagatagcgactggcatcaaaccccacgacgccaaggtattcaagcctgaatattttcacgccaatgcctgagtggttcctcataatatggtcaactttgcggctgaaattccctccacaagcactcgcattcaagccaattgtatccttatttaaaatgagattgggatgacttctccaggactgtaaaaaggttctagacaaacaagcagcacgggcagcatcacgcattggcattagggaatgtatatgatgccagatgtcctgcgtacacaagcatgggatggaagatcaacattgcagtcgtaaatccaaatggttacttccattagagaacgaaaaacggtagaacatcatggcatgcagcgttacgtagaaagatggtgcagtgaaatgtaaacatggcatatagagaatttttgctaccagtgtcattagtgggttttccaaggagaagaaataaagttgctaatggctagcacgaattaactaccatgaaaaatacttttgacttggattaaaagaatacttttacttgctgtagcaaatctagccatttgttctggattaaggtagcaacatagcaaaaccaatactcttgtacgaaatgtgaagcaggtggaaagaaaaaatatttttccaatttttcttaatgctaataagtgcagcatagcactaaagcaccccagttatgccaatttatgaacatggtactaaatatgtaaagcatcgcacttaggtaaaattctgaagagatttgttagtaatactgccagcctttgcagagagaaaagtggtaactagaacgaagagaatctgctagttcagtacgagtgtaggactgtggccacattgcagtactaaaatactatatctgacttctgtttatataaacaatactgtaatattcaggtattcaagtatagtcccaagaattagccctatcagatcactcatggtaatatcatgcttggaatctaagcctgcatcatcagaatttcatacagcagtacctcaggaaggcatgggtatggggtagaacgtctcattgttttgacagctcgagaatcaccatgctgacaaggtgatccctttcttttacaccacctaatcagttcatctgcgacacaaaaaaaaagaggataaggatggctatggttgcaggttgctcatacatgaatgcagaaaaaaggaagaaacgaaggcccaatctcttgagttcagagtaagagtaaggtggcttactctgggctctgatttggcggcggcgccgcttctggttgcgtttcgcaggcatgtggaactagtaggtcgacgacgactcttcttcgtcagatctcaccgagaaatcacttccgtttcccctccttcagatcactatttctctcctatctactactatctgtttttgtacttgaattttgacctcaatttcggaaaattcgactaggcataaaaaggattgcgatggccctggtacgagcaagaggaacctggactctttttattcccttccttttcctatcaggacttcttgaattgctccaaattgcgccctcctatagaaaatcgttaagataatgggagtcctttttcctatcaggacttcttgaattgctccaaattgcgtcctcctatggaaaatcgttagagaatgggagtataaaatttagccatattgtaacatttgcgctgcaaacttgtcgtttagataagcagaacaatactatctctcgatataacaactcccgaaactaaaaatctcctgcaacggcaataaatctgcaagcccggttgagttgcagagaagaatgagtgaaatcggactcaccggactagagatgcagcttctggggaggcggatgacggcggcggcggcggcggcgggaggaggagattgaagagcagcgtgtgataaggacgcgtgatgtgaccggctgcggcgagaagtcagccaaactagagaccgggcgacgaacagcagcggcgtagggcacgtcggcgacgcgaacctggcggtggcggcggtggtgcagcgatggaaggaaaggaggggctagaaagagaaaaaaaaatatccaaaacattaagagtaaattacagttcatgccacgttttatattatcaaagttttattttgattacctttaaactattttttttattttagaccatgtaactttttttattatttatgtctaccctctgttccggtgaagatatgatatgtataaagacgggaaagtgtattgaaaccaatttattgattggtgctggaaaagttgtttgggtagtttaatccgaaaaaatggtaaagttacttggttcaaaataaaaggattagttgaaagatgactcaaaagtgaaaatttaactataaaggatagtccaaactgcaatttactaaaaaaaacttagtttacaagatctcaatggtgctttaactgacaaacta

SEQ ID NO: 78767 - DNA, 6292 bp, Oryza sativa
  unsure (1)..(6292): unsure at all n locations
gggagttgaactgaaccgcactganatcgtgtnnnnnnnnnnnnnnnnnnnnnnnnnnnnnnnnnnnnnnnnnncttgtaggacatgtatttctgaaaatggtaactatctatctttgaagagcccaacaaagcatttagagttttattggcaaacaataggttgagctcgcaggcttatgcaatggtggccaaacagttcaattcctaccatatatttccttctgaaacttttaccggaactgaactgttttagctgaaagcaacaacatgggacgtctgcaatgcagacaatcaactaatcaactaattaagcgaattttgcatgtgttcaaaataccggaaagattttgtgaggagtatgaacagatggtgagaaatttttggtagggacatgataaaggagaacggaaggtacactcgattggttgggaaaagttaatgagtcccaaactattccgaggacttggttttcgggacattagatgctttaaccaagccttactagcaacgcaggcatggagactgttcgataatccagataatttatgtgcttgggtgctaaaggtgaagtactatccaaatggatcactaattgacacggccttcccttcaagttcatcgccgacttggaagggcatcgagtatggactagagttgttgaagaaagacttgatatggatagttggagatgggcaccaaattaaaatctagaggagtcaatgggttgcacatagggaaaacccagtgattctgtagaagaaggcctggaatcgtctcacgtatgtacatgagctcatgttgccggaaaccaaaacgtggaatcagcctttaatcagacatgtgtcacgcccagaaattcactagtaatttccgaactaatttgtgcattaaatcctcgtccaggaatcagccaaggtacacaaactgacaatttaatatacagattcatcaaattaactaaaacgataaatacttacttaagaggcacttagttctcaccatgaagaaaactgcagcggaaaataaaatctagcgaagctccggctccactcccacaggcagctcaactggggtatgagccaaacgtcttctccttctgaatcctttttcttcaactgaggtttgatggttattgcaaggtgagcatatgacatactcagcaagccacacaacaaatatgcaagtgcacaaggataccaaagaatggtataatatagggcttatttgcaaaagcagcatttagcaaacttttgagaattgtaaaacagtagagcaattaatcatcaatattaatcaacactgtacaacacacccatgctgcacaggcccaaccatcctgaacaaccatacccggctgtacagatctatctccaaaccaggaatgtaccattccaaaccaggagctaatcaaattattatcagttatagcatcttttattatggtgagaagtgtgagactaatcacgaaagacattgttagacccgcccataactgcgggcacggctattcgaatagttttactctggccagaggtgtaccactgtacccacaagacacagccccacgacatgtcaccatgcgcctcaataccaccacggtacctcggaaaggagctgtgacagtacccctcgcacaacacaatccaccacagtgcaccgttcctggatcataatcacccccttataaacaaggtatggactccccagcgacccccgtgggcttatctccgccacttctcagtctagtgctccgcaatgaaccatgctatataaaaggtaaagccgttgcccatactggcttgtggttggcacggttaatgtttcacaaccgaaactcatgaaccggtccttaattgtcatgagcacgaccatcaaaaccatgtgctcacaacccaccattatcaagttttagttgacaatttaattaattaaccaatcacgattgaccatcgtgagcttccattaaatatccataagtgatagtgaagcatgatttatcccattaatgagctaatgtttctaagcacggctaagcaactataaataacatctagctgaaccaatccaatatataaggtccatgctagtcaaattataacccataggaaaataaagtcatctttggccataattaaatgggaaaggctcaccacccaatgacattcgaaaacaatgcataagttgaaataaatcaatagctttaaacaggttcaacatgctcaaagggttgtttgggggatctgtgtgacttgccttacaaacaagcgtcttcaattcgtcttcaggaacttctccaacgaacgaacgatcctccgaaacaacgggaagtctaaacctaaaacgcaaaacaaggaaaaacactaataaaaaccaaatgaacagtacaattaaagttcataagggtagagtttgaatttagatgaattatgagacttgaacgagctcattccgagttcgtatgaattagatatgaattttacaagatttaattccaattaaacctattaaagaaaagactattccaaattgattaaacaatttacaaatgatttatagctgagacagaagattaaaacatcctccggaaaaagattagatcatatttagtagatgacatatattaaaaaggaataatatgtcattgaaaagagatgacaaatttatattaattttggatggtcaagatggcgctgatgccagcgatgacatggctgccatgcaggatcgacgaccgcaagcacgggaacggcagttaccagcgaaccacggtacaaagatgcaaacgaagggcaccgggagagagaggagatcaaggcgacccttaccaccacttacgcgaccacagacggcgagggagatggcaggcgacgaggcggcgaccttgggttgacgatggcgacggctttccggcgacgagaggcagcaaccgaagggcggacggtcttcacctcggtcctgcgatcccgagggtggtgacggtgagtgaaggcggcgatggacggcgacgaacggcgcggctgaagatggaacagatcggcttcacggtgacgacgggcttcccggggtcttcgacgatggggaagtggaggccggtcttcttctcctcgcaaactcaacggcggcagcggcgaccgaaggcgacgaccacagcgacggcgcggggctgctggagcggcggccggaggtggagagagaaggcgagcgcggggagagcgattccggcgagattcggcgcaagggaacgggtggccggggtagctctcacccttgcgaagccgagggaggcgacggcgcaggtcggggtcgaccgaggaggcggcgcgacgcggctggagggtcaccggcgtcggcggcggctagggcaaggcggcggcggcgctacaagcgacggctcggcttgggacttgaggcaaacggaagaggaggccgaggggatgctatttatagccggaagagggagagatcggctcgggaacggatggaatcggcgacggattaggtagggttcgccggaaaaaggaaggatttgatccgcgaaattggaaagaatttccatataaacttttggggatttcttgggggaaatgaagaggagattgagaggattccattcccacaactaatttggaaataggagcaacggagaggacgaatttgatggggaggcggcgctgtacacgggcacggcagggaggatatcggccggctggaggttaggggcgacactgtagcagagggggacaaaacagacttatttccgggcttcatttcctcggcccgattgaaggaggaaggcaaatagaacttcgtcagagagaggaagagaagatgcaggctcgggttgggccggcggaagagagaggaaggaagggaatgggccggattcggcccgagacaaagaagtggattttgattgactttttaatttaaataattgctgaaatgatgtttcatttattaaaaatacttataatgctcaaataattccgggaaaaatccagaaaatatttggacactaaaaatatttaataaagttttatctatatcaatttaatgttcaaaattttcatatattttattcaaacacttactttaattattaaataaattctaaaaattcctttttttacaacaatttataatatagcgattttcagggtgtgacatagtccaggaaaatgatgcatccgaaattctgaagatcaaaatacctggaagggagatgtcggactttccagcatggcatcttgagaagacaggaattttcactgtcaggagcgcctataggttagcatggaatcaatcagggaaggctcgtgtggaatcttcatctagcacggcgacaaatggtgaaaggaagctttggaagaatatatggcaaacaaatgctcaaccaaaagtgagaatttttgcatggaagctagccaggacagattgcccacttggggaaataagggcctgtttaattcgcgaaaagaaaatttttgggtgtcacatcagacgtttgaccggatatcggaaggggttttcggacacgaataaaaaaactaatttcataactcgcgtggaaatcacaagacgaatcttttgagcctaattaattcgtcattagcacatgtgggttgctatagcacttatggcaaatcatgggctaattagactcaaaagattcgtctcgcgatttcccccctaactgtgcaattagttttttaaaaaatctatatttaatgcttcatgcatgtatccaaagattcgatgtgatgtttttgggaaaaactttttgggaaccaggattcttgtggttccggggaatccagctacaggagaaccaggaacggggagctctcccctgccctaagagaaagagaaagatagaacagagtggcatatgcccgatctgcgggatggctgaagagaacgggtttcatgtacggtggagtgcactctagctagaggtttacgggaggcaatgagaacacattggctattgccggttgaaacgagttttgcatatacagggccggactggctgttagtgctgctggatagttcgcagtgttcagaaaaggcacatgttatgtatttactctggagagtttggcacctgcgaaacaacatgatccatggcaaaggaagtgcatcaattgctgatttggtcagtttcttggttagctatgaaggccaactgttgccaatccgacaacaagaagatgaccacaaaggaaagggccctatatacatggaaccgaaccagatatctctctctacaagtatcagcaaactgactgacaaatggtgtcaccgccggagcgcttcgctaaactgaatggtgacgcaggttatagggaagaaaccggggatgctagtgtcgggtttatatttagagattgcaggggtttggtgctattggcggcccaaagaaccctgcatcaatgtggctcagctgtctaggcattggcgctagcatatatcttgagggactcagagcggcgactgacttgattcacatgcccattgtgttggagatggacaatgcataaattgttagggatttaataagaaaggaacagctgaaatcggcctgggcgacgacaattgaagatattaaaggagtgatgcaaagtgcaagtgcacaagataaagagagaagcaaatagggtagcacatgttttagcacaaatggctgtcttgagggactcagagcggcgactgacttgattcacatgcccattgtgttggagatggacaatgcagaaattgttagagatttaataagagaggaacagctgaaatcggcctgggcgacgacgattgaagagattaaaggagtgatgcaaagtgcaagacttgattcatatgcccattgtgttggagatggacaatgcagaaattgttagagatttagtaagacaggaacagctgaaatcggcctgggcgacgatgattgaagagattaaatgagtgatgcaaagtgcaagtacacaagataaagagagaagcaaatagggtagcacatgttttagcacaaatgacaatgagttgtaggtcctacgcggagtggaggttgtgtgctcccgcaagaattctagacttattaaatcaggagtgtaatcccttatttaagcattaataaagctctctttaccctcatttttttttgcatgtgctagaatcgatcgcagaatgaatacgaaaatgcgtgtgccatattccgttctactccagttgggttgaggccatggcttgcgtacatggtggatttgtgggcttctcgttctgtgccacaggaa

SEQ ID NO: 78768 - DNA, 3862 bp, Oryza sativa
  unsure (1)..(3862): unsure at all n locations
ccgcccctttgatatgctccgcgtcgatgctcctctgactcgaggagattggtaccccattcacattcatattccatcacagcacagtcaattcacaaaatcaagcccatattcattcacattcccaacccattcacatatatgtcattcacatccatttttgtctccaaaccgccgacatgcatcaaaacctgcaaaaataagttataaattggaacaattttatatgttactagaaatgcaagtatatacagagacgagctacctaggactttactctaaagaatataattgtattacaaagaatatttacaaaaatcaaatgtgtgtcgcatatgcattgcaaatgttctgccattctgagacgagctacctaggacttcactcttaaacatccctttcggtgacaagatatcatctagtatgaattgtgctatctcctctctaatgatttcgaagttgatttctggaatccttgaaataaattcctgcatgttcggcgccaagttagtctacatacttgtaaatttgtcgtcctatgtgtatataaacaattgaattacacaccttagggtcgagcaatgtcaccttgtctgcgaagctcctcatgttatggcagacatggaacccacactggttgctaacttgttgacatattgggaagtctttcttgtgaccgagtttgggatgcccatccttatgcctcccgcctcttgccacgtattggtcccatgcctcgttcaaggaagattcgatggccgaccaatcgtatatttctggcttgatattggagttaaggtagtgtaccaaactccacttcggcgttattaccagaagaatccaatgtcgcctgcgaaattattaaattgccagttacatactacagttgtacgcgttgagtatttgagtataagtacggtacacgcttactgttgattgtaggcgcacataatgaagtccttgtcttgacgggcaaataagcagtccttgatataggtcaccatgtttgctcgatcatttttcagcgttgtcacgttgacgacagctggatcgagtaaggcaatatggggtgctttacgatggacatgcttccaggttaacctacaagcaagacatgagtcagggtaagcgtaatttatggacagtcgctaccatatcgcgtaccaagaaatacttacaaggagtagcacttaaggaggttggtgtcgatcgctcgcaccctatagaggtcccatagatctttgaagtctacggcgatgaaggcagtaggcccgaggaacggctgaccatcgtgctggcccaacatggaggtctctctattcttcctccttgcattggacttctccctgtagtacctgtgcaactccttgcatgcagggcccatcttgaataaggcatcgtctccgaccaatggcatgcccaatgtgaattctgctggaggctttggaggagctactggtgccttgccaagatcaagcttctttggggctaatggcacctttatttttcctctccccgttccagcagcttttctgcgtgtgtcaagcttgggtggagaagatttcgccctcttgctccttttcgcagaaggggggaggtgcggcctgctgtcaacctccataccgtcgtcccaaaaatcagtatcatactgtaattggagatcttcatctctttgttcaacggcaggagggagagatacaacagtttgatggggatgcgtcggcggcggacgagaacttggcgctggccttggagttatattgatctcaatgttgtgcttgggccattgaataaaggtcccacgtgcagccccaagggtcagaatctcgtcattaggtgggtgtgggatagtgtagccaacccaatcgggcttcactaagtccacctgaactttggcattgccggcttgctgctgcgccccatgcactcgggtctccggggtaggcttgaaagcttgaccctttgcggcaggaattgcaaatcctggtgtcaccctaacgactagggtacacgatgtgggttcctgcgatagattcattagtgtccttagtatatgttgcaatgtattgtggtgctaatataatatatgcgttcctgcgatagattcattagtgtccttagtatatgttgcaatgtattgtggtgctaatataatatatgcgttattaagttgtttttaccgttatgtggtccaccgcggcggggccttcaggctgttctgtcggagcctcagttgatgcgcagctgctacgcctctgcgtggggctcacttgtactatgggaccgggagtggcatcggtcgacctatccctgatgcgtgccttcatccgagcctccatatctaacagctcggcagtgagctcttctctaagctcttctttaagctcctcccgaagttgggccttaatgcgtgcagctttctgtgccttggaaagcttgtgcttcttgtactgccacgcgtattggaaaaacccaaactttcatggaacattggagccaatgcccttagtttgtccacggtgttcttcatttcccaacgctttcgtgcggatgtcatcctcgcgtttttgtgagcatacctcttgggaggcctgtctctcagcattcagttcgacctggggtacagttaggacgcgttagacgaagaacaagatacaacataatgaaacttattctatgtgttcaatttacgattttctggtacaccgcttgatcttcgggatttggaaacgaaagagttccgtcactattcttcttcacccttgcccttgcccagttccttgcccgctggaccgggatatcagcaagcacttgcggggtgttagattccgctgcagcttcatcctcgttgtcccattctgcctgtttccccgtgtagcctccggtgccaagccggtgcgggtgaaggttccttgcctgcagatcacggtaggtctggcttttttctcgagactctttcgtttatttggcggcatggaactcatcccacacgggttgggtgatgaatgggtatttcccaaatggttctggctgggcggggttgaggacgtactccgtgtccagcgttgtcttgaaatttttccaacaattccccatcttgcggatagcctgccgcttcagtcctgcctcggcctctgtagggtatcagaagctttccttgaactacctccaggcctcttctttttcttcttgagggaccagatcgatgtggtccttcagaatagtgaagttccgcctccctaggactccgcatatcgtagggaactttttgacagctttcgtcggagccgtcggatatccaacatcgtccacctctgttatggtgtagacttccttagtaatcttattatgggtcctaggattctggctcgatgtagtcccagtagtggtcatcgacatccgtttagtatacaattgaaaaaaattctggactttctttatagttagtacccattaaaactaaaactcaatatgcaagcatgtcacatcatcacccactagcaatttatattcgagtccatttacaatcccatccatttactatgctagcccatttagaatcccatgcaaccatgccatatcttcactcactagcaattactattctagcctattttaaatcccatacaagcattacatatcatctccaatattatattataaagatccacaagtatgtgtcaaatcatctttctcgcatttttcttcacaacattacagctttcatcattctcgacaatatttatcatatactcatcagtgaatcccgcagctaagcgaggggtatccccgggttcaaaatcgataacctgaatcccacagctcctgggcgttggatatgggttttcatnntcatggacgc

SEQ ID NO: 78769 - DNA, 4799 bp, Oryza sativa
tattcagttaaggaaagagaaattagaagagaaaaataattttggaaatatgggattaccattgtacccttaagtaatatatgtgggggtgcatcagtacatgttcgatatcctccttcccccagatccattcccatcccgaagtccttggcgcggcggcgccagaagcaggcggtggagcagctcttcagcgcggccgggagcaggtggcggcgcagctcctcggcgtggccaggagcaagctgcggctccaactcctcggcgaggccggaaggcggcggtgatggctcctcaacacggcgtcgcgagcagcaggaggcggcaggagtacctggcagcgacggcgatcctcagcgctatggcaggagcagcaggcgatggcagcgactcctcggagcggcaaaccattggtgatgaatcctgctcttgacgggttcatcagatcgaaaggacttgaccaacatgaagatacctgatgtggctgatactatgcacttatgcagtaagacacaggatgttaatgaacttaccattcatagacatcattcatgttcatgcaatgtggcgccattagattttcatacggattttgaatcatttcacgaaagctcagtacaaaataagggtaaaaatacaagtgttgtttaaaaagtaggggcaaatatgcaatagctagcaagggcataaaagtcttttcgtgctcgacttaaccccgttaaattgaccatccaaaccaggggcaaatctctacttcgtttcaaaaaagtaggagtaaaaacgcaaaccctaaaaagcgagggcaaaatcacaattgaacttcaaaataggggtaagaatgcaatagccccttttttttactatagttgaatcaaattcaaagtaaactcaaacttgttcaacacgaagttcaaaattatttaaaattttacataccctgcacatctcgtaccccaaatttcacatcgatcaagcacgtcctcaagacggttgcaggtaagaccgtaagagtgcctagcagcggccatgctagatcatcaaatggccgttttgcatcaccaaacggctgtttgaaacgagaccaggagatcttcagatgcatagaaacaaatgcatatatttaggaatttaggaacagaggtagtagagacagacaaatgaacatcatgaatatgcatgaatgatgattgaataatgatggtgtcaccattacagagtaattacatcctgtgtcaaaaatcaggtggtgtaaaattagacaacactgcttatctacctgttagtggcaaactaaaaaaaggtaacagctgtctcctctcttgttatgtacatcaaaatacagcatcagctgatgcaggctataagagacggctaagctcaggtttggtgactactgtactatggcttgcataagttcgtcgtatttacgatcgagtaaccagtttgttgttcttcgctaacaacagcaatgtgatcaataatgcaccccgtctttctttctttcttgccatgataaatttggctccgattcccctgcagttgttgtatgatggatgcctatcagctttgccacttctacagctggacgccggcatcctttagagcagcagtcacagaagcagaggcttcctctagggttcttgtcttcttaactgtgttgaatgcctccacgacatcaccttcctcccattcgtcaaaatcatctaccccaatgccacactctagcccagcaccaacctagtggggaaaaatgtaaatgttgaacatcacattacggggactaatatcaaaataaagtgaatgtgaatataacaaattaataatgtgaaaactttttctttttgcagtgatactcaggaaacacattgtgatattgcgggtaaataactttctcacagagtgcagtgaaataaaaatagttgatggattcatggttatcgtacgtacctcctttacagtttctttcacccgtcttaacgaatcaagtgtacccatataaacttctttccctttacgaagaacccgaacattgcagtcatgaacaactttcccagtagtaatcatgcaacccgccaccttgccactgccactactaaaaacagcacgaactttggctgaaccaattggtacttcctcctgataaagaaagacaatgaggatggacatccaaatattccagcaacttgaaatgacaagtaaatactctaaagcacaccaaactatcatggaaatggagaaataaataatactccctctgtttcagattgtaagactttctagcattactcatattcatttagaagttaataagtctagacacatatatatgcctagattcattaacatctatatgaatgtgggcaacgcaaggaagtcttatattgtgaaacggaggaagtattttagaagaaggatttcccagcatgcaaaggaatgtggtccatgtggacctatcaacaagggcatgtcccaagactcaactggttcataaaagttgaaaagcaattttctgcttacctcagcaagttcaagaagtccttccatggcattccgcaaatcatcaatcaaatcatagatcaccttgtacagacgaatttccacacttttcttcttagcatagcttttaactgatcctggagctttgacattaaaaccaaatataatcccttctgaagcaacagccagatcaacatcactgacactcacatctcccggagcttgaagtaggaacctcaaggagacattttcttgaggcagcacttggattgcttgcctaatggcctcaactgaaccctatttgatcatatgcttggcatatttagcaaatagaaaaaatgaatagttcatattcgataatgcatatagtttgcaagagcagtggatacctgaaaatcaactttaaggatgatattaagctcgtgtgtatcaattcctacttgttttccagatgaaacagatgcagcaatggatgacagagtgactttcccttccccagctttcgaagatatcctttcaattctcagtgcttcagcacgtgcgtttgccctttcacgtgcaacatcaaggttgtccacagactcaaattcatcaccagcaaggggtacattattcaagccaataacctgtcataacatatcatttcttgataaattcaggatgcttacaataatactacaaacttttgaagaacatttaatgctcaatggtactaaagtaaaaggcagcaagctatggaagaaatgtttccttttcaatccatgaattgtgatagtatatgtgtagcatccagcttccaaaattggcattagcttaatccttctatacgagcaggcccatgtatgtattgcacagtacttatactctcatccttgcttcatgaaaaaagaattaatctagaggaacacatgaacttgtgatgctcccggcagcacaatgtcctacatggcaaatgaccagaatcactcttggtgcaatgctgtatgcctccataggctcataggcactcacactccagcttccagaatctacattagcctaacccttctgtagggacaggtccatgcacatatatgtcacgtgcttcactcggtgaatagctagaagaatagagacagtagttgtgattgacaggtatgtattattattattattatctctaaacctattttactaaattttactaaaatagcttatctgtaagcctcatgtgccttctgccaatgtgccccgtgcatttcctccagtcaccacaccttggcccttctacaagtgtggtcccacatggcagatagcactgtacttacacattcttgccaaattaaatgtgtaaacctgaaggttttgtggttagaacatgtgagcttatatgctgaccacaaactaatttctccattggagactaatcccaccatactgaataacatgggccacaaaggtctccaataatgggctgaggtgtaattactcatcataatatagtccctggaagaaagcaagagaagttgatagcaacaatcaagctcaggaataccagggtgattaaagaaaacccacttgtgttttttcttgtcttctcctgtctacaaaattcaaattttagaattttcagcttctgataaaagggtgcatttttacatcatgtaaaagagctcacatataaggatgccatttaggacttgagcaggtttatatttgctagctagtcaacagcgacctctatttatccatattcatcaatgtcatgtaactaacagttctaatgcacataaacatttatagtttcagatgctttctctttatgtcaaaattgcatcagacttgtgatgagtattttgtttagagtcgtcatggccagaggggccatctcatgaggagaaccaactgtaatttcagtaactttttcatccgaaatatggtatattaggaaatgttaggaaggatcatggtaaaaggaacgaggaaaataaaggaaagggaaaacctgcacggcattggatggcccagccttatcgataagctttccaccatcatcatacattgcacggatctgaaatgataacaatgctatgttatactccaaatgacccatgtttgttagtttgtgcttctttttttcatgcaagatatattacatattctggatcaaatcataacaagtaggaattgagcaaaccaacctttccaaaagcctcaccacacacaacaatatcacccttgtttagggttccattctgtacaactagggtggcaagagatctttagctttggcaaggcatgcttcaataactgtaccctttgcattt

SEQ ID NO: 78770 - DNA, 29058 bp, Oryza sativa
  unsure (1)..(29058): unsure at all n locations
gccgcaaccgcatcgacaccctcaggaagaagtacaggaaggagaaggagaggatgcgcctcgccgcccgccgccccgaccgccccgaccgcccctcgccttccaagtggatctacttcgacaagatgcagtctctcatgtgcccaccgccgctcccgttgcagccacccgtagtgacgcgccgccgagacacgcagccggtgccgcgccaatcttggggtctggacgccgcggagtacgtgctgggcgggtgtgagaacgcgggaacaagggattctgggtctggtgcggaattgggtgaagagcagccaaacgaggctggtgcagggaaaggggaagactttgagttgctcgtggagtcgattcggaagcttggggatgtctatgagagggtggagagtagcaagaggcagcacatggctgaggttgagtggttgcggagggatctccaaagggatcttgaggtgaggaggagggagattttggagaaggcgcaagcagagattgcgcgtctcactgaggaagatggggaggagggtgacctcaaggagggtgagggtgatgataacaagaggtttggggatgatggtggtggcgaagagtagagcaatgtcgccgtgaatgcttattcttagcctagggtctgtaagttcgggaaatcaggttggtttactcatacaggattatcactcatcttgaatacccatccaagatagtttgtgatcttgaatttagtgacaggcctgtttcattctagcatcacacttagatttgttgtgtttgatattttgcatgctttatgtggttatgttgaactagcatccaagctcttatagttgtatatgtcattagaatatcatgttaagaggaaaacttttctggtacagaatatctcttcaagaaggatgttcacttagtaaaatacactgctttgaaatttttgtggtagaaaatagggcaaataccctttgcaactaaaccataagcttcgtactggtattgttatggaaaagattgaggcaatgttttagcagtgaatttgaaatgttgctgaggctgagcaacgttttgcacagtagcaatttgactctgttacccaatcattaaacgggaagttgtgcaggcacataggatttatgtagtgtcagcactcttttggactgctctatttgatagctacttcagaaatgcagttgttaacatactctgtataccattcctggattaattttttgttgctcttgctgctcataaatccttatactgtaaactctgttggaaactatattaatttaagtttccagtcttccttggaagttgttgctttgtgagcgcattgcgggcacatatccatgaatgtatctttatcagtccctcttgacatcctgcttttatctaacattgttatgctgtcccttggttgcttttcaattgttattttttgaattctgatacctgcaagcatcgtacacatacttataaacctatgttttaatttcgtttgtggatgtggcttgacatgccagttgtgtccttgattttaatctccgggtcacaattgttctgctggcagtatgttaggaaaaacatcatgttaatattctttcagcaggtccttagggtgtttttgttgtatgcctcgacttgccttttcaattgtttgatactaccccttgaatttggtcttatttggatggttgctaaaatttgccatgccgatgtcctgttagagtttggtggcattccatacatctattgccatattggtggtaaaaagataactttgggaacatgatttgttggcttgttatctagtatctaagtttttcactggaatgcatgcttgcttaagcaagtcttgtaatataagcaccccatgtcttggacgttgagaataaactgtttaattttggtatttcagggctaaaacatggattttgtgttagtagttggatccacaaggattgctgtggtagtcgaacttacatctgtaactttagatattatatgattttcagatcccttgattttagattgatttgatcagcttacacgactacacccagtgcagattgtggtgtaggtctcctttgtatttcttgtaatcaaaatagtggttctcatttaattgttgtatctgtctctttgggattgatacaattagtccattactatgacaaatcagtatgtattgggttcattaagttttggacctataatcataggcaatttgtacttcttgcaaatgcacattgtacagctgcatttgtaaatctcgtgtcaacccagggttatgtttggcgcttcctgcggttgtaccattgacagggtatgttagtatttattgataggtatatctatctaggaatctcgccatattgctgacggtatcgtatacaaaagatggcaggagaaaaacaccaaacacatcactgaacgaactaaccaaatatccctatcaattacaggaacagaaacatcaaaaacattaattacaactaaaaatctcagcgttgcaactacgggctagattctctcttccatcaggcgtagaattctttcatcaggagcagtagaattgcttgccacagctagatgatactccggcccgtcggcggcggtacatcgcaataagccatgcccacaaggcgatcgccccggcattgaacacggcgatgacgcaggtgagggccatgacgacgcggttgtcgccggcggcaaccaacacgacgctttggacgacgccgagagcgaggccgacgccgacgaacccgacgctctggatggccctgtcgacgtgcgccggcgtgtgcggccgcaggtacaggctgacgtaggacctgacgcaggagaccgtggacaggtagacggcgaacgacaccagcagcggcagccgccacgggacgctgccgaagaaggaggaggcggcggcggcggcgccgtacgactccgcgaggtaggcgccnacnatnaagcacggcacgacgacggcgcacgcccacacctgggcacgggacacgcccgaccgcgcctccccgaccgtcaacggcgccgccgccgccatggtcgagacgatcaagctcacggaatgctcaacgtaatgtttgagttatgcagtttactacaagtctacgacgctcgccgcgtcctccaccgagtgtttttgtatttatggcaaataactgtaagtccgaatcggacaatgggtcctagattccaagttgccgaccgcgataagaatacgattacgaattgacgcgagttggcggcagccatggacggatacggcacgctctgtgctggggctacagcaagattctgggtttagacccatggaatcgggaaaaaggtcaattttagcatttaggtctctcaactataggttgagtctcattcagttattagtatcattttcaaagtacgcaacgtaggctactgcaagatcgagaagagtgcctagaatcaccatgtgaaaatacaattcttctgcaggagcacattagtacgctctcaagaaaaaaaaattgttgagagagtaagtgttctctaaataatgttctgccaaggcaatatggcttatcctaccaactaaagaacaggtgatcgccatctcttatcacttcaatgtcctctacctcggcacctcccacggtgagaatccctctcgctgccttcccaaacttcttttctgcaaaggggtatccattcacaacgatgataaatctgttgcttgatctgaacatctgacgatgttaatctttatgcagagcacaatttacatacctgaaagtttcatcagatcttgcatagaatctggcagtatgacgagcttcccagatgagccgttcagtgctgtgccagtcccatttaagaggtgttcatgaatagatacccgtttgggttctttgcatggcaacattttgtgagctgactctttggattcatctacatcaaacatggttgcacttcctaataccgtggagtagccattgcgaagatgatccctaacaaaggctgtttcctttgccttcaccttcagagattcaaggtactgaaaaacgttgtgagaaattgtgaactgagaaaaaaatatctatattgcattcttgaataaaatcaaataccagaacaaaattggagaatacaacgaccccatctgcagtgttaggccggatggtcgagaccatatggctgtggcttatacggacgagctgcgtgagctttctgctccggatggtgaacggctgtgggatgttgaacatcaccccaatttcccctgccattccccgtggccctattctcatcacttgctgaaatgtcacaattttgatcagaaccttttcaggtcagtatgcaaatgccggaaaaagttcagtatactgagaagagtaaggccgtgtttcgttctttggccaaattttttttaaatatacggatacacttgaagtattaaacgtagactaataataaaataaattacagattccgtctgtaaactgcaagatgaatttattaagtctaattaatctgttattatcaaatgtttactgtagcatcatattgtcaaatcatggcgcaattagactcaaaagattcgtctcgcaatttacatgtaaactgtgcaattggtttttttcgcccacatttaatgctccatgcatgtgtccaaacatttgatgtgactttttttaccaaaaaattttagaatctaaacacaccctaagcttgaaatggtataactgatatactaagtgcgtcaactgggttctcgtgtgctttaccttctctgtaccatcctcaagggttgtcaatacctcctgatacaaaataaaagattaagagaaatgcaggttgtcagagcatgaacagcgaagagaacaaacgtcacacgaggcatgttcttaccacttcaccagacacgatgatgtagcagtccgtcgaagcctcgttctccaggatgatatccgccttggggggaaatgactctgccttcatctccgcgacctgaatttaccacgttatttagtcagtcacccaaccggtaaacgcagagctattccgaccaaggcgtttgctactgcgtgttcaattaccagcggcaggacgagcttgtcggagacgccctggaacaggtagcagctctggaccgcccctctgaacatgtgctgcgcgatgcctgaccgcacggccttgggcagctcggacagcatctcctgctgcagctgctcctccgccctgaacctgagctgcaggctttccatcatctgctccctcatcgccaccggcagccggttcgttctcccgaacaccgacgtcctctgcaccatgtccctctgcacacaatgccatgatcaccaatccgtgtcaaaagaaaagaaaaccatgatcaggttttgccaatatttaccatcttgaaggtgttggtggtttcgtggacgacgaggttggtgatgttgccgatgatgtaggaggtgaggcccatgttgaagagcatgaaggcgatgctgaacaacatctcgcccgtgttggcggcgtgcaggtcgccgtagccgacggtggcgagcgtggtgatggaccagtacacggcgcaggtgtagcagaaccacacgctgcggtcctcgaagccgtggaactggctgccgatccacgtcagctccttcgccttgtggtggaacgccatccacaggtagatgcacgaggcgaagtgcactgcgaacagcgtcacctgcattgcaatcatgagcacacaagatttcgtagcaagttatttgtatgaactctgccgaaatatagtactccgggtggaacggcgtggccttacgtagaggagcttgataagcctggtccacaagtaactgaatctaatgtccttctccaacctgcaagattcagaatttcatatcggtcattgatgaatgatgatcacatatgcatactgtagttattcatatagcattacatgccacccattggtgaatcatgctaccaactcaaagtcacgtagtgtatctgcactactactgtactacagggatggaaattgaggcggccaagctttctagaaatttatttattgtatttttctgaattatttaagacaattttttgttaagagctagggaactgacaaatttttgaataattttagcttaaaaaaactgatcaatcggaggctcggagctacagcaattataaaccaagccacttaaacgagctcttttcccccacactcgcactgaagataaagacaaagaaagaaaagtctcttggtccactcacttacaaggttgatatcatgaaagaaggtactctccgttcttccaaagacataagaatttctaggttatttagcagatattaagattaagaaaatatatattgctcgtcattaaatgagagattgataggagtgcgagagtgggagggggtattaaaatagaaaggaatttgaatgacgtgaacgatggcacaattaggctatattctttaatctattgtcccaacttcatcttccttgtttttcacgcgcacgcttcccaaaatgttaaacgctgcatttttttaaaaaaaaattctatagaaaaattgttttaaaaaatcatattaattcattttcaagttttttgctcatacttaattaatcacgcactaaaccgtcgtttcgttttgtgtccaatggtggaagagttctcaactcgaattggcgaacacaacctttagttagtatatacaaatgcttataaatgcatatattatgtacaaaatttaaatccaagaaatgtttatatttgaaaatggtgggagtactatgataataaattaccttataagtcaggccagtagtgctaaggcctcctttggatttggagggtttctttttggatttgcaaaggatccaaatccttaggattctattcctatagtgtcctttcgattgaaagaatactacaactttgaaaatcctatagatttaatttcctatgcctcatttcaaaggaaaataagcactctcttcctttctctctctactctctctctctctctcactcaaataaatttcctctagaattcctatattttatttcatgtgaattattcgaaggcactagttctggtattcctgtgttttgaaatcctataggttttacaagagcatgatattcaaatcttatattttttcctattcctatgttttgagaatcctatatttcaaaggagctaattaaatcatgctgcgtacaaaaagccatacgtacttgatcacaactctacaagtctgcaatacacactcacacaaagtactgcacactcacgtactaatcattcgtgcgtatatgaagttatgaactcacacacaatctatttgaccgagatcgtccattggatgtggagtatttaccttgcaaagagcttgctgacgcgccgtaatcgccagagccggagaagattgagcaacccatacaatgcttgtcttttgccgctcactatccggtagatcatctgtaaaggaatcgttgaggcgacatccagcgccaagcatggtcgtgccaggtgcctaaaaatgcaagtccatcgataaatattgaactctctgacggagatactccctccatttcaggttttcaggttataaaatgttttaactttggttaaaatcaaactagtttaactaagtttatagacaaatatagtaatatatataatactaaattagtttcatcaaattaataattgaatatatttttataataaatttgtcttgggttaaaaatattcctactttttcctacaaatttaatcaacttaaagcagtttaactttgattaaagtaaaaacgtcttacaacctaaaatagagagagcagcaaaaaggaaaaaaaaatggacatgcagtgacggatcagcatcacgtatacctggtggcgatcttcttgcggtcggttacgaggaggccggtggaggcgtcgcggtacgccacgaagaaggagacggcaatgtcgacggcgaagaaggcgtcgaccaccagctccgtgacggcgagcgcggccgaggccgacttctccatggccagctcgaacggcgacgcccacgccgtgtacagcaccagcacgatcaggaacttctgccaccacctggagtggaccactcaaaccagaccgatcgatgtacaagagttcagttcagttcagttcgtgatcgatgtataatggatgcaggttgttcgatcacctgtagctgcaggtgtgagggttaacgacgaatggtcctagcgaaggagagggctcgccgaatgccggccggagaagctcgcttctggaggcggccatgccgatattcgtcaccggtagtatggatgcccctgcagtgctgctttgtcttgccattctgctggctatgcctatattatatactgactctgcgtgctctctcctttgttacctcgtcaagttggtgatctagcttttgacgtgggctcaaatctgcaggatacgaccaagcgaggaaagagttcaaaccaaaagttttgaaagggtgtgtgccacagtccactaatcaggaatccactagagttaggatcagggtttataatatagaaaatccgataaatggcatttacaagcgcctaatttcaaaaagtacgagttacattaaatatgtgtttaatgtataccattatacaagtaactttatctcagaaatatcatcgtcgttaatgttccgttagcaacccctgtcaagtgctataggataaacaatacatttaatggagcgggacataaccttaacgacgatgacatttctattacaaagtcacttaggcaatgacattttataaaactcacacttatcgatagtattttttataattggttgtttgtcaatagtatattttggattttctcttacagtatcgacataaccagtcatttatcacaataaccagtcatacaaggggcattgcatttagaaaccgctcaatagttcaaacaaggttttcttaattgtactaaaattttttggacaaaatggtttgagacttactagttttcaaaataaaatgatcggttattacttctataaaaaaaaccactaggttatgacaatcaacagcaaaatcattttaaaatcattttttcagataatgaaaaacaaaatcatagactagcggttagcggttatagatcggtgcctaaactcatatggaaaaccttggataggttccaacttcgcttctcagacaatgttatccgcgttgatttgagaagcatcagtgccttcttttgtaactttaataattggactaaaattttagcaatggtggagattatggtcaataaaacatagagataatattttcttttgagcaataattgggtcaagaactataggtatgatatagctagctattagtgagatatctagctagctcttcgttcttggtagtttccataaagggagagagaaagggtaaccttaggccctgtttagtttccaaaacaaaaattttcatgctgtcacatcgaatgttacgacacatgtatggagtattaaatgtaagaaaaaaaaaccaattacacatattgcatgtaaattgcgagacgaatcttttaagcctaattgcgtcatgatttgacaatatggtgctacagtaaacatttgctaataacggattaattaggcttagtaaattcatctcacagtttcctggcagaatctgtaatttattttgttattagactacgtttaatactttaaatgtgtgtccgtatatccgatgtgatagccaaacccaaaacttttcctaagtccttaatgtacacatatatatgctgatatgcagcacactgtagtaaatttcctggtgttgtagcgctaatcggcactgtaaaataataaataaatctggcaatcttttatagctaaaaccaaattataaacaaaataaataccgataattatgtaaacttttctttaaaaggcgaatgattaaacatgtgtcaaaaagttaatggtgttacttattaaaaactggtagtatgatattagaagaaaactcaacaccagttacgatgtataactgggtgccaattaatttttagtttcaaatttcttaaattggtaatataaaatgtattgcttctaaattttgaaattattatatcaagaaaaaactaaattaagattccaaaccgagtgcagctacgtattattaattctaaattcaaaaattcattaagacttcatgacaagtacaaccttgtatttattaatgaatgtatttaataattactaaattaagaagataaaaggcagcaaataattaagtattatagtgtattcaatactaatattgtaattaaactaaatcgttttgatcttgatgactctaaagcaagatatacacttatgcacagtatataaaataaatagttcatgcaaacacacaagttatctcaaggatttaccggcctagtctttgaaatagaatttgcgtgcgtgtgtttatagaggtaagtgcacgtgcattatgagtgcgttgtactgtataatataaaatatatatatgtagtagctcttacagttgacatcatacaaagtcatatattgatgttatattcaggtcgcgtactgatgatagtacgtgagggggcttaatcatgatagagacgaaaccaatggttaattataacttgccaaggatggtgtccctccaataaatggtctgttttcatacatatacgctctgcaacattgacgataccttcatgaacagaaactaagccaaattcagactttcgtatggcctatatgtatgtaccccccatggttggcaccaggacgtaccagctttgcacgggactgttcctgataatgtgtttactgtagtactctagcatcgtactaccaccatctcatattacttgtcgctttgagtttttaatatttaattatttatcttattaaaaataattagaattattatttattttgtttgtgacttgttttattattaaaagtattttaattatgacttatcttttcttatatttatactaatttttcaaattaaacgaatgatcaaatgttacaagcaaaaagttaaagcgacatctattatgggacataggtaatactatatactccctccaatcctatcttaagtatagtggattttcgtggtcaacgtttgactgtacgttttatttaaaaaattttaaaaaagtaagtcacacataaactactattcatgttttatcatctaataataataaaaatattagttataaaaaatttttaaattagatactccctatgtcccataatatagcaacctagtaccgaacgagacacttcatagtacaacgaatctggacatgaaatatgtcatgtttcgttgtactatgaagtatctcgttcaagtatctcgtttggtactagggtgctatattataggacggagggagtagatggttaaatattgaacacgtaaacttacaactggactcaattaaaaatgagacgggggagtatatagtacgagagctattaatgttcacttttctaatttcaggatttcagcacttactaaaagtatataggccggccgactagagaagtagactttgcggctctgcacccgtggtgaaccgaaatccacatgaggctaatccaacaaaacttttctgttagtgccatgagttcaactacagtatttgagtgaggccattagaacacgccacataaaaaactagtaagtaaacctaaaaacaaaatgccttgccgtcatgtatatatatcacgctcacgcacatacacgaagggaatcaaattttctagcaaatatgtaaaaacgaagaacaagattttgctgcatttgattaggtaggaaaaaggaacatgtacaggcggcgtagtagtgctgctacgtacctgcagggagctataggaagacgctatctgaacgcaggacagcatcgagagaggccatatgctcgcaagatgcagaagagatgctcgtcgtggtggtcgacgactcgacggccgatcgagctaaacatgcatgccacgagaacagctaggtaaatagaaaaacatgcggctatgaatctgtaaccacggaggcagttccgtatctgtaggcagtggatcttcctctcgcacggtccgtcaaggactttcactgggaaactctttccaattccttgcaggatcggataagaagcatgcctacatacatggttgcgttgtattccgtcgcgattcttttacttattaccgtcaggattaaagaccaggattggcgcccttgatttcattattataactctgtcacggcatgatgccgcgatttcattccccagatatatatcaattccatgctctgcgatcgtctcgttctttactttgcattggcgctagctcgatccgtcgctcccttccgttgattaatacacgcgcatcggcaatctggcatggcgtagatggcgcaaaccgggcggggcgcatcgcctgctgccttttgagcgctccttcgaagaaacggcaagtgcttggcatcgatcgatcgatcggttctcgcggcgaggggtgcggacgtgcggctgcctcttgcgtttggcataacacggacgaccgggtggtggttcactcatgcgtggggtacgtgctagcggagctgcgcgcgggtgtccgaggcgtttgacaccatacggccttcggttgtcccggccaagctgcgaacgcttgctgcagccgactggcgacgaccgcttggtgactggccggtgcgcagaggagcgcgtcgcagcgatgctgggtacgtaacttttgttgcaacttgcaagttggtttgtaagccatcgtgtgtgggcttcccaggatccaacatggtggagaggttcggaaccgtgaggcggcatacggcacgttgcgtacgttgcatagtgattcagcccattcaaccacccgcgtctaaatcccaatacgatatcgttcaggtccaattcacatattttcagcaggaaaaagtacatacgaggtccctcatctgtcaccgaactaccaaatcatctctcaatcgaaaaattagatatatggcatctctcaacttaaaaaaccggtcacttaagatccttagacggtattgacaacagttttatccaacgtaatggttgagttagcgtgggtcccacatgtcaggatgacccacatcaacaccctcttgatctctttctccttttctctctcttctcctctatctctcacttttctcattgtcgtctgagtaagtggaacagggtggtggaacaggcaggagaggaggtccagcggtcggtgacgagcaacgccatatctgagtaagtggaacggggtggttggatgcccgaaccacagtggattagatccagatggcacttatggtggagagggggcaacggtagagacggatcccctggagctacacaggcggctcgacaaagagctctaagagcatccgcaatggtaaagtaaggtgctacctataaaacatgtacatctcagcaatagactagattaatagtaaaccactttaatggtatgtctacttgggtatctataactctctaatccattgcctcgtttttctctatagactatctacaggttagtagatagctttgttctctctcttcatttaatctcttccaagtaagaaaatatgctaacatggatatcttgtagagagcctatagataaccattgtgggtgccctaacacataagagcttccccataaataaattgtggcctctactatgaaatccacgtcaccttccatgtgacctcgtaactttcagcagcacactccggcggcggcaaggcggagatgtgtggtagaaagtgccgacgacgctggaggcttatcaattgttaattaatggttagagtttttattatctcaattgttttagaatagtcttaacgtgtattttctaagagccaacactggacttagtttagctcaatggcacacaaatcagtactatgttgtaattttttcttttcccctttgcgggggagtacgttgggaagaactttatttgaacgaacttcacggttggcacataaacgaattactggacacataatgggtacaaaaattgcaatttagaaatttcttccgttagtaataaattatatggagcacaacacgtatcataattcgctcttatttcaacgtcttcgttgaacttcggcatgataaaattctacaacctttgggcaagattttaaagaacacatgcatgtacatgtacaaattaagaaaaataaagaagctaatattcagggaagagctgttcagttgcctccagccctccactcagcggaacaggcacatgacgaagatcgccgcgagtacgagcaagtgatcgatcccttggtcgatggccattcctgcaagaggtgcaaacaacacgcgccaattcaatcagagtgcaggcaactcacctaatgttagcccggaactggcagccgcgacgccgcgatgcgcaaatcttggtgcgcgtataaagtcacaagcactaaccgtccatggcgagcttcccggcgatggaggcaggcgaggcggcggcggcgccttggcacagcaacgggtgcagcagcgcggcggccaggaagttggcgagcacgagagcttgaggcctcatggcgtcccgctccgttggctcctgtgttgtcctgtggtcgatctcgtcaggctacgcttgcagaaaggctagcgtgactggagattcttggttgcgaacttgcagtgcagcgttccgatcggatttataaacgcagggagcaacgaacaaccggcgtcatttgacattcgtcacgtcttcgttgagtttagcttagcctttcgctgatctgacctgactttggtcgccagccacttctgactaatctgtcttcctctgtgtgtccgtctcgtcaactgccacgtgtagctctcctatccgccggattggcagcgacgtgaagatcgaacggttggaggaaaaaacgatgaatccgtcagttggggtaggccaccggccggatttgaatccatgggaaaaatttcagagaatgaatgctgtgtgccaatctcggccggcaggaaagcgggtgcaactgttcaagcgcacgccacacatgtgtgcgcctgtgatgcgttttggcgtcaggtatgccgtctaaaataattgcactggaacacacagttactgttcgcagtggtctatagctagcaatcctagcgtggatgtgctgctttctagctccatcatctctaaatcttttataagcacaagtgtggaagtacaatccactcgagcactcgacccggccggtttgttcggtcagcactgcctaattggcaattctcgtcggttttcaacaaacattttagctgacgtttgatcataccgaacatatcctaccccacaatggttccagcgggcaatccggcaagacggcaagttagcgatcacccgtagagaggagcgccagaacagaacggaacagaacccatagaccagtagtgctctgcaaaggtggaagcccacggtgtagtatttgccagcccaacccacgcaacccacacacgtgatgtggcccactgggcgctggcaatgttggggggtttcgggctacgtagattagattagatagacgacacgataaaagcaaagacgatagaattaataacgggaacaaagtcccgtcccccgagagagtttaattgcgaccccaacctagcgacgcaacagacatctgttgcaggggacggacatacgaacaatcaaacaaacctagctactcctactacccccagcggcaagtcgaagcaccggacgatggtgaccaccgcgccaggccggcccagtcgtcgacggattggagtctggaaaggaggagagggtcgtgtatttaagcttaagcaggagcaagcaaagcagaccacctcgccatcacagcattcaaagtgcaacgatggggagtggtggtggctactggcttagccccacggtttacgccgcgtactcatgcgacggagctaaataattgcccgggcgccggcccgcgcgccctctctatccggctctcacgtgcggcggctagccccacccacggtgccacaccacgtacgccacggtacgtcgcggtatttactcgccccgcccgcgcgcgtacaagacaattgcgcgtaggtacgcgacgcgcgcggacggtacggtggggaggtgtttactaccacttcctacccacgcgtgcggctctttgttagactttaatttgttgcggccattgcagcacggcttccgtcgatacctcgtgctacgtagtactagcacaccaaggtccagtaaaaacatcaagacgaaccaaactgttcgcgagatttttaatttgtttttttaagatagctttgtcaccttgtcgttgtcggtaagatgagccatactagtattgttactgtggtgctataaccatgcagcactgcagctgcatgcacaagagatcgatcatcgatgtacgtagtacgatgtgtagggcttgtggccgccatcaatccggtaataagcgaaccggttttgcttcgaggccaccccggtcaaggcagggggaagaaaacaacacgaatggccggttcgtatgttgtgaccattttctccatcggagagaggcaaaggacgggggcggtgagagatctaacggcagattgcccgtacccggtacccctcccacgccaccacacccacacccaacggctgcgttcggccacagccgcgtgggccccctcccggaacctgaatccgacggctgcgatcgcgccccggccgtggtcccgggacaggcgcacgtgctgactgtcacggcgcgggccccgccaatccatcccccgacatctcccagtgacttgtccaatcaggcgtccacggccacgctcgtctcactggaggacgggacccacggatcgtggggccgacacgtcagtggggaggggagggagggatggtcttgggccggatcggctgtggcatgagtggtggggcccacatggcacgccacacgggtattgtgctcccggtcgtagctccaatatgacgcgctcggatgagacgcacgggtgtgcccgtaacctcatcatggagccacttctaataaagctccttttgctttgttttttttccccttctcgccttgactgaatctttcgaactttacgtttgttttgtttaggcttactagatcttaatcacctcgagccaggggttttgctgtgctaatcatgaattagcagctgcgtacgttttatggtgttctgtatacggctgtttgtactgcaggaaaaattcgaaggataattctagccatgttatatatgtatgggaggaattttgaatggctatctcgccttttgcagtggaatacagaaaagaaatatggtatattgtattcttcaccaatgtcatactaggcaacattgatgcataagcatatacttgcagtggagtatatgcctatgcagacttgattggaaggggcatttctttttttgaaaaaaaaaaggggtagaagtcagcctctctatattcataagtgaatatacatagctataaaacgagcaccgttataaaggaaagttttacttacatacttagtttttcctttttaataggattgtgacgagatcagtacgcacacttcgctttctatatatcttgatcatgtttcgttgttgagtttaacttactctagctaattaagccgcataatcaattattctctactttcacaattttgatacaataattacttaaaaattaatttatactatgataaatgagaggagaaaaaataaacttaatataatataagacgaagggagtagatgctacagcactgaggagagatatttcagtagcggagatcgtaccatcttaagctttgcctgagagtttctaataaccgtaacttatttcataatatctacctcccttaaactgtttagattctctcataattttcaagaatatgtagtcataatatatagtaaagggattagaagcagaaacttgataaacccatcaaattctcaccaaagctacacaggccccgttagattccataaaaaaagtggataattttttggataaaagtggcacgtttttcaaactactaaacggcatgtttcgtgtgaaaactttttatataaaagttgttctaaaatatcagattaatccaatttcaaatttataataattaaaactcgattaatcacacgttattatcacctcgttttacataaaacacttaatttttatcttcatatcaaacaccgtctcaatggtttcttaattcttgatttctcatgtcccctgaatatgaagtaaattgaggtgcggttgccggtaagcaatacctcgagagaacttttacttaatacatagtatattgttaatatatattgtcggtataataaggacaatttagaattttgtcacaagattaaaagatgtgataacaatttaatctaaacccattgatcacttataccgactatagatattatactaatacagtgtatacgtaaaattctctaccttgaaacccagtgcagcattggactgcccccttatccactggtttaatttagtctagtatatatagagtacataaacaaaatttgcttcttttaccatccttaacacatttattaaccaattgtcgatctgacccccaatgcatggatagtttaggttgattttgtcaggcaattctcatggtcaattcattattttgaatcaaggtttatgatatgtgctccgatatagagttctcattccttttcatagacatatacatctgataagtacctctaacatgcgtacacaattcttactgtctcaggtcataccaaggaagatcttattgtcacacaattgattccattgaacactgtacgacaatatcttgtaaatggtcagtaaaacctgaaagtgcatgtaccattaatctttttctagccaaaatttatctttcttttgcgggtaggaaacctttatctttattttcacggcgcagtgtatccgcggcgtgtgacgatctcatgcctgtcagggcagggaaacgtacgtacgcgatcccctcccccctgatcaggcgatcactgcaccgtcggctccgtgacaagtaggggtggaaaaaaagtttgggctcgcgagctcagctcgggcttggctcgagctcgcttagcttggctcggcttaaataccaaacgagccaagcctaagcgtcctttctagctcgtttctgaaacgagccgagcctgagctgtctcgcgagtcgcttgatttggctcgtgagcctacgctatcattaattatatgggtgattttattttctagtgaagttattatttgtcaatatgtaatttatcatttatattttgatgaattgaatatataaagttattttaattttacatattaattatttgttattactttttttaatgattataaattatatagcttaatggaaggctcgcaagccagctcgagctagctcgagccacaaacgagccgagccaagctcatgttttagctcattgctataaccgagccgagccaagccgagactagcttgttgcgagccattgcaagccgagccgctcggctcgtttccacccctagtgacaagtgacaacgtcgtcgtgggcatattggggaagcggagcaccctgaaaaaaaggtcgcacgccgcagcctccaccgcacgcttcttcggctcccggatcggatctaccaccccacttcggaaattaaagacaaaaaacccttcgcgaagcaacgcaagcccacgcgtccggttccctccacgagtccacgcccgcccagggattccgcacgctcggaacgcgacccgagcccatccgcgcgaggccacaccacaggcgtgaaatccccgcgctgcccacgagcccgccgcagcgccgcgcgagggcagtccggtcaatccggcgcgcaaccctccccctcgcgacggcacgtgaccgcgcctcgagcagaccaccggctgtccccggccgtcggatcggatcgggatttaacctcgccgtaagccgcggataagcgcgggggattagaatacttaacctctcctctgctctcctcctcacccggcttaagcgcgcgggggggctgcgattcgcaggcgagagcacatgccatgtgaccccaccccaccactcctccctcacctacagctgttaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaattgctctccccctctactgtgtttgcgtctttcttcttcgcttctctttctctctctctccatctcctcctcatcacttcccactctcccccttctgtctctctactttctctctctaccgccgctctcgcagcaggccaggttctctctaatggtcgtgaggcagtgagctcgctcgtacatggattccttgtgggcagcgatagcggcactgtttgtggcggcggcggtggtggtgaggggggcggcggcggccgacgacgcccagctgctcgaggagttcaggcaggcggtgccgaaccaggcggcgctcaaggggtggagcggcggcgacggcgcgtgcaggttcccgggggccgggtgccggaacgggaggctcacgtcgctgtcgctcgccggcgtgccgctcaatgccgagttccgcgccgtcgcggccaccctgctgcagctcggcagcgtcgaggtgctgagcctccgcggcgccaacgtcagcggcgcgctctcggcggctggcggcgcgaggtgcgggagcaagctgcaggcgctcgatttgtccgggaatgccgcgctccggggctccgtcgccgacgtggcggccctggccagcgcctgcggcggcctcaagacgctgaatctctccggcgatgcggttggtgcggcgaaggtcggtggcggtggtggcccgggctttgccgggctggactcgcttgatttgtccaacaacaagatcaccgacgatagcgacctccggtggatggtggatgccggagtcggggcagtacggtggttggaccttgccctgaacaggatctccggtgtcccggagttcaccaactgctccgggcttcagtaccttgacctctccggcaacctcatcgtcggtgaggtgcccggcggggcactttccgactgccgcggtctgaaagtgctcaacctctccttcaaccacctcgccggcgtgttccctccggacatcgccggcctcacgtcgctcaacgccctcaacctctccaacaacaacttctccggcgagctccccggcgaggctttcgcaaagctgcagcagcttacggcgctctccctctccttcaaccacttcaacggctccatcccggacaccgtagcctcgctgccggagctccagcagctcgacctcagctccaacaccttctccggcaccatcccgtcgtccctctgccaagatcccaactccaagctccatctgctgtaccttcagaacaactacctcaccggcggcatcccagacgccgtctccaactgcaccagcctcgtctccctcgacctcagcctcaactacatcaatgggtccatcccggcatccctcggcgaccttggcaacctgcaggacctcatcctgtggcagaacgagctggagggcgagataccggcgtccctgtcgcgcattcagggcctcgagcatctcatcctcgactacaacgggctcacgggtagcatcccgccggagctagccaagtgcaccaagctgaactggatttctttggcgagcaaccggctgtccgggccaatcccttcatggcttgggaagctcagctacttggctatcttgaagctcagcaacaattccttctcggggcctataccgccagagctcggtgactgccagagcttggtgtggctggacctgaatagcaatcagctgaatggatcaatacccaaagagctggccaaacagtctgggaagatgaatgttggcctcatagttggacggccttacgtttatcttcgcaacgacgagctgagcagcgagtgccgtggcaaggggagcttgctggagtttaccagcatccgacctgatgacctcagtcggatgccgagcaagaagctgtgcaacttcacaagaatgtatgtggggagcacggagtacaccttcaacaagaatggttcgatgatatttctcgatttgtcatataatcagctggactcggcgattcctggcgagctgggggacatgttctacctcatgatcatgaatcttgggcacaacctactgtcaggtaccatcccatcgcggctagcagaggccaagaagcttgcggtgcttgacctgtcgtataaccagttggaagggccaatacccaactctttctcggcactttccttgtcggagatcaatctgtcaaataatcagctgaatggaacaattccagagcttggttcccttgccacatttccgaagagccagtatgagaataacactggtttatgtggcttcccactgccaccatgtgaccatagttccccaagatcttccaatgaccaccaatcccaccggaggcaggcatcgatggcaagcagtatcgctatgggactgttattctcactgttctgtataattgtgatcatcatagccattgggagcaagcggcggaggctgaagaatgaggaggcgagtacctctcgtgatatatatattgatagcaggtcacattctgcaactatgaattctgattggaggcaaaatctctccggtacaaatcttcttagcatcaacctggctgcattcgagaagccattgcagaatctcaccctggctgatcttgttgaggccacaaatggcttccacatcgcatgccaaattgggtctggtgggtttggtgatgtctacaaggcacagctcaaggatgggaaggttgttgcaatcaagaagctaatacatgtgagcgggcagggtgaccgggagttcactgcagaaatggagaccattggcaagatcaaacaccgtaaccttgttccacttcttggctattgcaaggctggtgaggagcggttgttggtgtatgattacatgaagtttggcagcttggaggatgtgttgcatgaccgcaaaaagatcggtaaaaagctgaattgggaggcaagacggaaaatcgctgttggagcagcaaggggtttggcattcctccaccacaattgcattcctcacatcattcaccgagacatgaagtcgagcaatgtgcttatcgatgaacaactggaagcaagggtatctgatttcggtatggcgaggctgatgagcgtggtggatacacaccttagcgtgtccactcttgctggaacgccagggtatgtaccaccggagtactaccagagcttcagatgcaccaccaagggtgatgtttatagctatggtgttgtgttgctggagctgctcaccgggaaaccgccgacggactcggcagactttggcgaggacaataaccttgtggggtgggtcaagcagcacaccaaattgaagatcacggatgtcttcgaccctgagctactcaaggaggatccatccgtcgagcttgagctgctggagcatttgaaaatcgcctgtgcgtgcttggatgaccggccgtcgaggcggccgacgatgctgaaggtgatggcaatgttcaaggagatccaagctgggtcgacggtcgactcgaagacctcgtcggcggcagcgggctcgatcgatgagggaggctatggggtccttgacatgcccctcagggaagccaaggaggagaaggattagaaacaacaaccaccgacacacaggagaaacagccggcggtgagtggccaccaacgaggccagtcggcggcgaaatgcccgtagaaacaacagtcattcagaatcagatggatgccattttgaactctccacacaagcttagcaatcgcttctgatggtgctacaagataagaattttccagctgtaggttgatcagtcgaagttgttatgtacctataggagtagatcttttcttctttcttttttcgcagctttcttcgtctccctgtttgtttttcccgtcgcgtcgcagtaagagctgtgtatgtacatatataaatgttgaattttctttggcgcaaaatcaaaatccgcctaggttgctcctcgtcattttttccccttctcttgtctcttgacaatggtttaaatgtgcatgagttcatcaaacatgcaatgaatatttattgcagatggatattattgcagggtggtcattgcaagtaaatggcatccgaatctgagaagaagcaccactggagggggtggtggaggagggtggtggtgtgggagagagaaacatgacaggttgaacagcaaatggccagtcaagaggctgacacagctcctgtttccatgtgaggtagagcatggctttgcttgcgtggggtcaggtgcagtgagccagtgacacacccacgcaagaagacgcactcacgcagcacaagcacctttctttaatttcggggggctagcttgctttgtcttcaaatcatttcataagaggggcttagcttagcctttagttggtcaaaggttcccctaagcattttttgtcctctctgattatcctaatcgcctaggtaacatggctcccaatcttataataaccaccctcactattatacttgcatggtgctgtgtccgatgcttgggcgttgtcaaactaatgatgtgtgtgtccgcaaagtgagcggcacactggcatgcatgcagattcccccagatttcaagatggttgttcaaacgtatggttgctttcaagttcaggatttgagcttgcagtgtgctccttgtcttggtttgcccattccttttactgtgagagaatttagtgcagagcagagctagtcacattgggtaaaaattcatgaacttgctgaaaggcattctggttttggtctttatatctccacaagtagcttctccaatctccacagtctagacaggtcgttttctctaggccaaatgagtttttctttttcttcagtttttttttacctttgaggcttcgaggagctcaaaaaaagtccccatggagtctgtcccctgggtgcaactatagtggaacacatacacatccaacacaaacacaaagcctggaaaagctacaggagccatggtgacattgacaaactgtgcctcagaatggagtctctgacatcaccacaagggagtgggccctctgcctgtccgcatagcgttagcgctctggcttaaattttgctcgcccagtgctatcattatccccccttggaatagttgcatctgtaccaccatgtggcttgatgggttacaacttctgagtcgttaaaagtaattggacacgctcttcgtgtagaatcaactgaaatacgattatacgaatctacggaccatttgatacttggaaatgctcccacagaggattaggatgacttctgttggtttactgtagcacaatggattttttgaattacttctttcgatcaaaactatcactatgtcaaagttgttaggaatttcaactttcaagtagctagtacatattccctccgtttcatattataagacgttctagcattgcccgcattcatatagattttaatgaatctagacacatatatatgtttaaatttattaatatatatatatatatatgaatgtggacaatgctagaaagttttataatatgaaacgaaggagatagtagttaagagactttcttttttaaaaataactatatataacacactattttagtctagaataaattactcttacaatgtgggcctacatgctactcttgaattatgttagcaatgcgggcctacattcatacacatttatcattcatacacatttaagacaatcttagaaagaccatccacgccagtaccaatataagcttttggccattgattttaatgtaacacaacataggatagaagagaacatgaggtgcaacttcagcaggcttggtggcaaataaaggaagtgaaggcaagaaaaaatcattcattcgccctataaatggtaaggaaaaaagaaaccgtggtattggtggcagcagtaacagatgcgtttgatattgttcttatgacaatgtcacaaactaaaacgatatcaaaataatgcaattctaaagaaaaaaaatacagtgttggacgtaatacaagagatcaagtgaaatttaaattggcgaagataacagaagtgtggagagtgacaatgacacgccatagcaaggaagttccatgcaatggaggtgatgagatggggaggtaaaacgcaaaactgaaaaagaaaaggcaaaacatatctagcaggaagaattttaacggaaacacgctatataagggacattaataggtgatgacgatggcgaactatatctagggatgggtaaaaattgagacaaaaatcaaaactgaaaacccgagaccaaacctgaaaaaacatagtatcgatcattggtccctaactcggtctaggtctcatgtttacaggaccaattatttgattagtttattgcatcggatacttgaattaccgatctattcaagccttatcctaatcccctcctcattcatcaatatatcccttccacttcctcatccacgatagcacttgacgcctcgtatgttatcttggcgctcctctcccctctcctcacctcagaacttcttgagtggacctctctggctagaatgtctccatggcttttgtccctcattggccaccgctgcctcaacggcaaggtgctagaaataaagtggtacatagagagggaggaaggggagaacaatctcttctcttgttagtgtttggtggtgaggtttggaggaataacaaggtaggggatgacaaggagattgtgatttgttgaacatcgaggtcacatgtttcagatcagatctgagataaaccagacttggagaacaatatgtttaccgggtgtttggtggtaacgagccaccacaaccgcaccaacacctaaggagtaacggtgacagccgttgagcctctccactccacgcaccatagctagcgaggatgtctcctcttttgtgcacttcacgtcctcgagcatcaccaaaaaagacagtgcacgatggtcgatggcaaccatctccttgggggagagccggaagcctatgttaaaggcaagtaccacatttgcgtctaagtcatctgcaagtgtgcggcttgctcacctacaatcctacaaggaagatgaatgtttggttagaccaaaactatcggttaaccaaatggccagtttaaatacttccattgacaagttcggtcttccaatttaaaggaccgaattttgaaagaccaaaaagactagattatagcactatactatgaattggatggtaatgcttgaaattggttagatgtggggaatgcacttctgacgcgaacaaattggtagcatttctacacgtaaacaacaacaaaccaatactgtgtggtcacttatttttgctgaattatttaattcctaggagccccaaaatgcgccatgttcctcggcctatttttgcactgcgtttagaactatgcttaaagatttgtcgtgcatcagcatgcatggcactttaattgtttcgaagtgtaggagtacctagcaatctagcattgttgtcggcgcgatgcgtgtatggttgtgtatcaccatttgtatttctcaatttgtgcttgtgttcaaaaggagggcatcaagtctgggccccaggatggctgtgcttggcctaatgcttccacccttatctgttgggagaggacatgtagggcatccagggacagagttatcatggcacagtgactgggtagctggacgagtgaccggctgagcgatctagcagtagtatcatcggccaggagtatgtgaaaatctagcaaaacaaaagcgcaggttgcattgctgactttctgcactgataacagcgtcccccccgggggtctctctctctctaggtgacattacatgcgactaaggctgtgtgtttagtttcctttcaaacttccaacttttcgatcacaccatatatttggaaaagaaaataaattgtatagtttatatgcaaattgcgagacaaatcttttgagcctaattacataataatttaacaatgtggtgctacagtaaatatttgctaatgatagattaattaggtttaatagattcatttcgcagtttacagacgaaatatgtaacttcaaatgtgtgtccctgtacgttaattttttttttttaccaaaacaactacacacgacctaagtggttcggttgttcgtgcattcatatttgtgaggcattttaccacgcaccatgaatgcgccctgcccatgaatgtggagcagtaaagttgcagctttcttgaatggctactgttgcccatcaccagcaaaaagttgatcccatttcaccggtacaaacgtggtcaattgacaaaatggttgtatagtgttaatatatattccgacgtattttctctatcacaaaataacttaatcatgcattttatccaaatttattata

SEQ ID NO: 78771 - DNA, 6524 bp, Oryza sativa
cgagttctcctttgcactgcgactccgcactagcatttgatagcggtgaatcggtgctaggttcagagctcagagcggaagcataccgtgtggcgcataacctcctcccatggcgtgtccttcagcgggctgatgctcccgtcgcctactatggagactatgcggacggcgcccttcccggtgatggttccgccggccccgccgccaagctcgcccgcggcggcgcgcggtggcccgagagagcggacgccgccggagtagcggcgggcgatggtgcgcgaaggggcaggcacggaagcggtttcatggaggtggcggcgagtaggtaggaagaggcgagtggtggccgccgcggaggcggacgtggtgggcgtggctgccatgggagtctgggaagaggaggtggacgaagcggctggacctcgagtctcgagccttcgagaacctttcgactcatccctaccgttcgatcagaaaatcgacggtggatactaatctcagggaaaaaaattctggaaaacgtttttctacacaaacaaaatacgagttataaaaactagctggtggcccgcgcaattgcgcggcaaaccccaaacaaaattatatatttttaagtatgattttacttaaaaaatttattaaatagctatctcattgtcttaagacattgaaaggccaaaccttatcatcatcgtgtttctaaatatatagtttttaaaagtcacaccagttgctatccattatgtcatcctcttctttatttgcttgctcgattatcactatttctattcattcttcttggaatcattaaaaattggattttatagttttagagtttattgtcatgttgtgtttcgtttttacaattcctagatgtcccgtcaaatgttgccattatacacctctacggccagtccactgtctcttctctttattatcattgagattttaaaaatcgaaaataattatcgtttggtttattttttactttctaaaagtcctgccaaaccatcagcggctttgccattatactcctatatgactcgcccgttgcctcccttttttattgtcattgagatttcaaaatcgaacatgattatcattggttttttttactttttaaattggacttgtagtttcattttttataatttttagaaattccatcaaacgatgccactatgcccctctacagcccatccgccccctactcattattgtcattgtgattctaaaaatcgaacataattatcgttggaatttattttttattttctagaagtctcgtcaaccgtcggcggctctgcaactatactcttatacaccccgtccgctgcttctctttttattgtcattgagattttaaaaatcaaatatgattatcaatgtggtttattttttttactttctagaagtcccgataaccgtcttactcgtttgcttcacggcctgcctgacatccctccttttaatcgtcattaggattctatttggtgttttattaacattttttatatgtcgtatcaaccgccaacactctactctgttttagatggtattttctttcaatagtctttatttttatcacaaattttagttatttataaattgtattcctaattgaaatcttatttttctttttctaatttcagaattttttttaaaaaaaattagttagtaccgtattgtgttatcttaatgtttttattttttattttcaatttcagttgttttaaaaattgtatttctacttgaactctctttaatttttctaattttagatattattttattttttactctaaattttaattaatctcatattgggttcttatatggattattctttcaatgttgcttatttttaatttcgaatttcagctaattttaaattgtattcctacttacactctcctttcctttaataatttcggattttattctatttttatttcggatttgattaatctcgtattgagttcttatatggaaatttctttcaatattgcttatttttaattccgaatttcagctattttaaaattgtatttctacttggactctccttttctttttctccgattaatgtgggaatttctaacccccacagcgaacgtggtgtctcctttcaaagctgttttaataacataatagatagatacccgcgcaattgcgcggctagcaccgatataaaattatctaatttttaatatagttttacttaaaattttgttaaatagatatctcgttgtcttaagactttgaaaaaccaaaccttatcatccctgtgtttctagttttattttttaaaaagttatatcagttgcaaatcctaaattctttgtcacccctcatttatttgctttctcgatcaccactacgtctatttgttctcactaaaaacctctaaaaattagacttatagtttttagagtttattgtctcgtttgggttttgtttttataattttcagaagtctcatcaaatgctgccactatactactctacggtccatccactgcctcttcttttattttcattggattttaaaaatcaaacgtaattaccatttgggttctttttttactttctagaagttccaccaagctgtcagcacctttaccactgtacacatgtactgctcgcccgctgccccctctttattgtctttgagattttaaaattcgaacatgattatcattggggtttatttttttactttttagaagtcccgtcaaccgttgtaaccatgctacttaatgacccatccatcgtccctccttttaatcatcattgggattctatttggggttttgtttatagtttttagatattccatcaaccgccaccactctaatcctttacatgcatgttgcttctcctatatttgttgtcatttgtcatagttttataatttttagaagtcatatcaaaccctgtcaccatacttctcttcggcctatccactgcctcttctctttattgtcattgggattttaaaaatcgaacataattattatttgggttcatattttactttctataagtcccgccaaccgccatgaccaggctgcttaacggcccatccatcgtccctccttttaatcatcattgggattctatttgaggttttgttaatagtttttagatgtcctatcaatcgccaccattctacttctttataaacttgttgcttctccccctctttattgttgtttgttatcatttgtgttctagatgaagttttttagaagtccatatttttcagtccgatattttatttacaaattatattcctacttaaactcttataattatttttctattttcagtatttatttttttgttatttcaaattttagttaatctcgtcacatgttctagatggtatcttatttcaatagtttttatttttttatgacgaatttaagttatttataaattttattcctaggtgaactattattttttctttttctatttttggaatttattttaattttgatttagaattttggttaatatcgtattatgtcttatatgaattatttcttaatgttcttttattttcaattttatagttgttttatcctactcaaactatcttttttatttctctaattccggattttattttatttttattctgaattttaattaatctcgtactggattcttatatatactcttcttttaatattccttatttttaattccgaattccagttatttctagattgtattcctatatggactcttcttttttcaatttcagattttattttatttttattccgaattttaattaatctcgtattggattcttatacgaactctatattgcttatttgtaattccgaatttcagctatttttaaattgtatttctatttggactcttctttttttcttctccgattaatgtgggaatttctaacccccataacgaacgtgatgcttttttttcgagcagttttaataatataatagatagatagatatcttcgaaactcccgcccgccaccgagcgggatacgcaaaaatctccaaaattttccccaacccgcgcgcccccagttttcctctcctccgaatcccaatctctcgcagttcgttcgaggagctgagacgctgcgacggccatggcgacgagtctcttcctcgcgctgcagtgcgtccagtgctccactatgcaggtgcgcgtcctcgcccaaatccctcccccgaaaaccccgcgagtttcttcaatagctcacccggtttcgttcttgcggcttcggtttgatttcccaggtgaagccgcagaagaagagcagcaacaagtgggtgtgcgtggtgtgcaaccagcgccagtccgtgatgcgcgtccacgcccgcgggcaccgcgccgccgacctccgccgcttcgtccaggaagccaacctctcgcgcggccgcgccgcgcatgtgcccgtgcccgaggaagactgggtccctgcggtgccgggggagcagcgggatgagttcccgaaggagaggaagaggcggatggactggtccgactatctggaagatccgggggagtacgatggcggcggccaccacgaggaagctcgagatgaaggtatgcgcgaaacctgtttgatgtgatgtcgcaatgtatgtgtatcacagtatcagtatgatattgggtagcgtgtaaaatgatatgctcattaggaccaatggtaagttgattttgctaggggcctagtgttactacttaaaatcaacttgcttgccgcatggtttagtatcgtgttttcaagcttggacgcagtgagtacgggtaatgatacttgtggttcaaggcttaacaaaggcattgctgaactaaaattataagcacctgtttgtgaatagtcttgtatttcatattccatgcatgaatataaatgttattggggcaagctatacattgcttatgcagcgctagcatgatcacaggtctgttacgcagttacaatggctagtacctgaatgctcggctataaaaaagttgaatatctgcattatgtttcaggatgaggttgtattatgtatagcacttctaagtcttgagttagttctcttcatctttgtttatctgcacttatctgggaaggaatgaccagtctttaatgcatgatctaattgttttcatacctcaatttacaaatagatgtagggattcaagtaacaactgaattacctgaaaagaggcctaaagtcacttccttgaagagggcccccaaagcccaattgggattaggtggaaagaggcccaagacaccagtcacttccactttacccaagaggcaaccgatcgaagaaggttcactcccatgttctgcagctcctactgctgaaggcacattcaaatcctaacacatattgtacttgtcattaacaaaacatgtaagttaaacgggttgtatgttttctgcagcacaaagatcaaaatggagcaattatttggatacaagtttctctgaagggggaagtgggtttgaagactctgagcgacattgcagtgaactggaatgctccattactgatgttgtggtggatgatgaggtacaccctgattttgtgtgatatatatgtgtcttgtcttggtctgtagcattttatgctttgaatagtgcagtagttagaaaagatctgatgtgcagttggcaaaatattatcatataggatgggcactttattatgcactgaatcgcaacttgctatgttaaaattgaggagaaattaagatgcatgctaaccttttgaaacaatgatgttaacagtgcatctgcttaacctactttcagagttctctgaacttagtcctttgagtttaaaatgtatatgtataaggtgacaggcttatgtcacaacaagagtttcagttagttgtatactccacttaacaatacccccacccctgtaatttcaaaaaaatccctggcaaaaagagagaggatgggaaaacacaagtggtgactcttttcttcattttggaactccacaaagttatcctaaaaggtaccccgtataaaatcttctgcagtacttcaactggaagtagggatatgtaattccgagttaactgaagattttgttggatgtatatggggattatgcactactaaataactactgattgcatgcttcatttgttatgcttgtgtctggctgagtgcatcactgcatcttccaaacataaactgatattccgaaacaataatccctacacgaagcctgaatcacaatgaacaaatttgaaacttgctgatgtctgaacaattcaacaacttctgatttctgaaaccattgttagtttaaacaattttgatcattgaccatgatgaagatgtgcactcttctgacatgaacctatcaccgatcactgtttcgctgccatcaacctgctaagttatgttataacctattaacttggtaagttcatacgtctcaacatctttctaaatccagaagagggacttgaacaaatggtcattatggtagggcagtctgaag

SEQ ID NO: 78772 - DNA, 13329 bp, Oryza sativa
  unsure (1)..(13329): unsure at all n locations
ttacgctgggaatctgacacgtttcactagttacgcgacacctccttccgtgcgaaacttgtaaatatttatttggcaagaaaaaaatcaacgataaaattgtaatgtaatagtccagctctataactttcctgtagagtttgtctccatataaaatcgtttcaagattttaaaagtttgtttacacgaatagatttgaagacttataacataatatatttggacatataggccttcgttaagattccaaaaaattttggccaaaaacgtcacatcaaatgtttggacacatgcatgagcattaaatgtggaaaaaaaacaaattgcacggtttgcatgtaaattactagacgaatcttttgagcctaattacgccatgatttgacaatgtgatgctacagtaaacatttggtaatgactgattaattaggcttaataaatttgtctcgcggtttataaacggaatctgtaatttgtcttgttatcagtctacgtttaatactttaaatgtgcgtccgtatacttcaaaaattttacacccaaagaactaaacacacccataagcaatcgtagacaaaaatgttatcaagtggaaagttttcttcatccaacttaggactccttggaaatgctgaactgaaaaactagaggaacagaaaaatatatataattgacaaaagaaatgcaagtatgaaatagaatatcaagagaataaaataaatacaagaatagtctttaattgaaccgctacatatgaaaagatgcatatttgttgttatgttctactgaataggaactatgaagatggattctaatagctcgagtggacgtccatctgtttattgcatgtcaactaaatgattacaataaaaaatcaaaaaaattgacaagatagattaatatgaaatatatcactccacaacacatgtaatttcaaattcagcttctataaattgttacaaaaatatcaaatttaactgtaaatatacgtacagtaatttgagttttgtttgttatgtttgttacaattttatagaagttgaattttaacttgcatgtttgtggagtgatatattacatattaatctatcttgtcaattatttttattttttcataaccatttaaatgatatgtattaagcgagtggacatctaccactatagctttgttgttttgttgttaccaccaccaccactactactattagacttttgagggcaaaattttttatctttcaaccattggatttgttccaagattcatgcaggtaaggagatgatggtttgtacgttttgagttcttacatactcccttcgtctcaaatttaaagggattttggataaatggaacacattgagtgtccaaattcatagtatgtgtttatattcatagtcttataaagtgtctaatccattcaaaatctcttatattttagagcggaggaatacaattacgtactacttcagtacactcagaatgaaaaaaacactatagttaattagttggtgtatgtttagaagttattctctcgatttcctatcgaaagttaaatagccactttaagaaaacaaatccgagtgtgaaatgactttcgggatgtaggcgccatacagtaattttcttcttaatcatacgcgactctgctttgaattcagaacgccaccacagaccacagatccgctcgtagtacgtactacgagtcaccactgatttcgatcaaaattgaaaaagaagggatgaaaccgaaacgaacaaactatgaacaaacgcaccagcacgcacgcactcacgctgtcacgcgcatccatggacacgcgacgaactccaagcatccttacgctttacgcgagcaattttactgcgcggtacttcaattcactcctctgcttgatcggccggtgacactgacgccgacgccgaccggtttatgccctggcggcggcgccgggaagctccggcgtgacgatcatgttgtagatgtgctccatcatccgccgctcgaagtcgccgccgctcccctgcaggcgcgcccgcggcacccgcctgtccagcagcccggccgccgcctccgtcgccgcgcagctccgcgaccgcgacctggacagcgcggcgccgcctccggcggccagcgccagcatcgcgtcgacgtacgcgtcccggatcctcgccatcagccgcagcggcgacagtagcaccgcgcgcgccgccgcccgggcgttccaggacgacaggcgcccgcgccggacgggggcgtccttcgtgctccgcgcgccgccagcgccgccgccgaggcgcgccacgcggaggtgccgcgacggcggcgagccgaggcgcctgtagttcctccgcgcccagtacatctggatgctgcgccgcggctgcgacacgaggctgatcgccatgcgcgcgatcctgctgctgatcgatcgagttgctgccggtgctgcactgctgctgctgcgttgaggtgtgtactgcgcaatggatgcttatatagtactaagagctaaggttaattcagattagtgactggagatgagagaatttgtggtcaatataattggatcaagcacaagctaatctgactgtgatttgggttcttccttgacggcgcattgattgggagttgtagctcgtcagcgttgaaccgttcgaactgggtgggtcgagtaaaaaaaagaagagccgccaaagttgcaccgggaagaagcagataccgtgcgtatctgtcggcgaggcatacgccattctcgtctcttgctggagggtagggtatcgttgacgattgacgagaaatgcgtcgtgacctagcaagttttggatgctgcttaactttttgggggtgtttagattgaggggtgtaaagttttaatgtgccacgtcaggtattatatagggtgtcgtatggggtgttcgagcactaatagaaaaactaattataaaatctgtcggtaaaccgtgagacgactttattaagcctaattaatccatcattagcaaatatttattgtagcaccacattgtcaaatcatggagcaattagatttaaaagattcgtcttgcaaattagtcgtaatctgtggaattagttattttttagattatatttaatacttcattcatgtactaaacgatcgatgcgatagtgcgtaaaatttttacgtgttaactaaacggagcctttaacccagtcgacgagtttctcaagctgcaaatgtacagctcatggaatcccccttgggatcgtgcactcatggaaccatctgtacaatttgagacaaacacactattttccacacggaaattcttgttctctgacacgtcgctctatttatcacagctccagctccatctttcttgaggtgaagtctaaccaaataatttcagctccgcctaaaatagaaatagtgctaggtgagacgctatcataaaataaactaaagatgtaagctggttttaggctgctactacacaagtccactccacgtccaactcccgaaactaaatttatcggttagagttctacaaaatagacccgtcatattgtgcgtgcgactgtgaggccttgtttggaagttggaacggcccggcacattcgcatatagtccgctgcaactgggccgttatttttcgttgccgaaagaggccttatggagaccttggaccgcacgattttcaaccaacgttaaacggcaggcgcttactcgcacaaaaaggaataagttcactcgaggtcccttaacttgtagccgagttcgaaattcatccctacaccacaaaaccacatacaacgcatcccccaatttaccaaatcgtgcaaatcgtgcaaaaaggtctctcggcagtattgtccccggttttgactgacgtggtgcctacgtagcgctccaattactaggttttcatcccacgtggcattgacgtggcgcttacgtggcaatttgataaaaaaaattaataaaatatatgggacccacttcagttaaaaacaaatggtggaggacccacgtgggacccatatgtcatcctccctactcctctcttctctgttatcgttttcttttctttttcattctttttcttcttttaatttagaggatggcatccggcgaccggcactcggcggagagggcggccgacgagagaggagcggcggcgcgtgccgcgccgacggagaggaggccgctcggagcgaggcgtcgcgggagaagggcagcacgcggtgagcggcggcacgcattcctcctccgctagatctccggattcgtttttgtacttgctagtcgcgtccggagaagaggagaagaaatccagtcaatcagcatcggcatgtcgtcgcttggggtggtggtggttctgaattttgattgattcgtgctttttcgttgggggttgcttgccatgggattggtgaacgaggcgagctcgtcgtggacaccatgctggtgctcaagctcaggctcaactccatcaagacgctgacgctcctcgtgccactcagcatattcgccgatgtggttgacctcggcgccgtgggcgtcattctcaggaaggacatgtccgtctggctcaccaagccaccactcgtcttcgcctgcggtggcctgagcgcgatcctgtacagcatcggcgtgtctgtgtacgctttcgagggattcggcatggtccatccgcttgaggcggaggccgccaacaagaagaagttgggcgcaccacgctcgggctatccatggggccatcccgtctccgcccccctgccccatctccgcccccctgcggaggaagagatgcgcagcgggcggcggccagcgaccgtctcggccccactcatcggccgccgcatttttccctctcgacgcgcgctcgccggccggcgaggaaggatggccgggagggagagaggaggcgccggtccatcctctcccgtcgtccgtggatagagaggagggtgggacccactgatacgtgggtcccattatttttcttgtgtgtaactgatatgtgggtctcacttttttgtttttattttaattttttatattttgcttccggtgccacatcattgccacgtagaacgaggacaaaacaaaagagccacgtaggcgctatatcagtcaaaaccaccatcgaaaccgctgaaggacttgctttgtaccggttttgatagttgagggactcgttgtatctggttttagtgttaaaggacgaaaatcggattcgttgacaagtttaaggacctcaagtgaacttattccgcacaaaaacgaaaggaaatgggcttgccctgacgaagagcttgaacagcattttagactattaaaattttgttagcattaaatcttgggtaaattttggctagtagatttggctcagctctacaaatttggtacaagtttttcctcaatccaaatgtttatcaagtactattcgtggctatcaaatattacctccctcacaaaaatagttcattcaggtgcataatcatgaatggaagacttgtctacgtgcatagctagagataatagacttatactggtgcatagtaaaaaaaatgggaatttgtttttcaaccttaaattcaaagtcgattttgggttttcttcatcgaaatttattttttaacctttgtttttagattgttaagaacatgtatatgtaagttttattcaaattactttttttctgtaaatatgaagccaaacgatggggccggaagtctttttgacggacggagcaattggtaaggccgaattagtatcaaaccaaacacaacctttagatacgtttgtggttctatgccaatttttttacaattgcaagatttgattactgatgcagtcggcaatttttttcagaacaagcaaaaatcatgcaacctttagatacgtctgtggttctctgtctgtttttcttttcagaagaaacaatcctgaatttgacaaagtacttacctttttcttcgtagaattagactaaaactaaaccaaaccaaacgaaagatttttcccatacgacagaatggctgcactcggcgagatgaacaaggtcactgtcgtactacacgaaacggcaagagcagctacatgcctgtactccactccaacctcatttgttgtacacttgtactgccgatcagttccaagcagcaaaacttgtacgtttcatctgagaattgcagtggtagtaccgtacgtctcacgcgctggccaaatcgctcgcatcgtgccatgttgccatgtcaaacaagctcaaaccgctctttaaaaatctgaacctttctgatctgaattttcggtttcgctgtcatttggagttcttgctgtgtctttctctgtctacttttcctcgaaagcaacatggtcagattaagaaactgtgcataggccaaataagcgagttatattgatcagctgcaggatttgcttatttgcaagcaaagaattaagatacatggaacatatcacaaatagaaccatatctatttttcatttcccggctactaataagtgggaagaacatttatttcttctagaacctataaataaccaatagtccaatactaccatcttcctcgacaaatgacaaggccgtagtagtcgtatagtacaaggctatgctaattttgctaaactaatttgggggtatctaattaatcttcccctttacaaatgccatgctcgatcgtgtcacgtaccattcgtatgtcgcgtttagaggaagaagcagcccatgccggagcgcggcgcaaagaacgggagcacggcgtcgggcgacgccgacgcggggggcggcgcgctctccgccgcngcngcngcngtgatgctgttgaacctccggcgagccgacggccgcggcaggttctccggcacgatgttctccagcgagttggcgcgccacggggggcactgccggcggtcgctccaccgcgccggccccgccgccgccgccgccgtcgcctccggcgcacgcgccatcacggcgccttcgccggggccgcccgccgtcccgagcaccgcgcacgccgccgccgccgcgacgcacgcccggcgcagctgctggaggtgaggcgcgccgccgcctctgctggcggcggccggagccggcgcaggcttgagctggcaggagaccaccatggttgccgacacgtctcgcagcagcagcacagcaattttgatgggaaaaaggccagttcgaagcgagatttatagcgtttttttttcctttttttttttgtttgggtgagcagaggagggtcagatcacggctgttgatctcgacgtggacgctggattttagtgctagcttagcaagcgcgcgcgtgttgctttgcttggcgtgtggaaccacctgtggcgtgtgaaaagttgcatatggcacgtcgggggcgtggggtggggcccgcgggcggtggttagatatttggcatacagtaaatagcgtaattagcagtttgcgagcttgcaactttgcaagggggaaattactcagtcacagcgacgagaggagatgcatgggaaacccgggaaattacttggctgctgctaaaatagtctgccttggacgggttccttcgtataccaaccggagcgagacatgtaccggactttctatttgcgccacgcttggcacttggactcttacggttaaacccagattcaatctaggccggaaataacatgtatattaaaaaatttataatagatataacgagagactggatttattctgagccgggaactaatttatttatgataggaataataaaacatccagattagttccacacttcttgacttattggattgatttctaatatcttattgtccctatcataagtaaattgattcccggtccagaataaattctgatctgttattgtatctacataaatttctttctttagttgtcattccggctcggattgaattcgggcgcaaccgaacaagtcctaattcgtttcaggagggtgagctgtacgagccaccaagtcgccaacaacctaggaagaactcgtatcgccattcgtcgcatgccaacttggaaatcgacgttttttttttctctctctctctgcagactacaattacctcaactcagtgtcaactctgctttcgtagatgggagttcccaacacggcggcacactggaagccaagggaaggcaattaggtaaaaacccctcgctggacacaatcacgcgcacaaactgttcgagggaattccgcgctgaaacaggcacagcttcgtcgcatgatattttaagtgagaaagctaatcaacggtgattctttgaggctagggagaccctgtttagatgagactaaaatttataagtcactatcacatcgaatatttagacactaattataaatattaaacgtaaactattaataaaactcatatataatcttgtactaattcacgagacgaatctatttaccctaattaatccatgattagcctatatgatgctatagtaaacattctctacttacggattaattaggcttaaaaaatttgtctcgcgaattagctttcatttatataattagttttgtaagtagtctatatttaatactctaaattagtgtcaaatatatagactaaatttaagtccatggaatccaaagttccaaacaccacctgaagcttcatttctggtggcaccatgatttgattctcttgccgttggattggatgccgtccaatcggtgatttgctcgtacatatttttaaccgcgtgtcaaaagtttgtaagaatatcttttttacgtgaatcattttcgtatgttagaatcactggggttcatctgcaaaggaactgaaacagatgcagagagacttggaacttggaaaaactgaaaacctctattctggatttctggtctttcaggtctcttttttttgggcctgctttgggagcccatcatcgtggaaaggctaggaatcatgggccgccaaaacaggccttaaagatcacaattcttccagtagacacctgttacggtaaaattaccagattaggcaaataagaaaatcagatgaaaggagttatcaaatagaccatcatagtcaataacagagtgctgaaaaaggaaagacagtatatattccaaaaattgacaacaaatttaatgttgatagtcggaattttaaatatatgaccgttattggcttttaaatatatatgctattgtgagccaaagacataaatctaaaaaaaaaagtgagccaaagacaacatagagagatcaagacacatctgtttattgacttttaaatatatatgctattgtgagccaaagacacaagatagaaatccattcaagacacatccgtttcttgacttttaattatgtgctattgtgagccaagccaaagacataaatcctcaaaaaaaaaaagtgagccgaagacacaatatagagatccattcaagacacattcgtttattgactttaaatatatgctattgtgagccaaagatatacttcctccgtctcaaaataaacaaacatgttatgtaaccttttctagatacattcattgtactaggatctctatccaaattcattgtgctaggaaacgtcacatcctattctagattgatttttatgggatggagggagtaagatggagaaccatttaagacacatccgtacaatccttgtcctaatcaagaaagaaagatggtacaataggtaggtcagtatgacactagtacaaatcaagaaccaggcaacactgtcatgcatactttaggcatctctgccctctcatctaagagtgcgagcggataggctgaaatattgacctatccaattgagataccaagtattaacctatctcacatagtccaacatggactaaatcagtagaaggaaaaaaaactatttttgttgttttcggcatccaccacacaagntngnaagggaaatggaaanaaaccgggaaancccaattttttntttncaaccnttggggncctcggcaccatgtctctcattcatgactactatcgcaattcccaaaagccctcaccaacacactgtatgaccgagatcttttggtcatattgagcatccaccacagagttaggtagagtgaccttactctagtcggcatcctatctccattcatgattactcttcacaatttttcatgcgtcatgaccaacgacaccatgcgaccaaggtcttgtggttgttttcaacattgaccattgttaggctaggttggagtgaccttactccaattggtaccacatcctaaattcatggctactctcacaattcccatgcgcctcactaatggcaccatgtggctaagatcaaggccactcttaggtgttgcatgacgagtaggttcccaatttcattttagggtcaaaatgtgatccttagcaagatgcaaaattttatgaattttgagcgatatttgtgaaatccaatttatttcattttgaggaaatatggtttcttttgcaatggaatttgatgaaaatcaaacaaaattgtgaacccaacctataagtctgcaatacttattttaaaggattctttttaaagattatcgatctattttttttattattaccaagaagagattaacattcaccaatgggaattttttttggattaccagttgtagttaataagtactactgaaccggaatagcattctattataattcgaagtacatcatgttactcaaaacgcattacaactttaatccgcttcgtctaaattgatcgcattgtgctccacaccatgtctcccattcatgactactctcacaattcccacgagccctcaccaacgcattgtgtgagtgagatcttttggtcatatccagcatccaccacagagttaggtagagtgatctcactttgactagcatcctatttccattcatgattattctcataattttgcatgcatcatgaccaactacaccatgtgaagaaggtcttttggttgttttcaacattaaccagtgattaagctaggttggaatgaccttactcccattggcaccacatcttaaattcatggctactctcacaattcccgtgcacctcactgacaacaccgtgtggctaagatcaaggcccactcttatgtgttgcatgatgagtagatttcattttcattttagggttgaaatgcgatccttagcaagatgcaaaagctcatgaatttcagacgagatttgtgaaatccaatttgtttcattttgaggaaatctgaatttttggaaatggaatttgattaaaatcagataaatttgtgatctcaacgtgtaagtcccaatacactatctattttaaaggattctttttaaagattaccgatctaacatttaattcctaccaaaaggagagatcaatcaggagcgacattcacacatggggatcctctgaattaaaagcatcggtcaatgagtgtgactgcaccagtagtaatgtagaggatccatgtcctccattcacccacacgaatgaacggaaactacattttattataatttggagaacaacatgttactcagacaacatgcattacaacttaatatggttaatccaaatcgatcatattctttagactacttgcgccagggacgtgactatatgagacaatgatactagtcactggctcacggcccaaattggtgggagaaaaaacaactcactttttggttgttttcagcatccaccgtagagtaagataggctagagtgacatcactccacttggcaccacgtctaccattcatgggtactctcgtaattttgacaggtcctcgccaacgcattgcgcaaccaagatccttttgtcgtatccaacatccaccgcaggtaaggtaaagagtgatcttctatgcatgattattcccgcatttttccatctaccctcaccaatgataccatgcgaccaaggtcttttgatcgtttttagcatccaccgtagagtaagctaggctgcagtgatctctcttcgcttggcaccacttctccaatgcatggctactctcataattcccccaagttcccacaccaatggcatcgtgaggttgagatcgaagtcctaggcaacatgtgacgtcctacaggcagggtttccaatttggtgtcaaaatgcgagccttagcaagatgatgaattttgtgaatattgagtgagattcatgaaatttgggcaatttcatctaggggagctccaaatttttggcaacgaaatttgttgaaattaaatgaaatagtgaagccatcccacgagtcttggtgcaatatctttattttgatttccaaagatcaggaccttacacttaattcttaccccaaagatcgattaggagtaacattgatgaaatgggatcctttgaattactattggtgaaagtagcactcactggtatgtaggccggaaaacacatgttagtcgtggggattgctatctagagcagctgtgttttcagcacacactttcatctgaaaatgttcatccaaataacttttgtttgagaacttccattcgaaacactttcatctcacacattcatgtgaaaacttacatttggaaattaaaagtgtgtgctaagggcatataggaacacatctgcgttaaatagcagttatggtacttcaaaggatccattttcaacattcacacattgccaatgaactagaaacgacattttattattaattcgaaaaccaacatgttgctctctcagactaaatgcaatattattacaactttttaatctggttcatcaaaatcgatcacattgtttcccccacataaacttcgaaacccaaacatccctcttcttcactgcatgatttggttgagagcaccatggccaccaccactgcttccgccgccgccgccgttggtgttgctgttctgactctcctccatggcgtcggcggcgccgctagccatcatcgtcatcttcttccccgcggtcgcgcgccacgccgacgccgagtacagcctctggctatgccaggtgagcgtgaggaagccgccgttctcctggacgccgaagccggcgccggagaactcgcggagctgcatcgccgcctgccagaggccggtggcgccgagcggcagctgcgtcatccccccgcgccgcagcctctccacccaccgcggcatctgctcgtggcgctccacccggctgctcccctcgcggctcacgatgtcggcgatctccccctgcaggtacgcctcggcgagcgggttggccgccccgttgccgccgccaaggcgggtgaaaaccttgaccgaattgaacaaggaaggggaagaaaaaaaggaagtaa

SEQ ID NO: 78773 - DNA, 1904 bp, Oryza sativa
  unsure (1)..(1904): unsure at all n locations
aactggaccgtacctagaaagatgaagttgagtagtagtgttaaaacacgcggnagctattaggcgtgtaactcggcccacggcccacgcccagcccccaccacgtcgtatcccctccttttttttcgtttttttcttttttcccgggtgtatttcccttttttgcgatttttttctccttttctgattcttttttttttcgcgccaactagcaagtttttaatcatgacttgaaatttttcaaatctggatttgaaagttttcgatctcgagttgaaaatttttaaatctcaagttgaaagttttcaaaattttcaaatttgaacttgaaagttttcgaatctttagatggaagtttttcaatcccaagttgaaagattttaattccgagttgaaagttttcaatcccgagttgaaagtttttaaaatctcgagttgaaagttttcaagtctcgagttgaaagttttcaaaccctagttgaaagtttttaaaatttgagatgagaagttgaaagttttcaaattttgacataaaaaattcaaatttcaagttaaaaagtttttaaatctagattgaaagtttttaaaatttgactttccgtgtagatctgtatttaatcttttacttgaaaaaaattaggacacgaaaaattaccaagaaatcaaaactagttatgacgctaatcacagcgttaatcgtgtttttattccgcgctaatgacacgtggcctccccggggtgaaaatggcgaaaaaagcaaaagcaagcgatggcctgggaggttgggccgcgtgcgtgttgccggtgcacacgcgccaactaggaatctccgttaaaacatgggttgtttttttggaaaggccaaccaaaaacctgaaagcccataaccttaaatactcatgataattgataggaataagttcatttcaagtccctcaaaaccggtgcaatataggtcccatggcggtttggacagcggttttaactcacgtggcgtctattgactcgatctttttctgacgtggcattgatgtgacatatgaagcaaaatttaataatttaaaaattaaaaagaagggcccatatgtcaatgcctttccctcgtagcagagccagcggcctcaacaggggaatccagcagctgcggcaggaggatgaggccgacctatccaggcggagtcgtggcacccggaggagtcaggcggtgggggtggtccccctggtcgatggcggctgcggtcaggtccaacaacgacaagggatagcgagaaggcagccaacgtcccaggtagagcccggaggtgcggcgaaggggacgaggccggcgggagcaaataccggtaaccgagatccgaacaggacagcacggtggaggaaaagcagcaaagttgggggcgccgaagccatggaggctgatgccaacagtgacctgggtagagaaggtgtggaaggcgggacgcagcgatcctgctgatggacgacgcatgttggtgacagagatgagctgccgagagctaacgggggcctccaaatctcggcgatggtgcagacgagacagaatggagcagatcagcacaaatcctagcaatgctgcgaggcagcagacagagcgggatgtcctggagctgttcgtcggccgcacaccagtcaggtccaccgaaggcccctcctcgccggttgcccacaccagccgcgcactggtgagttgagttcactggattcagatcggtgccactccttacaaatggggctgtgccaccgcaacagggcctcaccaacctcaaggctctctccgtgctcggcagcgtcaccagnnnnnnnnnnnnnnnnnnnnnnnnnnnnnnnnnnnnnnnnnnnnnnnnnnnnnngnnatgagggtctacaattcacaaannnngacatca

SEQ ID NO: 78774 - DNA, 795 bp, Oryza sativa
  unsure (1)..(795): unsure at all n locations
atcacggaagcttnnnnnnnnnnnnnnnnnnnnnnnnnnnnnccgtgccagcgtcgcgccgcccaccgccggctgccgcgttttctgcgccagatccacgccgctgcggccacccgccgccggccgtcgcggggccgagcgccaaacacctccctaggacagcggatccggcccctcccgagggcggcgccactggatccgcaaccctcgtcgcctgccgctgccacccaccgatgtcgtcgccgcccatcgaagccgttgccgcagccgctccctaggtcgcggcagtcgagcccgctgccgctcccgcccgccgccgccacccgtcgttgcccgccacgccgctcgagcccgcccgccacccgccccgatccgcgctgctgtggatgagacgaagtgagagagagagagagagagtagaaagtgtgtgagagagaggagaggaagagaagataaggttggggtgaaaaaaaattgtggatttttttttcaatgtaaaaatcgattttttttgtatgtgtctgtttaaaactcattttaaggaactaaatcaacgtatatgaaaaagttgtcaaaattaaagttgtataacttattgagatctaccatttttcttttggtcatttctccatccgagtttgattaaactatataaaatttaaatattaaaatataagaaattcaaataatttttcggatagtaaatgatttcaaatgaaaaaattgtcaacaacaaagttgtataacgcattaacatctacaactttcgttttggtcattttttatatgactagg

SEQ ID NO: 78775 - DNA, 1595 bp, Oryza sativa
agaaaacttttgactatatatagtccaattgtcttggcagctatggcaccaaataatgttttgttgcgaataaaatgctaaatagaagtcttaacaatgccatggcaagtgcttgcatgtagaggtgactgagggtaaagcatccacttgggttttaaaaaatgcatgctttctatgcattggagattatttacagtgtcatatctgtaggagctagccgatatgggtgctttggtaaatggtctgcctacaaatgccagcaaatgtcaaaatatctccagatttggcaagtttttaaggtgcaatgggcagaagagcacatgtgggttgtatgcttaacagcatgtctcctcaactgtaaggagttcatatgaggcagcataaaaacatgcagactgaggatggtagcaagagctgcacaagatactactagacttctcatttgatctacacggtattgaggcgcccggcatacattgcacgagggtgtggtagtttttgcacactacacacaaagtatgcagtggaaggggttagccacagtttgcaccttgagggttctagcagatataaacaacagcataatgaaataacaccagaacagtcaaagtagatgaagcacaagcaggaagacagcagtacaaaaatcaactgatttaaaaacaaacatggagactttatggtttcacactttcactaaagcgtacctccggaagcgttgggtctgaacacttcgcttggccactccaagagtgtgtgttattttgacaggctggagcgtttattttatcccgtggatgaatcaaaactgatccatctgcaacaccatgaatggttgtgaatataatgcaccgcataaccaaataatacaaagctcaaacacaataataggcagacaatcaaatttggttctctcatcaaaccactgtttgttgtgcacaagaaacaagcagaacacaacacaacagagcaattttgcaagaccatagatattttttgcaaaggattgcccccgaattttatgaaaatttgttcaaccaagcagaacaaaacacaaaatttctacaaacagaaaaaatggttacaaatactatacgctcaaaactgcagatattttgatcaaactatcacaaatttacagattgaaggtgttgtaccacgaaactacagatttgaggctaagtatatatcagaactatttagtaaaaaaaaaaagaagaatcacaaaactacaggtttagttccaatttaatcacaaaacagcaacgtttatagcccaaaaataacagtagtgctgaggattaaactctaaaacctatagtttgtgataacatcaatattaaatctgtagttttacgatactttgccatatatatgtagttttgtgataaatttagtgttaaacccctagttttgtgataacacttcaaatctgtaggtttgagataatttggtagttttgtgaaatttacacgaagagtgaaaactaagtaaactactgcttagataaaacaaaaatcagtaagccgccgtccatcccccaacgcgcacacatacaagattttccccagagggaaacgatccacagaacatct

SEQ ID NO: 78776 - DNA, 15003 bp, Oryza sativa
caagaacccagattgttgtggtgacagaattgaaacttctgaatatcggcaattcagtcagacgaggtaacggagcactcatatataatcaaaagtcataaaaagacccctcgaattcagcttctgtcatcaaatcaacagtttcaaaattctgaaaaacggtgggttagttgattgtgccagcagcatcccgcatccggacccaatcctctcgatctcctccggccatctgtttccctccctgctagtcaaacgcctccaagattgctcctgccgctgcaagaggaaagctgcttccttaggggcttcgggctgctacttattcactggacatcaataatcgaacctatagaagaacaaacgatacaagacagtttagtttgtgataaatcgtgcattgccaagcaatcggcatacgactactatttatatcaaagataaatatctgcattttgcaaagctagctgaaatcaacaaacatcgtctctgatctcaaaagaaacaacatctatcttagcacgacaactttatactctacatagccacaagaggagacaagagtacaacgcacggtaaattaaggacatcttagccagattaccaacaacatacctcaccatgacaaactaaattgaacaccatcaccaagcttcaccagaggccctccattgcggcagactggcagctctcttcaacaaatttcttaacttggttgctggtatctcaatcttgaacctaaatagataatgttagaaagctttctaaaagtatgaagtgttagtgcggctaagcaatgcatacagctcaagatgacaatactctggcctagaggcgacgcggacaagaagctagctgggaagtttccacagaaaaatgtagtttcttctgaagaactagatgaacaaacaaacattactaagtagaactggacactacatgtacatacaaaaataagacaaaaaccaatcatgcaattgactttgaagataaattactcagtcacattagaatatgcctccttgtgatctacttcttgaatattgagggtaacttcagtcaggagtcgcatgtaaggaaaaattctatatacagcagttctcctccatcacttgatcaaaatagttaacaaagacattggttgctctgctacttagtcaacaaatccgcaaatgggaaagcaatagcatatcctcccttgttagtcgttaaaataattcacatatttacatcttttaactttgttcttcaaaaaaatgattgcatttccatgtccatgtcctaacttcacttgtcctctggagctgcgactttaatgactctctggtcccacctcaacatttatactcagcaaaaatgctcttgaatcacatatatggccaatcagctccattcagctgattcacgaggctttatgcaatcgacctttgagaaccacatattatatagtttttttttaagaaagggcaaaagctttgccacttttatattgacatattatatagattgaatcaccaatagtcatcacatgagcagactccatcttctatacaatgaaaccgaacagtgtcccttacaactattcttctgcctgtggcaagtgaaatgagtttgatggcaacatggcaatcatcacatatcctgacgtttttcattatacgaatagcttctcccttgggggtgcgaataaggccaaatgcaagagctaatttctcactgtgatacataagatgttcttccttttgttcatcctcaacatcatgtagggccactgcaatgtttggaacatatccaatcacttttatcttgtctatcagctcttggagttttttggtgatctgctccatatatgggtgttttttgtcctcagatgtgaaaacatggacctcactacccacttgaatccaactaacaccaggctccttcctaacgcccaactctctcatcagcctccgaaccttcacgacaccatcccaccggtttgctttcgcatacatattagaaagcaaaacataggttccaacatctttgggctttaactgaaaaatctgttcagctactcgatgaccaagaccataatttctatatacttggcaagaacttagaagtgatctccatgcaacaacatcggtaccaatgcagttactttctatgaatcgttctgcctcgtcaagccgtccaactctgcacagcaaaccgaccatgcaagtgtaatgttccttaccaggttttactcccacttccttcatcataatattcaggtagtagaacccttcatctacaagacccaactgagcacaggctgacagcaccccaatgaaagttacataagatgggacttcttctgcaaacaacatatcatgaaatgcttccatggcttctcttgcacggccatgatgagcgtagccaatgatgattgaattccaagaaaccacatcacgacatggcatagaaaggaagactctccgtgcatcctcaacactgccactctttgagtacatgttcatgagggcattacagacaggcaaaaggccccaatgcccagttttcatagtacatgcaccaagggcattaccatttttcaaggtggcaagaccagcgcaactgttgagagcaacagcataagtgaactcattaggccgaactccttccatttccatatccaagaacaactgcaatgcatcttcaaacagctcattttgtgtataagcagtcataatggctgtccaggaaacaatattcttttctggcaaaacctcaaacacgcgattagcttcatggggaaagtcacatttcccatacatatcaacgagtgcactccccacatacacattcagctcaagcctcctcttcaacgcttgggtatgcacctgactcccaagcaccacctctttcgtgctagcacaatgcccaagaactgcgacatatgacacatgatcccattgcccgacatttctcaccatgcttcttactatactggtggaaccatccatctggccccgatcaagaaacccatttatcattgagttgaacgcgaatacattaaaactggaaacattatcaaataccttcaccgcttcgtccatgtgtgcacattggcaatacatatgcagcaccgcactacaaacgtaagggtgctctgctagtccagccttgatagcatatccatggcactgcctccccatatcatagctccggacatgggcagtcgcggccacagccgacgacagcacgtactcattcagaccaaagtcagccaccctgatgagcgcgagggcgtccctgtggcgcccggaagaagcgtacccggacatgagcaggttcccagacacggggttcctggagggcattgcgtcgaacacctggcgggcgaggcctagtcgaccgcacttgacgtacagggcaatgaggttgttgtactggacgacgtcgaagcgcgcggccctgacaaccctcgcgtgaaccgccttccctaacgaaagctcgccggcggcggcggcggcgcggagcacggcaacggccgcgcgccgctggtcgaccgatactcccatagggcaagctcgggcggccgccatgccacagccgtccccgtaaaccccccacccctcccctcccggcgtgctcaagctcctcagccggcaccaccggagttgggaaggaggcgcgggggcgccggagttgggggggagcaggcgcgcgggcggcggaggtgggtccccttatcctgcgcgggggagccccagacaacagcagagaacaccggagctgcgaggaatggtggcgcggccgccggagttggggaagaaggcgcgcgggcggcggggtttaagcagagccgccgccagccgccagagagaaggtttgagtgttttccatgggcctattctgtgacctgtctgttgccggctggactcggcctactcctcctacaaggcatcgtccttcttttcttgggcccaacgccatttcccggtattcccaaatataatgagcattaatcctgtgattgccatcataatcgtcgtgttagagcaaatttaatagtatagcccactactaacttcaaattatctataatcaatataataaccaattaatacaacagttgctaactatactattaatacctggtcctacatgtcatacacacattatgtcttatagtctgtactacagctgactacagatctatagcatgctgctattctctctcttcctttatctctttaaaatacatttattgctggcttataacctgctattattgtacctgctcttacctatgctattacttcgttttcttctacttcccccatcccaaaatgttgcaaccctggaggtaggggtgaaaacggtacagaaactttccggattccggacctattttcgaaaacggaatctgttggtcggaattttttcggaaactgaaacgaattcggaaatattttctcggatacggaatcggaaatgataagggcagtttccgtcggaactcggaatcggtcggaaactttccggaaattttcttggaattaccagaaattttgtgactgaaataccctaaattctttttttaagcactaaatagtgaataccatggtgtttggctgttattttttaaaaatatttgttatgcaaatctaaaattacataagaatatttttttttcctatattgggatttatcaacaacattactcttttaaatatagataatttattcaattggatttatcagtttgaggggttttttattccgataaattttcgttaccgtattcgcgccggttcgttttcgctccgttttcggtttcgataatatttgattccgttttcgtatccggggtttccgattccgaaaaaaaaatgtgaaaacgaaaatgataaaaatggtttccgtctgtttccgtaccgttttcacccttacctagtagccgccacagaacaaaagaaactagtgctcgatgggacacaacctagtactatccagattcacattaataggataggaaaatgctacgcatacgatctttttagtacgatcttgttacgataagacgcaacggcatggatggcagcggaacgcacggcgcggacggcaacggcaaaacggcacgcacggcgcgcgcggcagtctaagcgtacttatgggccctaaagcccaattcacctctaaacctgactttacgttcactactccaaaccctaaatctgactttcatgttctgatctaatctgcaagtgtgaaactaatccaatagcatacgcatcgaagacgaaggtatggcatcttatttacttgatattctttagcttcacaatcatctttttttttacattattctctctttcttttttttcctaggcaatgttcatggccatgaaatgctttctttattattatggatttaatctaaaattttcctttgcaaaacatatgccattatttttaattcaatctgaaactagggttaatgttatcactgtccaaggttcaaggaacatatttgtatgcgtaatttgcttaaccatgccacatgataaattcaatgttgagtgctaagtacgattactatatacagtaagatattaggaagaggattgcttaagatatgattgaaaagaaaattgctttggttggctcattggctgtccaagtaggccaacaagatagcaggccaggacgtcaggagcttgggcttggatatgggatcaactgaggcctgagggatccgtttgatcgtacaaccatcgtacgaaataattcgtacgtatagcagcgctgaataggatactactacgtcttaactagtactacttctgactcaaaatataagagattttagagtgatgtgacatatcctggtactatagatctaggctggcttcctgtctagattcgtagcactagaaaatatcacatccctctaaaatcatttatattatgggaccaagagagtattgtattgttatgttttgggacggagagagtagtattcatcttcgagttttaaactcttcttttttaaagaaaaatgtataaatatctgaatgtatgctatgttaacgagagaatgtatcttattacataagtcttttcgtttacacactatgcacgccaactaaaaaatatcataaaaaattatacaaaaaattgtacatgtactttgattagtattgcatctatgtgtaaagtaatcatcttcaaattcatagggagtaaaaaaaaagacaaatttatacttttaaaactattaatttttttcttttattggttaaaatataatgaatttaaggttgagactttacaaataagtaaattttattggttggtgtacacgagaagacttgtgtgcacagggtatgttacctgttaacgaagcatgcagcttccttaatacaaccataaaactttcgtacatcaaccatctaaccattcaaaatttatttatggtcaaagttaaaattacattagtctacagatatttcaaaaccgaagggaagggaatattaagggctcatttgacatacatggattatatatatatatatatatatatatatatatatatatatatatatatatatatatatatatatatatatttatagaattcagttcaataaaatctctcaaaattgatccattccagaggaggtatatccagcagtaattgtcaatgaaagatatagcattcatctcaacaatttgttcattgttcggtggatctctcatccaactttcatgattgcaagacgaagttggagcctcagttggaatccatgcacaagtgaagcgaagctctggagatcccttagttgtagggaacatatcaggtgcacatatctacattggtgaacaaatgcacaaactgaaccagtatatcttagcccctgtagtctcttcttatacactccagaaatcaagcaaaaggtagcaagagaacaaaattttcctattataaagatggcaaaaaggatatatattctttcagataatggaacagaaaaatcatatgatataggcattggaactatttttccaatccatgaaaagggagtatattgtcattagtctttccagccatctttggtagatctccttgaagctagacctttggatgataggttgggcatatgtctggttggcgtcaatggcgcctcatcatcccactcgtctccccagttgtcatcccactgatcagattgatctgcttctttcttccctccagtcgaaagaggaagctccgccgcatcaagcttctggtatgcaggtccaccatcttggatacctcttctccgaagtttaatgcatgctaccacagctccaataagaagaaaaacaggcactaacatgtattttgaggtaagccgcattggcattacttgacttatctccctcgcaattgctcggtgaatgctaatattgcaggtctcttcagcaactctaagaattattgtcatgtttggtgcaccgttgttaaaaatagtcacctgtgtctaaattaacaatatgaaaataaaaaagaagatcagtacatcgattgaaaacattgaaacagcatgagaaagatccagttccccttgaataaaagctgataagaacagcaatagtatactgacattctgctaatcctgagatacactatcaacaagaactcaaaataagctaatgcaattatgcatgtatataaatcaatatgggaataacctaccgcagttcacgtgaaatatataactcacgaaccaattatatgacaaaacataaattaatgacaccatgaagccaggatcttggtaaagagcaactatccttctataagcttgcaaaaaacagctactctattttgaaacaacacatacagtagatagtacatatgggaaaaaataagccagaaaacctgcagtataatcctctcaaaagctcgctggaaaaactttcatatcaataaagaatataaaagacagtctcttctgaaataacatgtgtggaagtaacaccatgcaaatattgcataaagaaaagttaagccagaaaatctcattactataattatcttcaagatactcatttgcattagctcacctcattatgatcatttgcttggacatggatggtgtcttcagctgaagtgacaaattctggagttgtaataccaacataaagtgggtccatgcctttgttgtccatcagaagtgatagagctaatgaatctgatttcaacggtaacaagttatttatgtgcaaaacatagaaaaatctaattaataagaactaacacgactatatccatatgtgatgcaaaaccttcagagaaaaaacaatgaaaatatatctttgcaaagtattttttaggtaggtgataacatcacaggtacttttgcagaaacattatttgcttaaattcgtcaggggcaaaatttgcttgtgatacagcagttgtattgcatattcaatttggtcccagacattgtgtttttggttagtatagatagctccaactacgcaatcaattgtcacttcatcagcactagtcgtggctataagttgacaatagtgaattgcaattggtcaaaaataattgctgactggggaaaattacagttgcagaccaatttacgtgtcaatctttttatcaacaaacccagtatttggtagcactaattaaggcaaggtcaaatcaaagataaaataactgccataacacaatttgcaaacgatctgtcaaaaaggaaatgagaacttttcgtgaagacaggtatactgctatactacaacaatgatggtgcactaacagagattagagaagactagttgccgagaaaatcaccttctccaggaactttcaagcaggcgatgaactttttattttcaattacacatgtatgagatgggtcacaccccttgataagaggatcttgtgagaagtctgttacatgcgaggattttgctgtgttgatatctttatccacatgatgcacagctgccgcatattttgccgtgctaataacttctgttgatttgtccttcttgttgttcccatcagggtcattctttccttcatcatgatgtactgtattaggatttgtttcatcatgccgtcctgtcttcccaccatctgaatgtgctatgttgttgtcattatttttgtctgcttgtagaatatttgttttatcctaaattcaaaatgaaacaacatatcagcaacaacaatgaaaacaaaacagattatggcatttgttagtcactggatcgaattaagttttcatggtaggtattggtgaattgagctttgactgaccatcacaagttaagtgagagcaacgaaatctttcatgcgacttgagaatcacaaataagtgcacgaactctagagtgcacaaaaaggcgatagagatgcattgccgatggattgaagcataaacagctaccatcaccagcaatgatctcgccatctaatattcaagtcatcccaaatacagaagggatgacagcttttatgtttcgtcagaactaaaatgagccaacgtaagcacaagttaattagtaatcagtaatcattcaaccaagtcgtatataaatctgtgcatctatagccatctatctataccttacttgctccagttacttaatgcaaataatacttacaaatttggaagatattacaccttacctcttctgcggctgcagcaataacaagcaggcaaaccagtgggagcagccgcaggccgcaccaccgcatcccgccggcacagcaacagcagcagcaaagctcgcactgccccgcccccaaatccaacccaacccaacccaacccgagctggtccgcaccgcgcgccgccggccgggccggagatccgggggcagagcggagtcgccccaacccgcgtgcctgcgatagctgatgggttccccggagcccggaggagacgaggaagaggaacgagcagccgcggcccgcagcgacgacgagcatccgacgagaaagcagttgggacttgggaagggggaaggaaaccgccaccggcgactgaaaaaagaaaaaaaaaagatcgcgcaaaacgaagacggccgtgactgcggccaaggaggaaaaaaaaaatgttctttttcgccggccggtaacgcatcactgcaagattcagtgcagtcctaactgggaccgcaagttaggaactgcgtatcatcttagctatccattttttcaatgaacggtctaaatctgatgctatagtgttgctgtcacagtagttctacagttttttaagatgtgaacagtattttatagattttgaacccttaaatttacatcaaaaggtactaggtgactgcttatgttgcagtcacactaggtactgcaccggatctaaatccgtctgcatgtgtccaaagggaaaaaggcaccaaattacttgcagttgcaggcttgctgtattttcttaatcactggttgattcagtgtaaggaataaacatggtgactgtttggagtactaacaccgtgtttagttctaaaccttttttcaaactccatcacatcaaaacttttctacacacataaacttctaattttttcatcacatcgttccaatttcaaccaaacttctaatcttaacataaactaaacacggccttaagttaataatcaccgaaaaggacatcattagaccagagtttttggacttggtgatttactctagtggctctcctttgattttttttagagaaggttattttctacccgacctccatatccaaccggatatatacagccattgagatagggaacttagccccgtaaacaacctaatctgaaattcactccatagaagattttaactcagaacctcgtactacttttgtactactcaggctctcctttgatggggcagtatattactctctccgtttcattttaagtgtaaccatgagtttacatgtccaactttgatcgtccgtcttatttgaaattttttataattagtatttgtgttgttatgagatgataaaacatgaatagtattacttgtgacttatgtttttatatttttttaaaaaaaatttaaataagacagatgattaaagttaggcgcgtaaaatcatggctgtaataagacggagggagtatcactgtatcgtatatttggacacaatcaagcaagtcagtactgagaaataaaaatgatctgtactgtaaatgccaagttaagtacatcagcacgatgtagcacgttgtacttttgtaccgcggatcaggtgcagattcagggaatgattgagtagtctgctctacagccattcactggtgggctgggccgtgggcttcccaacggtccaaggtcgtgcactgcaggaaatggggcccagcccgaagcataagtgcaaacaacagcccaggtaggtggcacacccgcgccactggactgacagcaagtgtgggtgaaacggaagaggaataagttcactttaggttcctctatctgtcggccagtccaattttcgtccctgaacctcagaaccgggtacgacccgtcccccaacttatgaaaaccgggcacataaggtcctaaggcggtttggatagcggttttggctgacgtagcgcctacgtggctggtttgactaggtctccatctcacgtggtactgacgtggtgcttacttggcaattcaatttggaaaaatataatacccatgagacccacatgtcaattacataaaaaaataattaataaaaataattaataaaaggtgggctcgcgtggaccccacatgtcaatcccactcccatctccttcctcctcactccccgtctccccttctcttcgtctctctccgactctcccccctctcctctctcttctcctctctcgggtgcgacggccggcggggtggacggcgtgacaggcggcgaagagatgggtgactgccggcgaggaggatggcgcgacgggcggcgactggcggggagaaggagcgcccggacgggcggcgaccggcagggagaaggggcgccgggacgggcggcggccaatagggaggacgaccgacgagcggcgggcggcgcgcgtgatgacccgggcggtggtgggcagtgaggaggtcgacggtgggcagtgaggagggcagctgccggtgcccgtgacgaggatgagccgacgagggctgggcggttttgacggtgggcacctcgggcgctgccgctccaccgcctcccccaccttgttccggtcgcttccacccggaccaccccggccgaagcctgcagcttgcaaccgctgcggcatgtccggccatcgcctcgagaactgcccgctggagcgtcgtttcctcgccaggctagtagccctctgccagtacgccatgcccgccgtgccggaatctctgcgccgcactgcaagtcttgatcaccatgctgtagtctgtcgcagctaaggcgtcggtcgttgaaccatgacacaccgaagcctgcccgtctcaccggctgacagagaaatcactccttcgctttcacccaatttcagtggctaatctgaagaactctgatgatcccagacggtgaacagtgaactgaaaaactgagtacggagaaacgaacagagtgcaaactcggagttttgggctgcgaattacttgcagcatttgacaaatacgcccaagattgcattatttgtaacaccggccccccaaagcctcgtcgcgctccacacatgtcaacgtcgagcctccagagctcgagccttcggacatgtcaccagtgcagcagcgtggtgttcatgggcgcatctcgtaccaggtcggccccgtcgtgtctctttgactcgtcgtcgacaaggccactggcaaaccgagggccttcgtgttcgtcgagtacctcccacaacacctgccgcaacctcgaccgccacgcctattgcagccgcgtgctccgtgtcggcctcgccgaactggaagtagcagggcgctcgcgcggcagcggcgagccgcacgagctggtgggcatcgaggactccacacacgccgcatcgctcgtgaagggggcaccacccagcgccgacgacagctgtggagacggtgggcgccgtggaggcccagggagacgtcacgcgcaccgctggccgcgtcgccgttgtcccccgccggagccggtcgcccccgccgccgggctaagtgggtccctctatttggtcgcctgctcggccgcccacccgcgccgccggctgcccgggaaggagagagagaggggaaagggaagaagagatgaggaagatgaggaggctgacacatggagcccacgtgggccccaccattttaaaattatttttatgtgcagctgatatatggggccacactttttattattttttcgagatatacttgccacgtcaatgccacgtgggacggagaactagtcaaacaagccacgtaggcgccacgtcagccaaaacagacttcaaacccgttgagggacctcgtttacccggtttacataagttgagggacgggtcgtacctggttttgcggtcagggatgaaaatcggactgggcgacaaatagagggatccaaagtgaacttattccaacggaagaggagaaggcccataattcatagtgggccgtacttgaggactggcccaaattttgccgttcgtctttgcattgcaggtttttctctgaacctgattcggctcttgccgctcacagatccagccagcttctttcaaggcgaaactgatcaatggtactgaccaaaatatgaatattttttttattttttcatgaagtaatgaagagaaaggtaaaattaaataggtggactagtcgtaattggttaagatgaaagagtaagtaaagaaattaaacaagagatacattgtgtttgattgagatgaataagtatgccaagaaattattatattttgagataattttaaaatgctagaaactgctatatcttcggacgcagagcagtagatcatttgtcagattggatggattgtgctactgtacatgcatagtgtttcagactttcagcaggtggagcaaaatggattcagaatgttgtcaagagttttacctattgtttcagaaatcagaactccaattgcagtctgcagtctgcatactccctccgtccaaaaaaaaaaaaagtcaaacctggtttcctaccaacgtttgactgtccgtcttatataatttttttttataattagtattttcattgttgttagatgataaaatatgattaatgctttatacgtgacttatctttttaattttttcataatttttttaaataagacggacggtcaaacgttagacacgaaaactagggttcgtcttttttttttttttttggaaacaatacgatcatctttatggtctttgattgatgaaccagcagtggcgccaatccatccgtggctacaaaagcatgtccacgtaggacaggtgggccccaccggaagcgtctctatttaaaacctcgcctctcactgttcagtgttcagtgccaccaccatcttcttcttcttcttcttcttcttcctcaagactaccaatccaatctcctcctcgccgccatcgcgatctccgccgccgcccgcctgtcgcggccatggcatccaccaagatcaaggtcgccaaccccattgtcgagatggacggtcagtctgatccctctcccattttcccctccctacacggatctgctactagtctccaatggattccggcgtgtcctcaattcgtcatgcgtatcgttttgcgactctgtttgagcttatctttagtctaggttcagtagcgtgccacaggaagcctctcggatctactagatcctttgcattgtgcttggtttggctagaattggggatccgattcgcgatgcgagtttttttttttttttttgaggtggtcgagtgctcctctcgagatatggcacattggcactcacgtgcgtttccggattggattttccgttcgcaggtgatgagatgactcgagta

SEQ ID NO: 78777 - DNA, 6464 bp, Oryza sativa
  unsure (1)..(6464): unsure at all n locations
tggaatannnnnnnnnnnnnnnnnnnnnnnnnnnnnnnnnnnaacttcctaacactcaaaagcaaacaaacgcatgcacttacatcccaccactgatgtaaatcacatgcgagacacacacaaccaaacttaaacaaacaaaccaacacaacgatctaagacaacagcttgacaaggcactctaggtcttccgggcatcggagttgattgaaggctcgttcggctcgtctccatcatcttgagtagctccccactcgacctttgaatgggtgcgcttcgattcttctccttcatcatcacttacattgacgaccggaggatccgctagggctagggtaacttctttctccgccacacggacctttggcgccatttggtagcgagggacaaatagagctctcttccttgccgtaagacgaatcctggccttctgcggtggtgcttctcccttcaacgcggctagttccttctccaaacgatccaccttgtcctctagcttgcaaatcttaccacgattccggtcttcacgatcttgagctgctaacacagtctccgcgcgggtctcatccatagcccacagcatctcaaccaaatgccttgtggtagcatcattctcaatcctctcagtctcaaggtagctgccacggtcacttccctggggttggcgaggatggtagcgatactcagtgtcggccaactgatcactgtagcgatcgcggagctctcctatggcaatccttgccacctcctgacatgcatggatgtagtttcctcctccagcttcgaacatcactgatgggatatcttcactattactgttcaaggtgactttgactcggcacttttcttcgtgacgatcatgagaaatctaggcatacaaaggggcagtcccaaatcctatggcaaaggacatcgtacgcaactcctggacaaatccctcaacaccaaacaggtactcaggcttgtagcgcggcatctaaagacaagtgaaaggagggagttatgacatttatccaattaatagcacaagtttttggattaagtaaaaggtaagtaaataaagtaaaccaagcttgcaagataagttgaaacaaggtcacaaattttgtacttttgaacaacagattccaaaagaaaataaaagaaagttataaaatcaacatgctaaatttatttcattgcagcaagataaaacaatgttgtaaaacatttgctggtaaatgagccattagtaccgtaatagatgtacagtactaacaacactggaataacttttgaatgagaaccactaaaagagattatgaagtgcatgtgctattagtttggtttaattaaaaaaaaagaaagggaggagaacagttctacttttccaatagttttagagggcttctatgggtaaccatttggcataacctagggtcaaggggctctgataccaacttgccacgcccggaatttctatccaaaattccaaactcttatatgtgtgtgaaccctcgtccaagaatcagccgaggcacacaataacaaattgataatagagtacaattattactctaattaataagtgaataaaatttcattacagaggtagatagttcctctcaatcaataaagatctaagcagcggaaaaataagataaacggcgcagacgactccactccacaggcagcttgaccagggctacacctaatcctccacaccatcagcatcaccgtagaactcttcctttgatgaatgattgcaaggtgagtatatgacatactcagcaagccatgcagcaaatatgcaagtgcacaaggataccaaagaatggcataatataggactcattngcaaaagcagcatttagcaaacatttgagaattataaaacagtagagtaattaatcatcaattttaatcaacactaaacagcacacccatgctgctcaggcccaaccatcctgaacaaccataccgggctgtacagatctatctccaaaccaggaatataccattccaaaccaggagctaaacaaattattaccagttatagcatcttttattacggtgagaagtgtgaaactaatcacgaaagacattgttagacccgcccataaccgcgggcacggctattcgaatagttttactctggccagacgtgtaccactgtacccacagcgacccccgtgggcttatctccgccacttctcagtctggtgctccgcaatgaaccatactatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaaattttagttggcaagtaattaattaaccaatcacgattggccatcgtgagctatcattaagccatcattaaataatagtgagtcataagttatcccaatagtgtgctaatgtttctatgcatggctaagcaatcatatctaatatctagcttaaccaatatatatagcacaactagtcaagttataataacctaaggtatcaaggaataaagtaatcaagaacaaaagggctataacaaacaataggttaattccacccaatgacattcgaaaataaatacaatagttgaatggaaacaatagctttaaacgggatcaatatgctcaaagggttgtttggaatgtgtgtgacttgccttgctggccttggaactcttcaaattcttcttctgcgaaaacgaactctccggaaacgtcggaatctaaacagaaaggagcaaaacaccaaaacagcacataaacaagcatgaacagtacatgtggatatttttaacatgtagatttcaattttagaaaaatttagagacttgaaccaactaaatccgagctaagatgaattagttatgtatttttaaaaattaaatcggattaaaacacttatatgggtattaattcaattatgacgcaataatgaattatttttgaaaaggaaaagggcattattgcgtcagcggctagggttcgcggtaaaccgggtgcacggcgacggctcacgaaaacaaacggcggagatcgatcctatccaaaacggacgcccaagatcgatggacgacgacgataacgtcaccggtgacgtcaccaccggcggcggctcacggatggacgacgacgatgacgtcagcggtgacgtcaccaccggcggcggctcaagcgtgcaagctcgccggcgaacgacggcgcgacggcacgaacggagggcaccagcacgtagagggcgacgcggcgaactcaccggtgaccaaaacaacggcggaagatccaagaaaggagacggcgtcgagaaagagcggcggcgacgattggcttgacgacgacggcggtgttccggcggtcgacagcgacggcagaggggcggacgaggacggcgacgcgacggcgaccacgatggcgacctccccgagcgacggcgacgactggagcgacggcggcgcacggctggagcggcggcgacgacagcggcgcgaggtctcacggggctagggcgctacggacgacgagagacgaaggcaagggtggcgacgggtagcggcgggcttgggggtccttatataggggttggaaggcggcggcgaaggtaagtctagggttcggaggagagagatcgatccgaatcgaactcgaatccacggatttccaaacgaaattagccgacgattccataagagaatagatagaggggatcccggggatcatttcccctctattaatttcatcggaaacggaaaggggcggcgcggctcggctagggttcggccgggcgacggcgcgaggaagacgacggccctgacaggtgggccccacctgtcagcggcgaacgcacgcgcgggcggactgggccgactgggccgaggaagagagagagagggttttgggccgactttcggcccaaagccaaaagagaacttttaaaaccttttctaatttaaattattcatgaaatgcaattccatttattaaaaatacttccttagctcaaataaatcccagaaaaatctaggaattatagaattaagcaaagtttttaatgaaattttatctggccccattttatattggaattttttaattaaaattagatcttctcttctaggcttttaaaataaattctaataattccaattaaacaacaatttatatatttaggatttttagggtgtgacaaatagtttatattattgaccgaatacaatagatcatatataaagtggtataaaattaaaactaatttaaaagatgatgtttagagacctttgatttgatattttaatatattataggtctagcttaattgcatacccttccgtacacagtatattgtgcagtattatattttctttattttttatattatacgaaatctattttagacggtcgtgttttccaccagtaataagtacgcatttttttggctttattaatttttatagtacgtagatgtttttttttcttccggctaactgtaggaagcttcatttgtcttactaggtgataccccgcgctttgctgcgggattcactgatgagtatatgttaaatattgtcgaaatgatgaaagttgaaatgttgagaagaaaaatgtgagaaagatgatttgacacatacttgtggatctttataatataatattgtagatgatatgtaatgcttgtatgggatttaaaataggctagaatagtaattgctagtgagtgaagatatggcatggttgcatgggattttaaatgggctagaatagtaattgtatgggattttaaatggactagaatagtaattgctagtgggtgatgatgtgacatgcttgcatattgagttttagttttaatgggtactaactataaagaaagtacagatttttttcaattgtatacttgcgtacattcttttatgttttctttccttttcccagccaccggttccatattttatttgtaaaaaaatgtatcacatttttaataatagatctaatatggtttaaattagcggcctagaaatatttgtgggagtgccacgtggtgacaatagattttttaaaagtttaatggactttttttaatatataacagatagatagatagattacacgtgctactttgtggcttgtggctactaattgtggtgcatataaagcatgcagttatttttttttctttgggattatatgtgccgatcctaacataaaaccggaacatataggtctaccgtagatgcgctgccatgctataaatactgcgacggatcatgcaagatttgccatccaacaaaacgtgggtagtgagtagcagtagtagtattcagttgccgtcaatggaggattcccctgtggcagtggccatcccctggtttgccctcgctgccgctacggctgtgctagcaggagctgcttggctgataatccgcgcatgcaaagctgatgaaagctgctgcaggctgccgccagggtcgaggggcctccccctcctcggcgagtcggtcgagttcttcgcccggagcccatcccttgagttgcttccaggaattccgcaccccctcgagaggtgactgaacaatattatgcgtaatagtttgtgcgttccttcacatttcacttttttaagcttttcggtggcctccaacgtgcagttatattaattgttctggccttgcatatatatgggcctctttctattaatcataggctcccaatatactccatcggatggcctaatcagctaaagaaaaagctaaattttgaatttttaaacttaattttgagattgattttaagatattttcaatgtagtttcttttttagcattggcttttgagtcaccaagaacacatatataaaagttttacttacaaatgttgaatttgcatgtgtgaattattggcatgtccatgtggtgtttttagattacccaagtactatattaagtcacataaccaaattttgggacttatttagtcaataagaaatgtgagggactaaattgactctgaaagaagaaattaaagttcaaggatcatatatatagattgttcactctataatctaatggaccctaagagcaaggctaatatctaagccagctacgtgctagctctaattttatacatgtcatatataaatagctcaagagataacttttacaatagaagctctatctacttaagcatattttacttagaaattttattttattatactttataggaaaaagtacgaattaccgtactgaactatcgcggtcgatcgaattaccccataaactaaaataccagatattttatatcatcaactatttaaactagacaaannnnnnnnnnnnnnnnnnnnnnnnnnnnnnnnnnnnnnnnnnnnnnnnnnnnnagctataggttcacaaaanggnnntcaaangcccg

SEQ ID NO: 78778 - DNA, 1055 bp, Oryza sativa
tctggcgccgtcctcctgccaccgtggcgcacgcgaaccgacgtggcaggagaagggcgccagccatgctggcgccgccccaggctagcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgttaaacataatacactctaccactatatgaaattacttaatctaattcaaaatataaccatatgaaatgacatatataagttaaacagtacatagagatataatttttttatttttatttcatttttttgatatttttttcacacttaggagaacataggaaccaaccgtataaaaaataaactcaaacggacaaaatatgtgacatgtagaattttccaaaactctaccgaaacggacaaaatatgccatctattaaaataggcgtaactttctcatacggactcggaatcaggcaaataatatatgcacggagatctacagaaaaagttacatccgattctccccagctttgctgggttcggcgatattaaaacctccaaattccgcttgcaagattgtgttttcgaggagagaagtttttcggtggagctttggaaaattccatatgccacatatttcgtccgtttgagtttattttttacgtggttggttcctgtgagttcctaagtgtgaaaaaaatatcaaaaaaataaaataaaaataaaaaagttgcacatctctctcctctgcactagttcggagagaggagaggagaggaaaaattatacatgtcacatattacgtccatttgagttcaatttttctatggttggttcttgtgtgtccctaagcgtgaaaaaaatatcaaacaaataaaacaaaaataaaaaaattcgggggggggggggcg

SEQ ID NO: 78779 - DNA, 3612 bp, Oryza sativa
ttagtactggtcgaagttgtaatctctggaggtccatctcgatcagcatcaacagtaccggaacccgacgaacctggccagtttgaccgctcctcatgggccggtctgtccggaggtgtgccggcggtcggaccggcctggcgcccggtctgaccagctgagccgacctcgtcgtcgtcgttgtcatcgctctcgtcttaaaaaatacgaccatcctccccctgaacctgtgacagtgtacctgcaatgtcgggtctagtacctagactagcctcatcaaaaaaaacgtcgcaagtttcaacaattttgttagtctccaaaataagtacacgatagccacgagtatgtgtgaggtaaccaagaaacaatccatcggtagaacgtgccttaaacttatccaaattttcagatttcaagacaaagcacttgcaaccaaaaacacgcaaatgtgaaactttgggttgatgtccaaatcgaagttcataagaagtttttccaagtttacatctcaagaaaacccgatttgaaatataacaagcagtgttaattgcctcagcccaaaattttctaggagttttatattcatccaacatcgatctagccatctcaaccaaaacacgatttttcctttcaacaacaccgttttgttgaggaacattaggagaagaaaattcatgttcaagacctctttcattgcaaaattgttcaaatgaagcatttttaaattcaccaccattatcacttcgaattctttttcaaataaccaggaaattcaagctcaaatcgaagaaacaaaccacgaaagtgttgaaaagcttcgtccttagttgccataaagaaaacccaagaatatcgagaaaaatcgtcaacaataaccaacacataccactttcctccaacagattgcactccagctggaccaacagtgtccatatgtaatagctgtcccggtgcatccgtcatcacagaaacaataggagcatgtgaaaaagcaatcatcttagcatgacgacacggtgtacaaaccaaatcaagatctttcttaagtttaggcaaaccacgaacaagatccaaaccacttaacctagtgagatgatcaaaaccaacatgtccaagtctacgatgccaaaacatcacatctttatcaaacttagcaaccaaacatgttatcacaggtgaaacaggattttcaaaatcggctttaaacactcttccatagcgagaaatattcaacacagaatcaccacaagaatcaaaaactttacttccagttttcttaaagtggacctcaaaattttcatcaacaatttgtgaaaccgaaagcaaattgtactttaagttctcaaccaaagctacattcttcaattcaaatttttcctttaccttaaccaaacctatagcgagaacgacacttgtagaagcatcaccaaagataatagattcagtcttggatgccttcttgagtgaggagaaccaatttttatcaccggtcatgtgccgcgaacaaccggaatccatgatccacacattctccttccttgccacaaaagcctacacacaagtagaagtcgaagcctcagtactggggttagatgataataaaaatttaggaatccagtactgagacacatgaccagaagatccaataggcatatatccacgtgtaaaatcaattttagaattttcagaaaaattcctccgagaccggtctgaccgaggtatagtggccggtctgaccgggggccggtctgactacctctgtaccaccggtctgaccggtgcccggtctaaccgacgctcagtaaccggtctgaccggtcgccggtctgaccacgggacccactgcggtctgaccggtttcctcgagggaaaaccagatttttgccactttgattttgcaaaagcaatctctctctctctcctttttctgtttatgagctaatctgaaacaaaaaccaacaatatgtccatcttttccacagaaagagtaagtatatttttcacgatgattagacacattggtaaaattagaagacttagcaacacaagcaacaacaggaggttttgcattcacaacattggattttgaagaagatgcactcaaagtagacatgataccagcagatttaaacacagttttcttagtatcaggtttaaccaaaatctcaccacttctagcaccagcacctaacacaataggaggatgtctagaattatgaccataaggattaaaacctaaaccatgattatgtgtgctaacctttgattgatccaaaatcatgttgaggttctttttaccatcataaaatcttagcaaagaacttttcaaataagaaatctctttttccaaattagcacaattttcactatctaccatgacacctttgcttttacgacatttagggcaagaaagcacttcattgtttttcacaacatcttccatgtactcaacacgacctaaagcatccctcaatttcaacttattcaaattacatgttgagcaatccaaaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactaaaagcaagagaagatctatttttcaaatcatgtgcagcattaacatctctaatttttgaaatctcattcattaaaaccccacagtttgagcaatcatcatcattaggaataagagattttaatctagtaatttcatatttaagagattcaatgataaattcctgttttctatacatcttctcacacttcctttttttcactcaaaatattaatagcttcctcaaaagcacttacctcattatcttcatactctgtgtcagattcaccacgcgccatgaagcaaacatcggagatgttctttcccttatcatcatctccactttcaccatctctatcacttagtggctcgaaggcggcgcaaacttgttgaaaagccttcctgagattctccagcttcctcccttgggatgaacccttcggcttgttgttgttggtcttctcaccatctttgtcttctcttttgcctctcccaagcttaggacaatacgaacgaagatgatcaattgaaccacattcaaagcaacgatttggaccacctcttttcctgttcctggcattattcatagctcgagcaattctgttagcaaccaaagccaaatcctcctcctcgatttgttcgagttgatcatcggatgtggcattaaaaacagcaagaaaagaagacttagatgaagaagcatcagcatccaaagaggaagaagaagaaaccaaagcactcgacttagaatcaacttttcgagaaagaacattcatctcatgtgttttcaattttatataaagtgaatccaaagtcaaagtagacatgtcaacagactcctgaatagatataactttcatatcccaaatagacatatcaagaccatttaaaaagtgacgagaaatctcagattgtggataattagcatcataagaagaattaacagatctaagattactcaaaattttattaaacctaaaagatagt

SEQ ID NO: 78780 - DNA, 11982 bp, Oryza sativa
  unsure (1)..(11982): unsure at all n locations
cttattaggcgaaacgatgggtcattaatatgcgcacttgcaagttgcaactgcatgtatcatctggagtttattttgccgggatgtgattgaagtttcagttttttagtttgaacctcattactactcagtgcttaatactcttttcattctaggctattacaatctaatataggatataatacaattcataatactataagtattatagtgtgtgtttgattgctttattttaaaacggaggtagtactccctccgttttttaataaatgacgccgttgtcttttgaacatatatttgatcattcgtcttattaaaaaaatatgtaaatgtatagatataaatcatgcttaaagtagtttgagtgataaaataactcataacaaataaattataattacgtaaattttttgaataagacgaatggtcatatgtgtgataaaaagtcaacagcgtcatctattttaaaaacggaggtagtaccattttatcatggaccctaatctcttactactcgtttcactactagtatttgtcagtttcaggtgctttggtttgattgctacgtcgtcttaatctacacatgcgtacgacaaatgttgtgggccattttctattcatcgtgggctacacaaactaaccgttcatttaaccggagaaacgatgcctcccgggcctatcatttcggccaacgcccacccgtgcaaacccgcctattcaggacgatccagacacatcacatgtggccccatgcttccatcccccacgcttccgggcgcgcctcctttttgtcttaaccaagcttccccccgcgccattaattaacgggcaagtaatttaattattaccatctctcacagcctaaatcgggggccgcgtcctcttcgggatcccgaaatagtaatttactttcccccccccccccccttcccgatccatcgcacgctacagcaagaaaacccccccaccgggccttcgctgtcgtcgatgaccagtgggcccgcgagacaatctagccgttcttcatttttttcgctttcctgccacgtaaaccgacccgtgggatatctcgcccctttttctagtatttttttttcttttcggtactccacgctcgttctttcgcttttcatccccttcgcgtccgtttcttccctttctccccccatttttctacctcccttctccatagctcacgctccttcacgcacacgcctcgctcgcgcgcgcacacaggggggaggaggaggcaggtcggcggcatggcggtggcgagctggagcattccggcgatcccgcgggcgggtccgacagcgaggggtgtgctgctcggcggcgccttcgtgacggccgcgcggccgcccgtggcgtggcggtgccgggccacgctccctaggagagtgaggctcggtggcgtggtggcccgtgccggtgcggcggagacgccggtggccggctccggggaagccgggttgctgttctccgagaagttccccttgcgccgatcccgaacggtaacttgttctgctctgttgttgtgatctgcggcgaagctatgcttcgttgttttttttttgttggtgatggggtctgtggtgttcaggtggaagggaaggcgtgggtgagggtcgatgcggagccggatggggagggcaagtgcaaggttgtgatcgggtgtgatgtagaggggaagtgggtgctgcattggggtgtctcctacgatggtgagcagggaaggtactcgctgattctctctccgagctgtgtctctgtttgcatgatttatgaactatgagtgcatccttgttttgatcatccgtggggagttgatttgtgcattgttgagagcgtcgtttgaatcaacgatggttgtcagactggcaggtatgtcctcatggtaggctgctttccatatctatgtagcctcaccggtccagtctaagcacttgtatatgtatatagtgaaattactgtcaagtgtcaatgcaaccccttaatctttatttggcttcgattagaggaaattataaacaggttcattatgaaaaattcttacaaggtgggtgccattgatttatggctatacttggaaaatgcgcgcgaaaagagaattttgattaggtgacggggtagtgccgtaaccatgtaggttggctcttatcctgtttttcttttttatttggaatttcgatatagcgttgaagcgcgaggtgattagaaataggcatatctgcaagataggaatgataagttcttaaatttcaattgcaggttgcccggtgttatgtctccttatctcctttggagttgtcttgatattccaatattctatacgttacttaaatggcacgatagttttgcaaggaatatttagaattaatatttgtcatatcttttgtttttgtatgtattcaagcttcaacatacatacatttctccccgcaaaaaaaaaagaacatttctgtaaaaggcaaaaaattgaattttgtcgtctttcagatttagttgttgctgtaatgtccttccttgaatgcaaaaataaatgatctagctcctgaaatatatggcattctttatccttatttagtgacccaatttattgttatcacttgtttctataattttttgcagagaatgggaccaacctccttcagacatgagacctcccggttcagtgcctattaaggttgttctaatcctatgaaaaacatgttaaagaactcactactgacattcacatcccagggatctctaagtttgtttgatgtctgagtcgaaagctcgttgcatcctgtagccatattttttctcatttgatcttcctattgctgaacaatatttcaaactttcaggactatgcaattgaaacatctttggacactccacacaattcagaaggcaagacgattcatgaagtgcaaatcaaaattgataagggcacatcaattgctgctatcaattttgttctaaaggttcaaattttacgctgctgtatgctttctctgctgtcagttttatttcctaggcattctgtaccatgtgtcaaaaggcctagaagtctacgactggcccattagattcgtaaaattgctgaaagtgcctaaggtgggaagttgtcttcccattttttagttgtctaagaaaagaataatatataacccctacaggtatatntgcaaantaaagtattgggagcggatatantaaacacatgccttttagatntatagattagttgttaaatgcactactctttcttttaattatnacattttggaattaatttttngannngaaggtnnngatgcactttgcagggtntagnnnnngnnnnngggngnttggtttcagcacaagggtcaggatttcagaatacctttagtggatcctttggtggagatctactaggaacagaacaagatattgatgtcaggccaggttaggaagtattttagtgaatcatgttttagattattactatagtggtttggcactttgttcttttcattggttggtttttatgttatataaaaatgcatttccttctataagaaaataatcttatttagggttaaaatcttagtaattttcataggatgcttgatcatgaatattaccacattgaaaatttaccccatttgcacctttcatatttcagttatctaacatactcacatctctgatttcttaggggctttaggtcacctatctaacgtgttacagaaacctgagggacctattgctgagcctcataaaactgtacccgatgataaaggttcaagaaccaaacacatttcaggtttctatgaggaatacccaatcttaaaaacggtgtatgttcagaattttataactgttaatgtgagggaaaacaatggaacaactaaacatgctgtggaattcgacactgatattcctggagaagttatcattcattggggagtttgcaaagacaataccatgacatgggagatccccccagaaccacatccacctgcaacgaagatattccgacagaaagctcttcagaccatgctacaagtaaggaccttgatcccttggtagaggcaaagaaatgacatttaattgtatcaagctaaagtacaagataaatgtacttacaagctgtgctatataaaaattaacaagtaaaggtgttctggaaaagtaagtcaggctcatttgtatttttggtatgtcctgattctatctgcgctccaaaaacagggaattgtatcatttgcacttcttaggttgtctgaacttgaatttaccactatggcatatgcatatgtggtaaatcatgaaagaatgctcgctatagaaaaataaaaaaaggaacattttttaagtgtacagaaatgatttcacttttttcttattgcttaagaaaagtttaaaactcttctttgttttcctttttgaatggtaccttcaaatgatccattattaagagggttacttttagtctccctttgatcaggggaaatgtgcaaaactttatatcaagattcaagtcaacattttgaaaatctgaaggaaattgtgaagttctttgtttgtctccctactccattaccgacagactggcttctttttgggtttgatttcttcctttactagtctagtgagggcaagcattttcttatcagcaattctctttcaacaatcctacatcttcaatgtaggtgctgttttttggggatattttggtagtagtacactatgttctctaaaatcactgaaaatgcctcaattgatgccttttcatttttcaagatggttttgtattaatgttttcaatagtttcagctgtgggaaatcagttaagtatcactcttcacacatctcttatcatactgcagcaaaaagctgatggaacaggcaactctctatcattcttactggatggagagtattctggtctgatttttgtggtaaaacttgatgagtatacttggttgagaaatgtggagaatggatttgatttctacattcctcttacaagagcagacgccgaggctgacaaacagaaagccgatgataagtcttcacaagatgatggcttaatcagtgatataaggaatctggtggttgggctgtcgtctagaagaggtcagcgagcgaagaataaagttctgcaagaggatatcctacaagaaattgagaggttagcggcagaagcttatagcatttttaggagccccacaattgatactgtagaggaatctgtttacattgatgactcatccattgtgaagcctgcttgttctggtactggatctggatttgaaatattgtgtcaaggatttaactgggaatctcataagtcaggaaaatggtatgtggaacttggctcaaaggccaaggagttgtcatcgatgggtttcaccattgtctggtcaccaccacctactgattctgtgtcgcctgaaggatacatgccaagggatttgtataatctaaattccaggtatatctctgtgtgcacaattattgtgttactttagtaatgttttctatgaaatttgaaatattagtaatattggtgctaagctggaagtttacacttccgctatctacaaaaaaatgagatgggatagttggtaagttagagataaagctagtaaccaagttagagctaagatggtgctatgctccagcttgttttatgtaaagccatgctgtgtacatgagttgattatgatggataatcagtctaccctaccttaagtttccttcttctccgttgccaaagcttcttcctccttgctgtttccaaaccaatctactgctaattctccattgcctacctcagctaaccttctacaatctagcatatagcacttgtgctgaagattttagtactacgctatctagtagaaacgaaaacctgggtagcatatgaaattcacatatggattctaaaggagaaaaccccttttatacccctaaaatctctattaaaggcactattactgctgcagtagcttgttgttcttctatggttaacactaccaccactatgcaataaatatttatatgtcgcttgaggcatcacttgtccactatgatgcatggatacgcgatactggtacggcgatacgagattttttaaaaaacatcaatacgtcgatacggcgagtatatataaaaatatgtttaaaaataaaatatagggaactacaaaagggtaaagcaataagattatcttaaaatatattctatgaattgttgcctgttacaaaaaatatagcaaatatagccttgtattacaaatatagcaagtatattaaagttataaatatatcagaagtatagcattgggtctttaatgtgctattgaacaaggaggttacactgctaggtatcaaagaagtatctgataagtatcgtgtgagtatcggtatttattttttcttttttttccattgtttaatgaccgatactcctccgataccgtatcgacagagtatcggacgtatcgccgtatcggataccggtacggcaagaaattgaagtatcggtgcatcatagcttgtccagaaaactggctctcatcctacttgattttgactacccttatgaagcttcttagttgttgtcttccttgtttccaaaaaaaaaaaaaaaacaatgattttcaaagggaaaattatgacactgaaagatctatgcctttatacagcataatagtatgaacccatcatgtcagctcatgccattcattaatatgatatcatcaatgtttcagatatgggaccatggaagagttgaaggaggctgtgaaacgttttcatgaagccggtatgaaggttcttggtgatgccgtcctgaatcacaggtgtgctcaatttcagaaccaaaatggcgtctggaatatttttggtggacgccttaactgggatgatcgagcagttgttgcagatgatccacatttccaggtgaggttccaccttcccttgcaaactatttaattagaattatttgaaaatgtcattcatgaatgttcattatgttaactaagtatcacaacattatgattttcttcatgaactgctggtttcatttgcacaaatattttcctccagtggagcttgataaagttatgcgaaaataagcttaatttaaccaacaaatgatgcttggagatagtctcattgagtgacctacaaactttgatagactccaccttttcaacttgcatacatttagtattggaagtaaacacagattagcatccgaaataacatagaaattgacatagttccaaaatggaaaaaagacatactcaaacttcagcagccatgaacattgatcaatcataatattgttctacatgcctattccatttcattttacttaacaatgcactatgtgatgtactagacttactttctaatttttgggtaaaactatatgtccttgtagggaagaggaaacaagagcagtggagataacttccatgcagccccaaacattgatcactcgcaagagtttgtgaggagtgatcttaaagaatggctttgttggatgaggtatgctatcttgttttttcttggctaaaactccttttgttgctcatgcttaactatatatgtgtattccccatgcgaagggttgtatgttatagcatccccatgcaacagattaaatagatttgatgtacatacattgtttctggatggcgtgtttagctgagtgctagttttctttcctcatatcacattcttttcaaagctatgttttcatatatgttagtttaccttgctcttaccacaaaatggaatgtacacagtgcacatcctcatcaatatcacaagattctttttcatgctacgataataggtatatattgtaggctgctaagctcctataataacaaactggattggacaaatgctacacctgaatatctgcaaattgtcatgggttccaccatatatatatgtatatatatttttgccatgtagcttagggatgatcgattctgtatctatgtaattgtgtagtgcttggacatatgcaaaaaaaaggggaagatattgcaggagctttaccctcattaatactgaaactatttcttggagccaatttattagggagtattgttgggaacagtagcttactagtcctaatgtggttgctgcatattttcattagctgaacaggataaattaaatcatagaacatagcattagagcagcattcctgaaaacgttagcatcagatgacttcattgtatgtttgcttctgcttgacttgcagaaaggaagttggatacgatggatggcgacttgattttgttcgcggattttggggtggatatgtccacgattacttggaagcaagcgaaccatattttgcagtaggagagtactgggattctctcagttacacctatggtgaaatggattataatcaagatgcccacaggcagagaatagttgattggataaatgctacaaatggaactgctggtgcatttgatgttaccacgaaaggaatacttcactctgtgagactccattttcttaccaagttttataatagtgcttatgggtgatttagtatttttgaaactctagaatttatatgcctttccatggtttgagcttctcagttcggatatgcatcatgaagaatttcctgccctttagcatttttcttttgggtggaggtatactttgtccttcaattatttgataattaaagttttattgctgctatgaagacgcagcatgctgaaccacattaattaaacttgcatctttggcagtattcctgttccatggcaatatttaaagtctcattaatctgttgtaaagtggttttctgatgatagttaactcatccatgattgtaatagccaattctgccagtttgagaaggatgctattgctctggattagccatgcatattttgtcttacacatcttttctggtatacaggcactggaaagatctgagtactggcgtctgtctgatgaaaaaggaaaaccccctggagtgttaggttggtggccttcgcgtgctgtcacatttatagaaaatcatgacactggttctactcaggtacattacaaaatccctacatacacaaataagtattactccgtagcattatcttcagaaggttactatatggcagcatgattctggcaaatctgacatcatatttttgttatatttgcatagaaacatcacaaatgtgcaacgacctgcatgcatttcttaataatagtcagatagttgtccctttttttgaacgctgcttaatttcttgttttcaaacaactaaattttgctcagcccatccttgtagaactcttttgaaactggaatgcttttatggatactaatcaaattataactggagctgttaagctgtgttcgaacaaaatcatggctaactttctttgatatctttgtagggtcattggagattcccctttggtatggagttgcaaggctatgtctacatcttaactcacccaggcactcctgcaatcttctatgatcatatattttcgcatttacagccagagattgctaaattaatttctattagaaatcgccaaaagatccattgccgtagcaaggtaaaacttcctcttgtatcgtatggtaccccctcttaccctccttgcccttccccactctattcatgttctctaatgcttgaatttatataacatttacagatcaagatactgaaagcagagggaaatttatatgcggcagagattgatgagagggtaacaatgaagattggcgcaggacattttgagccaagcggccccacaaactgggtagttgctgccgagggacaggattacaaggtctgggaagtgtcatcgtagacttgccgcgctggtacttgcagaacttctattgtagacagtatacaaccattcggtatagctcacaaaaggaaaactgaatagcacaaagctagagttcggcatcctgctgatggtaccaagaaaagaagtggacagcaagggcaatggaaccacttgtcctaccgaaaagatttcaccaatgcagtgaaattacattgtaaattcgaacatttgatcatgcagaatcaccggttatcctgtgaataatttgtctgcaggcaattcgcctgttgatgtatgcatgttctttatacatttttgcagagatacctccaccatgttggagctatgtaatactatgtgatacactttggcgataaataaatgaagtgcatgcatttcttgctatctgcaaatgttagtaccaatttttcctgcagtgtgtgtgagtggatcataaaaggttgagacatctcccatttcaaattgcaccagttttcgatgtagtattgaaaccaacatggagcttacagtaagatatccaacaatagacaagatgccagtgacaagaacattagtatggattcagttttaacttctaaaacatgccacggggaaacactatactactactactactactactactactactactactaggtgggaaatactcagaatgatgctacgaggccaagtttccagagtaaagatgccacggcaccaaagaggttaaccagacttagtttcactagacatcaggagctgctgatacgggacgataccatcctgtcctactagtataccaaaaaaagggatcgtcatcatcgaatcatcgccatcaggagggggggcatcagggcttgagaaccagcgacagtccaaccttggaggccttgtcgatcgccttggtgtcgacctcggcggagagcgttaagaaagacttgggtctccactcgtgctggatgagggcgctgaccatgccgtggttgttgtagcgcgccttcacggtagtgagagggtccagggcgtgctgcatcccgaagctgagggtgttctccttggtcgagaagctgtgggtcagctccgctccagcagccgtacctgactctttgttcaccagatggtagtaggacgcagtgaggctgtcccctttgttgttcctgaaaatgggaagccaaggatttcacgcatggatacaaaagagaaactgcaacattacagaaaatttgcttcgattaggagtttctgagaagtcagattaagaggaatgtatgctcaagctagcaaacaggtacgcacatggttatattgtagacatgaatcgtaaaattgcaagcaacttaacagtgttacagtgggcacgttagaagaaaacacttacagcgtcagatcagcagcaagatctgaattgttgatggtcagtccagcatcgtacttggtgaagtccccagtagaagtatcaactgcaacatcagcaccgacagcaacagatttgttgccgaacacaccagaaaggttaaccaaaggctttgaggtcaggccaacaccgaggctgataccagcgtagtcatgcaggtactggagttcagcctgcaaccacaaggcagagagtcacaaacggtaagtcaatttgaaatctaaaagacccaaccaatctagcagagatgaagatgcatataccttcccagctgtctggtatggaaaaggaagtgatacgatttgcttcaagcctgatacaccaaggtcttcagttgtgattgtagttaacacctgggaaaagttaaacacaaatcaatcaccagtagataagctactgactcaatttatagtccatcaccagcgagtttaatcaggaagtaataatcagataacatttgatagatgaagggcattttcaaggagaaacttgcctgagaatcggaagtagctttcacatccagcatcacattattgctcttcagcttggtctggatctcgctaaagatagcttcatctttcattgtgcttgcagcagtgattacctatagacagaatcacagaaatcaaataataagagtcatatttgattattatattagtaggcgtcgcgacactaaatgatggnggggtgtccaacaagtagatctaatgcgcg

SEQ ID NO: 78781 - DNA, 82999 bp, Oryza sativa
cttgaagaaataccagtaggcttctggatgcaagaggtccagccgaatagctgctgctgttcccagattctcgatcttatctgacctgctggtgatgattattttgctcccacgggcccagcaactcatcgaagattttaagctttgccatgtttgttcactgatatcgcaagctagctcaataattatcagcaaccttttgcatgaagaatagttttggtgcttcactacaccattctctctcagatttgccactcttgcatccttcaggttatttcctctaaggaacaaaatcaaagagtagtgattgcgcaccctataatcacgacaagcatgctcgactagagtgcttttcccacattttcttggaccaattattggaagcacaggaaaatcttcatcaccaagaccatctgtttgcagcaagaaactgagcacctgctcatgttccatttgacggccaaacatgcaattttccaaaactgaatatgtgtcacgaggctggtggtgcactactcgataattcctcaaaaatacaacaagattcatcatgtcagaaatgcctttttctatggtagcaatcattccttgtagctgttttatgctgttactaccaaaacacagtgttcttctatgactggagaaacgaagacgcttggctggattgaacttagaaaatgaatagacatgactcacctcctcatcctttctgtcctcttgaagggctggatatttatacctatcaagcaagtagtggcctctgtacatcccctctattaacatctgcaactgatggagcatcccttcattggcaatacactttccctctgcctcctcaatgatggtctgggctcttagtagcagtcggtttagtgtctccagagccacctcagcatctggcagttgctgatatttcttgatggcaaaggttgtgagtctataggcaatatcacttacggctgcaggaaccagcatattcatggtgattggtgaacctccccaaaagatggtgcagtgaaacaaaaatataagggagagatcaagcagagcagtggtgctctatgatgctaatgtgctgtttttctacagtacttcacgcatcgcactttcctcagtaactttcttatcacatcactctcatggccgtccaaaatacatttaactcgcttacaagggagcactgtggataaactaacaagtatttctttaaagagaacttctcggctgagaaattaacaacttctcatcgaggaatgatcctgattttcctgcattgagatttgactcgagggtccatatctgtttagtaaatgaggcgcaagataaacttgttttctaaatagagaatacatttcctacaagatttctctttaaagttaatttaaatataatctcctacaacaaatatggattgatatgcagatagatgccatgtcagtatgtcacatcattccatggtcaactataatactatacccaataattgagcattttttgtttctagcgttttaaccgcaagaatcaaaacgtgctatgatgtgaacatccccaatcgccatccaggttaaatccaatacaatccaatcaaataacgccgtaggagagcaaatcgatgaaagagacaaacttacgggccctatacgctcgttgatcgtctctgccagtaattgattagttaccagtcacatcggcgccgccatcaggtggggtgacgccgcatatgggagacaggtgaaggaagcttccgggcacggggaaggagaggaggcggggattccacctgcggcggcgccggcgtacgcgaccaccgcgcggccgcgggtacccgcgcgcccgcgcccggcgacgccggacgctgtcaccggtcgcgagcatttgcggtgcggaagggagcggaggccggaggggaggtgagagtctgagagacgagagaatgagcggtcgtaacagaggggatgacgagagagagggatggaccttcttgggccggagaacttgttaggtgagctcttttcgctagttgggccgggattcctctcttgaaggaataagttcaccagacatccctcaattttacgtccagtttgtatgacatccttaatcctcaatactagaaatcttcacccttatactatacaaaaccgtacaatttagttcccataacagtatggttctctggtttcactgatgtggcatcctagtcagcaaactaaaaaataaaaaaattatgagcccacatgtaagtgagaaaaaaaagagtagttaactagttggaccggatcctagggcctggaatctcctgcccaatagctctcccttaaaatgatgtgctcatgggctgctttggtcgacggccgccgtcctcctcaccaccccacatggaaagaagagagatattggtgaaggcagagataggtgaagatgttctgacatgtaggacccatgttgactcaacgctgatgacttgggtcaaattgcgatgcgggacaaaatcgcctcgctgtactgccatgggacctatattgcaccggtttttgataattgagagacccgttgtatttggtattttggttgaaggatgaaaatcgatctcgttgtcgagttaaagggacctaaaatgaacttattccaatttttttatcccatcaactatttgaaaatttcaatttgttagggttgtgttcgacagtgatagctgagaactaatccctcgtgcacgcaaaacggatagacttattagcatatgattaattaagtattaggtatttttttaaaaaaaaaaggattaatttgattttttaaagcaaatttcctatagaaaacttaaaaaaacactgtttaacagtttgaaaagcatgtgcgtggaaaaaaaggaatatgagttgggaaagaagggggaagaacacaacctatattgataacccactccacatagggcactcccctaataataaggtaaatgctccgatactacttgaacaaaacaaaatatttctgccgtagttagcagtcaaaccaactctacctttgattcctcaatatttttttattaattactccataatcctttccatataaatattatttccttcgtgggtctgttcccctactccacgatacgccatcatgagctttagaaatattgttgattaattccatatttaccaaatcaaccctctatagtctatcctaccagaaaattggtgaatctttcacaataccaacaatttggtagggtagagaaccaaacttgctcgataatgcgcatcatatttatcaattcctttttcaaagaaattaattaggagcatggaaaaaatcagcatgcatttggcaaaccttgtccatatggaactaaactctcaaggattttagttagtcctccacaacttagtaaaattttgagagcctcctctgataggttgagctagagataataagctgtagaaaattgaacaaagcaactaaaatagtgtgtatgtaaaatttttaatatgtattattagcattttaaaaaccaatgccgaataatagtctatcatgaggaaaaacccctaagaatcaactataagttctaaaatttaaatttttgctgcatatgccaacaaacagacgacgagtatgcaggtcggtttgaacatttggaaggaaatggaagaaacaggcgaggtttgcaaaacgaggtaggtagggatgcacagcaacggccaaaacagaaggatgatcatgccgactgtcaccaagagcctacaacaatcgagcatcaagatggggatagcctttaagttcgtcggtgaagctctagaccccttgggaaaatattctttaaaaatgcaagttgcgacgctattagagtatgttgagagaaaggatccatcgaacaaaggttccatttgacttagtatatattcagccattcaggccttcagggttgcaagcaaagcagtgacgaaagcagcactgctttcagttgtgtatggattcaagcgaagcactgacgaaagcagcggcgtcttcagtgcgacggggtcgagacgggatcactcaaaaatcggctaagatggataataaactatggtggaaactggaaagcatcagtcgttttcgagaaatctatcatgtatatgagcaattctacggtatttaaggaggtaccatgaggtaccaaaattttagtgtaaattttgatacctcatggtacctcacagtatctagttatcacgagataccaaatttataatagaaaaaatggtactttatggtacaccctcaagaaccgtaaaattgctcaatgtatatagtcttcgagacagcagcgacgaacagcagcacgcctaaacggaagcgattaatttcaattgccctgaaaaaaataaattagtacagctagtgcatgcaaagacatctgtcactgtttagttgcgaaagaggcatatctagtaatggcagtgtcaaccccaacaatgatttgcattattgctgtttttagaataataaaatgttattctcaacacatataaatcacgtcagcagttcagcactgtcccataaggtaaaactctcaaactggccgagaggcaaagtctgacgatcgcttgaacaactctagctaggcagcagaagatgcccaatgttgtcaatatgccatccagcaactgctccggccgtcacagagaagcaaaagctgtgtttccttctcctaggagagagccaagcggacaagcctggaggttggctgctaatgctatggagcgtccagttgccaatatttctgctaggcactgtaagcggccataggccggttggtgtgaaaacgcaaagatccccttcagggtcgcccacaggaaaaacataaaaaccatgtgctcaaaaactacacagccatgagcagatgcgctactcattcgaggaaagtaaattcagtgcaacaaaaggattcatttcgttaattcattcctgaaaaatttgttgctgtgctgaattagtaattggacagcagacagcacgcttgaggcttgacaatctttactcatggccgccgaattgccaatgtacgttttccctgaaaaaagtgaccactgaccatgctaacatgcagctgtagatcctttcttgaggttctggacaggacagatccaaagatgtttcactgaagaacatggaagagatcgactagcaagtctcagaaatgttcactgaagaatatgacgagtcccgtgagttcagaattcggaaatgtgttcaccgaagaaaaacgaaagttcagaattcagaaaagctgactattttattttttgaacgactcgcccgagacgatacggagttctattcatagagcgaagctgactattttatcacctcctacgttgttattatgactagataagcaaacataggaagtactaatgccataggagctttcaaatggggctattttaaggtagtggatagtattacattccacgagaccttcgcaaaattacaaagtgaacatccagtacaagtgtccggagacgagcacgacaatgtgcagtacggttcaccttcagctcgccggagcaaagcttacagccattacaagcaaaaaagaaacacattgtgctattacttgtagtgttattaagtaataacaccactagtaccagttcaagcacagctcgaaacaaggagaaaatttagtagcgcatacaccatgtcctgctcagatgctgtagtccgaccattgctggatgaaggaggtgtggtccatggattcacccggcatgtcgtcgcccttcttcccgccgagcagcctcgccggattccccaccgccgtggtcctcggcggcacgtcgatgagcaccagcgacccggccccgatcttggccccggcgccgatcctgactttgccgaggatcgtcgcgccggcgccaatgaagacgccgtcgccgatcttggggtgccggtcgcccacggccttgcctgtcccgcccagcgtgacgtggtggaggatggagacgttgtcgccgatgacggcggtctctccgatgacgacgcccgtggcgtggtcgaggaggacgcccttgccgatcgcggcggcggggtggatgtcgacggcgaacacctcggcgacgcgggactggagcgcgagcgcgagggcgcggcggtcctgcgcccagagcacgtgcgcgacgcgctgggcctggatggcgaggaagcccttgtagttgaggaggcagtgggagaagccgacgcaggcggggtccctggagcgcgcggcgaggaggtcggcgacgacggcggcgcggagggtggggtgcgcggcgagggaggcgacgaagaggtcgtagaggagcgtggagagcagcgtggaggagcagagcttgttggcgaggtggaaggcgagcgagcggtcgagggaggggtgggagagcacggtggcgtagaggaacgacgcgagcgccggctcggcgtcggcgtcgcggcgcgcctcggccttgatctgggaccagacccacgactcgtcggcgtccgactccgggggcgggtacgccggcacgacggccgggtggagcgccggcgggctgtgccggcgtggctggggatcgtcccggagaggctggcccgcagtcatcgtcgccgtcgccgtcgccgtcgtgtcgaggtgtgtggatatgtggcggtcggcggcgaggaaggcgtgtggcccgtgccgaggcgagagcgaataaataggcgtgtgccgagtggggacacgtcagccaaccaatcgaaaacaggtaaactttatctctgcgtgggcccggagttaagctggtacacacgatgagcacgagcccgagttggcgcgccgtggacgcgtgggcaagcgccaaggcggatcgagcggcgacgggcctggcccacgtttcgtggcctagctcggccctgcacaaacaccggatcgagcgaactggatccacgcggataaccgcgggtggcggcaggcggtgtcgagtttgtgcacgtccacgtcgtgatccacctgaccacctctagccagaaggcgccggttgatcgagccggagatacctgcgctgacgcgagtacgcgacgctaagctggtcgtacttggttggttgaatacgatctgatcgcaatattgttgccatcgatggacgaaaatcacacgattacacgagcaattatttggttgtgaaaccgtgaaagcatccaaatgttccatataaccgttggattaacgtgcacgggacggcccgacggggagagtgcatcgataagagtcatagtatagccaactactcattccaaattatctataaccaatctaacagcatatttatacaatagttatatactacactattaatatatggtccaacctgtcatacacacattgtgtcttgaagtctgtgctacagctgactataaatctataacccgctgctattctctcttctcatttatcttcttaaaatatatttacagcctgctattgtaatccctccgttttttaatagatgacgccgttaactttttctcacatgtttggccattcgtcttattaaaaactttacgtaattataatttattttattatgagttgttttatcactcatagtactttaattgtgatttatatcttatacatttgcataaaatttttaaataagacgaatggttaaacatgtgagaaaaagtcaacggctattaaaaaacggagctaatatttgctctaactgggtatggatgataggtcacgccgtcacgtgccaaagtcagagtgggccggtcccgatactgttgtcttgcgccgctgagtttctgaccccgccgcggcctccgccgtttcgtacgccttctcctctcccgcgcgcacccgcctccgcctccgccttccccggccgccgccgccgccgcaggagaggagacgcaggccgcggcggcgtcaaccgccgctctccctttgccaccatctccgctcccgacacacactccactccactccagtccacagcactaacccatcggtcccggcgatccccactagtgcccctcctcgcccgcttgccatggcggcttgcggcgccgcggcggcggagtattcagctctcctgtccctctcatgtgggcctatcactcgccgccgtttcgccgtctcctgccgcgctcgaccgcccggcaacctcaggtgagtgcctgaccaatctgctgcttcctgcttgctgggagtagctgggggacacgcgatgtgttcgagaaagtgtccatgagcgaacgcatttgggattgcgcggtcgttgcgtgcaaacgaggccgtttgtgccaaacgttctctcactgttccacccgctcgtgcaaaatggatgtcgccgagcatcgatcgtggcatgttgtcgtgtctcaacccattagtcgagtaggaatatctgttaatactctgtccagtggtgaacgaatctaagctgacttagaggctgctctgcacggttaatctgcagtgctcgagctaatgaaatttcacattaatcttctgaaaaagcagtgtgtttcagtgtgctaagtcattttgcaaaacatggtaaagtcgctctattccatattggtctagaaatccctgggtttgcgcattctagttggtagagttcacatgaaggtttttgcgcttgactcatgactgacagcttctgtgtggtagtgcacagcagaagaagaagcgagggaaaaacattgctccaaaacagcgctcttcaaatgcaaaactcttgcttactactgaggaaaatggacagcttccaagtaccagtttgaggacttctatggaacgtcctcagaagagtacatccagtgaggacgataccaatggggctattagccagatagatgaaaaaattgcagccattggtaatgaacagcaagaggtactgccttactggggtggtcatatacttatatcagcctatcagggtatcctggtgcacttccacacctccttcaaacaagctagctaatttaaagagatatgcttctacattcatagatcaaggattattgaacttttgtttatgtgacttctgtgcagtatgtcagaaaaaaacattaaaaagaaaaggcacagtcatattgcagaaccatgataacataggattaaaacatttaaattgctattcatttcctttggactgattatgcattgtcgcttcctaggagggcaaccttgttataaatgtttttccctatttggaatagagttcatccttatgtagtattatgcagaaattcgtctgataaaggattgtaatgtttattttcactcctcagtttgccatgttcatccttatttagtaccaataccaatatgctaaattgcctctcaatatcttagcagttatcaccaggccatccacaataaccttagagctcgcatcgtctccaccagaactagaatgatactgctttgagcgagacactgctacctagttgtactatgcaagcgtgtagtctttcttatgtccttcagaaattgtttcatttttcataagaatttctcctcttatatattaacacagaggtcaaaggataaacatttcgaatcagactttcaacttgaagattttggggaaatgatacaaaacatggaaaagagtatggaatgctttcttctcaagtgtattcatacattcatgcatgatatctgatgaaaatacatgaaaaataatttttaaaaatctgacatggctagatattctgctcctaaatcaagctcgtcttcaagcaattgaagatgttgacaaaattcttactgaaaaggaagctttgcagaaaaaggttgacactctagagatgaatttgtcaaaagcacttgcaaccaaagggaacataaatacagatatccctggtgatcatttagagaaatttacaaaagaaattttgatagaaagtgctctaagtggaggcaatccagcacatttgtgtgagtctccacttttcatggagctgactgttctaaaagaagagaatatgctacttaaggctgacgcacaatttcttaaagcaaagattgttgagtttgctgaaacagaggaattcctattcaaattggagaaagaaaggtcactgttagacgctacagttagggagctggaagctaggtttctagttgctcaaactgatatctggaaagttgtccctctgcaatatgatgtttggatggagaaagtagaaaatctgcaacacatgcttggatgtttgaaaaatcatgtagagaagtatgctgcattgttggatcagcatgatgatctgcatgacaagattgatgagctagaagcatcactaaaagaagggaaaacatctgagttttctccttatgttgttgaacttctgcaacagaagttgaaagcagcaaaaagccatcaccaagcaggccatcaagaaacaaacactcacattcaagtatatcagcagttaactgaggaatttcaagataacctaggtaaactaatagaagaaagtggcagactggagcattctgcaaatagtatgccatcagaattctggagtcacatcctgctcatgattgatggttggttccttgagcggaaaataccaaatactgatgcacgtatgctgagagaaatggcatggaagagagatgaccgtatctgtgaagcctactttgcttgcaagggtgcaaaagaaagtgatgttatggaaactttcctaaagctatcgttatcaggaaacaggtattaaatttatcttgtgaatcactttatttttgatgggttcaaatatgaattagaaaacttatctgcaattttttcataagatctatactactttagtggtggtgtccaaatctgcctccaacgtcacgagcaaacgtgtggggccataaggtctcagcacatgaatgcttttgctttgatgttatatgcctaattaaataactatgttataaacttgtaatttttgcttgtgcttttatctcttgtaatatccattacaacacacggacctttagctagtattttctaatatattatcagtcaatgcagttctggcttgcacattgtccatatagcagcagagatggctccagtggcaaaggtgatcctgtacatcaattcacacttccatcaagtatttggttctgtcggtgccttatccactctcactgcacaatatatcctttctgtaggctatgtaccaagaaaatgtaatttcgtgaattgcagccttgcctgatataatccacacaagcttagctctatcttgttcacatctgcagttatttttgcctagtagttgtcaacaataatgccaacagccaagtactggcattccattttgagttgaaaagattgtatcgagactttgcaaccaacaagaacatgcaaaataatggagaaatgcactgaaaattgtatttagcactaagttcatgcatctcaaaattcaattggaattatgtagaaatttcttggttgaacttcacattggctgaaaattgacttagaatgataacattatttggcttacctttacttattaaatgcatacaatttattcaaaaccagttataccaacaactgattagtcagaaaagtaatggaagtcacccaccacaaaccatgccgtgttttgcactagaaattccatccgatatttgctagtaggtgccacattgcctgcttagtcagaaaatcaacatgcctgcttgcttgctagtaggtgccacaatgctgggcacattaaagttggtgatgatcaacatggccctgatcaagcacatgagtagggaaatgagtgatttgattcttaatagttttctcctatgtaaagcgttaaatatttgtacatgaggttgaattcatcttcacatcaaaaaccaagtacttagtcatataatacaggaataatgggtaggattagtgtgctgtattgtttgacaagaaatttcatagcattaatgaaagttccccatttgttaggaacttgcattgtataattgatggaaaatttacaagaacaccctaaaaatattttatgtattggttatactcctgaatttttagtgtagattcgtgtcaggtaagttcatctctacatgaggtcttccccttctgaatgaattttcctatttgctactagcgttctagaaggtgctaggtttgttgcctgccttctagaacaggggccactaccagcagttttcttctatattaagaaatagaccataaagtcataaacattatatctgtgtatgcaactgctcatagccttaaatcctagttatgagaaagattaattggctgtggaaagtagtctgctggcaatttcatgtttcaaaatcaaatagattatctcaaccagaccacattctgactggaagttgaaatgagataactgttacatgggcagttatattgagaaatatttgcagaaattcttatgtaattgtttatacttatctttccatgctgcttggatttgaagtattgcttatactaatcagcattttaattgtgtaatctcatttaagtttgcttaacaaaatggttcttcaggttggcggtctggcagatgtagttgctggtcttggcaaggcacttcagactaagggacatttagtagagattgttcttcccaaatacgactgtatgcaacttgaccagattactaatcttaaggtttgtgcttgttggttagccatgatttttttttacatggttttgcatctttaatctgagcctctgaggtaagattgtattcttggtgatcctgcaggttttagatgttgtcatacaatcctattttgatggaaatctattcagcaacaacgtgtggacaggaactgttgaaggttctaagcaactctattggaccttataagaactcaaaaaaagttaataattgtttgctaactgcaattccaatatacaggtcttccagtctattttattgagccacagcatccttcaaaattcttctggagggcccaatactatggagagcatgacgattttaaacgttattcatactttagccgtgcagcactggaattactttaccaatctgggaagaaaattgatataatccactgccatgactggcaaactgcatttgttgtaagaactgaaattcatttcgcttgctttttcatcaatagctgaaaacatataaattttgctgttattcatttgctaagttctgggtgtcaactattctctaccgtgttcaagaatattgtatcttacacttagatttcaggcacctctatattgggatatatatgcaactcgaggcttcagctcagctagaatttgtttcacttgccacaacttcgaataccaaggtacagcacctgctcctgatttatcatattgcggccttgatgttgagcagttggatagaccagacaggatgcaagacaatgcacatggaagaataaatgttgccaaggtatagaatagagaaatagcagttgttttgaattctgtaccttaaaagtcatgatttttatatttttgcttcttattggtttcagggtggaattgtttattccaatattgtgacaactgtatcaccaacatatgctttagaagtgcgctcagaggtaacaccagcaactctgttttctaaacaactattacaaattcaatatcagcttcacacactttagatgttttctttcaactgtagatacatgatcaacctctcaaatagtacatatttttttttgtaacattagtatttatacttagagtaattgactacacaaaggtcgatgtatttatctgatagaccaaatcttttttcgaggcaacatttatgtaagctgttaatgtacaagtaatgtgaaaaattaatatgtttatttgacaggcacttcttcatctaaaacaagtggcatttcttagtccatgtaggattaactgtctgcatttgctgtccttgcttttcttttggcctttgccccagagtaaaaattgctagctcaaaacatatggcataagtaaacaaggtttgaagagacttcagtgaaggccttttatgtctgacattgttatgcaattttttttaattgttttaagaattttcaaggcattttacttgatatgttactaatgaattaggggtctgatataagttgcccatcatgaccttttttattggtcagggtggtcgtggtctccaagatacacttaaaatgcattccaggaaatttgtggggatacttaatggaatcgacacaggaacatggaacccttccacagacagatttcttgctgtgcaatatagtgctactgatcttcaggggaaagcagcaaacaaagcatttctcaggaagcagctagggctgtattctgaggatgcctctcaaccactggtatgaatttcagttctacgcccatcttaactaattatatggctatctattcatctattgtagcctttttaatgtaatcaagtcatttcattgttttttcttgaaaacgccagagaattgcatttcatttcatttaggggaagagaataaaggaaaaatacaaagtaggagagaccaaagcctcctacacacccaagccccggccaactagctgcctaggtttgccgaaccactaagaaacttttggagggcagacgctcccactatacaccaaagattaccctcattctctaccacctgcaagaccgttgcaacattaggactggcgccattgaaaacacagtcattgcgatgcttccaagtctcccaagccactaagataaccaaggaattgagcccttttcgcacgtcctttggccagtattttgtatattggctccaccacagcagctttttataacaagccccttgatttgtttaaccactttttataacaagaaagtacttctgttaggggagaataccatttaaaaatcacatatctgaactctgttttctccagttcaagaaaaccccttttgagttttgaactttatatcattttcattttttgttggtattattcgtttagattagctgtctccttttgttttgtttcttggagtacagtctctattgaaatgaattagtctcgtagtttatgttcagctttgatcctcattttgtgccttttaatgaccatggttttctgaggcaggtagcctgcattacgaggctagttcctcaaaagggtctacatcttatcaggcatgcaatatacaaaacagctgagttaggaggacagtttgtactcctgggttcaagtccagttccacatattcaggtctgtatactcatcgagtgcctcattttattttctcaactgcagctcacatttggccctatgagttcttgatttgccatggatatgtctggttccatagttttatgtatataatttattttcttctacatcttggctgatcttgttactgtgaactgatcgttgtgcatttgtatcacagagggaatttgagggtgttgcagaccaattccagaagaataacaatattaggttaattctgaaatatgatgaagctttgtctcattgtatttatgcggcatctgacatgtttatcattccatcaatgtttgagccttgtggccttactcaggtgatctatccgtacatattaaattatagatcttccatttaccaaccaaataggcctacaattgctaaatgtgcgccagtgtgcccacatagcttgcttgggttcaaattggcatttgtgagctattatcacaaggcatggatttagactaggttttactttgatctaaatatcccatacaagtcttacatggttgtgtcatccaaataattttcttttatgaaattagccacattttactaaccattttacatggttgttgacattttattctttttcatgcccaagtctgacaagtttttatcaaccagatgatagctatgagatatggttctgtgccaattgttcgacaaactggtggattgtgtgataggtgatttctccctcaaacatttcctttgcatagtatattctgatatatctgttgtgttctacttttccagtgtttttgattttgatgatgaaactatacctgtggagctgcggaatggctttacatttgctaggactgatgagcaggtgagttttacaatggaatgcactttcaaatttggatttctaatgttttatgggtagagctcacgtgggatgcctattttggtaggatctaagcagttgcttggaaagggcattcagctactacagcagaaaacctatggtttggaaacagttagtgcagaaggatatgcagattgatttcagctgggattctccagcttcacagtacgaaaacctttatcagagtgctgttgctcaggcaaggggagcggctcaaacataaaccttttcatgatgacattgtgagcttagattctcccaagcgcagagacaatcgtcagttttatcatatctgaaccaggcatatgctgaagaaatattgttcttctcacattcacagaattcacacatcgtgatccttgctgttgccattcccgaaagaactgagaaagagtagtcttacagttgatcaagatattgcattttgcagtcagtgcacggaactagttctgggtttaatggggatgagtaatcataatctatactggattgcccccctctaaattccccccaaccgttagtttttgtgggaatgcaagaagtaaatatgtgcactgtagggtgacattcgcatacatgatactgtacggtttattcagatcaacgtttgggtaatgtgactacttttgagtttgagagatttgcgtgctccgttctaaccttctagggtgtgtttagaaaatgggttaggagaggtgggattgggaaatggaaatgaataaagggataggatgaaatggggtgagaagaatgggtggctaagattgaagcttaccctttaaggggtgggaaatcatatcccaaacccattttccaaacacagccccaaggttataaattttttttttgagggaccaaggttataaattcgtcgtctgaaattgacattttgttttgcgtttttgcatgtgattatttgagtccgcgtacatttccatgtaccatggggtattccgttccataccgccaggcaaactgatttcccaggaacaaatcagataaaaattattttacacaatcaggtccattgtacttctttcatcaaccaaccagataacattgttttacacaatctgaacgaacgaagcaaatattcgggtacgcggaaagaggagaacgtcgcgcgtctcaccgcagcctgcatgaaagcaatggacctcaccgccgttgctcgccggagatccacactcacttgccggggacgaagttggtggcgtaggcccatgcgttgttgttgacggggtcggcgaggtggtcggccaggttctccagtggccccttgccggtgacgatggcctggacgaagaacccgaacatggagaacatggcgaggcggccgttcttgatctccttcaccttgagctcggcgaacgcctcggggtcgtcggcgaggccgagcgggtcgaagctgccgccggggtagagcgggtcgacgacctcgccgagcgggccgccggcgacgcggtacccctcgacggcgcccatgagcacgacctggcaaccccagatcgccaggatgctctgcgcgtggatcaggctggggttgccgaggtagtcgagccccccctcgctgaagatctgggaccccgccttgaaccacacggcctcgccgaacttcacgccgttgcgggcgaggagctccgggaagacgcagccgagcgcgcccagcatggcccaccggcagtggatcacctccagctcccggttcttggcgaacgtctccgggtcggccgacagcccggcggtgtcccagccgtagtcgccggggaactcgccggtgaggtaggacggcggctcgccggagagcgggccgaggtagagcacgcggtcggcgccgtaccacgggctccccgacgccgcggcgggcttgggcttggccgccgacttgcgcatcgtgacgcggccctcgccgaacaccttggcattggcgaccgccttgccggcgagggcggcaggggaggagagtgccatggtggacgccgccattgacgcgagcctaggactaggaggagatggccacagatgcttttggaatgtgtgtcttttgagctcgtgagctgctgtggtgaggaaagtagtgagctcgagtggggtttaaatagtggcgggaaacggggacgctgcaaggatgggcctatctcttgcgatcgtctggttggatactttggatagctcgcttcgtctatctcgccacctgtgcacgctttctgctgacgtggagatcagccaatcagcagacgacggggtggacatctcgatatgagtcgatagagtagcaattattagatcctaggccctgtttggatccggaggaatagccctccggaatctcgttatttaagagtattaaacgtaaattactgacaaaacccattccataatccctaagctattttgcgagacgaatctaacgaggtatattaatccatgatttgctacagtaatcaactgttaatcatggattaatatacatcattagattcgtctcgcaaaatagcctaggggttatggaatcggttttgtcggtaatctacgtttaataatcctaaatagcaagattccagagggttatttaatagcccggaggatccaaacaaggccttagctaggctaatgggctaatatcttgttcggacaaataacccagcttggcccatgggctataataatccataacatctctcttcgtttagctttggaattcctttaggctgcgtttggctaatgggttatgtctaatgggaaatagaaatgatatcttgttggaatgaggtggtagattatatgaagagaaattgtatcctatgtttggttagatggatggaaaaggaagtttctagactaatgaccaaaatacccctccttgcaataagtggcagaacatagacagatagaaaggggtcaaaatggcaaggggcaatatggtaatttcgcctagcactctatccacccctcaatccagcaggattgtgcatcccatttccaatgtatccaaacagcataaatctggaaaagggaaatgatatccatttcccatcctcctaatcccattagccatacgtagccttagcttttatcactcgtgtcagattatcacacgcagcttgaagaggctattaaatactctgtagctaatatagtactctcttcatcttatgagacttcttagtcaaacgttttcaagttaaatcgaatttatagagaaaatagagtaacacttttaacaaaaacaaacatagtatcaaaatctattcaatgttatatttaataaaactaatttgatattttacatgttgctaatttttctataaatttgattaaactttaaaaagtttgattaaaaaaaaagagagtcaaagtgtcttacaagatgaagtggaaggagcagtaactttgatatattgaaaagaaaataccatggttcaagcctattcattattgtcagtgttacggataagtcatatttcctatacttaggttcgtattgtgtggaagtaccatatacctaatgttatacgagagcggaaaggtatatccaaacaagttaataaagtgagcctgaaaggaaattatctttgccggaatagaaagtgttaagagtctaacctagagaagacaagcttcttcatgttctacttggagaagaaggcgcttactagtataaatacaagcctcccgtgaagggatggacatctaatcacgtctcacaagtcatagctagagcctcatatagagacaattcggaggaagtcgaagccctagtccaagtcatagctagagcctcatacagagacaattcggagaaagttgaagccctagtcattgataagatcttgctgagccgtaagattatattcaacgggtcagattagctagtctactccatccatataatccgtgtggtacttttctcagttcattacttataataagggttattacttagcttgagagctcaaatcagtataaatccttatctcttgtcttcttgatatgatcttgcatataccttgttctaacgtttttcatactctacaaatattattgacaactatcatgaaaaaaaaaaccatgcaaaatgtgcatgttaaaagagaagggaaatagctagaggagcactaaattccgcatagcaaagtttatttctgcaggtcttctttggcgatttgtcctgaataattgctgggaagtgcacctgaatgaatccctgatacaagcaagcaaagacatcgattcacgtgagagcaaataacatccataattaagctgtgtgttcggacgtccattttctcaacccatattgctcgttttccgcacgcacgattttcaaactgctaaacggtgagttttttgtaaaaagtttctatacgaaagttgcttaaaaaatcaaattaatctattttttaaaaaaattagctaatacttaattaatcacgcgctaatagatcgctctattttccgtgctactgttccaagttgggaacaacccatagggaacacagcctagtttagctaaacacaatgcaacatgtgtttgccataatgcaatcaatctttggactgaacgtctgaaccctttcgaaacagcgcacttttcttgagtgttctgtgctaatattccactccagaagcgcccaggttcttatcgatgccacaacgaaaatgcagcagaatttctggcttactacctctctgcactagagcattatcacaacaaatctgctactttgatagttgatgcctggtagtgacaagaagcacgaatcttaccacgtacagtgcgcgcatcaaccacatgaaaagcatctactcacggggatgtgtcggctgtcaactgaacacaaattgcaggggttggttccttccatctgctttctccacaagtgaacattcacatatggtgttccatactttgatccgcatctgatttatagccatgtgttgcgaatttgtgaatacctcgccatattcgcaagttggtgaacatatcaccaattgtattcgagaatatagttgattacaagccgtaacgtttattagtgactaaaaacaatttatagataaaaaatttatatatgtacgtattattagcgacttaaaggttaatgctaaaaataattcactataaagaccatcaaattcaactctaaaattaagtttaaattttagctacaacgagtaaacattggagctaatcaatgtgaagccttctagcctttgttatttttggcgtggttttgcaagtgtctgatctcataatttccaagtgatggataattttaaaattttcccgaatcttcatccatttatttatgtatttattttgttatggatctttttacgtgtcaacacatgagcttgggacttgggagcctggccaagtggtgctagatactaggaatagtgtacaatgtatacagaattataagaggtgagccacgcaagctgccactaactacgcgggttaaacggaatattccttgctagtaagatacaggagaacttgttctttttcttaacctgataatgtagaataaggtagcagcaactaggagccttcccaagtgactaggagtaggcttctctcacatgaccgatgtctcgatacacacatggcacatggaaatgaaacactgcttcttgaccaaaaatctgggattggacctctgtttatatttcagcctgctggattagaagggaaggaaaaaaaattggatggaaattgacagatagaccagccaaacgatccagaaaccaactccctcacgttgtaccagtggttcaaaatcaaaagaggcaggcagaaaggaccaacgaggcaacgatcgaatcgtgtccatggtctccacctcacgggagattctccgcatccaccgaatatccactaggcgacgcccccggcaaatgctcccaatttttttctcacatgcactttgtcacctgtcagaaacgtgacccctgttatcctgtaccataaactacagtatttgtacttagctcctggcatccaaaaattatcattttctctgcactatacccttatatacctcgtgcgtaagaatatctcaattccttttttttcccaataagtactccaattcagccgcgtataaactcagaaacacgtagagattgtttctcaccgcagcagattgtggcaacccaactgcggatcaaaaaccaattgttccacacatataccactcgcctgggaaaccggcagagccacccaaaagatagatgcgccgaaagcgaccgccaccaccggtccaccgcggcacacgcgacgcgagaagcagagaaggatattcccctcgcggctcccctccggatccttcccccacacaccgcaagtccgcaacgcgagccgcaagcgcgcaggcgcgcaaccgcgcaacggccgcacgaaaagcgaaaccgaaagacacaaccccgcatcccattcccgcgggcctctcggctgcttccggaaactcgtgttttctctcacaatccctactcccacccgcgcatcttcgtaatattcgctcggcatctcccccctcgccctcccgcgctcccggtatataagccgacccccccgcggcctcccattctcctcatcagatcaaagcaagcaaacaacaacaaaaaccacttctcgtgggtagaagagagagagagcgaggcgatttcgaccaagaagatggccgggatcgtggtggtgttcgacttcgacaagacgatcatcgacgtcgacagcgacaactgggtcgtggacgggctcggcgcgacggaggagttcgagcggctgctgcccaccatgccgtggaacaccctcatggacaccatgatgggcgagctccacgcgagcggcaagtcgctcgccgacgtcgcgggcgtgctcaggtcggcgccgctcgacccgcgcgtcgtcgccgccatcaaggcctgctacggcctgggctgcgacctccggatcctcagcgacgccaaccgcttcttcatcgacaccatcctcgaccaccacggcctcacgggttacttctccgagatcaacaccaacccgagcgccgtcgacgccgccaccggccgcctccgcatcgcgccgtaccacgacttccacgccggcccgcacgggtgcggcctcgggatctgcccgcccaacatgtgcaagggccaggtgctcgaccgcatccgcgcctccgccggcgccgccggcaagagggtcatctacctcggtgacggccgcggcgactactgcccgtcgctccgcctcggccgcgacgacttcatgatgccacgcaggggcttccccgtgtgggagctcatctgcgaggacccgtcgctgctccacgcggaggtgcactcgtgggccgacggcgccgagatggaggagacgctgctgcggctggtcggcagggtgctcctcgaggagaggaacctgccgccgctcgactgcaagctcgagtcgttgccggccgtcgccgtgcaggacggcatgcccatgacgctccggatcaagaactgatcaatggcggcgacgaacgtacgcatgatttcgagcgcgaaacggctagctcgaacaatgtgtgtgtgaggattgcgatacgggtataattttaactattgactgatttttgcgctacgcgtgattgagcctgcgattagtagaggctcattgtatcttgtccgatcaattgaagtaaaacatttggcttggctctctctctatgagatgtaatccatttctattatcttaaaagaaaaaaagtaaaacattcagaaaaaaagtaaaacattcctgacagtgaattgactagtctgaattttggtgataattaattgtctgtcgcctaaaatgttttacccatttcgtcaaaagaacgtgctcacccaaagtcggtttggttaatttgtgattattgtatactattagtagaatcttcgtctcatatacttatatgcaaggaaagagatggttccgataacagtggaataaagtagaagcctacgaagagctataaataaaaacatgcgcataatacaattctcggtcactcagcttttgtcttttgtgtggaaaaaaagcttgtggctcggatcaactcgaacttgcagtcttaaaaaagttaagcaagctaggctttcagtttgtgaatcaaacaagctagcttgcgagccgctagtttaacttgttagtacaatagatcaccatagtttttagtgcttatcaactaatgtttagtcacttaattacattcaaaataactgtatttaataaattatttattaggtagtagtatttattatttatttatgataaaatagtaaatttgaaattatgaaggtgaaataatatgttaaaaaagcttaataggtcagcttatgagccaagccgagatagatttttagctcgttgaggataaagagccgagccgagccgagataagatggcttgttaagatgacaagctcaaacgtaccgagcaggcttattatttgcaagctggataccgtactccaacccataagttcatctcatatttttagcttaatagactagatcagtttagctgcctgcggatgcccaaccgcacagttaccgtcctaacatgtaggtccaatatttccatattcttaccgaaattttgagatgttccacagctcgatattcgtatttcgaatgtttagcaaagatgtggcgcgagaaaattcatctagcaattcggaaagcgccacacgggcggcggaaccgccatctcctgcgctttcaccgagcgagaagatacgatgatatcttcgcgtatccggtactcgtgaacctgaaagtttggacactgattgaaagagatattccccggcaggttcgccaccggattcagcttctcaccaaattttaggcacatattctaggcatatgctgggcatcgtttctgctcccctctctgttgcgctcctcgtcgatccacgagaaaggtgcagtggacgccattgaactgcagccactggctcccacagctcgccgttcacacacgtgccaccctcccattactcgattccgaccctcgacgacggcgacctcccggtgagtgggccgcgacggccagcttcagcccacgtcgtcttcgtctttgcaacggcccatcaaacgatgggcctcgtcgagagataagcccacaatggaacgggctattgttgggtttgggcccatcacgcagcccggcctctctctcgcgtcgtgacgcacaccacccatcgcctctcctctcctacgcttcctctctctctccgacctcctcggatccgcctcgatctcctcctcctcctccacgcgcgggcggcgaggaaaccctaccgcgaacgacggcgatggcgctgctcccgcggacggcgcggctggcgctgctctcggcgccgcgggcgtactcggcggccgctacgggggcgggcgcagccccggcgaggtacgcgggggcgccgccgccggcgccccagtcgaaggcggccgagttcgtgatctccaaggtggacgacctcatgaactgggcgcggagggggtcgatctggccgatgacgttcgggctggcctgctgcgccgtcgagatgatgcacgccggcgcgtcccgctacgacttcgaccgcttcggcgtcatcttccgcccatccccgcgacagtccgactgcatgatcgtcgccgggacgctcaccaacaagatggcgcccgcgctccgcaagtcagtaccaccttcctcccctcggctgctcagatttcgcgttcctgtgttccgatctgggaatttggtgttgcccagcttttagatcttggaaattatcttgccagggtgaaaaagactcaatagctaatgtgatgtcattctgtagtgtagaaaagccataatccgaaaagccttaatccccacctttaatgtcatttggaaacttgccacaaattcgacacaagcaccaatgttctgaatgcccggacaggacaaatgggatagtgcggtgaataattgaaacctccttccagcatcaatagtgcattagtctaaatattttggcatgattcaaagtatgccaatgaagattgtggatcattcaacccaccataacttaggataacttagcatacgccctatatggccttgcagatatttgagaggataaatcgacttgataaatatatagggtcaattcaatggcttggtgttaaacactggctggatttgattttagaaccataaaccactgcctgtggatcccgatttgatggcttggtgttaaagtcttgctggatttgatttgaggacctatgcattcatggaggatcagacttggaatgcttatgcgttcaagcttcagtagtgctaaatgttaacttaattaaagcattgcgtttgacttccaggatatatgtgtaacataaattgatttgatgtttacgttgtcgattactcattagtgaaaaaacatatttgctggtgaattagatattgtgggtacatagcatggttgttaaggcattgttatggcatcgccatagtggtaaaggcggttgcaggatatatgttgttgcagatcccatgccactaccatcagatctagctcaagatcgcagttgttgcagcttgctggagcctttgaatctctctggtggcggcgacggacaatgaggtgagcagaggcattgagctctaatgggccaatggcgccatggcagtggtagcagcctgagatgttgagctcatgcaaaggtggtcggcagccagatggcggctagtgcctcctctgctgatggctggtggctggtggctggtggctggtggctggtggagtatgatgcctcttagggcatacgtagaacatgtgggtatgaagctaatgttagctttggtgggttggctgcttggcttattgggccttttatcaatttcccctttgctcttgctgatttttctacaatattctccactaatcacaccttagtcacctcatatgacatcacaattcacaacacctcatgccctatgatgctgaggcggtggtgtgcaactgtgttgcctcaaaacaccttatgccttaacaacacttgtacctaggttatttaagatttgcttgtctcgataccaattttttcaaaaaataatatagtgctccacggtagaaaaaaaaacaaatatatgccctgattatttgcataagcatggatttgcttctccaagaatctataactctagaaagcaaagaaaaatctaattctgatcagcaaggtgtagtttgtattgatgtgcttctctgaaatgtccagaaaccagcaaaaggagtggcgtgttgttctgagtgtttgaaatcaaataaaattattttgttgtatgaatgccatggcctttgtggaaatcagtgcttttcttgtgtatcctctggttatctgctattaattttagggtgctacttccttcttcttttttttcaaacatgctttttaagatttcgtgaagaacttctgttgtgccttttgctatttaggaatggttttgtcaaaagaccattcaacctttcttacctgctcacaattttataatgctaatggcattggtaacttcttccacagggtttatgatcagatgcctgagcctcggtgggttatttccatgggcagctgtgccaatggtggtggatactaccattactcctactctgttgtgcgtggatgcgaccgtattgttcctgtggacatttacgtccctggatgccctccaactgctgaagctttactgtatggtgtcctccagctccaaaagaagatcaacaggcgcaaggatttccttcactggtggacaaagtgaggcaatgcttgctactgatcttggttgttttatttctttcgaccctaattttcatccgaaataagaatggcgttgtgctcggatctgcaaacttattgttgtgcctggaaggatgtatacccaggtcgtgttgatgtcagttccacatcaatggacgagaccagtgttggaacgagtttttctttacattgtaactcaacatgttaacttcgtttatgcaaagattcgccttaagcgcgatttgtgcgctgtatctttacccttcactaaacattttattgtgtccattattggagcttcctggcgcgccgtgttccctgtgctgtcataatgttcatagtcccattgcatatttcaattcaacagaactagaaatggcagtaatacaactgtccaaaaagtcacctgatttagatattgtttaggccccttgcacatgcgtttatgtttagattttctgaagacaaagtggactgatcatcaccttttagagagagtgtggaaatttcatctgcggatgttttaacacggaaaaggtgatggcttactcgaacaacgacgtttgtgtcatttcagcaggcatcctactcaacttctgtgtcgtagaattatcacttctgctgaagacaaccctgagttgaagacccatgcatcgtcaggccagtcataaagcatttgcatcctatggagtaaccttgtgctcgagcttccaccgccgcagcctcgctcatcgatcggtggagaccggagagggatcggcagagaatgcacgtgacaccaagggactcttcaggtggtcaccgaagttcttcgtgttagaacttggaagtgggaatcgtgctatggcaggggtactgtaaaagagattattattgacaactctcaaaaagagatacatcccgttttgttatcgtaggcttaatggagttcccttggcaaagcgggccctaacctctcctccaagccaagagcgccgctacaagaacacacaccccctctgccatagccgccacattgccgcaaagacgcaaattaaaccgtcctcttctgccatctcgtacgtcgcctccttcctccaatcccggattcccggtgatcaaagcgaaagaaggtaataataaccagtgatagcttcgaatctctgtaccgccggtgtttttgttatttataatctctaattataattgcgatctaataatgatccggcttcgtgcatggtggtagtagcaggattgttcgagcgagatgaatccggcggccatggcggcgctggggtcgaagctggcgacgctggggtcggcggcgcgggaggcggcgagggtggcggcgaggcaggggtgcgcgtacaacaaggcggtggtggaggggagcaggcagctgcagtcgagggcgtgcgaggcgacgaggagcgcggccaagcacgggcgcgcgttccacgaggagctcatggagcggaacaagcgctacgtcatcgacccgcccaccatccagacgtgccaggagctctccaagcagctcttctacacccgcctcgccaggtcccctccctaatccctatagagtgatagatcgatcagcattgattttgattgattttggttagctcgatcgatcttttttttcttttgcgctccattgacgtacgttgattagcttctttgatgccaactgaacttttttttggtagatgaacatattaattaattaattggtgcgattacagattgtatagttacaaccgaaacctactactaaggatttataattgaaaagtagattggttttacggttcttgacactaaaaatttgataacaaatattagagtagttttaatcttaagtctgaagacatttgattaaactttaatattgagtggttttacagaaagatacaaaaggtttgtactgttttatgataccggccctatgctttttgaaggattgtgaaaagagaatctcaattcattattatgagaattattgtcgcgccaagaccaccaccatgtttttctccctccgtcctaacactgaagtatttgctcatgaagagcttattatttttagatgtggggttcttcagtcctttttttatatatatttttagttgtagattgccaatgcatctccaatcttcaggtgcaaacgttattaattagggtatgtttagttcacgctaaaattgaaagtttggttgaaattgaaacgatgtgacggaaaagttggaagtttatgtatgtagaaaaattttgatgtgatggaaaagttggaagtttgaaaaaaaaagtttggaactaaactcggcgttagagaggttggacatgccaaaagtatagtcgaatgtacaagctagcctagggagaagatggatgtcatattcgtcttttcacatctactaaatatttgactgctaatactccctccgtattttaatgtataatgccgttgactttttaacaaacgtttgacatttcgtcttattcaaaaaaattatgtaattataatttattttattatgatttgatttatcatcaaatgttatttaagcatggcataagtatttttatatttgcataaaaattttgaataagacgaatggtcaaacgttgattaaaaagtcaacggcgtcatacattaaaatacggagggagtaataaactttctgagggtcggagagagtaaatcatagatgttgaatgctattttcttaatttacatacgagtttgtattcatgccttacttgttgagaaggaactctgtattcgatcatgtttaggaaaggtagctgatggtttcaatctctctgcgcaatcttttctagttcggtatggggcttgtgcaaggacttcgtttatttcttctttgaaaacatcggttttatgtgagcttactttttttgtacaataataaacttctttagatgatggaagtgttacgctgtcggccgaagatgaactcaaccacaacaaaaaaaaagttgaacataatgtatttctttggaaaagttaaatatcaccacttactaaatttgtttgttggcttattagccgcaactaaaatttaaattttgaaacgtaatttaatcgatttttgaggtatttttcatcgtattttattttcactattgatttttaaatcgttaagaacacaaatataaaaaaaattctacttacaaattatttttgtttactttgtttatgttttttcatggtttatcagccatcgtacaccgatgagatactaacaagttgatgtttcgatcttgcagcatccctggccgttacgagtcgttctggaaagaggttgatggcgcaaagctcttgtggaaaaacaggaagaatctaaatctaaaggccgaggatattggcgttgcaacattgtttggtattgagttgatagcatggtttgctggtggtgaagtcgttggtagaggatttactttcacaggctaccatgtctaacctcttacttctagcaagaacgaccacacactagtcatacatcatcagtaagatattgtgttaatttgctacttagtagaatatgtctagtctgatcttagattcctataattcaaggagatagtagtagtttttctcttcggcacgatacaagttttgttattcttgttatgccaccaaacagcatacatgtgaaacagccatgacaaactaattggtttatttattatatctatataacatatggtttatttattatactctgtttggagtttagacatgttagtgtcctggtgtgtgtgatcacttgcaattgatttgcacattaatactgctaatttaattcatgaaactgctgctggccagaatccggacctcaacgggcaatctattcaattgattgagtatttcaatggccttcactctcaaaaactccatatttcattaacactgccatcgcattgctccatccgtttaccaccttgatcaccacctcgccctcctcaatggcgccgctcaaaacgttgctcctcttcctcgtcgtccttctccccgtcgccaacgcatgccagcctccaagaacactccacgtcccggtcttccaccgcgacgcgctcttcccgccaccgcccggcgccaagcgtggcagcctcctccgccaacgcctcgccgccgacgccgcgcgctacgcgtcccttgtcgacgcgaccggccgcctccactcacccgtcttctccgggatccccttcgagagcggcgagtacttcgcgctcgtcggcgtcggcacaccgtccaccaaggcgatgctcgtcatcgacaccggcagcgacctcgtctggctccagtgcagcccctgccgccgctgctacgcccagaggggccaggtgttcgacccgcgccgctcgagcacgtaccgccgggtcccctgctcgtcaccgcagtgccgcgcgctccggttccccggctgcgacagcggcggcgccgccggaggaggctgcaggtacatggtagcctacggcgacggctcctccagcaccggcgacctcgccaccgacaagctcgcgttcgccaacgacacgtacgttaacaacgtcacgctcgggtgcggccgcgacaacgaggggctgttcgactcggcggccgggctgctcggcgtcggccgcggcaagatatccatctcgacgcaggtggcgccggcgtacggcagcgtcttcgagtactgcctcggcgaccggacgtcgcgctcaacgcgcagctcgtacctcgtgttcggccgcacgccggagccgccgtccacggcgttcaccgccctgctgtcgaacccgcggcgcccgagcctgtactacgtggacatggccgggttcagcgtcggcggcgagagggtcaccgggttctcgaacgccagcctcgcgctggacacggcgacggggcggggcggcgtcgtcgtggactccggcacggccatatcccggttcgccagggacgcgtacgcggcgctgcgcgacgccttcgacgcgcgtgcgcgcgcggccgggatgcggaggctggcgggcgagcactcggtgttcgacgcgtgctacgacctccgcgggaggccggcggcgagcgcgccgctgatcgtgctgcacttcgccggcggcgcggacatggcgctgccaccggagaactacttcctccccgtggacggcgggaggcggcgggcggcgtcgtaccgccgctgcctggggttcgaggcggcggacgacgggctcagcgtgatcggtaacgtgcagcagcaaggattccgggtcgtgtttgacgtggagaaggaacggatcggtttcgcgccaaaaggttgcacgtcttgattcaacttaatacacttcttgagttagcctgaagcacgtgtaattctactacagttatcaaatgttgtttcagctcgtacttaaatgtgtgattccgatgtattttggtacatttgtaatggtctaaaaatattttgggatcttttcccttccgtcgtgttaaatgttagactactaggcattacaacactacgtggttatggtgctattatcacggttatcacgtacaataatcttttcagtttttgaagccacgctatactgcacgtttttgaagccacgctatacttcacggtaaccgcacggtttttacggtaaccgtcaaaccatggactaacggtaacctcatcctaaatggtttggtaaacactaaaggccacacgctatagacaagggggcatcctctccaggtttagaatcctcccccataagagttcatgttattttttacccaaaaaaacttgcacaatttttttcttttagcaaattcccttgctgatttggcactttgacaattgacacgatctatcatctatggagttggagaagctgcggccacgaggagtcgaggaggcccccatgccatgcgcctccctagcggctatggccacgcctcgagcacctgatcgagcttcatttagttgatcgatctgaaaattaacgaaacaagagcacattgtctctacaacttcttttttttttaaacacggattgatgagttatcgaaatgacgaatgaatccctgatcgaagcatcttttccccgcattgtgcagatcgaatttcaagctttattagtagtaatgggcggcgcattccagcgccaggtccggcctccaccactggtggatcccgtgcgccgccttgaagtccggcgacgcgccgcggttcaccgtcaggacggcggacgggaacaggtgcagcggctcgcatccacccgccgtgccgatgcccagcagcaggtccttcaccgagttcctcgtcgccaccctccccacggcgcccgcgccgatgtcctccatcttcttccggtggtcgaagtaccccacgtactcggcgctgatcgggtcccccgggttgacgaacacgttgggcacccaccgcgccagcgccgcgaaggcgtcgtagcctccgccgccgctgccatggtgcaggagggtggccgcggcggcggtgacgaagctgttggcgatgcggacgccctgcctcacccgcctgtcgccgatcctctccaccggcgccgacgggaacggcgcgttgaagaggaacgtggggagggcgacgcccgccctggccatggacttggcggcgagcgtcgagatggcggagcccagggagtggccggccagccagacgcggtggtgatgctgatgccccgccgcggccacgacggcgtggacggtccgcatggcggcgtggaagcgggaggtgcggtcgaggccgttgcggacgagctggaggtcgagcgccaggtcccgggacgccgaggccttcttggtgatggtgccgcggaacgcgacgacgtagtgcggcgcgctggcagcggcggcggcggcggggtcgaggaggtgccacggcggctggaacgcgtagacggcgccgaagatggaggagtcggcggcgtccacgagcacctctcgtacctcgaagtggaagaacctccaccacgccggcgcgcgggcgtcgtggccgtgccggttccactgccggtcgcgctccatgacgtacacgccctggacgaggctcgccatgacggatcgctggtggtgcgggcaattcctggccggaggaaaaccatcagaactcaaaggtgatcagatcaatggttcccaatgcaggttcctgcttgttttctttcacaaaatatacgatcttttttatgcttagttgctttcagcactgcaagttagaaatctcggggtttcaaaaaaaaagttagaaatctaagcacggtactagacaatgcaaattcttcaaggaaacagagcaatctgcaaccaaaaactggaaagttttttttaaaaagtaaaaaaaaaaggaacaatggaaaagagggaatcagcaaactaccaattcacatatgtcaagtacgtaggtcctgacacctcaaagatgtccttctgtgacggcattttgcccatctttttcttgctcggttgctctgcacaacaaagggaagaaatttgcatgttagtctcagtgtcataggacagaaatttacagattaaaccgctctacttgattatatgaccaagattcccactttcctcttaacttaacagctccactctgcagtatcctgctgcatggatgtatccacattctgtacagaacctttgtgtgcagcaggaagagaacttttgtctaatcatattctctagagctcaggatcgacagtgaaccaaatagttgacaatgtgatccataaatccgtgatacatcaatcgcgtattcacaatttcacattacaagaatcagaggagaaactaaagaaaagcagcaagaacattacccggagataaaaactactctttgcatatcatctcctgctgaggatcatcctcatcttcattgcacttctgactctgaaatgaattcctcatagcaagagcgtttattagccaaccagacgacttaagtttcaagatcaagtcaagaaaggaatctaactttttttaaaaagcgatgaaaacaatagtttaaaagattgtgcgggcaacgaactgcatcagatcaaatggaagctccagttgcatgatttgggcaattttttgttggcgctgactcaggctgcagaagttaagaaagggttgtatcggaagagcaggaaaccagaagactttatcacttatttttttcaagaaaaaacttatgagcatgaagtctccggttttgtacagttggtcggagcacaagtggcttaaatttataaagaacatatcatgtgccgtgcagatttgcatagcattacttcctcttcacatcctttctggaggagcaattagagcaagtttaataatgtagccaactactaactctaaaaaatgaaacattatctatagccaacctaataatacactcatgcaataattatttgtacatataaaccgcatcattaatacctaatccatccatctcttacatagttattagagcttgtgttgcagccaactataaatctataacttttcttgtctcttgtctcttctcttttctctccttcacataagcacaacttgtacaactcatttatataaatcccattttactcactcttagaagattgcaattaatgaagacatctttttttttggattcctaattggatacaaactttggactggttctttatgatatttttgctgacaaaaacatagctgagaggtgaggtgatattgcttaaggctagtgatgacatctgaaaagtctaaacgtgtcgattggttctctgagttatgcaacttcaaaatttttgtatgacgggcccggttgacaaaaccagaactggtaagcaaaagtgcttccaagttttttttttttctaactcgtcgtggaagaatctaatgtggtcgataactagaatgaagtgtggatcttccagaattttgtgtagctacctggcaaatgatagaacaaccctgttgtttcgcttatgcttattagccaaactttgaattttaaaacttaattttaaattcgattttatggttttctttttcatggtttattttatattatttgtctttgaatcgctaaagacatgtatattaaagttttacctacaagttatttgtttcctaataaactgtctggataagagcaaaatgatatagcttgaaatgacttcggaaattactaatagagataattcaataaagttcattagcaaattgtaactcagaagactcttacatgtccttttggtcgatatgtggaatatggatggtggaaacacatcttgaatcccccttttcagacttcagagcatttcaaatggaccaaaagtaagaaaaaacaatgccttctattccaataaatattgctcattgtacactgttacagtaatcacacttcttttccctgtaatcctagaaactctgaaagtcgattgtatcaaaagtttgttttcttgccccttctgactgaacattatctctactctatcatgaagagactgctgctgttgttgcacgaggaacatccacaagcctctcaagcatttccaattgatcataaggtgctatctgcagagaatcagattcatgttcatttcatctccatttaatccatctacatgaatttcggaagtctactgtacatgaaataatctttattttgtattacattacctgagaaaaaccatcaggccaagttatagaaactgcgtagtttcccataggacggatctcttcaggttcaatgtcttctggtatatcaccatattgtactttctgctcacctgtccattcgtcctgcagacaagaactacttagtttgtgcaaaacaagggcaactgtgaaaatattggtttctgaaaatacagactacatgatttagtttctgaaaattataagcactgtacacgccatttgaagtcgatgccagtgttagaataatacacattaaacggcgaaaaggtatacccaccacactttgagcagatcggtcattccttctgactgttgctggatgcaacaagaactcttcatctgaatctggtactttcactcggattgctctaattgatctatcataggaaactgctgttgaaactggcaaaatgaaaaagattaacacatcattacaggagaaaaacttggtaaaaaaagaaacatatctgttttgctgtaatacattttttgaacaaaagctggcagtatttattttttttgggaataagaaagctggcagtatttattggtatacttctttcttcgttttgtttaaattttggttagttcgaattcaccaagaaaataaattgtatgaactacttttacatattctaggttgtaatttgtgaactgctaacttaccctgttgtctgattttagcacactgctgaacaacacaaactccaagattctgaaacgtcttagcaacatccccttgtggatcagccactacttcaggaattccagtatctccagacgctgaaagctgtaaattataccaaactgtgatcattgcactcacttttatccttgtacaagataggtgggattgagcttacagttggccgtatcggcaaatcgaagaggtgaggtattccaaactgctgcacaacctgaaataattgcaatgctgacgcaattcaaaaaatattcaagagaatgtgctaaatgtgcatcaaaacttttcttgcctgagctccagaaccttgcccaaatgggtaaaatcgttttccatcagcatcgaagtagcacatgttctcaacaactgcaacgcacggaaccttcacaaagaagatgaagatgaagcagaaacaaattgatgcacgaatagtaagcacggtagattacaattaaaatgaacagtgatatgaagattacacaccttcagcttggaaaacattctaactccctttgcaacatcgatgaaagcaagcttctgaggggtggtaacaatgacagctgcagtcaatggggctacctgatgtttcagacatgttaaatttcacagtgcctacaagcatggttgatgttaccacgtgtgatttgtacaatactcaggctagaggtaccacctgacagagtgttaagtgtatatctcctgttcctggaggcatgtcaatgacaaggtagtcgagttcgcccctttatgaaaagaagaaaaaaagtcaagttttttcaacggaacccaataatattattgggaatctacgaaaggctaagctggtaaaaatgggctgctttattatgttcatcagatgccttcataaagatgtcaagtatctcttttgcataccaatcagtagtggtcagcaactgattaatcactcccgaaaccattggaccacgcattatagctcttccttgtccagcaaagccaaaagacaccatcttgacgcccaaatactcggttggaagaatacttctgctttctgggttctaaaggtaaatctgtttaccattattagtgcaaccactaattttttgttaacacaattattcaatcagcttaccatcactagcagccggttttcaggagaaaccatagttggtaagctcggaccgaagacatcagcatcaaatattccaaccctggcccccataccagctaatgtatatgcaagatttacagcaactgtagactttccaactcctccctgggaaaaaatgttttttagttacttactactaaaaaggactgatttattattatcctgaggtcttgccttgcagcttgaaactgctatgatattcgaaatcttctgcaatccttctggaagctcccctgcgtatgctggtcgtgcaggttgcgcagacattgtaacattgaccttcttgacccaaggaagtgctgcaacaacctcatttgccttctcttcaaactacaaagcaaaacaagtcttcatgcaattttgccgcaaattgtttttccaacccaggataggacagcatttttacaaacagataggagtataaaccaatcagttcacatttatacatctatctcatcagatgccaatgataagcttaaccgatactattatctcaaaaccaatatagttactgctattttgtttgagacaactgaagataaagagtgaatagttccacggagataactgaacacgtcaacacaggaactgtactcaccatgtccttgatcgggcaggcaggagtcgtcagctccagacgaaacgagacctgaaaaagcagagccaaatggagaccaaagtaagccaaatgttcgagcagtgcatccaggcttcatcagcaagtgtccttcaacttaacctcttccaaggcctcgctaatctccaggtccttgacgaacccgcacgagacgatgtccgtcccgaagtcgggatcgatgatttgggagagcgccacgagcacgtccttcttggcgtcctccaccgacgccactgccacacacaccagttcgaaaatcaaatggaaagcacacacaaacgtaaaacaaatttcgcagtttgctgagaggagttccgactgacgaaggttaccgctcgacgaagcggctcccgcgcgccgccggagccggcccacgcgccgcggcgaggggcaccagccatgcgcctgggcggccgccgcggcaggagaagccttcgccgagaaggcgcctgcaagaaccatgaaatccgtggagttagctcgccggtgagagcccctgctcgggcgcgtcagagcatgagcacggagtagaagctgaacgcgagacaaggcaaccatccaaccgccgtgtgcgctcacctcgcggggttggagtcgacggggggaggaggagagggggcgcgggcggcgcgaggaaggaggcaggcgcggcggcgcggaggttccgcattgcgggccttcgacggcgaggcgaggagatggcgggcgcgcgcgcggcgaggaagcgtggcgcggaggagcggtgggagggagtggccgtctctgggccgctggttgtgtggatttggtttgcctttgctcgcttgaagattagtggtacaggcagatggcgagagcgtggcggacacgggacaccgacgagtgggccctgttggattacattttttaagataatggaataaaaatcccagcctctgcaaatttttggattacatatgccacaagtagttcgctcgagtgtcggtacatccatagaacgggagaaggcacagcagctaggtaaattttgtcgctaagtttgtcaagaaaagtacgtattttgcacattatttttttcccgagtttatacgtggatagtaaaatgtagtggtcaaggttagtagtatcgggaaagtgaaatcatctctttcgtgcacgtcacctaaatagtcataaaaatatgaaaaaaattggcaacatagattaatatgaaatatatcactccacaaacatgcaagtttaaattcaacttctacaagttgtaacaaaaataacaaatatagttgcgaatgtgagataactattttcagtttaatttgttatttttgttgtaacttatagaagttgaatttggtcttgcatgtttgtggagtgatatatttcgtattaatctatgttgttaatttttttaaattttttgataactatttagatgacatgcaaacaacgagaggatatcctctcgagagataaaaatagtgttgtttcattttatagatggagatgggccgaaagttctaaacgcacacgaagccaccaacagctcggacaaggcacaaggtaagcacatatgtgcatgggaacaagtccgcctttgtccctcgtcttcccgtggagtttaaattctaaaccataataccagaaattttaccaccccttctccccaacttacaaaattggattaaattagatcctatgataggatggatgaccagtttcgctgacgtggcatcctaatgagaacaaataaaaaatttggggcccatatgtaagtacacatccacctctcccatctcttcctaggagctcattggtgaggagatgagcggggtggtcggcgagatgatcacgaaggcaacaatggcagtaggaggtcggcaaagaggggctccagtggtttgtggcaacacgggaaagaggagggaggcaagggagacagtgcattgtgagtttgcctgtgggaagagaagcagtggtggcggtgccgacgagcccctgggagcttgagctcgtccgcccttcagtacgcgaagggatccagtggcggcggcagccagcaagccctacgtgagctcaagctcggtcaattgcttgtgcgaagggaggcttgcccaagtcctatcacaatcagtgaaggacacccgtgaattcgacagaggatagacaaatatgcaatgacaaacatgacggcatcgcaggtggtgtgggtgggagggctcgctgcatcgaaagcaataattgtacctgcgcccacccaagatccgtctcccgtcctcgatctccaactcaatagcgttgtttgggcccttcccgacgatgcgttacaacttcaataagaaggagatggcgcctggcgacagcctacaggcgagcaccttgaggagcacatgctgctccactttgtgaacccatcacccgccaccagagacaacatcgacactgaccgcaatcttcatcaagggtatttggcgtatagcttgtcgtcgacaccgatagtattgagcaagttggcatggaggagacgagaagaagcataggaagaaggtgaggtggtcactttacttgcgagccccacaaactaagataccacatcagcgaaacctggctttgcgaattggtggtggtggtggggggagtgggggttcaggatttccaatattgaggtttagtggtactatttaaaactcgacagaaagatgaggaacgaatagtacacttattgctatgtccatgctatgtgttgcagacggtccatatacgtagcccgtgagcgtctcggccctggcccctccagcactcgccggcccattgccagacaccacaaccgcgtgacgcacctttgctacacgcgacacaacaacttgtcctcactcgcgcccgcgaacgagtgggcattggcccaagcgcgggacggagcgccgcgccggttacgcaacgcgaagcgggagccatcggttggcttccgcttccgcccccgcccccgtccccgcgcgcgcgcgcgcggccaacgccaacgcagcctgtttatccgggtaaagccaccacgaatcgaggccactgccggtcctggcgtcgaacgactcggcaagtgtacatgatccaaccggagatggtcgatcgtccaatgcagcagcgacgggcaagattgtgatggatgagtagttgaggaccaatttaaccgaccgatgcagggaaaacacatgcactgaaaatggcgcttcttccctagttacatttcctgatcaatcctgacggtgcttctgtatatgtgcacgcgatgcgttcaagaccgagacggacgagaaggcacgaccccatggcgtaccatacacttgaatacttgacgcgacgagatctcacatatatgtattatccccgccgatctatcattctactactagcttagctagcaaccttgggagttgggggccacccacagctctgcaaacttcatcaccttggagacgctcgccagcacctcatacggcgtgatatcccctatcaccaccaccttcttactctctagatctacctcaaacgacgtaacacctgcacaccacacacagaaagatacatgttcagatgcatgtaatgcagagttcattcagactaacttgaaagttgaaactgacaaatcccttccatttttcgcttgatccggcaatgagccgacagacggtggcaacaaaccatcttttttgtagagtgaagtaaagttttactaccaaaatcttgggtaccgactggggtggcgacacctaaacttctttccagaaagggtaggcaagcacaggcaggaaggcagccatgcacatgtgtacagtgcaaacatgtgctgaaacctgcatataatgcatggatgcatttggcctgcgtgcctgcacaagccgcaaccaaaacgacacgaaagccaactcatgagcagcggatgatcgcacattttcgagctccgtgacctgtaacaatactacttttcttcagaaacattttcgttttctgaaatgatagtggctttatggagcagagcacattgctgcttggttgtgttcactgttcgccattagcgaaacaacgagggaaccagagtagatcgctggggttgggttcttcgctttgcttatactgaaatcattggaggtgtacaagggtcaaccaccggggcgagtttttcttccttgcactgacaggcccgtcttcttgcagcagctacgaattcttctgaaactctgaacaactcactgccctctctgactctcccagactctgctcacatcccaaagatgcccatgtggtagcaccaggctacgttataaaattctcagatgtacgccatttcataacccggtgatttttaaaagataacaccgactcagtgattgattcgaggtcctagatagtactaaaattcgacaaatatgaatgcttcgcttgactaatactcctaagaaatgtacacacttgcatatatgcatgaagtacgttgaagagatgttgagtaaaaaagatcgaggcaggattcaactccaggatttcaggtattatcaccttttagactagcggactgtcaaattagttgtcacaaattcgagtcccctgcccctaagttattgctgtgccattgctattgttgtgtgagtcacagagtcctcaagtaattgcaacgaagaaaaacagagagaaagagaacgaacaagtgggttacttgttcagttgttcttgggggtgaagaatcatgagttcatggcactacaaataaagttcagaatgatatatcggttcaagtagttttgttcgtttggtaaatgaaaagtgcaactttatgataacgagtacttcaaaatgcatcctttttagcactagggcctatcaaaagaatctgaacaccgtcccaaaaaaaaaaaaaaaagaacagaggatcagctgtctcataccgtccatcttggatatatgcttctgaactttcttggcgcatccgtagcagtgcatggacaccctgagctccacggtctgcaccaaccaaaaaacgcaacagatggaacagagagaaaagcatcagcagacagaatgttttgcagacatgtccttaatagaacaggggagaggagttcatgttcatcacctttggctctagatggaaagcgagagtcttggctccgccgacgagatccttgagcttcacaagctcttccagctgagagctcaccagcgcctccctctcgatggcctcctcctcgtcgtcttccaccgaatgtatgcagacgcaggcgttcgtgcagagagcgagggagaagcagtcgaggaccttctcaaaacctagcttcctccccatctctcacaaagtgcaatccttttgaaaaaaaagcagccaatgtctactgcctctcgccaagattggctgggctctgctgcgcaggggataatgtgaagaatggcacagctttgcgcgagaagagacaagtagatatgcgagctgagccagtagacctaccaaagcgcttggaatgaggtcagggaagaggcatatatacaagctgtagcagtattgaagtgggctattgcccaaaagtttgaagcaacttcctagaaatattattaacttttgttcagtgcaagacatggtcaggcgccggttttacaacgagacaagctggtaagctctgcatgtgacaatgtgcttgccgattggcaggtactagaactggtgcaattatgcattgcagaacacattgcaatgtttcttttagataatgagaactcactgcaatgtgataatcattcctggtctggtaggatgtatagaagagagagtcagagaaccaaactgagggacaacacatttaggtaaatcataagatacaattatagaagtaatcatgctaaccatttggctagtaattaatatacataaatactccatatgcaagtaactgaaaacatagaaaatctgcagcaagacgtcgttgattcacaaattgccacataagtgcctttcacttgtccacatcggaataatgtatgtatttgatcgtttcattcggtggggaacacatgccaacgtaagctgatcagcatagagaatacaggcaagaaggcatcagctaccattttaccatataaaaccatatccacttgtcttgcgccgaagagaggaccaaagttataaatttggtcggagaatatgaaatgcgagcaggtcaccttcatagacgcatgccacagcggttctaatctttgtaggccacgactttgtaagccacgacgacctttagcctctaatatcaaatatagctacgcaattaggaattgatttgttgccagtcatactctaatttgctcatctagacgcgtctgatcaatgcaaaattaatcgctaaatcttacgtaatcctcccattgtcttctactaataaaaaaagaagttataaactagtcgcgcatcgtgtgttgtcacctttttactttccgaaaggcatgatggatgcatcggtgcgcatcgccatttgacaagatcccaaagggctacacgtccaattaggggagagagacgagacatgattgattagcctgtaatgctttgtgcttatgtgcgacaccgacatcttaatcggttgtactcgcaaaaggggaaaaaaaggacgtcttaatcgcgtccagctctgaagaacagtggcggaatatggtggcgggcctcgtgcgattcaactgttttttcaaggaagcgcgcagcgactggatctttcactatttaactctttttgaaaacttattttatgaatataccctaatagaatttatcccaaaaacgacttaaatctcggcagcagggttgttggtggtgctgatttccaacgtgtatgtgccaaagatcttggcgccaaaaccctggtacattctaagggcctgttcactttgatgctattttcagtcttactaaattttggtaaagttgcaaaaaaaaagtggctacatttagtttgcttccaaattttggtaactatataagaaatcccggcaactatgctaaaattttatcaatgccaaaatttgataaggttgaaaatgacatcaaagtgaacatgccctaattcttaagaaatcaacaccaccaaacaagcataggtgcatggtgtagaagtgagatatccagactgctatcctagttaattgggtttgattaatacttgttaacttcttaagagaactgatgagctctgtgccaaaggactaggatctttggtgccgagaagttagacatcggctctaaattttttggtgccaagatttgagattaattataaaataatttcgtcagaatctatctataaaacaagttttctaaaagggataaattgtgaaaaatccagcgcgcaacgatgtgcatccactactgaataccgatgcatctgatctatctgaaaggctcgtggtgggtggccattgggcaatgggcaaggaggggggggggggggggtggtgctgaggcagacatggcaggtgggcccgagcgccgaattactggctctcagtggggaggacggatcatgtcgtacctcttacccagcatggattgggttgtgccatttgctttgcctcgttgtgaattgtcctggattccaagcaagcaatgcgtgccaagttcttaggattctgcaattcgccgactccgttcggagccaccaaccaaatagagcagtaggattctgtagatgcttcggaccccatgcattatggtgattgtgaaatgcgattgcagcgcatcgatatcagagtccatgtccaaggtaaaacacagtgtgagcacccgtctcgcgctagcgaagacgacaccatggaaacggtggcactaggtgactgcactggtggagtggctctttcttctgaactgtgaggagaatacatcaagtgcaggggaaagccggaaaggccattgtccagtctccatcaggtgggcaatcagctaaaacgagttgctaactcggctagcttagtggtctgtagaagtgtagattgccctgtgccccgattttttgagcgttcgccatggtgatgactgatgagcacgactcacatcagatgtctacgtagctaccagcattagcattggtgctgcctgtgaccacctcacaactcacaagctcaggtgggctctctttgccttgtcttgaaccagacgacgacgtgaacatgttcggagggtggggcaacagtggacggatcacggatgtaggagcaagagggcctgaaaagggtgaagcaggggccaggggcttcctctctccattgcccgtttcgtccaatccagatagtaatctcagcatggtccagccggatgaacacctgggaccttgctcgagagtagttgagcgactagggtagaaaatcagctaaaggaataaaggacggcttgagagtttgggggcacaaaacttggttgaacgtctcccagtagcccaaatgagcagagaaaccatacccggacgttaaacgtatgaataagatgtgagatgcgtccccagtgccagcccctacccggacgttaacgtgccagtaagtttcctgaaaacatggcatatcatttctatttttcttgcgttgccaccacgcacgaagtgctaacgaaagtagtactaatctagcaaaggccgagaaaacaagagcttcaacagaaaactgtgaaaaggacaggggaagaagtaaagccttttgtcgagcaagagtgactgtagtcttgtaactgttgtctttgggttcgtcgagcaagagtacatactatgccatggaatctggaatgaaacattacaataattgccaggcaacacacaagcagaaaactcaaatctggatcaaactggccagcatcaggacagaaaactctctgatattctgatgcaaaaggtataaatacacaaattcttgtccttggtcttaaaagaacaaggtaggagtggcagacaaagggaaaaaaaactgtctccgtctctaatgtccaggaaactatacgctaacttcctaagcatgaaacgttttcgcaatgatatgcgattgatctatagaaatttcccaagggagacataaagcagaaatatctgagagcaaggtttattaaaaaatctgcattgaatactatctaaatatttaaaacataatcagaaatacagtacccttggcagacactgacgcaattactattctggttcaccaaatacaagctagctttctgatatgaatacatgatcgtaccctaacaatctaacatatatacgtatcagggttgaattataaaatctgcaatccaattatgtaatgtacaaaaaactttatatttaccttggagataccaatgagggcacaagttcagaaggttgggggtaatagctgccaaaatgtggtggattatgtgttgctcccggagccccagtagaactagacgatactagcagcctaattcattgaaacaatgttaaaaaagaagaaaaataaacaaatacaagttcaggcccagaaagctacatttagatgccacatttagatggaattgtgttagttataaaactgaacctattaagatacctatgaaaacatgttaaagagatgaaatccaataagtgtaatgattgtttgaatggtttggcacatgagataaatctaaactttggacaaaaagggcatcttatggtacagagcctggttcactcatgactgaagttgtgctatgttcatgcaatgccatgtaaccaaaatttaaagacatgctacaattatatgccctagagtaaactatgtaaaagtccagataacactccccaatgtaggcatgtagctgtgcagcaattggtactagcagatcataggttagacaagcacagtcgcaaatactctatgcttgtcatttgaagagacattgcaaaggaatgttcaggttaggctgtcagagaaagttgccaccaaacacattctaccaattataaatcaaagcacaagaattcgagaaaccagaatcagactggaactcagcttatctgctccactagctagcagacaacttcctgggaacccataaccaggccatattcagctggaactaaaactcactgataacttggcacaattcaaattttagcagtcctctgtgtctgcagctcatttaactaaccagccatttatcaccatttttcttaaaccctgctgggcacaccacttagcaatccaatcagaactatttgttgtcctcgttaagaaattgccaataccccaggtggttatgagcaatgcaaatttcaaaatggagtgcttggctacagcaagccacaatatttaaagaaagtggaatagttcttccaaaagttatgcaagaaaattaagtcctgcataccatgtcatttgattcatttcagaactgccaccgactagttgtcgaaccacaaatctaggcagagtcctgccaatgaaaggggtatcaggtcccctaggatgttgtccactgaactgcaaagctgtggaggaaagagaaatgagactgggaagtccatataatagagtgcctgcaacgaaaaatatagaaagaacgaactatatgccatatgagagtacagagaatctccaattatagcacatgaccagccaagaactctataggaacctgcgagtaccatgatacctagctccaatccttattattgaaataatgtcaaagagtaacccctaaagatttccataattgttgtacacaaatgtagtttgtctgttgatagataaagtcaaacaatgaaatcaaatcaaccattttttcatcctcggtgaagtgcatggctacataaagaatatctgcagtgaataacaaggatactttgcatggttgatttctttacagctttttcttcttttcatatcccactatatgttgcattttgtattactaaactgacttaccctgtgaaacaatacgaatctaaaataatgatggaggtcgagttgatgcaccctagctaacaacataaacttggaagtaatgctggggatcgagtgaaaacctttgtcactgagtgtaaggccccttgctcctgtaacaccatgaacatgaccttcatcataagtaaaagagggcccctccacctcctcttttagctcagtcttcactgcagatgacactaaagaattgactaaaccaggggacatacttgtctcaatatcttcatttgaacttgtcacatgagattgaatttgggtggtactgagaggtttcggacaaaacaccagagtagacacccttgatgtggattgaaatggtcgatgaattgacctttcctgataaactgcattataggactgtgcataagagccaattgcttgaccatttgttgaacaagaaatgctctttgtgcactaaaagaaaggtcaaacctgttcctttatcactggattttgaatattggatgtagttgtctgatgctgatccagataaatttgagccaggattatcaatttcctccatagcatttgtgctaagagaatcaagagtgttccctctaccagatggaacaacagccttcactctataaacaggacgcgattgtggcttcagagaattatgagccatacggacagaggatgtgaagagtttactaaacatcacagctcgcgctttccctctctgaataaaaggttgttcctgatgagatgatctagaatggtaaaaggatggtgaagctgaattcaagtttgatggagaagtttgcttcatgggaaagtttttttcagtttggaaacccagagtttgagagggatacttttcccccttctgcattggaagaagcctcttcattctgagatctgcaacagtgaagcatagacaacaacattgcttaatgttagattcagctaggtagtcagagtaaaaggagcaaaaatggaactttcgctgacctaatatattgtcctgaacatatctctggatcactcctccaatgagatacatacgggttagaaactccccccctgtaaccatcgtgtgcactggtgaaatctttagcattgccataataggtatgtgattctctttgaacataggcaaaattcttggtatcaccatgatcatagtaagtgtgaaatttacttggaactcttttgtagttattggcactgccatacatattgttggattctttcagaaagctaatgtggtccctggtggtagcaaagaaagtacgtggttcctttgggacatacttgtactcttctctatcatcatgatagtaagattgggataaagttctttcaagatagccatgatcataacgatgtgttctatccccaccccatgctctaaaagagcctcttggtccccttccctaaaaacaacaatacaaacatagcagcactgtcaataagaatagacacaaaaaagacatagtgacaatggcatagtacctcgtttctcaaaaaaaaagaggcatagtactcacactgtcatttggagagttatgggagttcgtctcataaagcctatcatgatgggaattcatctcataaaacctatcatgcgcccatacgttatcatctttaggataccataacttttggccaccgaaatttttcctgaattatgatcattggatgcattaggcagcaaataaacgtgtccagatcaaactgaatattgttgaaactaatttatagaaaaagaaacacatgtcaagcgctgccattgccattgcccaggaaatgcacttaccaaccagttggtgaatgatgacaataactaacaaatgaaactaaacaccaatttatctgttcaaactctttagacaaaatacattggaatatgcatgctacaggcttccagctagacagtttgaaacaatatacccttttggcattttctatgcttattagccgcaccaaattatacgatcttcactctcatagtgaataattcagtcattccagtgcacataatacatatgaaactgtcggaattttgcacacaatggggttaattgattgataaaacaatcctgggtgaatagatgaggaatctaaagcacaggttgtggctataacctctattttcagtttgtcactcagaactatactaatgtccggataaacaacggaaaaatagaacattgagtcattgaatcaaggatgaagaagctagaacctttggctcccgtgcctgccattctccgggtcacggaaacggtcatcgtgcatgtagaaggcgcctatcgttggtacggcctgggcctcgccctccttgttcaccacctccgctccttccaccgcggcttccacctccgcctcctcaccgtcgcacttaccctcgtccccaagtgccgcgaccacgccatccgcttcctcgtcgccgtacctcccctcgtcctcaagcgcttcttcgtcggcgcacttcccctcgtcctcaagtgcctctcctcccccaacaccaccaccaccaccaccaccaccaccaccacctcccgcctccaactcatcgcgttcctcggacccctcctcctcgtcgtcgtacatctccgcggcgccctgcccgtcggagtcggagtaggagtcgaggtccgaccccgccacgctccacggcgccgatgaacccgacgcgccgccgccctcctcgtcgtcgctcgccgcggcgcgtcgcctcaccgccggtaggggcgcgtcgtcgaggtcgctctcgtactcctcctcatcctccacctcctcctccgcctcctccttctcggccatgggcgccgtcgatcgagatgccgcgggggcgaacaatcgggagaggacgctagggtttaagcttagggtttgggggaatctagaaggttcgagaggcttctcgggctcgcgttgctgttccgcctccgcgcattggctcgattaaccacctttttgctttccagctgattgatcagctcctttggggggaaaagagaaggggttggaaacttggaatcattagctacgccaatgacgccaaaaaccattggatcgttcaaatgctgggaagtcgagacgccgacaagtggggccaccggtccaatttcaggtggattttcatggtcccacatgtcatcgaattatccagtatatgctcttatagtagcgtgtttttcttttttgttcttttttttctgctgcttctcatgttttggcagtcttagagcaagcttaacggagtggtatagctaactactagctccaatttatttatagccaatctaatagttcattgatacaacagttatctataagtatatactacactattaatatatggtcccatctcttatacacatataatgtattgaatccgtgctacgaatatgtagcccgttttattctctcttttctcttctctccttcacacgtgcataattattgaaatccgtgctataaatatgtagcctgttttcattctctcttttctcttctctccttcacacgtgcttaccgttattgtattacagatggtttcaatcacctgcagactacagtactatcttgacatatgactcggcgtctcagccaagcaacggaatggtcactagtgtccatctaaaaaaaattgatcacggccatgaaggcgaatttcttgactcttgagcggtactggaagcgaggatctctcggaatgcaagggttcaatcattttatcctggagtaatcataccatgaacaattcagacttgatcgtacagagcgtcttaagccgctgatcagttgtgtgacatttcatctagtaatacttggatctaggatcatttgaaatgccagagcttgtaaatttcagccgctacaagtattggacaaaaaataataataataattcagtactactaacacagaacgccttccacgaacagcggcagagacaacagaattgttcctgtcagtatgtgtgtttctcttttttaaaaatgaaataattcggtgcagtgtcatgtctatttcctttcgatagttctcatttatgtttgttgagggaggaggatgctcatacagtaatcaagaaaattgatctaaataatttattattctagcagttcaagtagtgaacaagcctttcaccctgaattgagcaatgcaaccctgaaggcctgatacatgcaaatctatgaacttctctgtaaacccagaatataaactagtctatacacgaacactggttccatcctcctcactatattccccattgcccctaatcaacaaatacctgaaattaccatgatactccacaattcagaacatgcagagatcgaccaacaatccaaagcatctagcaagtactacttaatccatgcgactgaataaactgttactagctcgtggtactttctgaatcttcctcataccctttgatagtggagcatttcgtcctgcttgccttgcctgcccattgcccaagtgtctacacctataatttctaaacagctctacgcaagaaagagctccctatacttcgtcttctcccttatttctggatatctgcagcgcgtatcgacacgccgtgatggcgtccttgaccgtcaggaagacccactcatcccctaagatgtccctgacgtatccagacagcaccagcttctctgttacctctagcctcggattcgtcagagctatctgcaatgaccaaattaagcatgtgaaaaacagatcaaattctgcggttaagtttcagacttcagagtgagtgatgagctgtgatatcccctcgaggatatcccctcgtatacctttttcttctaaattcgatgcaaatagttatgaaaatttctaaaaaaaattgacaatatagagtacaatgatacctactagtccaccaaaattcaagttcaaattcgatttacacatcgagaaacaaaaaagacaaatttagatataaacagtacgctactattcatacgctgactttgtcttttttatatcttggcgtgtgagttgagtttggacttaagattttatggagttgtatatatgtgttatatgaatgttgtcaaatttttctagaatttttcataaccgtttagatggtttttaagcaaacgagagaacatctcctcaagggattagaatagtttcccgtgatagatagctaaccgtgatccctcttcgttcgaggctcttgtgtacttctagtagcatcccaactccagagttgtcgacagaagtgacacctgcaatgttcagacatatgccaagttagttatcacttatcagtggcctgaattctaggatgagagtcgctacgctgaaatggaagagggcgaagattcagacagtcataccaccaagatcaagaaccaagtattgcagatcgtgcccgacgctcttgcacaggttatcctcatcttccacccatctcaaaatcctgcaaggcagggtaagttaaattagcatccaatcgagagagaaaaaaaatgatcagcgatgatcttcagcgtcctgcattgctgtcacctttctcgcaggtaacccgcattgacgaagtagatgggagagccgagctgcaagacgaggatgccagggatgctcttcgcttgggggtattgcttcacgtcgcggaaggtctcgctccctgctatgttcccgagcttgcaggtggcaggcctggccacgtacagcaacgccctgacaactgacaagcctacctgcaaaaatgcacagccaaggggagcacatcagcatcgtgcagagaaatgtgctacggagtagtatctaatcaaggtttaagttggcgatgctcacggatgcgctgaggcctgcgaccatggtgaagaagacgacgccgaggaaggcgaccatgcagatgcagaagtcgaacttgtcgaccttgtagaggtggcagaactccttgaccttgacgagcccgatcatggcgacgacgatgatggaggagagcgccaccagcggggtgtacttgaagaggggtgccaggaacagcagcaccagcatgatgcacaccgacatcaccacgttcgacatcggcgtcttgcacccggcgtggaagttcaccgccgactttgagaacggccctgaaacaagcagcacatcgtcagacaaaatgttgcaaaatgtatcatggttctggttttctgaacaaaggtcgcagaggccaagatttatacctgtcgtgaggtagcaggaggtgaaagaaccggcgatgttcatgataccaaacgcgatcatctccttgttgccgtcgatctgctcgttcttgaccatcgccaagcttcggccgacggctattccttcctggagaagcatcgatggccgccgatcagaaactccggtgaattagagtgtaaagtttaagtgattgatgagggagtttgagtcaagatcatgttcgtactgccagtgctaggatcccagacaagagaccagctttcactgccgtcttcatgtgcctggactggaacgttagctgcgcaatggacaggggattgatccctttattcaggttaccgacctgtcccaagttaagcagcgttttagcgcatgttgtcaggaaaacagaaaaaaaaatattgatgtttctctgaagcttgaatcgtcttggcatggacgactgacttactatcggaattccatgctcgtcacccttgacaaggaaagcgaagatgcctccgatgacgacaaccatgaatggcgcaatggccgacacccagaacaactttggcagtttctttctctgaagttttggagaaacaaaacttatatgaatataaaacggtcattctataaagaagcagtagcttagcgtatgggtacagttgtttggctagattcatcagtctcctgattcccccacttaccaggtgcttactcgacatcaagaacaagaggaagcatatgccgagaactgcactctgccatttccactgcagagttaaaaaaaaacataaacaaaaggttcagttcagaatcttattcctgcaatttttccactctgaaatcatttacccgcgattacaaagaaaaaaaaaggaacatatgctagtgtgctacacgtctggtgtttctgaaaaatcgcaatggcatgtaccattcctcacatgacattgaccaaggtcaacatggcatgtaccagtattaccaatgtactggccatataatgctggtaaaaaaaatcttcagaaagctacgggctgtacaacagaaagagagtggattaacatgcgatatatcacttaataaatatataatttaaaattcaacttctacaagttaaaaaaataaattaaactacagctagttaacatatactaacaaaacatgtagaaattaaagtttaattgtggattgatctatcatatattaatgtatcttattaaatttataaaaaaatataattatttaagtgacatgtaaggcactatttagttctccaacaaaaactttttacactatcagatcgaatgtttcgacatatgcatggagtattaaatctctactattataaaaattaaagatgtttttgctggtattttgatacgtcatccgtgtatgagtcggtttttaagttcgtttgcttttgttaatacatatccttatttgagtcggtttttaaaatcgttcacttttgataatacataagaaattatataaaaattctgttttttttaaaaaaacttgcatgctaacttgagatgatcggactcctaactgcaactcatgattttataaaaatatatatatccaagtgaactctcacagtgaatttcatcttaactaaaccatataataataataagattaaaatagaattcacccgttgcaacgcacgggtattttttctagtataaaaaaaataattatacagattgcgtgcaaaatgtgatatgaatattttaagtctaattgctccatgatttgacaatatggtgctacagtaaacatttactaacgatggattaattaggcttaataacttcatctcgcagttttcaggcgaaatatgtaatttgttttgttattaatctatatttaatattttaaatgtgtgtccgtatatccaatatgacacgccaaaaaaagatactttaaatatatgtccgtatatccgatatgacacgccaaaactttttatctcgcaaactaaacaatgcctaaatagatgaaaaggacgacccttgagatagattttaaatagtttcccgtcaaaaacaatcccgagcatttcctcggtgcacgcaaccggtccagcgcacaaactgtaggcccaacaatgattggtcttttcttaaaaagacaagatccagcgacacccaaatagtattattgtttgtttgcacgtacgcatcatcgatgcaaaccttgttttgatctgaagttgttaacgactcgacacgaatccagccgatatactaatcgagaaagtcctagctgcaatccagtcgagattccttacgctagtcgcggttatttctcggagaagtttacaggagaggttacaacaacaccctcggaattcggaaatactcaactacttcgcagtttatccctctcgaaacgtgcggctgcatgctatttatagcggttacacatccaggacagcgaggaacaatcgccgttaaaattcttaagaaaaaactccaaaaatacgtccagaaaacacgggagaagtagaagtatggagaagcaaaagaacgacccaacttttctttatttcctcctactagtgaagtgaattgttttttgtttattttttttaaaaaaataggtcttagtgaagtcattactagtactaatcacggagagatttaaattacgtgatgaaattgaactggtaattcgcattgcacctcgtgccggtaatggtaggtggagtgcaggacggagatgatgtctgtcttggtggtgaagtgcttcatccccaggaggcccttgaactgctgcagtatgatgatcatcgccgtgccgcccatgaacccggtgatcgtcgaccgcgagaggaaatccactattagccctaaccttcacaggccaagtgtaacgtaatagtaataacaggttaattaaaaacgtcaggccgggttaacgagtgatgaattagtgaagagagatgatggaagtgcgattagtttggggtttgattttaattttttttatttttacctaaagacgcctagcgcggtctggaagaggccggtgaagaaggcggcggtgtagaagagctgcaggtacagctgcgggttctcgtccgccgccacctccgtctcgatgatggacgccagcagcagcgacgccgccgccaccgtccccaccgccaggttgttggagctcccgaacaccgcgtacatcaacggcggcacgaagctcgaatctggcaaccccaaaaaaaaaaaccaattaattcatcgggtgtgcgtgcgcatacagaaacgcattagtaataaatccgagcgcgcagtacacgtacagaggccgatgattggagggaggttggcgaggcgggcgtagctgatgccctgcgggatggcgaggctggcgatggtgatgccggcgaggaggtcgaacttgaacttgtcgaggccgtagcgcgggacccagtccagcgccgggacgaagtacttgaccgcgcaccacgcgcgcctggccgggggcagcgcgccgaacccgcggaacgggtcgtcggggaagaacgtctccgcgaggtccgaccacagcttctccgcgaacgggcggcgcccggacaggttcacctccgccgccgaggcgcctcccacgccgtgcaggtggcgcgacgacgcggacgacccgcggccgggccggtggttgcggccgtcgacgtcgccggcctccgtccccatgtggatgggtggggtacgcgatcggtctctcgatccgccggggccggggccgagatctggctgctactgccacacacacacacacacacagacacacacagagacgacgatgatggagaggagcggagcggaggaagggaaccgccaaccgcgcgcgcgcgatcgagtcgagagcgttttgctctgatcgactcggtgactgctatttcattggctcctaattatggctttgcatgcagacagagagagagtgcagagcgagcagtggctacagtagtgtgagggttaattaagtattacgcgcgagcaccgaatggcggtggctgtgcgtacatgtcgcgcgttcgcgattacgtgcagcgtgtgctcagaagcggggcgcatggcgcggtttatataggcgatcaacaaggagaggctacgggccattctaaattacgttttggattggctcatttcttgatttttgttagcatattttaaactgctaaacattatattatattttgtacgaaaacttttctatatataatttattttagaaaaactaaagaaatctattttcatattttttttaattataaatattcaattactcatatcctaaggcaccgttcgatctccttggtgagagaaaaattttcaacgcacttaaaacgagaaggctcattagcatataattaattaaatattaattattataaaaattaaaatagatttatttaaatatttttaaataacttttatatagaattttttttaaaagtaccattttactgtttggaaaacatactaatagaaaacgagaaagttgtagtttgggcctaagcattcgtttgtttgcataggaattgaactttcaagaggcacggaaactggagcaagcaattaacacataattaattaattattaattattataaacttgaaaattaggttcatttgaatttttaaaggagcttttacataatatttttttaaaaaaacatggtttaacagtttggaaacgtgctaatgaaaaacacgtaggaagtaggagtttagatctgagcctaattacgtttatagttcgtttcacgtacggctaatcatccaaagtaacccataaaagggatgtaggcttatggacgcgtggtaggaaggaattaaattaatcgatcatcgggaagatgacgatgacttaattatatcgacatgtaaaagcttttacgcgttaggcgaaagaaaatgacgacggtggcgacgtggggacgtacgggcccgggccggcccggcaggggcgcgcgcggctgcgagtagttcggtggttctctcgatcgatccatatacaatgcacgtaagatgaacggtggcatgtgacacaattccgtgcggttgtacaagtttccgcgccgcttcgatcaggatcaaatgcatatcgtttttatcatgcatgcttgctgcttactcccaccttttcaaaatatttgacaccgttaactttttagtatgtgtttgatcattcgtcttatttaaaaattttaagtaattatttattcttttcatatcatttgattcattgttaaatatacttttatgtgcacatatagttttacatatttcacaaatttttttaataagacgaacggtcaaacatgtatttaaaaagtcaacggtgttaaacattttgaaacggagggagtatttagttagacagagcccaggaggccagaaatacggaagaccaaatcattctgtcgctagcgagatagagttgaactctccgatcgagctctgaagataaatccgccccgtttctttccatttcttcttcttcttttctccctttgcatgcatgcatggttgcatgtagtgagctagatgcagatgtggatatgcccggccggttgcaattatccgtcgagggttaattaattgtccatgtatatataggtgccgttgtatatgtagtgtattcgaagataagctatgggaatgatttttgtcacatgcatcaaatttatacgcatagacttctcaccaaaaaaagaaaaagtacttccaaaatataccgtctatctatctactctctcgttccctaaatgtttgacgccgttgatttttttaaacatgtttgaccatttatcttattaaaaaaacttttgtgaaataagtaaaactatatgtatacataaaagtatatttaacaatgaatcaaatgatagaaaaaaaaattaataattacttaaattttttgaataagatgaacggtcaaatatatttaaaaaagtcaacggtgtcaaatattttgggatggagggagtataaggtaagagattctctacaataatatcgttgcacgcggtgatatatggttgttaataattattgcatgggcggtattgcggatgatatatggctgttaataattatcgttgattatgtggatataggatcatatatcatgctgagagtttgtgataaaaatgggtgaatttcgttttgcccttcaatacggtctttgaagttttgctctaggtcagtttagtttctaagatttcaaatcaaccaagcaagttctcaaaattaatcatatgacttaatataatccttaacccatcaaaagtgccacataagcgtgccacgtcatcctcgcatgaatggcatggttttggaatgatcattctaatctaccctacatatgtactccctctattctaaaatataaacattttcagcataatgacaagtcaaatatttttaactttgacaattaatagtaaaaagaaaataaaaaagattaattatgcaaaattgatggtactagatttattattaaacaaactatcatattatgtaatatttttatttaaaacatcttatttttatagatattgttgattaaagtagtatatcggagaccgtgtcagagtctaaaaatacttatattttgggacggatagagcactacgttagaaagaaaatgaaaaaataaaaaggaaaaagaaacaacataaataaggctggcctattattaccctatcgggttattttctctgtttaaacctcgatagggtttgggcgccgacgaacagcgcgcggctgcgtcgttgcagcgttgcacggtgattgctccagttcagctgcactgccgcgacatggggcaacaccaacgtaccattccaataaacgttgccaatttctcctgtggtttgttttcttttctttcttttttatatggtagataaggtcagaatggtcatttcatccttactgatgcatacgaggatgacgtgacacacttacgtagtattattggtgggtccaaggaccatgttaagccaaacaattaatttcgaggatttatttgaacatttgaaaccttatggactaaaatattgcaattggttattcacccataaaaaatccacttggtaataacatgtattctttaattttattttatccaaacaacactatcaaaatttcagaattaataaatatgacgttgtatctactctcaaattagtattttattaatttaatttcgaatttcaaaattaataattaatcatatgtaagtctgtaactgacatgtctgaaatattattagaatgttaatgtttataacttataataataataataataataataataataataataataataataataataataataataataataataataataatagattattgactagtcattttaacaggttttataaatacttaaaaaataattgctggtctgaatcacaatattgtccaatggatattttacagtagagcaggtacaatagtagtctataagccaactataaatatattttaaagagataaaagaaaagagagaagagcagcgggctatagatttatagccagttgcagtacgaattccaagacataatgtgtgtatgacaagtggaactagatattaatagtatagtaagcaactattgtatgaattaactgttatattggctatagatgatttggagttcatagttgcctataatattaaacttgctcgtagtgcaactgtccaataaattggcaggcgctaaatcgaagaggaggaagttttcaacggagaaactcagaaattagtacttgcccgcgcatctgcaaaaggtggcatcaaatgtgatcacatcgatcgtccttttgactccttttggaaatgcgagcaaatagggacacaacaattttgaaacatgcttggttgagttagctagctaagcttacctcagtcaagattagctagagcattgctttaatgttgatgataagttgcccccaaccaatcatcatcaatcaagtataagaaagctttgattttgtacgctaatatctccatcgtcacaagtgagcagtcgtactagccaacttcctgttatactaacaaaaaccaccgccgccgacgagcaccagtctatgtgccgtgctgtgttgaacacgcgactacgcgagtagaaccaagtgagtcgccgtcggcagctgagagtcgtcgatcacaccgtacacctccaatcagttcttcatttatgcaatgatctgatctctgcgaccggataaaacaatgatttcgagtgatgctttccagaagcacctgtatgatcacctaacaatctgaaactctccaggaactgcacttgttcattggacggatcggaactgatcatggcctacctgccgggagggattcactgttctactacttattacagctgaatcaactgatgatgactcctatttagatccgggggaaaaaagaagtcaggccaaatgggatgttcaacagaagatcaatttactgaagataatctaatttctgcagaaataagaaatactcaagttcaggctttttggaacgcaaaattttcaaaacacaaggataagaaaataacagaattagagtgcactgatatatcaaattctatggatgaaaaaaatcaagaaaaaaaactatagtaatgactatttgaatgaagcacgaaaaacatggaaatgaggcagacatgaaattttcccaggagattaaacctcgtgttgaaaatcctctagaagttctatgactttaggcaatcctaaagaatttgagagccttccattgttccaaataccaccatataagattttgtttcccattgaaaatcaatccctcaaaatttctcaaaaatttcattgttcaaaaggagctcttactcctaacggttaggatcaattttagccaaaaccatgtcacgaaagcacaactccaccatccggatataaggccatatgatcgagtgcaataaaatgatgtaagcggactatacaagttgtcacatcatatttgtgttttgtggaggggacagagaggagagagaataaaaagtgggctacatatttgtaactaattatagcacgagctccaataaaatatataagagatggatggattaggtattaatgatgcaatatatatctacaactaactattgtattagtgggctattaggttggctatagatgatcttgtggtttttagagttagaagttggttatatttttaaacttgctctaaggtctcctttggaacaaagtatttttttttatgttttggccttttttgtttttacttttaaaagcaaactctttcaaaacttatttctaaatccaaacctatttttcctgtgtcaccctgcctgatgtgacaaaacaacactgccgcgtcattagtctggctggtgtgaccaaataacattgtgagagctttgtttcgtcacgcaatctgactgttatggctaaaagttcatatttggaaataagttttgagagaattttttgaaaacaaaaaatttaaaaggtaaaacatatattttaaaaaacaataaaatctattgaaaaattttcctacatagtcctttgggacaaagaaatggctttcccaaaatcctttgcaattcttatgtaagtacttattttaggggcaaagcccaacgaggcttagaattgaagacccattggggtgtacaatattccaccatataatttttttaaggcaagaagattgccttatatattgatagagtaagtaagcaaagttatatacaagtcataggagttatggttgtcccagaccagtcagaacactctattctcacaaagggtacatctcacttaggtttttcgcccccgcaactgcccattggcgagcttcctcctttattctcgaggatgagggatgggtgccggccaattttctgaagatacacgagttccattctttccataattcctaggagaccaaaatgactgtcgacttgagctgttcttgcgaagtgttcggagctgcggtgattactatccaccatataattaccaatatcatgcaaggtccaagtctctctatcgactgcccgagactagggccaaccccgactcatttcatatgaactttagaggaagaccagcatgaggctagacctcatgttttctttctcatgattcagttcatttgttttttctataatgctaccttaatgttatcacaaaaagatcaggataggatactatgtgcagtggtgctatactcttgaaatcggtaaacaaggatcttttattctattttgaatgatgcatacgtaatacctaccggatatgacatgctaaaatttatgtgattttagaacttcttttagttaaacttggttaaagggaattagggtttgtcccatcaccatactaaaatttatcggttgtgtgccttaagaatgaagatgtaaaacatttttattatagaaaaataaataataccttttataaaatctgttgtgccctgatatcctatttcataagttttattatttttgtgtgattcttgtgtttttagaatcatgcgttcaagcgaccggtctctattaccatgttgtctaacagaacgtaatcacgtttgcaaattgcaacacatgagacgccaccatgcatcgtggctcgtggggaagccatgaaaattaacatgtgctgtagcagtgataactgtgataatagtgtaataaccgtacggttttgtaaatcccgagctagagctccacaacagctagctctgcaggctgcagctgccagctggtgaacagtgatatcctctaaagaaacggtaacgcacgtcctcttctggggaagtagagttcagaggcaggcttaccccgtgcgcgcaaaaccagcgcagcgccgttacgacatcatggactggtttgatttaagatctaaattagttttaccaatatttgttaattttaatagtgtttagtgtctatttggtttgaagccaaattttggcatgcctaagaaaataggccatttcagtagtgaacttaggctattttggtttcaatccaaacacaactttgcattaccaaaattagtcatgccaaaacttaccaaaatttgacattgataaaatttagtaaggtctatttagggcacaaacgaaaccaacctcatatgtccataacaatggtaacacgcatacatctccatcaaaaatcgcttctgccgagcggtggtcgaccaaaagattttaatgcagatcatgcaacaaccttttctacagtctcttttatgtggcgttcatttggttggctagctagcatcagcctgtagagtgtagacgggaacaactaacgacagaataaatgagcctgtttaacaaccatagtacacccctgatcacggaaaaatcatttttaaggatgaatattgatatacttgtcctaattaatccttagaaaataatttttaacaaaggaagtacttcctctgtactcgtaaataaaatcgtttaggacaatgtttaagtcaaaccttgggaatataaattatgaataactctcgagttgttgagtttaaaaatataaaaattatatgaatagatttgtcttgaaaaatactttcataaaaatatacatatatcacatttcaataaatatttttatataaataagaagtcaaagttgtgttttggataccgtgtcgctgtcctaaacgacttattttatgagtacggagggagtagaagtactcattaaacatgacactatctatgacagaataacttaattaagggaaattgatttcattcctcgagaggagatatcccttcgtttcgtgcatgccatctaaatagtcctaaaaaaaatttaaaaaaattggcaatagattaatatgaaatatatcactccacaaatatacaagtttaaattcaacttatacaagttgtaacaaaaataacaaatataattacgaatgtacaataactattttcagtttaatttatttattttttgcaactggtagaagttgaatttggttttgcatgtttgtggagtgatatatttcatattaattaatctatgatattatttttttaataactatttagatgaaaatccacttcccttaattaagtacgcacagaagcgtccctgtatgacagggtactaacagagtagtacgaatagagggtactggccattctggtttatttgatttggatgagaacacattacatttgatgaggtgtctctgtagtctacacacctatccgcaacacaggcaagaggacattggagaatttgtgattcggtcttcagagcaactgtgggctcagcttttagtgatttcagcaaacaagcatgacatgcatcagtgttgtcatgcggagctcatatacgatgaatcctggatatggtggaacccagtcgtgattgagagcaaccgtgcttcaccaaagtacccatgaggccatgacaagcatattttgtggcattttctgctcgacttcttttgagcagtagaaaaaataaaatgtattgcatttcagagttatgtttcatctaaacaaacatgttctcgccgttttcgttacagtgcgtctatcttggcatcttgcactatctaaaagtaagcaagtatagcatgcagcatctcctgaataatcatgatggcttcacgacctaaacctgaataatctgacctctcgtatcacctaaagccattggattggttattattgggggatgcagtttctcccgatgaagaaaagcttggcgatccagaagaaaaggattgttcacttcctccttccatgtcctctcatgccaagtagagccatatggttctgttagcaactttttgtgacaagttgacaacgacgatcgcagcaccttaagccttgcggtgatcctagagtcgccaaccacctcgatctagcgaaaagctaaacctagatgggttttgataactaaactggctagcagagccgatttctagataactacctgtctcgtaggcaaaatggaaggttttcaggacaaacctacaaagaggtgtcgcactctcgcagcggcggcggacggtttacggcgcaaaccgacaaagatggataaactaagagaaaactaaaagcaatatgaaaaaacgattcgattgattgactgtagattgtttttttacaatgaaccggccatgtcccttatataggggttggtcttgccctctacaggccctcctccacgtccaactcggggtagaaactaaaggaaacccgaaacatgccttcccgagcaaggaaacctcgaaacccgacgaaacacagtcggattcagacctgccggtcagaccggcaacacactgccggtctgaccggccctcaaccggcggtctgaccgcccaacacacggcggtcagaccggcctactcggaggaaaccggcagacttccaaattttggcaatcttttctattttaatcctagatgctaaatttgggtgtaaagaggttcttgccaaatggttgcttttccatgccatgtaatcaagatgtaaacttgtcatgcaaatgcagtactgctggcaccacaactcattagatcaatagagaaatgttgacgaggctcacttacttcttcaaaaagtaataacgtaacgtaatgaaattaacaaacaaatgcatgttcaagtttgaatcatgttattctgtagcttttgtcttgtgggggtagtttgcgcttcttctgaaacatccggtgttgacaaattggagatagggcaggaaagtattgttttctcggcctatcctaagagtgagatgagctagaaaagtaaaatcccatatgttgtatggtactgatatccatgatctcgtgttcgattacaagattgggatggcttatagcctccggatatacaagtgaggttacagtcctacccctaacagtgtctagtaagttactacaatacccatgtaaagctagaaactctaaaggtgtggttgtacacttgaaggagtgtagttgaattggtccccgcagtatctttttggaaatacttctcgctaaacaacataacctttaggctttaccagccttggtcgaatggtattttcctcttatggtaagttagaataatccttttcagaccgaccggtctattagtatttatctgtcgcattatcaaaaagtatttgtcacgagtaaaaacctctctggcaaatgagtgagagtgttttggttgaattggaagtggtgtttacctcctgctgcaacatccggtaaaaatgcctacctgacatgcacatatatatggatgtaagtattatatctttcacgattcttgaggagttactgaggtgaatgattaggagttgtgaattcatttgacaaaattaaccaacaagcactcaaacatattcactggaatattactaacagcaccacttttttctttttttttgtttgtgtttgtttagatttatttttgctatcttgaactttttgtatgagttttcttctgtgtgagttctgtaataattggttgtaactctttgagtaaaggccaaaatgttatattctattatcttaaaaaaaaactaacagcactaccaacattattcaatgatctcaggcaattccccgttatgcggttccctcggctatacaacaataaaatttgtcaatttccaacacatttgggagaagataacatatgttaatgtccccctcaacgcataatggagctcagaatctccctcttttactttcaccaaagcatgttaacctcttgctagtagttaattagtagtccactaacatacacccacgcatatggtccatgcgtttcttctcctcctagctttctaaccacccctgtcgatcaatagggaggaagtctcaaacacgcgcatatatggatggatccgtcatctccttcaacaggataaccgaaccaataatgcgagcaaaagagagcctgcagtgctgcactttcttcgaatccgagtcactcgtctcgctgaaaacatcacgcacgagagctcgcgctagcccccacacgccgaagagggtcgtggaaaattttccccagcatccgttcgtggaatgtagtcactagccaccggcgaatgatacctccctcggatgaatcaaattaagctggtagtaggagtaacgaacacaccatatggcttgataccaagcctctgcatgagtgcagtctctgtggctggctgctctgctcggtcatgcatgacggcattttgactatactttgagcaggcagaaagttattagcaactgtatagttgattgatgattcgctgctttttatcccacttctgggatgacctgcagaattgccgaagcagtaggaaacggcacctgagctgaactgatttgtccttgtagtatctttctggatgactatttgcaggggtgtaggattgatgcatttttcacatttttgatctttttagaaaatttattcttcaaataggcctttaagaaaacttattatagaattaatattttacgacgccaatattattggcgccgtggtccaacatgacagcgccaataatattggcgccatccccctaaccccttggtggaaggtaagtcactaatatgaagagggatgatgttggcgcttaggaccaatttgtttttttaaatgaaatacccatagtacaaatatttacaaatagatcctcaacacaacaatattggtgtcgtccccttcacattagtgacttggctttcaccggagggcgaaggggacggcgccaacgtcattggcgctgttatgttggataactgtgtcaatgacgttggtgtcacggaactggtccatttctagaataagtttttctataaactatttatagaataagttattcaaaaggactaaggtgaaaaatccagtgtgtgggattgtgggaagcatggaccgaacgatctagaagtttattttttaaaaaaattcaggacgtgaattcggtcggtcagtctatttccagaagtcccattatattaattctgcttctgtgcggttattaaaaaagcgtgcaccagaagtctaaagcccgtaaagtgaattttgttacaccaaaactcattacgaattcttgttctgatgctaacatctaagctttggagccttgactaatgctagtatcaggctttcagcactacagtggtcaacgtatgcacaaataaggctggaaccgacattactaaaacaccatttttcacaggcacctctttttttttttggcgaaaaagaaaactatatgtgaaaatgtataggctcttcaggctcgtatgtaaaaacaaaactaaacaggtaggtctattaagagctcgtcctgtgaaaatcaagattctcgtagctagggccttatgctattttacaagcagatctctaaagaccgcgtggagtgttgtcatctcccaatcatatctgctcatcaccactctagtacatgtggctacggaaaaggcagattcatccacgacatccaagagagaggcggatctgccgccagtagcctcgggatcggtcggtttggggcttcattgaccatcgggtgcggtgatgatttttcgtgcattttctagaacttttttgttggggagctatcatttttggaattcttgtgaactttttttagcttttttcccccaaaaaacttttgtagtcggatgtcctaacgctctcacctaaaaaattaatttttatgtgtcattgtggtgcatgtgaaaatttcgattttacatacatccagttacaagcgggcaccccacctccctatgaacgcttttgaccgaatgagaaaacgtttatcgtagtgagatgagagaaattgtgactgtcaatcttttcggaaagaaaaataaatgggggatcatcagaccatgcataaacaatttgatatatgatcagacgtacatacaaaatggcaacggatcaaacaggctgatataacacgctgctgctgctcgaggtggtatagaacggcaacttgtggctggattaggtcagtcagacaagaaaacacagctgttacccacatttttatgattcgagaaaagctcggatgttcttaaaataattacagtgagaccagtctctatttaatactctactcaaattgtgacacgtaagcctaacggctaactaaaaaagcttaattttaggataggttaacgctttgaacagagtctaaacttaaacatagaatagagtgctatcataggattattttcaaccataagagatgtatggtgaaccaacctcctatatatatttcatttaaaaaaaactcctatatacacgatgatgacgaaggccaaagctccgaacgcagaatcaaatgcaaaaatgaaaaccacatcctgtaggctgtagtagccaataggaaacacaaggacgatgatcaatcaatccaaggctaagggcagttcaaattgatgttattttcatctatactatttttttaaagtaaagttataaaaaaatgttaacatttagtttattgtcaaactttgataaatacataaaaaatcttatcaaaattttaataatatttttaacttgctaaatgtttattttggctataatctgaatagccccaaatcttcgtttcgattaagtattcaaatgatgaacggaaggatctcgccacaattatgagaaaggccgaaatctacggagggatggataacacagcctgaaagcaacatgggccctcctcacttgtgtgggcctaattgaagggaatcttctactcattgcattttgtcggcctaaaatggccttctgttgaatctgccaaaccttctattttctcttctttttttcacggtggataatctgatggagaaaacatgaagaaacagctagtcatttcagcctcacttgctcctttgcagcgcaattctggccggcaattgacattgatccagacatcaacgatgtcagaaacttggagagcatagcacggccagggccagcgagcctacctacggcgcaccactgctcgttcttcctcctgtgcttctagggctttggaaccacatgcacgcggggtggttttcttttctttctttttttttttagcgaacgccggggtggtttcccgaaatgagcatccatgtgtacaacgcctacttcgacttggctgtgtttagttgctgaaattggggagaaatttagtgaaagttagtagtttggaaaaaattagaagtttatgtgagtaggaaaattttgaatgtgatgtgatgtgatggaaagttggaagtttggtgtgaactaaatagagccattgcttgggagatgcaaatccctcataaagatatgttgtcacggcttggaaacaagacttctcccatcccctcaactagatcacactgtaaatgtaaaacgctgaaaacactttgtattctttatcaaagaaaaattcagatgaggaaactctcccctctagtgatttaaaagaaaaaagggcttgtttagttcacgaaaatgtcacatcgaatgtttgacaggatgtcggaagggcttccgaacacgaatgaaaaaaaactaatttcataacttgtctagaaaccacgagacgaatcttttgagcctaattaatcagtcattagcacatgtggattactgtagcacttatggctaatcatagactaattaggctcaaaagattcgtctcacgattttctccctaattgtgcaattagtttttggctgccttagtttttttatctatatttaatgctccatgcatgtgtccaaagattcgatgtgatgtttttgagaaaaaaaatttgggaactgaaccagacctaaaattaaaatgaagagaactccaacattctaatgggcccttaaaggctagacagcgaccatttgagcccaaacatggaatcatctgaggcgttaactctactcgatagcggatcattctaaggaccgatcgaggcgtcgtcacctgtcctcatcaccgtcaatttgtcggctgccctctgccgtgccgccctctcgcagaggcagagagaccaccggttgatgtcacgccgtacaccaccatcccggtgcccgatccccctcgcgccacgcaattcagaacagccacatcattatgcttctctcgattggctaacggcgaatcaaagacgtacataccccctattgatgatacacaaataattggccatgacctgtgcatcacaatatttcgcgttctaccagtagtttcctgtagagcaatcatcagcgcgtgaaatattcatggaagagcttatcaagtacggctggatgattgatgttcgagtcaaacacgccggattatagaacgaccaaatgtcctagttatcaccttgagtgttcgccatagccattagctcgtctacacgtcccccgccctgccggacacgtcgatggcccaaccccaaacggggacttggggttgggggaaggccccccccccccccccctccccgagcgacagtctcgaccggtcccatccgtgcctatccgcctcggtgatggtcagcacgcgtgcattattactaagcttatcgcatcgcgttacacggcacggcacgggcgagatgcaagcagcgcaggacgtgggcggtggagtcccggggatacgtgtagcgtcgtggcggagactctgattccgccaaatccggccgagatttggatgaacaatggcagtatatatacacggcgacgtgtacgacagccgtaggccattcccaaccctatatatagttttcataaattctacatcatactagacactacttttttcaatacaaacatcactatacatatttaaatttaatgttagttcaaacatcactatacatacttaaatttaatgttagttatctcacgtaatatcttggatgcagtggcggaggaaaaaaaaagagatatgtctcatggacacatactaatcgcactatactgtacgtcacaacattgtatcaatattcagcaaggcaataatcaattgaatcagggagaggatagatatgcatagaatctgaaaaaagaagagcaaggattgattagggacgattgaatcgggaggaaggccacttgcttcagcttaccttgctgctgctgcttgccttccgcctcccacatcgctcctgctgcctgctggctcgccgcctgccacgcgcgtgtccctgccgcgtagccgcgccgctgcacaccagctctcgtgcccagtcgccgcttgttgatctcatgcggggagctggatgcggatgcctcccgcagttccaagcggccgcgccgtcgtcgcctcatcgtccgccgcggcggcggagatatggggaatttctgggctagggttaagtctagtgaatcacccacatatgcccacattaacacaaaacgagcccaatgggcctacgattcagtggagagtggcccagcagcgagtgctctgtctttgcccatcgcctgacgccgcacttcgcctctgcgcctgactgccgtcagcggcctgccggagttggaggttgggggtgttggtacgagcgggcggcgcgaggtatggcctcgccataccgagtcctccgtcactgcttggatgttgtgtaaaaactatgtcttatataagacatgtttttttctcttttctcatttatttacttgtcacattattttttatactagatggcagtctatttaatattccctccgttttgaaatgtttgacgccgttgactttttagcacatgtttgaccgttcgtcttattcaaaaaatttaagtaattattaattattttcctatcatttgatttattgttaaatatatttttatgtaggcatataattttacatatttcacaaaagtttttgaataagacgaacggtcaaacatgttctaaaaagttaacagtgacaaacatttcaaaacaaagggagtattatagacaacatattagttattgggttggaaatggccttacaataaagcgaatcctcatccctgttccgtaggagtaggccggatgcgcaacaggctgttgccaatgggagcaggataaggccgagattaacctcatccgcggcccactaggcgacgtccacgtcacccgaatcctctggaaaccgcgtccccctctcccccgccgtttaaataccctcctccttaagcttcctcttccgaagccactcgccactgcaaagcgctctctctctctctctctctctcgcatcgcgcgcagccttcctcatccccgtcctgatccactccacctccctaatccacagcgcgcgccagaggaaatccggcgccggtcgaggcggccgcgccgcgccgccgtcacgcccagcccactcgattcggtcgcgtgtgcgctaggaagttcgtcatacgcctcgcggttttcacttcgtgtgtttttcttttaaatttttacctgtgcttcgtttaaagcctctcttgatcttaggtatagctttgctcgatctgattataggtatgttgtatgtttctggtctcccgtgattgcgcgtggattgtgattatgactaatttgcttgatctgaatatctgattgtggtggtggtgtgtgtgtgtgtgtgtctgatttgtctgatctgttgtggattattattgtatgatttaccgtggttttatgttgtttatatataagcgtttgccatgagtctgattaattgtattgttgcggtttttcctaggtgtcatactgtcatgctcgatttttacaaggtttagtgcaaactgatagatgatgtccatccccaaaactccgtctaccagtattggttcatgtgcgagcacacgggatagttcgagttcctgtttgatattgattcgctggcgctggttgtttggttggtttattagctagagttgtttgtgtgcaaaggtgggatcatggttgcaaaggcatattgatgaatgacgattcataagcgtggaaagcaatctctgtgcaaggggttattaggattctttgtgcgtattcactctaaaccgatagtcttgtattgctatcagcaccacgttatctatttcctaaccaatgttttctgcatatggactctgcattttgcttcctctccttgtaccacacccagtaccctatgtttgtgcctctcccatggtccatctctcctgttaaaaaaataaaaataaaaataatagaatagaaaaattctagaccaaatacagggaagaaaataaattttgtcaggcaagagagcgacgaggcgatggggaacttattacttttctggacaaatccttcaatttgcctcatctatatcaatggaattgggaaagcagtggactacttaccatgtattggctactaatttccaccactccttgccagagaattgggaaagtgaattctcttatgcaggttctgtcagagtattgtaccagtcattgagatgactgtattcagtagagaagttttgtagataggttaaatttcaggtacaaaccaatgaagtaaaaaagtcttagtatgatggatgtgagaggctcaagaagttccctgattggagaagcaaaggaataagttttttatatggatgtgctatggattttaattaaaagaatggagaagtttcttttgttgaagatgaagctgttggcagctggaggtaggctcccttatgatctaacgtcctaagtaacgacgtatctgattggtgtaagctaataaccaaagccttatcatgaaaccgtcacgcttgtttttttcttttttctttttcttcttgtttcctggcatttgatgctgttacgtgttcctcttgccagagaatgggggtggacaccacagtaagtttgatgcagatggacactgttcgaattgcttgggaactcttccatggaatctggatggataccttattgagtagtaaatttcttaatacagctcgctatccagatagtgctagctgtgattgtttggtgatcaatctattgggattgtgccgactggagctgttcgacattgctttggtcttttgttgatttgcctggagttcggcagtatacagcaaccctggagtgcatgcagtggtttcctcattttttaggacctgactgcattctgtagtgagaactatcctgctaaatgcataatacttgcaggtgttttctgttgtattggcaacgtgatagtttttgtggtgcaaaacattcaagatgggcgccatggacgtacaacttgagtctactgctgttcaacatggacaagctaagataaatgtggaggaacatgctctagtttctctgttgtctgatgagaagtacgcaactgaaaagaccgaagatgtggaccctgatgattatgagaaacttgaggaagggataatgcagtatgggtatgttttttttttttgttctctggttaggcgttcttgataagctccttaagtgccaacaagtttgtgcttaatgtactatgtcaggtgtgcacattatcgaagaaggtgccgcattcgagctccatgttgcaacgagatttttgattgtcggcattgccacaatgaaacaaaggtatggttttcgagttgatgtggaagtgcaatagttaaaaagtatgtactcttttatccatactttcctaggtggttttgatgtaggaatagtcagttactcacaaaggctttgattaactgctgttcatattaatgcatatgtttgaagagcactagtgagtataaaacgtttcctttaaaaaaatcaaatagtgagcataaaatggtttaaaaaaacctaacaatgttctgatcattaactcattttatagctggatatgatttagaaatcagataaatggtatggttgtgacataaaatgaagacacagaatagaactactaaactgctgccagccgtccattatgactttggattatcatccatctgtaacagttgaaatctgttgtattttccattcttacattgaaacagtaatttgatgtatttgcttatgggctgttacatgtacacgacttatttgtattgtaccagcaatttgttggcaactataatatatccttttgttcttttcctggtgaaatatctgaatcgtcactgttttggtttatactgcatacttggaccttccttgggcagttcccaagctgaactatacaagtatctattctttatcatggtattaactgttggtttaaaaatgtggaaagttgttgacatccaaactgttttgacagaattcaattaaaattgatgctgtgaagaggcatgaactcccacgccatgaagtgcagcaggttatatgctcgttgtgtggcacggaacaagaggtacagctgagctatccttgttgcttgcattgtaacattattaattatctggcatctagtgtaatcacgataactcttttatgttaccaggtacggcaagtatgtatcagttgtggtgtatgcatggggaagtacttctgtgaagtgtgcaagctctttgatgatgatgttagtaagaagaataactattttgattgccttgtctatttgtaataagtagataggaaagcataatgacacttctttctacaatgtcaggtttcaaaacagcaatatcattgcaatggttgtggaatatgcaggtttgcatctcttttttgttgtgcaatcaatatgaactggaaaatatacttacattcgactatgtttgcagaattggtggcaaggagaatttctttcactgctcaaaatgcggtaatgcctcttgtctccaacgttgcattccgaagtactataatttaacatagcgccatttaaggaataaggattcttttagtccctgaactcttaattgatgggaaaaggatactgattgatataatgagagatcttgtttatgctacttttcccgatagagatatatgcatcatgcatgggttgtatggacttctgctatgataagattgcagttttttttcccaaaattttctctgttatacactgtatattactagatgaatatcctctacctttctggaagtctactaagatcttgcatcgttaacgttgactatttaaccctgttagctgaactagttcaaaccctcacttgaattttatgacttgatttctattatttatatgcatatgaatgaattttgctagtcacttctcttgatttgtgttcacctttgttatctgtttcatgcaggatgctgttattctatagtattgaagaacagtcatgcatgtgttgaaggagcgatgcatcatgactgtccaatctgctttgaggtaggcattcactgttcttttatgaatggttatatgcagcatactgtggattatattgttgatgagtgacttatcaccttgttttcaagttgtttcttgagtgctgatcttgttacacatatttcagtacctttttgaatcaaccaatgatgtttccgtcttgccctgtggtcataccattcatgtcaagtgcttgcgagaaatggaggagcactgccagtaagtcaatccttcttggccctttgttactatttgtaatgatattatgagtggttgattttgacagcttaaaattgatgctcagatttgcttgcccgctttgctctaaatctgtctgcgacatgtcgaaggcatgggagagattggacgaggaactagcaacgatatctgacacctgtgacaataaaatggtaatgctctcttctctgctcttctgttgtcagtaggaactaag

SEQ ID NO: 78782 - DNA, 14587 bp, Oryza sativa
cccccccccccctcccccaatggcgaagactatagaacaaggacggcgagaggcgaagtatcatgtgggtactctgccaagccggaggcctcttgggcgaaggatgcagggcgaagagtatatgccgaagggagacgacttcgccaaagcaagctcgcccccgcgagggccgaagaagccttttccggcccatcaagcctaggggccattgggccgacgatcgcctaacggcccatcaggagtccatgaacctctattacactatgtactcatttaaatgtccctttcataagggtaaccatgtaaattcccctgtataaccaaaaccctaatagtaataacctgtaataggggatataaatagtcccatagggccaggtaatggggggatcccaagaaaaattatctaatcaatacactttactttttctcaaccactgttgagtaaccacttctttcgacgtatgcagttgtcgtttcgacaatactccctttggctacaaatataaccatttctaggttgtttaacagaggttaacctgatgtctcttattaaatgagggatatgttcgtaggggtggagcttgagtcatcagggagggggggggcggttaccaggaacccgatgaaaaaaatttgtaactaaaatttacctattttcaccatgtgtgcatggtgcacccccctaaatataaatttagtcacccatatcaacttaaaatcaatataaagtagagcaaattaaacaagtgacaccccctccatttcgttctagctccacccctatatgctcctgtaagttggaaacaaatttgaatgcaaggcatttgataggataaatagtatttgaaatgtttacgtttgtgcagaattttttttacacaaaaaaaaattgagacacttcgaatgtttatatttagggtcccttatatttatggacaaggagagtaagctgttttgttttttcgagtaaaatggaacattgcatccatttccatgcttttagctagaggtcaggattgcaattggttgttcattgtttttttttcttggaggggaattgattgttcattgttactgtcacattatctccattgtatgttgtacacagagtttgatgactaaggcaacccaaaagtactcctttgtcatctattcatgggtggacggtaatcgttcacacactagcttggtttgcttatttcactttcatggtcaaagcacgggcggtgcggctgtatgtcgacggcttgtgttctaggagagtgtgacatttggttggaatctaaggagaaattcaaggtgaattcaagcaaaatccttcccatctgaacaagttaggtcgaaaatacttgagttctgtgtaggtagagacgtcaagtttgttctagaaaataaattgttcgctgatttgggacgaaaaagtaaaaaaaaaactcctttcaataattggtgtttaaattatttaagttggaaatgcaatatgattggcaattattcatcaagaatgtagatgtcaatcagtcagtgcttgccagccagctcagtcgatcagcatgaatgaatgatcagctagtcaaaggggaggccatggcaagggcccaatcagtgtgccccaatacagaggtcaggactttgatcttgatgacatatcgctaagctacagaaattcagcgaccgaccctaacctacctcgcatacatgtcaccggtttgtagaacgatcgagagatgtggtccaatgctcattgatggttcatcttcagagaacataaatccgtgttcatattgttagccactgtgtttccaattgttttgggtggtgaacttatgttcagattgagttagctacttctgaagggaagatgtgaccaaggcttttacccaaaaaaaaaagtgtttgcactgaattttatagtttctcaattgcttgtaaggaggaggcaatgcaacctactgaatctgctagtacaatttggtactcctgccaattcggaggcaacaaaagtccggtcaatattgaaccgtcgctctcagataaagattttgattggaaccctcgttgaacggaagagttggctcctttttgagctgatgaaaagaagccatctttacactttacagagcgcagttttaattcttgtgaatgctaagctgttcatgaattcgatcgctatacacgctgcaatcaaacataatactacgagtgcagcattgaaacgcaaaaggcagtagcagctacagctacagctacagcttgggcactgcgcgtgaagagattggcagcgaagtcaatggcttggggaccctgaatgcgagggcaagcgcagcagaggccacgaatcgcttgaaatcgaatcgcttccatgtgatcagcgatgtcgcggccaaacctttccatttcctgccttttttcttggccaaaaaactcgccctcgctgccctcgcgcgtcgctgtagataacagtgattcctgtctagaattcctctgactttcagcagagacgttcttggctgagctggttgtatcattgcccatcctgatctgttgtcacagagagcttaacatgtgtaattaactctagactggctactgaagctgattcttgcaggctgaatcgatcagtattcagtaatgctgaggttacaaactggattactagtactttgttccttttgtcaggataagatcaattgatcatttgatcaagccatatatgtgtggattgagggccctgcggtcaccccatttcctaggccggatgccacccttaacggtgacacaatcagcatgctgtcatgtctgacagggaatgagaagaagtttgggactttgcagccatgtgagtctcctcaagttgcatgaagcagagacagaaactgccatggacttggtgcatgaatcactacttagggtgtgtttagttcacgctaaaattagaagtttggatgaaattagatcgatgtgatggaaaagttggaagtttgtgtgtaggaaagttttgatgtgatggaaaaattgaaagtttaaagaaaaagtttgtaactaaactgagccttaggctgagttcgtataggagggttcccaacccttctccttcgtttttcgcgcgcacgtttttcaaactgctaaacggtttatttttttcaaaagtttttatacgaaagttgtttaaaaaaatcatattgatctatttttgaaaaaaaaatagctaatacttaattaatcacgcgctaatggactgctccgttttccgtgcgggagggtaaggttcccaaccatgatctacgaacacagccttagttcatttctacaactcgtaaaagttaaatttactcaattcgttgagtatgtatctttgtcttatcaaatttttcaataaatttaggtgaaatgtaagaaacgaggggatatttctactagcgttgaaaaaccatctggtacaactactccctgaacttgtcacttacttcgtccatacaaaacacctgagacgattgaatgaaccctagccagcaaggtaagctttagcttgtttcggctcacacatgtacacactgaaacagtgggaagaacacgcacggagagtcggagagaaacagtctagaacacggacactccgctgtgcgcacagcgtcgtccctgcagacagcctcagcgaggtggtcaaagctcaaaaccccagcgaggcgagagcgatgtcgccgtcgccgtcgcgtcgcggggggagtgctacgtgctggcgcgggattagatccggccatgccgccccacgccggcacgacagccacgcgccgacacgcgcgcgcggggtcagaaacgcagccaccgctcgcctcgcgatttcggcgccgggaacggcgaaccggtcttggcggtcgccgtcgtcgccgtcgccgtcgcgccggatagcgccaaacgaacgctttttcgggcggcctcccggaaccaacacctacacgaggcggcaattaatccaatccacagctcgaagtcgaacgctcgatcgcccggcgatctggcgcgcatacgacgcgtcgtcactcgtagtgcagctcgcttggaccgtatttaattatttacaccaccacttggctctctcgatcgcatctcgtcgtcaaggggctctggtgatgtgacgagacaccgggcggcacaccaggtgtcaggcgcgcggccatcggggcggctcctggtcgaggaaacggaggcgtcgagcactgtgattcattcgcgggcggtgtcgatcgatctcacctcgccatttttgtcaaaagagggggaaaatgtttgcagctgggtattgatctgcttaattaagatttaaggggagttcgttgagaggctccagttactagtagtttttggactcgtatctagtgtatttctgaactttccattttttttcttcttttcttttcgtttcttgcaaggatgcgtggcgcgtcgtcacaggggagcggaaagctcaatgattgagccgtttgtgtatttcgtgacgaagacttgacgtaagcacacgtaatcccctcaaaaaaaaagaaaaagaagaagaagaagaaaagaaaactaaaataactgcctagtgcaatacaaatggctcgggcgggcataggcccggtgaccacgcgcgggcgactcaggagaaacctagcgccaccgccggagcgcgtcaccggagcaccgtgcggccatccgggatggcgacggcaaggccaagcctcgatggcgccctgtcactgtgcgtggaaggcgggccggcgtgtgaagggtggccagtggcggatctaggaatttttctaagcttgggcaaacctaataatcgagaagaactaaaattaaattcatataaccacgtgcacgatttagcatagatcgagttctaatttataaagaagagaaccaatgtgtgaaattatattgatgaaatgaaactcgttaattgttaatgttgaatactagacatctattatattattaaaggaatagaaaaagaatgctccacgttcgctctcatggcctagaaattcccacgttaattaaagaaaatctattatattattaaaggaatagaaaaaagagactccacgttcgctctcatgacctagaaattcccacgttaatcgaagaaaaaaacagagtccgtataggaatacaattaggaaataactgaaattcggaattaaaaataaggaatattagaataggagactagagtccatatagaaatacaattaggaaataactgaaattcgaaattaaaaataaggaatattagaagtagagtatagagtccatatagaaatacaattaagaaaaaaaaatagaaattcagaattaaaaataaggaatattagaagtagagtatagaaataaggaatattagaagtagagtatagaatccatatagaaataaaattaagaaaaaaatagaaattcggaattaaaaataaggaatattagaagtaagtatagagtccatataggaatttaaaactaactaaaatttaaaataaacataataaaattaaaagtagagtttagagtccgtataaaaatacaatttacaaataactaaaattcaaaattaagaaaaacatgggaagaagagtttaaagtcaatataggaatagaagtaactgaaattcgaaactaaaaattaaagaatattgaaagatgagtttagagtccatatagaaatataattagaaataataaaaatttataaataaaaataaataatattggaagaagagtatagagtctatatagaaatacaatttacagaaaatttggaattaaaaaaaagaaatattaaaagacgagtctagagtccatataggaatatatataatttacaaataactaaaatttgatattaaaaataattaataactaacacgtatataaaatacagtatgaatattacacattaatagttttgtaaagttattgcaaaatttaaaattatgtttaaatataaaattttaatatatttgaataatataatgagaaaacatatatgctattatatgagagaaaatataatgatgctagcgcgtaatctgtatgggccaccatgctagttatatgtatatagctagtcactttgctagtatatgtgctgatccactgatctcacatccattagaactagttgattaagcatgtatatttgctattagtagtattttactcaattgtatgtggctgaacgtctgagcttgtatctaagcatgttaattaacataaactaaaaattactgcacatacggctacatccagcggagcccgggcacttgccgaggctagccgggtcctggctccgccgctaaggatggctgaagacacagggtggaggcgacggatctggcgccgccgcggccggatccagcctccccatgggtggatccgacgcctccaacaccggatctgggcggagcaagctgctcccgggcggcgtcgacgggaggtagtggtggcgtctggtggcaccgggtgaaggaggacggtgtgcgcggaggacgcggtggtggaagctggtggcggttgttgcggaggccggcgctgtggcgccggcagcgggcctcggcacggcctcgtcatcgcctccctcccctgcggccggtggtagaggctccttccggctggcgatgctccaatttgagcctctcgtggtcggatctgctgcaccaacactgggctatggcctcgacggcagcggtcttcggcgccggcggccttgccctataccctcttccctcccctttcctccctcctctttgaggcgcactgaaccttgctttgcttcttcccctccccttgtgccctcgttcgtctgccctcttccctccccgatccaaacatcgcttgtgaccgttcttttcaatccggcgtgcttgtttcggacttgtgctcctctagcagctcgagtggctgcggttctatgccctcctctgaagtcgccgttgatgttcttcctctgtgagattcccccttggtcatttcccttttatctagctccctgctcatcttcaccctcttcctcgagatgtccaggaccgcaaggatcagcatttctccctcctttgagacttccttcccttgaagggcgttggagagagttgatctaacaagcaacttgataaaacctgattaaagaaaactcaatttgggcggcctctggccgcaaccttcaatggccctccctcctttggggcttcctttccccaaagaacgttagcgagctctgatccaaacagtaacaagaccaagttagcttcttgatggcttcatgcgggtggccttagacttcaacagcattcccttggcctttcttcttttccggcttgtttgtggctgtgtgaggaattggatgttgataagttggggtttagcattaggttgatttggttcttggttgggtttttttgcaggtgtcgttcgtctatcgttaactttggggagcctttacaacctagcctccaaagcttagccgctgtctagctgtagcactttcaacgctctgatcgaattgttgttggtcagaaatcttttcccgcccttttcattcatatcctatgtaaaggctctgacgctgtcatgccaaacctttgtactccctgtaatatcatttcttttcaatggaaaattcaggtggggaagttctcccatccggtgatttattaagtttttttttaaaaaaaaatcttactcctggctagctttaaattgcgtttgacagtgacaggccctcgcgggcagggaaatcgatcctatccgctgggaaatatgtcaacacggtgaggtggcacgagtttgcgcattttgcagtacgcctcgactagctaacaggagttgcatgcctaaatcagtgtgggattagcatcaggcttctgtagctgatcagcaaagtttgaaaataacccacccaaatccatccacagcctgtatcgatttatgcatagtgttgaacccctgctttactgatagccatacaactatctaaggatgaaaacggatcaaaaacggacggaaactagctttatcatattcattttcatattttttttcagaatcggtatcggaatcgaaaactcggatacggaaatgaaatcgaatattatcgaatacagatacggagcaaatacgagacggaacgaatacggtagcgactatttaccggtatataaaaaacccctcaaattgagttttgataaggaagatatattgcttattattttaattcaacatctccaacatttatattgtcaaatttgtagacggtcccccaacagtacgtgaaaatcgattttcatggttgtttctctaagagatccatatgcaaatatgattatcattttctattcccaagaccttttactagatgtataacttacttaccattatataaattggagatgttatttattttacttcacatcttcgaaacttgtaatgtttgttttatactttaaatgctctcaaatacaaatgctataaactataaagtggtagatcccgttgagctctacaactttaatatggaacacatctccatcagatgtcgtttgaattgtagatctgagattttgtaaaaattaatatgatatattataatgaatatttagacccttaaatgaccccaaataataaaatagtcaataagaaagttgtagatctcatcgagctctacaatgttgatataaattttgtcttcatctgattccgtatgaagaagttatgtatatatacgtgttttttctaaaatttgctcaatgtctgcagatatccgaaaaaaattccggatagtttccgaccattttccgattccgacggatagtacccttactgtattcgttttcgttttcgagaaaaaaaatccgaattcgtttccgaatccgaaaattttccggatagttccgaccaaaactattcgaatccaaaaaaaggtccgaacggacggaaactactgaaccagtttcaaccctactactatcactgtcagtgcctcactgacgaaggcagattgaattttcaggttatgagccaacaaggcctagcatgggaaattggaggtagatactccatccgtttcaggttataagatgttttgactttgatcaaagttaaattgttttaagtttaaccaaatttatagataaatataataggggcatttacaaatttgctaccggttttttcaatattacaaggataccagtcgaatgatagttctagtggtatttttgcatctaatgacagttttacaataacgattcaaagcaatggtaaatttgtaattgtcctaatatagtaatatttactttaccaaattagttttattaaattaacagttaaatatattttttataataaaattattttggatcgaaaatattactattgtttttataatctgaaacagagggaatagctgaaactatccaactgagtggagtggtagagctgcggctgagggggtggagtaagggcggtggcagcagatcgagaggaaacttcgtctaatccgacggaaacggaggtagccaaggggagcacgccctggtggtggatcaggtgagagacgggaaaaaagggaaatgggagaggaggaagaagatttgatggcggacatattgggactcatgtgagtttcacttgtcactatattatcggtatcaaagttgacatggtataatgaggtgagcgatgagcggtattttagtcagggacgaatttcagactaagtagacacatttaggaacctaaagtgaacttatttcatccataaatgcatcaagaaattcaagcttacaacgcagtagaatgcaaatggttcgacccacgggcctaacacccacgggctttgtgttgggctaccgattccggcccaactaaccgaccaaggaggcaatgcgaggtctcttctgggtcctgtgtgacatagcggctctgcgagatggcatgaacgtaagccagtttacctcaccgcacgatgcagcaagaaataattaactgaagatctaacagtgcatgcattggatgctataattatcagacccgagagtccaacacatccgactactacatctatacaaaccacagaatcgatcatctcttctcaatcgaaaccttcatcgccggaaccgtttaattccggcgtctcgccgcgcgatgcccaaattaatagtatcatcgacgtaatgtacagggagctactagtagcttattaattagtagcgacgtgccgcctccatcgcggatgatgtcgaagctcaagctgccctgctcttgagccgcctgagctcgacgacgacgacgctgatgttgtccctgctgccgcgcgagacggcgagctcggcgaggagcgccgcggcgtcggcggccgagctgccggagacggactccgggaacatggaggccgcgcggccgttgaggcagttcctggcgatcttgcacgccacctcgttggacaccacgtcccacagcccgtcgctcgccaggatcaggaactcgtccttgtccgtcctctccaccaccctcacctccggctctgcgctcacgaacggcttcaggtagtagtcgcctgaaattcgagatgccttggcatttgttagttttacatatgccaatgctatgagcagcaagagttagattgggcttttttttgcttttacctatggatctagaagtggctaaaacaccaaggacacggtaaccgttccagttgatgactctgcctccagctgcttccactcgttccaactcgtcaggccgatctggctgcgtagtcaaaacaagcattattcagtttatgaccctgcataattcatgttacatctgaaccagtttactgatgggatcctaaaataatatcagagtccactcaagtgaagacacaaaatcggagcatcaacctgtttacgacaacagcgcaaacagtacactgttgctagtaagtggtgtaacccatatctttttcagaacggcggcacgggaaacataaaaagacaaggttctagaatgggggtaagctagctgatcgctgtgcccaacagctaacttttggcacatttagtggccgagacgcatcagacctactaacccatctcattgacgaacagtagtgtactgctgctactaccatgctttggagttaaccctgcagttgtgctgttcaaccgacaaagtaaaaggagactgtcaacgtgtaaagccagagatgaaatagatcttgcacttaccacaaccacccaagcgacagtatcagtaaatattttgaattgaagtacacgataatggcataatgcactgttagcatcaagctatagttacatgggcaaaatttcctactacctgcgtccttggcgaacattcgaaagatcaaactaggtacagtactatggagtagtaagcatgccacgtacggatctaaccaaaaaattaattgacggcaatcagagctaaatgtacacgagtaccatggattacacgaataacatttggccatccatatatcattataaagaagtagttgtacggagtgccacgtagcgtaccttgtggtcagtggagagtggcagcgcgacgccaccgcgggagagcacggcgcgcgagtcgccgcagttggcaacgacgatgcggcggcgtcccacgacggcgaccacggcggtggagcccaccgtcctgaaccccgacggctcggtgccgtcgacgcggggggcggcggcggcgacgctcccgacgacctcgccgtccatcctcgcgaagctggccaacatcgcctccttccagcgcacgtcgccgcccgacgcgctctgcccccgcagccgccgcaggctcacctcctccgcgagcacaacgtgcatccgcttcctgcacgcctccgccacccgcgacccgccgtggccgtcgtacaccgcgaagaagtcctcctcgccctccccgccgcccctgatagcgcccgcaccatcccccgtcgaagccatgaacgtccgctcgatggccaccgcgtcctccatctccctccgccgcccgatcaccgacaccgagccgtgcgacacgcacgccggccagctccggggaacaacctccgtcgacgagtcatcagacgacgacccgtccttcaccgaccggattctcttcgccgccgcatcatcctccgccgccagcccgagccgccggagctcgagacgtcggcgccggcgtgccgccgcggccttgccgtcacctccggctactacaacttcgcacgcgtgcccctcatccgtcgcgcccgtctccctcatgtcccacgcgtagtagagagagcaacggaggaatcaaagggaaaggctcgccgaggagggcgaggcgggctttaatacaagcccacggcgaaaggtaggagaagcaacccgagccgtcggatcgcgcgcggacggccagatgcgcgccaccgccgcgtgggacgtggacggacgagatcgccggtggcgcgtggcgtggccgccgtctgggatcccgggccgggagagagaccacgctgcgcctggtccaccggtacgctctcgcgcgcggtccatgtgggcccatgttttcagtgacataggcttaggtggaatgggtccacgtagcgttgggatggttgggaccattaggtaggggagtggggcccaggaaggggtttacgtggagggagagagtggaacgaggaagtgtgggggcgcccgctcccgctgcggcggggacaaatgttaaccagcggcaaggcaaaagggcgcggcttacgtgcaaggaaacgagattctacaggagcgagcaaaactgcaaaagccctctgtgtttttgacccaaaccgcgccaaaaccaaacccacgtctcacacacctggattccggaaaaacagtgttgggtcaaacaaaccacgccgcgaacagccggcggatgaacgaggtttcgtttcggcgtttcgaatggcggagatggtcgatggcgtacgcccgatttggagcgtggcgcgggggtgagggccgcgtggcgggcgaggtggacacgcgcggcggatccagaggcgcaagcgcgagagggagctcggctcatgccggggtggaagagccagcgccatggcgcggcctcgggctccgtttccggcgcagcgccactgctgctgctgagtgggggcgacgtggagacgacccgggccgtggtctccgcttcttcgtacgagcagtggtgacgtggtccgttgtggtcaggcactcggtgcaggcgcgggattcgaggggtgccacgacggcatgcgggcagcaaccatgggagggccatgccgttgctagctttcaacttttacggcaaagcttgttcattcatggtgatgcgttggatggcgcttttgtccggtcgtttctgatctcgacttccaaacgagggcgcgcacatgcatgctcgctcgctccatgatcagttcggaaccagcaactgttttgttccagctctcaggatctggacaggtgtggtagcactcccagtacgtcactgcattaacttgaaacccgtacgtagctcctgatcagcaaattaatgttcgttgctactagtaataggcattacacgtccttcacaatcacttcatctgtactcgagccatttgatagcatcatgatcacacagtactggacatgaggttaagcgggagcagagatgctttcccgtttgaaacttaatgtcacctgcacgctagctaaaacaatactgaatgctaacaatgtgccccttggatactatcatgatcacactactgtagagtgatgtattaaaaataattgttgctaattccgagcttagcatatttaagaaattcgaacataaaaaggagcagaaaatatcatctcactttctcagtactactctcagtacaataacagactataagccagatataaacatatttcaagaatataaaataggagagagaacagcagcgggctatagatttatagccacttgtagtaccaattataatttgtatagtatacgtttataggtaactattgtatgaatcggttattaaattgactataaatgatttaaagctaatagctggctataccattaaacttgctctaatactggtatctctctaagctagcgttgtgttgtcgctttcggagaacaacgcatgcatcaatgcatcatgattaattcatgcatggcttagcttttttaagatttttaagcacttagagcagttacaatagcaagctataaaccagctataaatatattttaaaaagataaaacaagagagagaagagcagcggactacagatctatagccagctgcagcacgaactctaagacgtaatatgtgtatgacaggtgggatcagatattaatagtatagtaagtaaatattatataaattagctattacattggctataaatgatttgaagctaatagttgactatactattaaactcttagcgagctaagctcaacttgttaggtctgatctgatgcaatgcaaagcggacaagattccgcgcgcggccgccataagcatggcctcgcaaatttgtgtagcatcgccttgacggcaatg

SEQ ID NO: 78783 - DNA, 16776 bp, Oryza sativa
aaaaaaacaaggcaaaagatagatgcaatattgaaagaacgattcaattactctctccgtttcacaatgtaagactttctagcattgcccacatacatatagatgttaatgaatctaaacacatacacatgtctagattcattaacatctaagtaaatgtgggcaatactagaaagtcttacattgtgaaacagagaaagtaattaattgcgttattatagattgtgtatctcaattgaactagccatggttgttataaaggggtagtcttgccttgcataggatcttctccatgtcccactatgtgtagatgtcaattattaggactcgaataaccacagtacaagcaagaaaatccgagacccaacaaaacctaactcggaattgaactccgccggtctcacgggtcgcatgctgccggtcaaaccgaccccaaccgttggtctgaccgccatcagtgcagagaacattcagcccatcaaaaaaatcaagttatttgggcagcacaggcccatatgcctcactcacttgggccgatccggcctcgctgaacggccgatggtactgcaaacggtaacagttgaggcattaacaaccgtacaccgatgttcatcagcgacgcggatgtgcgtccctgtttctctcttggcgatgtagatgtcagtgtgaccacaaacagagggagtggccctgaacaggaaaccagaattgggacgcgcaggtcgcaggaatcggaatgttaagagtgctgctagtaatggcatattggcatattagcatgtccagtcgaccagtccatttccagcagctgttagttagcactcgccataattaagatggatgcgtgccactgtcactcgccatctcacccagatcacacgaccaaattgatccatcgctaacgttgtaaagctaagctgcctcttatgtgatctgatcaataatacgccagttaattgacagtaaatcagtaatacagcaagaacgtacatttttagtttttttttcttacctagtttgatggcaaagattatttgctacgaattgatatttataataaggtgaaaataatcctgtggtgaaacgaagcaatggaggaggtggtggtgcgccgccgggcatgggattgcgggagcccactgtacgactcgttcgagctcgcgtcggtgtacggcctcctcgacagcaatctcatggcgctgccgttcgccgagcggtccgcggagctggacgcggcggcggatcgcgctccggcgaggaggacggcggcgaaggagcagaggcggaggaagaaggcggcggcggcggcgaggaggacgggcaaggcggtgctccgttccatcttcaggtccgtcacctgcagcaggaagctgtaaagctgtaacactgagaattcagaattcagaattgcatcgaacgagatggttgagaaaattaacgatatgatatggattgatatgaattgattcatcggtccgcagtgcagatctcgctgcttttgtttcatttcggcagattttatgattcgagttgggttttcgtttccatcggtttcttgtccttctcgggaatctccctattttcctgcatacgataattcgatctcagaaaaaagagagactctcggtgggcaagatccgttttgcactaggggtaaagggtccactaccagcaatcgtgtgaactctgaagtaacacaactaaggtctgtacatccataccgaaatagtgcattggcgttgcactgaaaattgaaaaatgccaaaatgggctgaatatatggatggtactcctagcagaagtcaatcagagtgcaaagtactactgagtactattatacatctggaattttgatattaagaaaactatttatttttcctaaaatgaaatagtagttctgaacttccgatcagggttcacctttccgattaagcgctggatcccgatccctggcagtatgacagttttcaccaaatttcgacaaattttggtcaatcttactgtttcaaatttgaattcccgaaaaccatccaaacttccactcggactctgctttcttcccacgttgaaacctcaaaattttgtgattttcaatcagttctaaaatgtcaggcagaagctagctcaacacaggatctttgagaaaggctcaacacaggagcaatttgtcttatgggtgaacaaaaatggaacactcgattagtatttcattgctgttcttgtccaaacattccaattgtggatgtactggacagattgtgtgggtttttattcagaagtggaggtggagcccagctcaactaaccactgtttgatgcacatgcgaacagagaaaaattggtgcagatgccttagtcagtactaatctccacggaccacaactgaaaggtttctttcagaaaatcaagtgaacaagctctacaagatttgtactggttagataggaatacaaaatatagtggcatgctgaaatccttcccttctgttgcgtgtctcatagtttctctatcctcttgcaatcaatcctctgctctgcaccacatctgttcattcatctaaaaatgtgcaaaactgcacatatgtgtgatgtgtatgaaatatcaaccactagggaaagaacataaagaaattatctgtgcaaataatcctctctaaaattctcatggatgctctctagctatgcaaacaaatcagaacaagaaacagagtacgagcaacatttttgtagagctagaaattcagtgattagtttttacaactttgtcgatgcaaaaacccacgacagatcgagtattcgagtatacatgttgttactaattagtcatttctaacaaagcccaattttctcgggacgatttattgctgatatccttctaatatttctaggttataaccttcacaaataaccaataatccatcatcacctaacagcgaagaatttctaagagctcaaactctgcaaccaatcatggccatccatggaccttggtgtcggttggttcgtgtccatggttcgtactccatctacgcagctagaagttaagcatctcccagatcaactcgggatcgaacgacggcatccgctcgagcgggcagtcgccgtcgacggacgccgcgctcatggagagcacgccgtccggtgacccgtacgacgacgacgtcgtggttgtcgtcgtcgtcgtctcggacgcggcgcgctcggaggccacggggcgagacggcgtcgccgccttcgcgtcctcggcgcgttggctcttcttgctctcctcgcgctggcggcgcgcgcgcgcgcgcttgcgcgccatgcggacgcggatggcctggatcttggcgtcgacggcgtcgcggagttggcgcaggttgtcggggcagtcgcggccgtccatgacgccggggaagttgaggcgcgcgtactcgccgcggagcttgaacgcggcgcggtcgtaggcgtgcgcggcggtctccggcgagtcgtaggtgccgagccacacgcgcacccggttctgcggcagcctgatctcggccacccacttcccccactgccgctgccgcacgccgcggtacagcttccgcggcgcgccatcgtcgagacccgccgcggcggccgacgaagagctggcggcggcggtggcgctctgcgcctgcgccgcctgcgacgcggcgaagtggcgcaggagctcgctctggcggtagtagacgctggagccgagcggcgggatggtgacgggcggcgggaggtgggagaacacggtgtcgagggcgctgccgccgggagagaggaggagggaggagacggcggagcggacctcgccggggaagatcgccggaggcagtgtgcggaggctggcgtccatgggaatcccggaggcgggagggtaatttcgtaattagcagcggatgttacgggcaaggcgggaagggcattcttgtggtgatttgctcgagatttcgccaagtactcgtgtaccatgtggcttatataagcgaggaatggcacggtggttttaccattatacccctcacatgataattggagtatgaacacaagatctttatgttgttaacacttcacgctttggtttggtcaactagctcaccatgtttagacccgtgatcgtaattaagcacccaagctaccccaaatcacctgtcaaatgaatagataatcattctacggaacaacaaatctgactacttatttcctcctgtgcatatctataagttggtgtttggatgcatccctatatttagacactaatatagagtattaaatataaactacttacaaaactaattatataaatgaaagctaattcgtgagacaatttttttacgggaatgctaggggacgggataccgtcccccaataggatagctccttctccacaacgcaattcttatccatacacgcaccaggactgctcactcgtcgccgtcgccgtcccccgccgctgctgcgcccgtcccccgtcgcctccgtcgccgccgccgtcgctatcccctgccgccgccacgcccgtcccccatcgacgccgcgcccatcccccaccaccgccgtcgctgtaccccgccgccatcgtgcccgtcccccgccgccgccgctgcacccgtcccctgcagccgccgtcgctgtcctcgtctacaaggaacggctgcaggggccgaccgcacgtgtcggggtgctcctcccctaacggaatgcccagctatatctagtaggaatcacctgatacctggtaggtatcattcgatacctcgcaagtatcacatgatacatggtagaaatcgtctgatacctgacaagtatcacatgatacgatacgtggtagaaatcgtctgatacatgacaggtatcgcatgatacctcgtgagtatcacgcgatacgtagttgaaatcatctgatacctgataggtttcacatgatacatcgcgagtatcacgtgatacgtggtagaaatcgcatgatacctgataagtatcacatgatacttacaagtatcacctgaaacgtgtgtagaatcgtgtgatacctgataggtatcacacctgatacctactcgggatcatcctgttgtgtagaattgtctgatacctgataggtatcagacctgatacctactcgggatcatcccgttcgaaaacgggatcccgttatatagcagcccctttttttaagcctaattaatctataattaaagaatgtttactgtagcatcacataggctaatcatggattaattaggctcaatagattcgtctcgtgaattagtccaagattatggatgggtttttattaatagtctacgtttaatatttataattaatatccaaacatccgatgtgatagatatttaaaagttttagtctcatctaaatagggtctaattccacctactgtaacattctcattgaaacttgtgttacaccaaatcaatctatatatgcaccacatttgtttcggatacaagaaaatctcacatcaattaaatttatcagccgatcatggtagatttaaattagtaatggtgcaggccaattaagagttatacctaaaaatccaatcacactctgaaatgtattgaaaatataatcttatccatagaaaaaaaatgctaatatagttatccatcaactccaatttgatgttcactattatatagtagaataaaaaattaagagccgtataacaaatctaattacactctaacttctctctgcgtggaagttgtgcgggacaattcatcactacttaaaataacaattgaatactaattccagataaattccagactaaaaattcaatccaattccaaatgcagaaaagcccgcggcgtgcacggatcatggattcccaagttcttggacacgaaggccagtttgggaattttgacgggtgggtgggggcagggacacgtggccacggaggtggacgtacggaggtggcactgcaaaatgtcaaaacgggagaggtcggaacgggaagagagagagccgtgatgagaaggcccaaaagcaaacttttggcatttatgaggattagttgcggtgacagcggcggccttacgctgccacgtttccggttctcctggagccacacccttgcacatccatcatctctcattaacttgattagacccggtccaccgtgctccggtgacacgtcggcagcccccttcctgccaaaaaatcacacttaatcaaaattaactactcttatcagtttatcacaaacctgtttcactatttgcactgtttgttttgatgactgcatgttacagtacaaaggcccccatttttcttacatagaagtaggtaaaataagcctgagaaaacatgctctaaaattttgtagttgcatgtctttattgattttttttggcatcattggttggctacgagctgattctaagtaaaaacggcttattagaaaaaaaaatttatgtttaaagctttttatatatcaagaagaaattgcgttaacataccgtagaattaacttcaagattaagttttaaatttaaattttggctcttgttcatttgttttgtagggcaaactatgaggcttgattgtttccttactccctgttggcggtatggtatgaggcccttcgaccaaaatctgccaaaggctatgtgaggagtgggaatccaagcccgagacgctaaagttagtcggggcgaagccccctcccccatggcgaacactatggaacaagtacagcgagaggcgaaggatcgtgtgggtactctgccaagccggaggcctcttgggcgaaggacgcagggcgaagagtatatgccgaagggagacgacttcgccaaagcaagctccccccgcgagggccaaagaagccttttccggcccatcaagcctaggggccattgggccgacgatcgcctaacggcccatcaggagtccatgaacctctattacactatgtactcatgtaaatgtcctttcataagggtaaccatgtaaattcccctgtataaccaaaaccctaatagtaataacctgtaataggggctataaatagtcccatagggccaggtaatggggggatcccaagaaaaattctctaatcaatacactttactttttctcaaccactgttgagtaaccacatctttcgacgtatgcagttgtcgtttcgacaacagctggtgccgaccgtgtggacctccgagcgaaaccactgagagcgaatgccaccgaagaaggtcgtaaaggagaaggttacaaggcgaaaggaaagcgacgccggggcggatatggccgccgaagagggagcagagccttcggcgcctgtcgccgaagatggaggagcgccatctgcttccgcacctgcgctatcactaccgcctttggcccctgctacctctgtgcaggtgccgaacgcggctgacatggcgaaggcggctgtggcggcgagggcactccagaccagggcggagatcctttcgacaaaccaactgctggtgccctaagccgctccgtcacagccggcagtggccctaactgcgctcgccgctgtgcaagcctaagtcaaccctgacaccgagacacaaaccgaagccgacatggaagccatgcgacagaacatgacacgactctaagacatgcttcaccaaatgcaagaacagcagcaagcgtacgaggcggtccaaggtcgcttcggcaccaatcctccagtattcggcaggttatgtcccaccccaagtctatccacaagtgccgacccagccccttctgccataagttgtgcaagcgccaatgtacttcgccgggcagccatcgaccgcagcagtgcatccggcccctcacgtgcaactgcaagctcaaccggtcgctgcccaagtacatccttaaccgcctggccaagtgccacaaacaatggcagaaggggcttcagctctgcaggcgcagctccaagctttccttcagcagctcagccaaccccacaacatttcaagtacaaccccttcggcccgcccggaggggaatacaagtcaaggtgcgcctcgttggttgccttcgaatcagctaggtctggggacttcgccttggagtcaaggaccacagttcgactccatcaatgctgcttaggcgccaaccgttcggccgcaagcaccaacgccaggtttcggagcaaaccaagcaccaaaccaggtcgtcatgacatggtcacagccaactttcgacccattcatggcggtacagcaagcatcaccaatcgggccgggcagccgaatgccatggcccaacctcacgcgcaagccgtgatttcgcccttcgccacgccatacccgcagcaaggtgccatgaacagggcagggggcgaaaaggggctaccattgagtgggggaatcaagacccgtccaatcccaccccagttcaacttcccacccgtcccacgctactcaggcgaaactgacccaaaggaattcctctccatttatgaatccgcgatcgaagcggctcatggcgacgaaaataccaaggcaaaggtaatacatctcgccctagacggcatcgcccgctcttggtatttcaatttgccagccaatagcatttactcatgggagcaattacgcgatgtctttgtccttaactttcgaggcacctatgaggagccgaagacgtagcagcatctactcggcattcgccagaggccgggggagtcgataagggagtacatgtgtcgcttctcgcaagcccggtgccaagttcaagacataactgaggcatcagtcataaacgccgcttcggctggtttactcgagggcgaactcacaagaaaaatcgccaacaaggagccgcagacgcttgaacacctatttcgcatcattgacgagttcgcaaggggcgaagagaattccaagcgacggcaagcaatacaagctgagtacgataaggcttctgtcgccgctgctcaagcccaacaacaagttcaagttgccgaaccacctcctctcgttgttcgccaaccccagccggcgatccaagcacaaccgccaaggcaaggtcaagcccccatgacctggaggaagttcagaatcgaccgagcgggcaaggctgtgatggctgtcgaagaagtgcaagccctccgcaaggagttcgacgctcagcaagcaagcaaccattagcagcctgtccgcaagaaggtccgaaaagacctctactgcgccttccacggacgctcttcacacaccacggagcaatggcgaaacattcggcaacgtggcaacgtgcaagatccaaggatgcagcagggagcagcggccgaagcaactcgtgaagtagctcaagaacaagtacccccggccgaacaacgccaagatgcgcaacgcagagtgatccaagtgattacaagggccgacccgccgatccaactgtcgaagcgacagaagaaaatgcagctgcgaacggtccacaatatcacttcggcaggcgaaggggctccgcagtatctgaaccagcaaatcttttttgggccagaagatgccgaaggagtaatgttcccgcatcacgatcctctggtgatctcagccgagatagctggtttcgaggtccggcgaatcctggtcgacggaggaagttcggccaatgtcatctttgccgaagcatatgccaagatggggttgactacccaagcccttaccccagcacccacatcgctctgaggattcggcggagaagcagttcaagttcttggccaagcacagttgatagtagccttcggcacgggggaaaacagacgcgaagagcaagtattgtttgatgttgtcgacatcccatacaactacaacgccatcttcggccgtgcaaccttgaacaagttcgaagccatttcccatcacaattatctcaagctcaagatgcccggcccggcaggagtgatcgtggtcaaggggcttcagccttcggctgcttcaaaaggcgatttggccataatcaatacagcagtgcacaatgttgaggccgaaccgcatgaccgggcgaagcacacgccaaagcccgcccctcacggcaagataatcaagatgcagattgatgatgccgaccccataaaactcgtatcactggggggcgacatgggcgaagaagaagctaagaacatcctagaggtactcgaaaagaacattgatatctttgcctggggccctgatgaagtgggaggtgtttcggcagatctcatcatgtatcacctagcagtcaagccagatgcaaagccaaggaaacagaagctacgcaagatgtccgctgatcgccaggaggcagcaaaagccaaagtccaaaaattgctcaaggcaggggtcattcaagagatcgatcatcctgagtggctggcgaatccagtgctggtgcggaagtcaaatggcaaatggcgcatgtgtgtcgatttcacagacttaaacaaagcatgtccgaaggatgatttccccttgccacggatcgaccagctcgtggattcgacagccggctgcgaactcatgagcttcctagatgcatattccagctatcatcagatttgcatgaacccaaccgacagccccaagacagccttcatcacaccgtttggcaccttttgccacctcaagatgccttttgaccatgcgtccgacctacaggagaccttcgacaacttgcgcgcaacatgtatgaaactgaatcctgagaagtgtgttttcggcgttcgcgcaagcaagctgttgggtttccttgtttctgaaagaggcatcgaggcgaattccgagaaaatcgatgccatttatcaaatgaagcctccgtcgagcgcacgtgaagtataaaagctcgcgggccgaattgcggcactgagtcgattcctctcaaaggcagccgaaagaggtttgcccttcttcaaaaccctccagggcacgggaaaattcaactggactcccgaatgtcaagcagcgttcgacgagctaaagcaatacctgcaaagcccgccagctctgatcaggccaacataaggaagcgaactgctactatacctggcagcttcgccagtggcaatcagtgctgctcttgtccaagaaacggattcaggccaaaaaccggtctatttcgtctccgaagcattgcaaggagcgaagacaatatacattgaaatggaaaagctcgcttacgccctggtgatggctcacgcaagcttaagcattactttcaggcccacaaagtcatagtgccatcacagtaccctttgggcgaaatactccggggtaaagaagttactggccggcttagcaagtgggcaacagagctatccccttttgacttacattttgttgcccacactactgtcaagtcccaagtgctagccgactttgtggccgaatggacaccggcattcgcccctgaacccgagctcgtcgaacagccctgggtgatgtactccgacggttcgtggtcgcacaagggggcgggtgttgcggcagtactcacttcgccaaatggtgtgccaatttggtatgctgcaaggctacagttcgacacaaccaacaatgcggtagaatacgaagccattcttttgggcctaagaaaggcaaaagcattggggattcggcgcctgctaatccgaaccgactccaagctggtggcgggccatgtcgacaagtcttttgaggcaaaagaagaagggatgaaaaggtatttggatgccgttcggtctatggaaaagtgcttcaccggcataacaatcgaacatttacctagaggccagaacgaggaagcagacgccctggcgaaatctgccgcttgtggtggcccacattcgcctggcatcctttttgaggtcttgtatgcaccaagcgagcccacggacagcttggaggtcctggcaatcgaccaggtcaaattgggcgaagacccatacgactggaggaccccgtttgtgaagcaccttgaaactagctggcttcaggaagacgaagcagaggcaaagcgcttgcaattcagagtcacgaagtataagatggtctcgggccagctctatcgctacgggatacttcaaccccttgcttcgctgcatttctttcgccgaaggcgaggaaatggcgaaggaaatacaccaggggctatgtggcgcgcactaaaccgcaagaacagttgcctccaaagtatttagacaaggagtttactggcccactgtgttgaaagtatgtgttgagcaaatcaagaagtgcgaaagttgctagcatcatggccgaagccaaacctcgccccagtatgagttgcagcccatcgcaccaatctagcccttcgccagatggggactggacattattggccgttcccggcggcgcgaaacgggcacaagttcgcaattgtggccgttgaatacttctctcgatggattgaggccgaactccttggtgcgatctcttcggcagcagtatagaagtttgtatggaaaaacattgtttgccatttcggagtgccaaaatagttcatcactgacaacggcaagcagttcgactctgacaagttcagagaaatgtgagaagggcttaacctggaaatcaggttcgcatcggtcgcgcacccgcagtcaaacggagcggcgaaacgtacaaatggtaaaatcctagaagtactaaagaaaaggcttgagggggtagcgaagggcaaatggccagaggaaatgctatctgttctctaggcccttcggacgacccccacaagaccaaccaagttcagcccgtttatgcttctctatggcgatgaggcaatgaccccaacagagctaggggctaactcaccaagggtgacattctctgggggcaaagaggggcgcgagttgtcactcgaactcatggagggggtaagagtcgaagcactcgagcacatgcaaaagtatgccacaggcacttcggcaacttacaacaaaaaagttcgaccgacggagctgttgcctggtcatcttgtcctaaggaaaaaggcgaacccgatagccgttagcaagcttgaatcgaagtgggaaggaccgtacctcatcaagcacaaatccaggatggaatcctttcgactggcgacactggaaggcaaagagttcgaccattcctggaacgctacctctctcaaacgtttctatgtctagaacgggtggcacccaaatcgccaacttgtaaaaatgtatatatcgttatgtaagcccttcggcactatgtaagcctttcagcaagaaaaaaaataaaaaaagaggaaaatgaaaaaagacaaaaaaaaatggatgtagggctattatccaccacggaggcccgaaccagtataaaatctttgtatcctctgccttctttttatttgtttgtgcgattgataatttgcggaaaaaccccaaggcaaacgccttatcagcgaaaaaagccaggagggcgaaacgaatcggccgaagcatcgttcgccgaacgattgaaaccgcagcagcttgtttcagactcgatcgaaaggaaagcacgagtgcttcctataacgtagaacaaaacggatcgaaaacggaaaccgaaagctgaaaagtcaaaacctatttcgctaatatatgcaaaggggctgatacattccgacccaacgaaaagcacgcgaagtgacaatgcaaaaataacgaaatggaaataaaatgcacctttattgattttaaataaaaatgtatcgaagaatacatcacaatggtacaaatgaagagaaaggagcaatggcgttacagcccggcttacagataaattacatcttcgcccccacgatctctctctctctatggagtgattgggcgaactaggttcgtcatcactactaatatcatacacaaccctaagaggagaagggggcgaaatacagactagactgtaacgacgctgggagatcgcctcctgccgatcagtcttctgatggtttcgctaaaagcgagccatgtcctccaaacgtcttgaatgaacaagatcgtagtcatctaaggttcgcctagggtgcgcccgaagccacccgggaaccttaaaaaccttatagctgcgtccgtttatcaccatttcacgataaacaggccgaaatgggcatcgcacctttggcaaatcctttaatgccacaaatttctcgttttggtttcgccaactcccagaagggggccgaatgcacaactttcggcaaacaccctggtagacagtgcaaaaagggcaaaaggagaattgcatagtaagaataggccgttaggcgatcgacctcggccctagcctctcttcctttctccaactcggattggagccacttgttttcggctttcgactctttcagggtgttggcgagggcctccatctccaagttcttgcggcctatttcgtcatccttggctcgaagacggttcttaaatccgtcaagacgagcctgcactgttcgctctgtcgaacagtgagttgcaagaatctggatgcaaaataggaacggtgaagagagcaaatgttaattatgggacatgtaaaaaagaagaggaaaaccaagaatagagaaaaagcatacccgaaccgccaagcttttaatagcagaacacccctcatcgaactcattcagttcggtgaataggctcggggtgctggcaggtaagacaagattgcttactccctcgacaaagggaataaggtctgtccgggtctcgaaatcgccaggggcgaaatggggcgccgcaagagaatactccgaaccagatgtttcgacggtcgcacccttccccttcgccttgactagcggcgaaacaaccggctgacgcagagggctaccgaagaccctcgccgcagctgtcacaatccgttccacggaggctgaagccccggcggcggcgctaccgcctgctccaactgcgccaagtgaaagaacgggggcggtcgaaaggtccaggctgcggccaacgggctaagtcagagtctcgtcagaagacttgtcgtcgctgaagacgcgagcgacatcgacgagtcctttctccttggaaatctttttgaccaaacctcccttcgccgccttgcctgccgaaaacgcaattagcgccttcgccccatccatctcctttcgacgaaggggggagctgttcgactccaccccggtctcattgtgacccgggcttggagtaggagtatagccaggggtgtcgacgcggttttcgaccgcctcgtccgcggccttttcgaccacgacctcaacctcctcctcttcctccccttcctcctcgccgtcacgctcttcgacgtcatcctcgtcgtcggcgtcggaatcggacaaaacaggaacccttcgcttcctgggcgcaagctttacttgtccgcgcgttcgctttcacgaaggtcctgcatcgtcgtcggccttgtgggggttcgcccgcggaggcaattcgccgttgtaaacccggttcgcccggccagccgcttgtcgcgttagcagctggctatactcgacgaccgacacgtcgccgatcatactgcgggcttcggcatcagcctggtcgagggtcaacactacaaaaataaagggtgtagccacattaagcgtcgaacaaagcaaaataacaaagcgcaggactgcatttcgaaagggcagtcttaccgttcgtcccttcaaggagaaccaacttcggcaaaccatcaacctcttcgccttgctcaactgcgacttgccacgactgggagaggggaaagatgcgaagcatgcaaaattcctccaccaagtcgcggcagctaaggccggagcagaccttacgtagtagagcgaaccacgcctccatagcgccgtccacggcgatcttgggctttcggttcggcgcaatcgccctgcaccgtcaccgaagggcttttgcggagtcagaaccagcctcgaaggggatggtgtggtaaaaccacctcgccatccaatggcggtcccacttcgacatggcggcgttcacccaccagagatcggaccgctcggggcgaacattaaagtttacgctcccgaacactgtcttcttcgttctagctggggtaatcaccgtcttcgaattcacggtggcgaagaatatggcgccgatgagttcggcacctggctcaaaccacgaagtccggcacgcccagtcaaagatagcgatctggaccaacgccgacgggctcaactacgggagctccacctagaaaaggcaaagaatctctggcaacaacgcgttgcacggaaaccggagccccgcttcaaaaaacacggcgaacaccactgtctggttgtcgacgggtttcggtacaacggctttccccggggcgaaatcctgtccctcgactaacgccccagagctgaccaactttgccagctcgccgtcgtctatgagagaaatccccaaataggcggtggtgttgtcgtcaatccggccggggtcgggccctttcgccgaagaggggttaggcttgcggggagccatgacgaaggacgtatgaagtggcgaagggtgtgtgcagtggcgaacaagaggagtgagcgagaaatctaaagggccaaggggtgccgtgagagcaagaacggaggaagagagcgcgagcggtgaaagtggcaagtctggcggtgaaaagataacgggggagcatatatagcccaacaaggcgacggttcgcctacccaccagtaataaagcgccacgtgtcgtgagggtaggtgaaacggtaaattcccatcgaccgagctgcacagtaaaaagcccacaaagggaaggcccattactgttcctttcggcccggtaaaaaaatgggctgcaggaa

SEQ ID NO: 78784 - DNA, 23988 bp, Oryza sativa
ttagaatccccttttcgagaaagaacattcatctcatgtgttttcaattttatataaagtgaatccaaagtcaaagtagacatgtcaacagactcctgaatagatataactttcatatcccaaatagacatatcaagaccatttaaaaagtgacgagaaatctcagattgtggataattagcatcataagaagaattaacagatctaagattactcaaaattttattaaacctaaaagatagtcatccaacgcttctccaggtttcatctcaaatttaatatactcctttttgaaaatatcacgacgaagttctttaatgttatttgttccttgataaaagttactcaaagcattccaaatttcatgagcagttcgaaagtgcgcaacacgatcataatccgaacgagaaataccactcaaaagaatgttgcgagctttgcaattttgctcaaaagcagttttttcagcggcagtattaatagcttcaggaatcacataaggataagaaacttttctccaaatatcataatcttcagtcataatataagattgcatcctactacaccaatgagaaaaatccgttccgtcgaaaacatgaggcttagttgaaaacctagcaggagtagccatggcaaaaactttagatcgataaaaatccaaagaagaaaacaagtctctgataccacttgtaggatcgaatcaccagaactaagccaaccagagggggtgaatggttggtatacccaaaaaccgaaaacttttagcggaaataaaagttaccctctaaatcgacggagatcggtctgaccgcagttgccttgccggtctgaccgctcagatgccgccggtctgaccggtatagatcaaccggtctgaccgccaaagtcgttcgccgtgcctatcgccgccgtcggtcggaccgcccgaatgccgccggtctgaccgccggtagatcgccggttagaccgccgaaacccggtaaacacaaatcgaagaactcttaaagtagatgacgactttattgattctctctgtgtttacaaagtgcaccaacagcactccttacaaaaatttcgactaaacttgaaaccctaactcaaaactcaactcaattgctctctaaagcgataccgggaagcctcacgctccccctctatttatacatgaggtaggcagcctaaagccacgaaccaaactcatattaggagtcctaaacaccttaggaaaccctctagtacaagaaagaaactttacataaccaatcataccaaatttggactctttccaaattcgactccgcatcccacacgcacacaatacctccattgtatgccatatggaatctccatcaaccaagtacatcaactctagaattagtatcccgcatgatctctgaccaccacggacatcgtcttatccccaagccgactcccggtccatcaccgcaaatactgtcccaagacatcgagtcacctacacatgaaataaacaaagaaaccatattctgagaccaagctatctccaacttgactcattagtagcaaacaacagtattacatacgtatagtattcatctagaagccataatcatgaaataatcacggatatccaaacaaacaacccgaaactgaaaccgacacagcgtcggccggtcaaaccgtgtcacagcctgattttcgttttaggatttataaattatttaataaattattaatagaatttatattaaatgttctttaatttacaagtgaagttaaatgtgggaaataaaatttcctaaatttaaagcatggcaggatttaatttttattaaattctccatgattaattatactctctgaaattttctcggttttttcagagctcaattcctaaatgatacaaagaacagttcaataattagttaatcaataatcattaatgatctagttataattatgttaagtgcttttctcatttaaaaatccttaaattataaattgttgtttaaaaggaattattagaaataatcttaaaagcctaaaagagaagatctaattttaatttgttaaatctcaatataaaagtgggctagataaaattttgttaaatacttctcttgtttctatagttcctagatttttctgggatttatttgagccaaggaagtatttttaataaatggaattgcatttcatgaataatttaaattgaaaaatgttttaaaattctccttttagctttgggccaaaagtcagcccaagtctctctctctccctctcctcggcctgcttgcgccggcccgttcggcccagtctgccacgccctccctcctctctctctctcggtgccgctgacaggtgggacccacatgtcagtcgtcttcttcctccagccgctcctagccgcgcaagccgccgccgatctccttccaaattcgcccgcccctttcctcctccggctgaattgtttgaggggaaatgatcctcgagatctcctcttccttttctcttttggaaacatcggctaatttcgtttggaaatcatcggattcgatctcgaatcggattcgtctctctcccccgaaccctaaactttccatcccgtcgccagcctccgtgggcctccgtcgccgcctcctagcccctataaaaggatccccgggacctcctctctccgtcgccaccctcgccttagctcgtcgccgctcgtagcgccctagccgcgagagctcttgtgccgccgtcgccgccgcttgtccagccgtgcgccaccgccgctccggtcgtcgtcgtcgctcgggaaggtcaccgccgggttcgcgaagtcgtcgccgtcctcgtcccgtcctccgttgctgccgaggatcgccggagcaccgccgtcgtcgtcgacccgatcgtcaccgccgcttcaacctcgtcgccgtcgccgtccggttgccgtccgccgccgtctaagccctcggtgagttcgcgcgtcgcccgctacgcgttggttccctccgtttgcgccaccgcgccgtcgttcgccggcgagcatgcgaggccgagtcatcgccggtgatgacgtcatcgccgacgtcatcgtcgatgtccccgtagacccgcgatagatcaagatgatctcggccgttcgttttgaatcgattagatcccggtcgttcgtttccgtaaaccgccgccatgcacccggtccaccatgagccgagcccgctgatgcaataattcccttttccttttcaaaaataattctttattgtgtcataattcaattaaaatctatataaatgttttaatccggtttaatctttaaaaattcataactaattcatcttagctcggatttagttggttcaagtttctaaagttgtataaaataaagatctacatattaaaattatccataaattgaattaaatttatttagttctttttaaatgggctttaattagattaaatcttgtaaaattcataattaattcatatgaagtcagaatggggccgttcaagtctcataattcatctaaaattatgatttacgtgtttgtttactttttatgtattgtttgtttggagtttcttagtctttttccttgttttgcgttttagcttgtcgtttccgtcgtttcgaaggttcgcgagtgcgccggaagtattcaagaagattaattgaagacccgttattgcaaggcaagtcacacagatcgcaaacacaattcctttgagcatgttgatcctacatttaaattctctatttatttcaattgtgcatttattttcgaatgtcactaggtggtgtgaacttattcctttgttatggcctgtttgcattgattactctattccttgataccttgggttattataatttgactagttgagctttatatattggttcagctagatgttagacataattgcttagccatgcttagaaacattagcacacaattaggataactaatgtttcactgttacttaatgatggacatgataatggtagctcacgatggctaatcgtgattggttaattaattaatgtgccaactaaaacttgataatggtgggttgtgagcacatggttttgatggtcgtgctcatgacaattaaggaccggttcacgagtttcggttgtgaaacattaaccgtgccaaccacaagccagaatgggcaacagctggacactttgtataacaaggctcattgcggagcaccagactgagaagtggcggagataagcccacgggggtagctggggagtccatgcctctggttttttagggggtgactacgatccaggaacggtgcactgctttgggttgagttatgcgaagggtcttgtcacaatcattcgtcatggtgacatgtctgcgcagacacggtgacatgacggtgggttgtgtcttgtgagtacagtggtacacctctggccagagtaaaactattcgaatagccgtgcccgcggttatgggcgggtcgaacaatgtctttcgtgattagtcacacgctactcattaataataatgtggtaattgatggtaattaatttagctcctggtttggaatggtatattcctggtttggagatagatctgtgcagccgggtatggttgttcaggatggttgggcctgtgcagcatgggtgtgctgttcagtgttgattaatattgatgattaattactctactgttttacaattctcaattatttgctaaatgctgcttttgcaaatgagccctatattatgccattctttggtatccttgtgcacttgcatatttgctgtgcagcttgctgagtatgtcatatgctcaccttgcaataatcaatcaaacctcagttgaagacaagttgcgaaggagaagacgtttggtttataccccagttgagctgcttgtgggagtggagccggagcttcgctagattttattttccgctgcagttttcttcatggtaaggactaagtgcctcttaagtaagtatttatcgttttagttaatttgatgaatctgtatattaaattatcagtttgtgtatctcggctgattcctggacgatgatttaatgcacaaataagttctgtaattactagtgaatttctgggcgtgacaaaccgcgggctagccggtctgaccgacaatacctgcccggtctgaccggtcgcatgaaataacagcagtatctgcagattcacctgtgaaatccaatcatctccaaaaccacttcgtgaataaattccaaataacaaaactaataatctccaatgacaaatgttcatcacagaataataatcaaaaacacctttgattttgcaccatctaggtctcatgctaactcaaccgactctattaccgtcaactcgcaatatcagtcaaaaccaggcataatattgttaaggtctcaagtaatccggtttcgtaaattaagaaatctgatattacggttcaaatgacgtgatctaaactcgatattactgtgaggacctgaagtgaacatttctatgtttaatgtagccttagatttcaggatatagacgcaactacaacggtggcgttgcgctcgggccagcccatgcgaatcgcatccaacacggcgagaacgggctgtttgaatccaatagcgccaaatcgcatccaaagttaggagtaaagcgtgtgcattccttactgccggtcaccctgttttctcttactctgtttgtagttcgctgtaaagaacacttcaaatcaagctcacacccgaagccttccactcgtgcaacaacttcaggagttccatggtgtgattggtgtcatgtcgttcatcttttttccttgtgatgttcgtacagatttggtcttggtagctcaccttctttacccttaacgcaggctcctaccatttgtttctcgttttcttttatgaaaaatcctcggaatattttggcgtggtacgtgatatttttggccgtctgtgcttttgcttcttccagaaagcgagcaaccgttcgttggctgatgatggtccatttttcagtgttattcggccccagctctggttcttgttctatgtttgtgattatgttctctggtcctgtttctgaatttgttcctttttctctctaagaacatctttgtgaaagttttcgatgtagtagatgttacaaggcgatgtcactgtgcatgtccaagtttatgtcgctttcgtgacattagagcacgtacaatgcctagccctaggtcattcccctggctcacgccatcggcctccattgcctttcgtgcgtttgctcgcgggggacgcgcccttcgcccacttttggctaagccacggagccgagctctgtgttgggcgcacagtggctaccaatgtagctcatggtcactgctcccaccccaaaatttcccaaacgactcctcgggactctcccactctcgcccctcgttctcatcgacctcctcggcggccgcctcgccttctcacttcaccggccgcaatcgtcgtcgtccccgtgagagcaagcttcggggagggcagatccaccgtcaaagcgtagagaaagggaggggggagaaagaggggtgagcagcagggaaggggcaaatctcgttgggctacctgttcagcggcggcggcgaaggcgaagctggctacggtggcggagacaatgccggtgccggtgaagaagacgatggagccatcaccgtcggatgcagcgcgaggcgggaggttggcgaggacacggagccacgcctcgtgcgccccatccatcggccaccagcgacccggggatggagcgggcccaccaaatccggggacggcgacgatctgcgtctcgcccacgctgctcgccatcggtcaccagcggagggagggcggtggcagtgcgctgggacagagacgacgggcggagggagagagatgtgggcggaggaagagagaggcgaggcagcgacacaagggtaggataggaaaatattacaaacggctttgtgggttgggacacacattgtgggctgtagcatcttcatataccctcagttttttaagggtccaactgagagtattctttattgaaaggtgagtgtagtcatatgtagtggcttcagtcaacgaggacactactagtgtggcttggattgtagatgtccctatgacgtttaggcttcgtgttccgatggatgtgcagcgattacgcgtcctgtgatccccaaatgatcgcgcatctcgctgtcactaccggtctaccactccaagtgaaataataatggtcacttggctgtaaattggagtgcgaatgttgttggcttgttgcagggaaagccgtcaacataggccgggaatgcctcttccctttgctgctgcttcacaccttttgcaaaggtgagtgtttaacagaaaaggaaaagaaaagattaagaaatacataaattaacataagtcattagcttatgattaattatatattaattactttaaatttaaaaacatattaatatgatttttcaaaattattttttcatagtaattttttaagaaaaatatattgtttaatagcttggaaaacatatacgtaaataacgaatactcgaggtgccatggtggatgtatgtcgaagatgtgcagccatgaccacgacgccatgaggcccatgatgcatcgagccatcgacgcatcaacaaatatgaaacatcaatcaactggcaaaaaaaaaaaagtgctcagcaactagtgctaatgctatacagactacattagacccgttcactttgatgccattttcaacaatactattgtttaagttaccaaaaaaaaatatctacgtttagtttgtcgtcaaatttaggtcaatacataagaaatcctgctaaaaatttttagcaatatcgctattttaccaaaactttgacattaacaaaatttgataagatttattttggctacaatctaaacaggcctagtatgtttccttcagcaattcaatctgctcatcattccgcgaggcgcgaccgcgcgagcccatatattccgaacgctcagcgaatcagaatactactgtttgccgctgatcgcgtgctgctccgtttctgttttctttttgccgcgaaatgggaccgaccgaaaggtgttcttctagggagggcatagtttcgggaccaaccaattaccaaccgtctcagattctcgctagtcgctcggacaaaaaaaaatatcatatcagctcgaaccgctaaaaagcagaggtccgagacgacggaattcggtgtgggggagggacggcgacatggttggcacagagacagtcaaccgatcgcctatgcagctacgctatatagtacagatcgctagtactacagcattccatggtgaccgatcgaggaattggatctcttctctctcttttttatttccagcggatggtgcaggacatttcgccaaaaaagggctcgcgtttttcagagaccggtagaggccaagttgagcccaagaagaaggcgaggagcacaattcgtaggcattagtacttctatgtcaaaagaaaaaaaaaactaaacatgagaatgtttttggataacatacatatatacagatactccctccgttccaaaatataataacttttagcactaatgaattgtcctaaagtataacaacttcttcaccaaccaatcacaaccctccaccattcactttttttatctacttacacttctcaaccaattacatatttaattctatcacttttcttaataaccatgtccaactctaaaactctcactgctggagaatgcaactacactcccggtttgtaatccccttcaatcacgggtatacaaccgggatctcgaatccggaactaaagatggtaacgccacgtggccggtgctaccatctttagtcccagttggtgttaccaccgagactaaagttattttttcttttttttcattgttttttgctatttgcatattgatttctaacaaaactcaacaataaaatcatccacattcatagaaacatcacaaaattatccacaaattcaccgatcaaactgacatcacaaattcacaattcacgtcgcagatttacagatccaaaaacatcacaaattacaaatttacttgtgctaggccactcgctgccgctgcccccgtgcgggccgccgccttcgccccgcgctagggcgccgatgcccctgcgctggccgtcgtcaccctcgcgtgggccgctgccgctgcctccgcccgcgccacgccaggccatcgcctcgctactgcttctgcaagtaaagaggagaggataagagcaagaaaagaggagaggataagagagaggaggaagttaaaagatgaggataaagactttgcgatagaagatttgaggataagtgcgagggattatatacgacgggttgaattttagtctcggttattaataccaaccgagactaaaaatagtaaggggtcgcacgctttttgacccgggacaaagtggcgttgggtttttcaaccgagaaaaaaaagatttttggtcaacccaataaagatgtttctctagtagtatctctatattctaggacggaggaagtacatcttttcaattaaacttattttggaatggaagaaatacttcattatattctatactactccaggaaatacttcattatggagtacatttcacttgaaaaaatatatacctgttcatggaacaccaggttgtgtacagagaaggctatttatcgaggggaagattcggtgcgttgcactcgatcgaggacggtgcctgcttggaatcgtagtacaactctagtagtagtactagtaagctgcaccggtcacactcacacctagtacaccgctacattacgtgcgtatgggagtgtggccacccacatccacctgtcatctgcatcgccccttggaattgttgataccaatccatccaccgctcgcctcacctgttcgtcacgacctcacgcctgactctttaacctggaaccgcccgtctgacgagctcaccgtctttgtagttgcagacaaaagtctacgtgacgcacacccttatacggtcatacagtgatacgtactgtacgcattggtgcaacgcaaacagggtggttcagacttcggagcatgatgggtcactcggcccttgtttttatttcccaactttttttttcaaacttctaactttttttatcacatcaaaatttttcaacacatatactttcaacctttttaaatagactttcaattttaatcaaacttttaattttagcataaaactaaacacaccctctgacttttaacttgagattttgagaactcgaacgcattagcaggtactgtacttgatatagcaatgtactactccagcatgctgactcggcgccgacaccggcgacgtgtgacacgtcttgatggacagtatagcgaccgggagtcttgatctttttctggaacaagtggctctcagcatgtaggctctactgcggccgtgtttacttccatggatataaatttttaaagtatacggacacaaatttaaagtattaaacacagactaataacaaaacaaatttcaggttatgtctgtaaactgcgagacaaatttattaagcctaattaatctgttattaacaaatgtttactgtagcacaacattgttaaattatggtgcaattagactcaagagattcatctcgcaatttacacacgagctctatgtatatgtctaaatatttgatgtgatgtttttgttaaaattttttaattaaacaaggcctacttctaaaatagttactgttgaaaggaccttgcttctgtgctgtgcagtgtgcagtttctggggaacttttcaggaaagcgatggcgtatgtagctgttgccttccctaaaaaaacgaagattcctacatcgtttataagggcaataacaatatatataataaaagtagtatataaaacccacttatatgaactttaactattaaaacattcataatatatatggatagcaaatagtattggaaagagagaaaagatagagacaaataatatattttattctctatgggcaacccatatgcttatgggtagcttttgctatggactagttccacaatgttgttaggtggctgaaacaaatattttattacttatggaccacttttagactacatcgtggatgccctaattaagtaaaattagcaggtacctcgtaaattaacttctaggttacctattgatttatatataaatcggttaatgggtcgacccacctacatctctaaatacatgggttatctttatttaatctataagcgggctcgtgggttgacccgctagcatccctagttccagataaattaatcgttcatctcgctggttgtctcaatgtctttgggcccgactatgtgagtggcccttgtacgggtagctgtcttttccctagctattgtcactagcaagtgggctcgtagctttacccattctaccataggtgtacatgcccttactcaaatccatgggcttgtttggatttatgctaatttttgttcttctaaattgttggtaactttaatactagtattataaggatgtttgtttgatgctaaattttatccacactagtacaaatgatactataacaaattttataacaaatttggtagtttcaaaacttatcaggattttggtactaccaatatgttggtagggtgaaaattgtcatcaaaataaattagccccaaatttctctatctccatggatcacatgggaggaagatggtagtgtgaatcaagagcaaacaaaaaggatcatgctctataggttctttattaatctatcgtatgtactgccggtgaccccatgacctatcccaaaacatataaatatattctcgtccccacgtaaaagaacatttgcatatccagcgttacggtgtaaggtcatattgctcttttttgagaggaaaatagctttccattaacttaaggactcagcataatcgttggccaccaaattctccatgcccgaagacgtaccatcccattgcaattgcatgacgttattatgaggacactcacaagttacaacctaaaatttctaaagcgtgagctactttattccattctcggggagctaaaggtcatattgtttggtgcgtaacatcccctcgcatagacaatgggagatgatttgcttctggaattaactaatcacagcttcacaagaaccaaacaagcaacactgtcaaacctagggagggacttatgtttttaagagagaggctaaagtttagcccctctctcccaaacacccccttagcagcaacaccgtatcatgccatcagcaagcggtcgcaaaagtcagagcacgtgtgccgtgtgctaaaaatggaaccgtgacttcgccgcgggaccgtgggtccaaatgttgctaacaaagaggcaagtgttagaggtcaatatcgatcggccatccccttatttgtttcgatatacacatattcatactacaggataaggctcgcaagtcgcaacgaatttgtgacgtggatttgacaaaaacgcctttgctagcttctctataaaatcgattattatataggctcgaacgaagcaaaaacacggcgatgaatttgcccacgcagatcgcatggccgtgtgcccgcgtgctcctatgtgagaacaagtttaataataatatagctaactactagctccaattcatttataatcaatttagcagctcattcatataatagttatatactacactattaatacatggtcccacctgttatacacacaatacgtcttagagtctatgctaaaggtggctacaaatctgtagcccgctgtttttctctctccttatttatttttttaaaatatatttacagctggcttatagcctactattactgtaactgctctgaagataatcaaatccccaaccgcccgcaccacgcgtgtgagccgcgcggtagacggcggccagcgcggacgcgagtcgccgctgccacctccacacgggatccgccgtggccggccgcgggccgtacaggtggcgctcgctgataggtgcagtgcgatgggtcggttgttgccttttcatggaatagaccctggcttctgaaagaatggagcgtgtgccccttggctcggccagcctggaatatatggattttttttcattagctggtttattattttgtaacgtggggtactcgactctgctatatggatcgatattatggtttttgtccaaaaatgttatgggtaaggacaactagtttggtttctaattttgatccctggtcactttagtccttattgctcactttaaattgataatatttatcgttttgtataaggatatagtctgaaaaaaattaaaacgacttataatatgaaatagagagaataagtgcaatagctagcctggttgtagggacgggagggcagatgaggagcctggttgtagtactaattgtgaggagttgacaatagacatgtggtttggtttgtgagtgacttaaactcgtgaaggtaacaattccatccaatgttattccggtcaccttacttgtttgaaatgataagtcggtggaaaataaagggaagatgaaattgtatagcaaagatgctatatgtcaaaatggagtaaactttgtgaaaaataaggacaaccaaggagaagcttggttatcaaatataattataagaaattgtgagcgcattaaaaaattaaacacaagatcttaagattaaagtcacacacctcttgcaactatactatggatgtgttcgctagttccggttaggaacccatgtcccacacacagaaaacggagcggcccattagagcgtgattaattaagtattagcaaaaaatattcaaaaatagattaatttgattttttaaaacaactttcatatagaatttttttggaaaaaaacaagagaggggagttggaaacctggggaaagaacacaacctatatagtgcatctctttagactctattaaggtaaatcaacaacttccgtcaaaaattaactagttactttgtttaattgatataattctatttacagctatatattaagagtactcggcagttgaaatttaatgaagtttagtcttatattttaaaatgtatttgtataccgtatagtcagaaatatttttaaccgatcaatagtagaaatttagtcttggaaaccttatgaaatagggtgaaaacggtctgattcggtagcactttttcggaaacgatgctcgatcggctggtaattgaccatatttatcatttaaactactcaatatcgacattaatacgatgtataaagaaattagaaaaaacaaaatataaaaatagacaaaaaggtaccccttaaacggaacggcgtccggtcgatcgggaatttctgtgacagttttcaccccttgaaatatgtataccgtatatcgtaaaccgtacaagaaaaaaagaagttgctgacgacccagtgactttgtaacctgtgagacttccaagctaagcaacaaaaatacgctaggtcaacagttgtttgacaagggaggccctggtatagaacgtagataaaacttggagggggcatctacaaaatcccggcgcagcggactctatttatacgcggccccgctccttgatccccgagggtgaatcgtagcgatagcggatcagattggaggaaaactcgctagtacgcttgttacttgcaactctttctctaatcttgcttcggaaagatatccaaatcgaagaaaaagaaaaaaaaattagaaagcgtgattagccattcctcttctcatctctagccacttcgcttcagcttttcttctttcttgatcgcgagcaaaaagggagagagaaaaaaaaacggtaaaaggacgtgattagcaaggatggtggcgatcgagaaccagagccagggccagcgggcggcggaggcggcggcgcagccacggatccccagggaggcgcggcggctactgcacgagatggcggcgtcgtgggcggacgttgccgactgccgggcgctgcaggtgattccgctcaagggcgccatgaccaacgaggtgtaccaggtgcgctggctcaacggcgccccggccaccgccgacggcggcgaggtggaggcggaggcggccgcaagggagagggaggtgaggaaggtcctcgtgcggatatacggcgacggcgtggagctcttcttcgaccgcgaggacgaggtgcgcaccttcgagtgcatgtctcgccatggccaaggcccccgcctcctcggccggttcaccaacggccgcgtcgaggagttcatccacgcaagggtaggtgcacatgaatatgatatgattccgcgctgctgtagccaaactgtctagccttcctcgcgccacggattgtgttttctcctcccgttttttccctttagttttcctctgtttatcttcgactctcttgaactattaaattgggtagggatttttaggggattttggtggtaccttttgtgctttggacgaataaatctttgttgattttaccgcgttagtgaaaagttattttcctaagtttattagcaccaaaattaggcagattttggagtttgttcttgcatactgataatttttttagctgaactcgtagcaatttgggctttaacgttcttcttgatactttaaagattctacaggcactattccgacttatttattgcagtctggttatcgttttctaaaaggttctgccgtgggaatctgcaattccttagacctttcttatctatcagttcataaaatctctcttcatgccctagtcaaatatctctcctacttaacaggaattgtttatgcccacaccaattatctcccaaaattatttgcctctgtggcatgaggcgtacaatcttatttttaagggtattgtcaacagctggaatttagttttctttgcactctttcctgtattgtcagtaaaattgtgatacaaagtcaatagtcggtgaagctattaataactcgtttgaaagatttttttttctttcgtttgaattagtcagctagaattgataattgtccattcgacaacaggagatgtctctttcagagaagctgttgattgaaaacaatttattggacttgagaaaagcaagatagctgactaaactggtgtaaagtaaggactgaatggagtaaatctagaccatacatggtctatttctcttgcggaatctcttttagaaagtgaattaggctatagctgttaaattgcgagtcgaagcactttctggattcttcattttgctttaatacatgtgtcactctcataaaagggatatcttgtgttgttttcttggacgaacaaaaggaaaaaaagaacgaaatttcgtgcaatactcctactatcagatttttctcctcaagttttctggtgataatgaaatgttatcacgatggaataactgtccaacctgttacgtcagcaactcaagcatatacaaaaattaatgcaattactttctttcagacactatctgcagcagaccttcgtgatcctgaaatttcagctctggtggcgtcaaaactgagggaattccacaaccttgacatgcctggcccgaaatctgtactcatttgggaccgactgaagtaagagcattttctcagataaatatacacttggcacttttaataagtatataaaactaaacctggccgtgctttttctagaaactggctcaaaactgcaaggaacctgtgctcatctgatgaatccaagaaatttcggctgggtagcctggagaacgagattgctgcattggagaaagaattttcaggggattaccacgggattggtttttgccacaacgatcttcagtatggcaacatcatgattgatgaagacaccaacatgttgactatcatcgtgagtaatattcattcacaataatgtccctgtgatcatatttgttttttgctgcattttttttgcgtgtatctattatgtgcaaatgtgaaatgtagaagaggctattgaacgtaggttgtagaacttttaagtttcttctctcatgtgatcatctgttgaacaacaagcgatatgggatagttggaactgccgtatcattttcactagttggaatagcgccagcccttttccctttcatacaacttgttttttgtttgttgcgttcccttccccctcgacattttaaattgtcacggctctgctaaaaaacaacatagttttggttttggacactacctaccttatggaggactgatgctttgctcctttttttttcccttctgtataccaatttgtcacgactgtttcttaaggaaatctgattcctttttctttacatatatgacaagccccaattaattgttggcaatttgatcctttctgttcttctcatatatatacaggattatgaatatgccagcttcaatccagttgcgtatgacatcgctaatcatttctgcgagatggcagcagactatcattcagagaagccacatagactggactacagtaaatatccaggtacccaaaaatactaccaatgcgctgttttgcttatgttttggtacttaaatcagtttacacaatcttggtccaccttgcttatttgctattctacatgtggcagacactgatgagcagaagcgttttgtgaagacgtacctaagcaattctggtaagtgcaaattcatttctcgtttcattatctgaagatttctttggcactaccatgattatttgactgcaaccattctttttggaggaatatttctgttacaaattcgaattcagcttccattgaatactacttttttcacaataactagctaagatatgctcctaattttgtttagtaagtgaagaacctgatgcggaagaggtggagaaccttctccaaagcattgagaaatacacgctcgccagtcatctagtttggggcctctggggaataatatcggtatgttcatatttctggatgtccattgcctgtttcttttttcaaaagaactatatgaatccattctgtcactgtaaacctgtgctattatctgacctctatcttctgcaggatcatgtcaatgatattgacttcgactacaaggagtatgcaaggcagagattcgagcagtattggcagaagaagcaagcacttttaacttcatgaattgcctgaaggcgtcaggtcgtacctgaaggcctgtgctgcacataacttgtgcgatgttactgacacataactccctgtgaaaagaagaaagatgaagatgataatgaagaagaaaccctttcgggatcaggagttctcatcccgaaatttccgtaaggttcagcttcaggaggaagctgtgggctttggttgctttgtttatagtctgaaaggcagcgaagaaaaagcccctggttgcgtgtttgtttgctcgacaaactagaggccgcttgtggggctagtagtgccgtcgtgtttcatgtgtatgtatacctaaatatatgttacataatggatcttgctttcgtcgactcgagagtcgagacagtgcctccatttagtccatattgtactatgcttacatgactgccctgttgaagaaatagcctatacagctgcactgttattttggttgttgatactacctgataataatatggcgtgtaccaaagctttaacgtggccatgttcagcagttcaggtcatcttcgttgctctctggtgcagacgagctacgaggtatgagctgcctgatgttggtgatacctgacgaaaaatccgtccgaacggctgtgatggatatcagctttcgctgcctcttcctcctgactttgtttcatcggctcatcgccatttcgcctttcgtcaatctctaaccctctctcctttctccttccccacgctgggctgcgaagaggaagatcgatgacgcgtggaattccatgacgcgtcgcttgtgagcccggaacgagatctcaatacccgtttatgacggcccatataagtggaacgggattgccgctaacaagcggcccatatgtgttggctggaacacgacgtgcggcccaagtccggaggtggaatcagatggacgtggtccatgtggagaagggcaaaagttgcccagtccagttttcgctgcccgcaaggctcctggcgaggaataattctagggtgaaaagttttggtatatattatcggataggaaaaagtacgaattaccctcctgaactatcgtggtcgtccgaattaccccctgaaccataaaaccggacatttttcatccctaactatgcaaaccggacgaattaccccctcgacccaatctgcggtggttttagtttacatggcgtacgcgtggcagtacagtcagcattctatttattaaaaaaatgtgggacccatgtgtcatcctcttccactcttcctctctctctcactcttctctctctcactcgctgctcactcttcctctctatctctctctcactggtcgtcagcggccttcctgtccacctgctgctgcgcgccaccgccggccgacgccgccgagtagttgtcgtcgccgttgttcgcggcgaacgacgagtcggtgatgcgaccgcgatgccggctcggcgccgcggggccagggctgtgggagtgggagcgggctggcgtccacagcggcgtcatctcggcggtggccagcgccacggcggcggcgtcgtcgtcgttgaagaggtgccccgtgtaagtaagacgcgacacggtgacagtgcagatgaccgaatctctcagagcagcagagcagagctgcactgtgctgctagctgcttggtgcgtcgagacataggattcctttaggcattgatgatggacggcaggttggcccctgcacggtgcgacgccggcggttttcccggccacaagttcgtacgcctgcctagctttgccagccgcctcgttgggccgtggcggaggaagaagacgtgctagctcgcctacacacgccgtcgtcgtcttctttcctgacaatgggtaggagtagtatgtgcactgctgctctgctagcacgaattcttccaccgccgccgccgccgcccgcctccatccgtccccacgccgaggggcggccgttcgtcgtggccacggccgccgccgccgccgctccgcgtcccccgcctgccgctgaccggcgagaaagagagaggaagagtgtgagaaagagagtgagagagagaggagagagaggggaaaagtgagagaggagtatcacatatgggtctcatattttttttataaataaaatgctgactggactgccacgcgcaaaaccgcttggaattgaattgaggggggtaatttgtccggtattgaaagtttagagtgaacggtgtctggtttttgggtttaggggggaattcagtcgatcgcaatagttcagggggtaatttgtactttttcctatcggatataccgacacatatttaaagtattaagaccctgtttgattcagtttaagattattataatctgaattattaggaataagctgaaacaaacaagtagattgttatgatagattattataatctaataatctcctgtgaaggagcttttctcagattattgggtggctaaaaacccactaccttagatgcctccaataatccagagaaacaaacaactcgcagcttattctatgccagcttattataatccagtttagagtaatctgatttaataatctagattacaataatcttaagctgaaacaaacatggcctaaatatagactaataacaaaacaaattacagattatgcctgtaaactgtgagacgaatttattaagcccaattaatttgtcatcagcaaatgtgtactatagcactatattgtcaaataatagagcaattaggcttaaaagatttgtctcgtaatttacacttaatctgtgtaattagtttttgagtaaatttcacaaaactacaggtgttttgcacaatttatcacaaaactacatatttaagagcttgtttcacaaaactacatatttagtgtctttgtttatcacaaaactacaggtattttctacaatctatcataaaactacatatttaagaatttgtttcacaaaaatatagatttagtgtattcatttatcacagtactacacatttagtgtctttatttatcacaaaactacagatttagtgtctccattctcacaaaactacatgttttagcattgttaaaacgtgtagttttgtgagaatggagacattaaatctgtagttttgtgataaacaaagatattaaacctgtagttttgtgaaactagttcttaaatctatagttttgtgatagattatgcaaagtatctgtagttttatgaaatttactctagtttttttatctatatttaatactctatgcatgtgtccaaacattcgatgtgacagggtgaaaaagttttgcgtggaaactaaacagggccttagaacatcccctaatatggcttcttaaaatttagaaaaactctccaaatttctatttgaccggtttgctaaaactaaagaaagtaaagagtcaaatttatcgtttattccaacaacctctctttttttatataatggaatgaaacattctggcatttgctcaagagatacagccaattattacaaggttcacacaaaagtaaactcatacagtgagtatgtagccaaagtaacaaaaccaaaagtaaaagcaaactaatcaaaaaccaagcaaggtaaagaccccacaactactaaattctattggtgaatctccacccgaagttggcaaagagctacatgatgagtgggttccacgtgtcattctctttttacttctttctccctccctcatcttccttctccccacccgacccatccttcccctctgatgcctattctcaggtgctccaatgttggagagtggagatggtggcagacatggaggtgactagaaggcgaggagtcgacaacgatgatggtgatgacggagaggttgaaggggaagataaggcatgggttccaacgatgccgtcgtgacgaccactggagcttggtggactgatctagaacctcgacacagagggttaggactcggtctcaagagggcagcttgggtcaccacgacccgccctcggatccacccctggcctatcctcacgcgccgcttgctccatccttgccttcacctcatcgtcaccgccgtcgctcatagggaggagaatagacacgtagagctcacgcttagcaagccagttatgccaggccaaaacttggctagttggcaaggttatgggagagcatttttttttcagcaagctggttaaattttgggttatagagtcatttgacaactctgttagggcctcttcggattgagggatttttagaggatttccagaggaatactgtatataggaaatatttcttcacatgaatcaacccaaaggaaaatcagaggaaacattcctttcctgtggaatcaatagagaaacaaaggaaaatttacatctagtcctaccttattttttccatttcctacgtttttcctctgtctatccaaacacatgtttatctacagaattcttgtgtttttcaatcctctgttttacccatgtattcctatcatattcctatgatttttctattcctacgtttttataatcccatggttcgaataagcccttagagttgcttcataggatttggtcgcaatatttgtcatgtgccatgtgtgccgtgctgtcacgcaaggatacgtgatagcaggcgcgtgacctacgacgggccagaccaatcaatcaatcaattggagcgggccgcaggctgggacaggatgccaagtgccaacctagccacgtactccgtacgcctgatcccaccggaaggcccgcgttgtgcgttgtgcgttgtgcgttgtgcctccctttctcgtgcgccgccgggctccgttccatcacccgcggtgccaactgccaactgccgattgcggaagtggaacctggcatcggcggcaacggcacgagcgcacgaggcagccagccgcgcatccaccgatccacgggccgggggaccccgagcgtccgcccacccagcagggcaccgcaggcagccgcgaccgcgagcctcgtgtaatcgtgctggatttttcacattttggtccttttgaaaaacttatttcgcaagtagatccctagaaaaacttatcccaaaaatggtcctttttggggcgccagagtggctggcgccgtcgttcaacaggacggcgccagcctctttggcgccgtcccaccgccgacgtggcggggcgatgctgaggtggctagggggagtcccacaccacctgtttgacgctgtgccgcgcccgacccccgccctttggggtacgctcatcttcgctctctcaaggctctgctcgcaccaggagcttctcgacgccttttcatctcttcaccgcaggggcttctacgttccgccccgctgtgtgcccctcgttgttaagtccttccccatcttggacccattacctcaaggaaagcaggtgcactgtcaccccattgttcgtggtctccttggggatatcttttgtcatactgctctggtggatttctattcaaagaacggcgacatggattgtgctgtgaaggtgtttgaccagatgccggtgaaggaccccatacccatgaactgcttgatcactgggtattccaagaccggtgatgtggtgaaagccaagaagctattttatggcatggtaagaaagacatttgcattctggaattaaatgatccgctgttatgcgcattggggggaataccaggaagcttttaggctttttcctaagatgtttattaaggtgcaaggtccaatgccatcactattgcgacgaggtttttcatttgtgcgcaagacttggtgatcttcaacaagaaaattggctatgttctttataccact

SEQ ID NO: 78785 - DNA, 11044 bp, Oryza sativa
agtggaaccttgggtgatatttgggagactgtttctggcagcgacctcgtgttgctgttgatatcagacgctgcacaggtttacttcaggctctagctgcatgattttagttgccacttgatgttgttacttttaccaatgcttgtttgaattgtgctgaatttcatggttctgttgtttcatggtcctgtttattgaattgaatctcctagttttattgtgccctctacccatttaacattttctatatgttgctttctcttcttacactttgctgtggtgttctgtcggtataatttttcttttcactttctccaggcagacaactatgagaaaatcttctctcacatgaaaccaaacagtattcttggtttatcacatggatttttgcttggacatttgcaatctgctggccttgatttcccaaaaaatatcagcgtgattgctgtatgccccaagggaatgggtccatccgttcggaggttatacgtacaaggcaaagaaattaatggtgctggtatcaactctagttttgctgttcaccaggtaagttggtttcattgaaaaacatattttcaattatagattttgtaaagacattcctctgtgcttatgcactttttttgcacaggatgttgatggaagggcaactgatgttgctctaggatggtcagttgcgctgggatctcccttcacatttgctactaccttagaacaggagtacaagagcgatatctttggggagcgaggtgagcctactttcctgtttatgttgcatttggtgattgcactgtagctaatcagttagtgtccaggcattcttcttggagctgttcatggcatcgtggaggctctgtttaggagatacacagagcaaggaatggatgaagaaatggcatacaaaaacaccgtagagggcatcactggaattatctcgaaaactatctcaaagaaggtacacaattattgatagttttatcatccctctttgttgttcacttataagagtatgttttaaaaaccagggaatgcttgaagtgtacaactccttgacagaggaggggaagaaggaattcaacaaggcctacagtgcatcattctatccttgcatggacatactctatgagtgctacgaagatgttgcctctggaagtgaaatccggagtgttgtgttggctggacggagattttacgtaagttattcctgcctaaagttcaccatacttttcttcgattgtttagtctggagttctcagagagagtaatgcctgtaactatttgttaactcattggctatgcttccacaggagaaggaaggccttcctgctttccctatgggcaacatcgaccaaactcgtatgtggaaggttggtgaaaaggtgcggtcaacccgaccagaaaacgatcttggccccctgcatcccttcactgctggagtctacgttgcactgatgatggctcaggttagtcttcccataattcctcgtcaacctctcatatagtgacaaaaccaactgacaacagtatatgcttgaatcaatagcgctcaattttccaatctgttttgcaatgtttgtagatcgaggtccttagaaagaagggtcactcctactcagagatcatcaacgagagcgtcatcgagtccgtggactcactgaaccccttcatgcatgctcgtggagtggccttcatggttgacaactgctcaacgacggctcgtctgggatcaaggaaatgggcgccacgcttcgactacatcctgacccagcaagcattcgtgacagtggacaaggatgctcccatcaaccaggacctcatcagcaacttcatgtccgaccccgtccatggcgcaatcgaggtgtgcgctgagctgcggcccaccgtcgacatctccgtgcctgccaacgccgatttcgtgcgcccagagctccggcagtcatcgtagagtgagataagataatctcaagggagcttgcatcttgttacagtttgtccgagagtattgtatgtgtgtgcgtgactgtctgaacttgtgagcttgccatcaggtgacctggaactggcctgagcatctttttcccgaataaaatgaggcccggattctgaatacttagctttctcaataccatatactccacttctctggacagattcgtaataatagacaccacggtgtgtctagtcgagtactagactaggctcttttgatttatatgaaaaacatagaaattaattttaatcctataggaaaactttaatgaatttcttcgaaacaaacgattgaatcatattctatccttaaaatttctacgcaatatacaattccatagagattgcaagggaaacccattaagaaagaaaactcattaagagctttagtcattttgaaaaaaaaaggtctatatttctctcaattgatttatgcgtattttctatggcccaatcaaatggttatttttgtgtttttcacgcgtttataatttcacctacatttacattcatctcagaattctgtttttttttcttttctatcgttttctattccaacaatttaaactcctaatatattttaatacggaggtaggagtgagcagtgaaaagaacgtgtgattccgccgaaatctcgacgccgacgctcccagccggctcgctgccggccatcggtattgtcaaccacaacatctgcgagtctgcgacgccgatgcgcatgcaaacaccgcgctaaactcccaaaaccaacggcaaatccgatgaaaaaaaaaacaagaaaaacagcgcttgccctcacctacttaaaccaccccaacacattgttcacagcccacacaccaccaagatcggcgagctagttagctacatcgatcgaggccatcagctagccatggcggcggagagggagggagccgtggtggcgaagggccacgaggaggggatgaagatggcggcgtcgctgctggaggagttcggcctcccgctggggctgctgccgctgggcgacgtggtggaggtcggcttcgcgcgggccacgggctacatgtggatcgcgcagcggaggaaggtggagcaccacttcaggatggtgggcaagcacgtcagctacgacgccgacatcaccggctacgtcaagcccaggtgcatcaagaagctcaagggcgtcaaggccaaggagctcatgctctggccccccgtcaacgagatcgccgtcgacgaaccctccaccaccggcaagatccacttcaagagcctcgccggcgtcaccaagaccttccctgttgaagccttcgccgccggccagtagccatatgcatgcagcatatatacatgcttgttcatgctctacgtaatattcttactgctatgtatttcctctgtttcaggttacctttagttaaagtccaactattctaagtttgactaattttatagaaaaaagtagtaatatttttaacccaaaataaatatattatgaaaatttatttaaaatattactatctttttataaaattagttaaacttagagtagtttaaatttgaccaaagtcaaaaacatctcgtacctgaaacgaagaaagtacttattactatctcgtttttcttttttaaacgagccgcacgacacagcgcgaggtttcctcctcctactactgctgtgtatgcatgcagtcacggtacgtgatggtaagttcatggtgagagttgctgggtatgaaaaatcgtgagttgcatttgctgcgtagagtggggagagcgcatggagtttggtttggaacttgttcggtttacatggttttcatgaaaccttaaattatgctgaataaagtttttaataatcccgtgctaattaagccatatccatacatgatcaagtgatatgtagagagacggatgtacctcaaactcgtaagaataaaagaacctgtgaaaaagggtggatgcgcactcattctgtatattgaggttatggaggtcgagagattttctgaaatatagtatcagataattaactaaagcgcgccgtcaagcagtattagtactactgtggaacagttaatcaaagcaatcaggaatgttacaggtaacaacgtactgttctctttcaatgtgagaacaataattaatgttgttgtgaggaactggcttctcacaaatcacagctagccgtaattgagacttacaggtaactactactggccactgggaagagaaaataaccgccaacccgggttaattaattgaaaatggagcttatcacgtaatcaagaatgactaagctaataaccttcggttgttctttctgaatatattttttggggtttgtcgttttgattcaaagcggcaaatccagttcaccgtggcttaattacctctatgctctatcatgcacgctagtcagtcttctatgcagaattttttttttaaaaaaaagttttaacgagctccgatccatgcataatgcatggccagaaaagaagcctaaattttgttcatagtggcacagaaagtagatgaaacgatgtgttattcatagattctgacctaaatttacaaagtaaagaaaagggcagaaagattgaaagaacattagaacagctagggtagaaatgaagaggaactaagattaagtaatttactaaaaaataataattgaagaggtagcatgcaagttatgctatgcttattcatgcagcaatagcttctttattagctgctcttcttttcgctggaggagcctaccttgtgatcgccatggcgactggcctctctccctgagccaaacctctgggcactattcagctccggtgcatcgccggcgacggcgtccttgccggtgagcctctggacgacggacttgaagtcgtcggcggtgtcggcctccacgtacaccgtctcgatgatcttcacggtcaccggcttcgcttcatcctcccctgacatcgaagaagcgacacaccaaacaatcacagagagaggatgataatgggcagcttagctacagtttcttcaggatgaggagaaccgaggaagaagaagaagaagaagataattaagtagatgatgagccgtcactggcagaaattttgactgtgattttggacagaacttgaataagaggtagagagataggtaacacaaacatcgaactactcttccttctcggtgcacttaatgacttaaatatactacggtagatcatgtagtggcactgacttgtcatcctcactcgatatactataattgaatcagtcatgaaagcccataaaaaagtacagctttttcaggctaagtatgatattatatcaactcttaaattatgagaccaacgaaaaatggtgattttcatgacggccacacgtgttaggaatatgcattacgcatgcagttggcagtggtgctctctggatttttacggaggaggaagaagaggtcgaggtggtttgcattggcgtctgctctttgggccccgtagttgacaagctaccatggtcaacatacgttacatcagctttactacatgctgctgctgtttgttcttcagtcaataccgtgaccgaccaagacactgttaccgctgtttttagacctgttcaatcataatattgcagccaacagacattggctgtggttagttctttagccaaattttttttaagtatacggacacacatttaaaatattaaacgtagactaataacaaaacaaattacatattccgtatgttaactgtgagacgaatttattaagcctaattaatctattattagtaaatgtttactgtagcaccacattgtcaaatcatgacgtaattaggctcaaaagatttgtctcgcaatttacatgcaaactgtgcaattggtttttttcagccacatttaatgtcccatgcatatgtctaaatatttgatgtgacggaatttttggaagtttgaaaataacttaacaaggccattatcaactataataagctgcagaggtcgcatcgtaaatagcgaaacttcaaaaggatgtgtcctttactcagatagtagaagtaacattgcagagctggtctattcaagcggtgcagttctgcagttgtttggtggcatgatagagtttttaatgtttgtaaaagtattcaacagattagaattgaatttgaaacccaactttgcataaacttgtgtcagcatcacacctgcttgcgtaagagtttagaaaagtttctcttagatctctttacccctctgaatttagcatatgcaggacagccggaaacggccaaatatggttagacacaaccacacaacacacgactgaactagaacctacaacaaatttggacatcctggctaacacaagaacatttcaaaaagaacgacgactaacattcgtggtaacaaggtattggaactttagaagcatcctgcttacaacataacaggatgctggagcgttctttccctaaaaacgatggttctccttcctagatgctatcacactcctcgtcctacatgccttcaaactgtcaagaaaataatgctccagtgagatttgcttgcaccattatattcatccaaaaataacttttcaatattactaatatggctaccaatggttaccgatcaagaatagcaggaaaaccaaaagtaaggggaacaaatatatcatgatacagaaatggtattaaaggttgaaaagcaaaaggaaagaaaatgcatggctcaacaatgtgcaatctagaagtgattgatttttgaaaataacaagtttatacaaagtaagccagcttccatgaaaccttaaaacaaaaccaggctttatgtttggcttttcaatccatttttataccagaaccagtcaaaggctagcctgactacagccctccaacaaaatcacagacccataatgcagcagcagaaataacaggttatgaatatgtttacagcccaaacgataatcttagaaactaaaaaaaacagttaacattttcacgctgctgatgcatcagctagtggcatactggcatgaatagaagaatggtcaaaacaatgagagttttgtgcatattgatgtagcacttgcaaaaaagataatacagcaagttgtagggaaaaatatgtgaatgtgtgcttgacaataaagaaaggcagatggtagtgcaatgtttcgttttattaaaacttggcacaaggaactatatattaccgatgatccaggatctccattaagtacaacatctttctttactggcagttcagaagctcttgaaccctttgtgtcaccctagaagatcaacaagtaaattgaataaaccttcattaacaaaacttaaagattaacaagtaatacaacatgggaaatacctccgtcttcagtaccatcaagggtaatcaacggccgttgttattcatgcaagaaaggggaaaaaactatcagtgcacgtaaaaatttgtgtataatatggaaaagaaaacaaaggaaattatatcggtaaatatctttttctggaggacaatgaaacatccttttgttgtattttatatctcactagtgattgaaattaaaaatatatgctgatgaaaaaaaatcaatcttggtccaggcactaatgtcagttcagcaaaaatgttacatgtcttcagcataaatgtagttcataatctgacaattgcaagtttgcattggcgttcatcagatatgtagctttatggacataaaacaaaattacagtccatgttaacctggccactctgccagcagcacgcctacagatggaagactacggccattttgaatcggttcatgccaataagtacaaagaaaattccacctttacagtgcatgccctggacctagaaatattgggcgcttaacattcaggcagcacattcaacctttccgcaatctactgttggcaactaaatcaaccatccatcaatttggagtgaatcaacccatgtgacagaccaagtaatactaagtcaaagccttgatataagtacaatcacgaaagctctctccttttgcacgaatcatggcctcatggtatatgcacaatccaatcagtgcagagctcgtatgagcatcagtctgtgtatcaaaagcttaggcaaactgtgtgcgaatatagaagcctacgcctacctaatcgaggtgaaccagccttcacttcccacgtagtaacatatgcatcactaggcaatacaatactaggaaacactctggaagagagaggagaggaacaatacctcccggtagagcctgaggtagagcttgagaggctcgacatagtcctcgaatccgagcgtgcccattgaccagatcaggtcgtccccattgatggtcttgcgcttctccttgaggcacttgtcgcttgctctgcagggaaagatgccaaagatggccgtcagtcacccttgccatctgcacggcaggtgcacgacaaaatgcgccgccgccgctccgaactggatcggatcaagcaagctccggcaccgatatatacagcaaatacaaaggcgaggcgacactgactcgctggtgatgaagctgatgaactcggagacgcactcctggacggactccttggagtccttggcgatcttgccgttctccggcacggcccggcgcatgatgcggccgatgttggcgatcggcaggaaccggtcctgctccttccctactccgcctccgccgccgccgccgccgttctccgtcccgtcgaacccctccgacatcgctgggccatggcagaggtcggtgagaaggagagcgactaccactactgctggtgtcaagggaaagttggtggcttaccttagtttttttaggcggagatggacggagatggcggaggggatcagcgccgttggttggggaggagggagagggaggaggacgccaccggccgccggatctcgacttgtctttgtgtttgactccgctggagacgatgctgtgccttgcctttgcttagatttcttctctttttcaacttctcttcccctttttttcctcgctctccgtttctgcttctctcgttgcagtcaaaatgggccgaaagggctagatttgttggcaagtatatgggcccgatcgagtctgctcggcccatcagtaaagtagcgggctaactgcgccggtagcgtcggcgacacttgtgtacggcggcgagtcggtaagagcaagtttaatatagccaactgatggctccttatcatctatagtcaacttaatagtcaatccattacctataaacatatactacataattaatatttagtcccacctgtcatacactcacgtgtcttagagtccgtgctgcagctggctacaaatctgtagcacgcagctcttatagctggcttatagcctgctattttacatgctcttaagcaggtacaataggagagctataaacacatctcgagtagataaaaaaggagatagaagagtagcgggctatagatttgtagccagctatagcacgaactctaagatacatatgtgtatgacaagtgggaccaaatattagtagtgtaaatatatgtttataggtaactattgtataaattggctattaagttgctctaatagtatagccaactgttgactctaaatcatatatagttaacttaatagacaattcatataatagttatatataaatatatattacataattaatatttggtcacacatgtcatacacacatgcaccttagagtatgtactgcagctggctacaaatctatagcccgctatcattctctcttctcttttatcttcttgaattgtgtttatttatagcttcccattgtacatgttcttaaacttgctctaagttgacaagtaagttctcccaaaaacaagaaattaattaatcccataagtataagatatgttaaagtgttaatccttcagacctaagtacccaactctacaggatcaagcaattaagtatcataggccggcttcccaaatgatcacctgaccatacacatagtgtgtgtgtatcgtgtcgctaactgtgttttgtcctggagcaccgtatgcatgttgcatcatagatacatatagccccatgcatgtggccgaattaatgatgaataaacatgccatgagagtatatacgagacatacacatgtgcaaaactattatattactgtatctcacaggagaatacaggatgacatcaattcaggactagctctcgatcgagacacgttgcttagcagcaggtgcgtaccactcactgttctcctaaacaatgacgaggaatcactggtggagaaaccctttatagtcccggttcgtaacccccctttagtcccggtttccaaaccgggagtatcaatccgggactaaagatcgctatctttagtcccgggtgaaataaccgggactaaagatcgagctgaccttttttttttcatggccctgttgctattttataaaaccttgtttagcaaatgaactaaatttctatatattctttcttccccacacacattttctctctcatcaacttacaactaaattttggagacaaaaaagtgtgcaaaacataggtgcaaatgtagtatgacaaaaaaaaacattggaggataaagttgcaaaccttttaggcacctccgatttatatgtaatcaccaaaataaattcaatagaaattttggcatgacctcccctcttttttgaagaaattttgaagcttgctcggacagctggaggaggaaaaagacatatatatataggggtgagactttagtcccggttggtagcaccaaccggggctaaagatcaccgggatctttagccccggttggtgctaccaaccgggactaaagtctcacccctatatatatatgtctttttcctcctccagctgtccgagcaagcttcaaaatttcttcaaaaaagaggggaggtcatgccaaaatttctattgaatttattttggtgattacatataaatcggaggtgcctaaaaggtttgcaactttatcctccaatgtttttttttgtcatactacatttgcacctatgttttgcacactttttt

SEQ ID NO: 78786 - DNA, 14910 bp, Oryza sativa
tttaaattttaaaaataaattaatatgattttttaaagtaacttttctataaaatatttttgcaaaaaatacaccgtttactagtttgggaaacgtgcgcgcggaaaacgaaaccaacaaactcactcccttaccctctcaaacgctgcctaagtatgtagagtaccatcaagcgcgtgtaaaaacgtcgctttatatatacatcgcgttagttataccaactcgatcgtaaatagagtacgtgtttgtgcgctaataaaattccgtgtgggtcgcgtcatatgcatcacagtcgtcatgatatcacccgggtggccggctgccacgcagggccacgtacgcgcgcccacgcgtgagacaagctcacgcacagcgcgacacggacggccaggtgcgtgcagtggccagtggagaattaaggtcgagtttactttcaaactttttcaacaaacttttaattttttcatcacatcaaaacttttctacacatataaactttcaacttttccgtcgtatcgttttaattttaacccaaatttttaatttaaacgtgaattaaacacaccctaacacaaggagaggcacacgcaagaagagtatcgatagatgaggtgcggcggagccatgtgatcggcggtccaaggagcaacggcgcgcgcatcgtcggcctctcgtcgcgtggcgtgtcgcgtccggttccctggtcgggcggccggatgacggggcgataaatggggcgtcaccgaatccgtggggttatgtggtccgggccagaaacccggcagcataacggccgatccaacggtttaatttgttgtcagcagaagcaacggtaggcccgggggagtctgggcttgggccgttgggcgggccacatcgggtagttgcgatggggtcggtgtgtcacacacaaggttgttgctctgtgcgctgctccaactgatagtagataggagtagtcttgtttataccaggcaggtttcagtacactctagtacccactccgttccataatataaaggattttaagtttttttcttattttatttaactactcgtcttattcaaaaaatttgtgcaaatataaaaaacgaaaagttacacttaaaatactatagataataaagtaagtcaaaaaaattaaataataattccaaattttttgaataagacgagtagtcaaatggtacaaataaaaacttaaaatcgcttatgttataggacggagcgagtagtacactctctcaaccgttaaccgtttaccggttgcacccgccatcacgacgccgcccgcgccgaccaaaccggcctgttccccggtcccgcctcttgatggcgacttggcgcgcgacctcggattgaacccgcaagctacgggcacacgcaggctaatagcgtgctgcgtgcggcgtgccgaacccacgacgcgggcgttggcaactttgcaggcagaagctagctagccaaattcgtgtatgccgcagtgtcactactcactagtgtggcaggtcggttcgatcaatccacgtacgcatcgatcgccgtcacgtacgccggccacctctatgtataatctctccaccaccttatgccgccggccggagcaatgcaaaagcggctgtctactcccgccccggacgcatcctacgggtgtgttcgctaccaagggatgggaactgtgtacggtgcgcaaggaaaatagatggtccattagcacacgattaattaattatttgttaattttttttttcaaaaatgaattaattggattttttaaagcaactttcatatagaaactatttaaaaaaacaaaccatttaacaatttgaaaagcgtgcgcagaaaaaacgagggagaggagttgagaaaagtagcatccgaacacacccgtacctacacgagaacccatggggttatatggcttgctccctccgtaaaaaaacgaaaaccctcacatcccctcctggtagaatgaatctgaattacccttttgtccaaattaagtgacctagcatgcatgccatttttaagtttttttcggatagagggagtacctaacatgcactgcgtccgagacctatgtgaccgatcggaccatcgggatcaaaggctgagttttccgacaatacaccacttcctgaaccgttaaccgatactgtcttcgtattatgttgcaagtcattttttttcaaacttattaaatattgaccaagtttataaaaattaaaaacatatatgtcagggttatgaataccacatacctaatagtagttgattaaatctcggtaggacccactacataccatgtcctatacggaatcaaccttcgaatataggaggagttccggataagaaaagacaaccagagttctacatgtaaacgacaaggactacttagattgtatccatattgttttccctagttttacttgaacaaaagaacacctatgggtataaatacaagcccccctaggaagagaggggagacgaggaacacccaacacaatcgacatagaagacacaacataaaagcctacatacgccaagacacgctgccggatatcgacttcagggataagcacgactggtaccctacggtgtctccggatactgtcaggagagacgaaagcgctatctctgatctcgccgggcacggattcgaggaggaaagctaccctgttgtcgactacgagtcagatcatcagaccgccaggtcgacaacagttagataggctaccccaaatattgtactggtgtgattatcataaataagagcaataccggcttcggccaacaggatgtagggttattacctgacaattcaggggctcgaacctgtataaaaatccctgtctccatctcttttaactcagtctcgcgtatattctagtaccaacgatccccataccatgcaaataccgtagtcgagacatcaaacgtcgacattatacaacaccaaattaatttaattaagattaatattaatatattttagtagtatgcttattttgtgttaaaaatattgttatattttttataaacttggacaaacttaaatatttttattttttactaggatggaagttaaagcgagtatattttatttatatatagaatttttttaaataattaaataaatatatttttactttatattagttagtaattaattattatgtgctagtaagctatttcgttttgcgtgctgctaatatgctcttcaatatggaggttcaaacatgtcctaatttcgttacacggtggtgcgtaaccagcaagacatttgggctccgccatcaattttttactgtccttttctttggtagtaacatttacagtataaaacatcgatcattaataaacgttactatttatcttttaggtttgacgatatcgctggctccaccagataaaacaatgaaagtaacatttttctactctatcaacgcgttacacagcttgcggtaagtcggctccaaccagcaccttaattaattaatatgttaatgctggcatgatggatttggtatggttggtactcctgggtgatcgcctaatttgagccctctctcatgtgacgcaacaacatcgacgactagtcgactaggattaagatcaggtgagctgacgtacgacatgacatcctttacttaaccgacttccccctagcagaacaaatcacaacagagtttctctcaggaaacagacctgtatattccacatttgtcacaaagatgttaactgaaacctacgtactaactaaagggaacagcctaacaatttttaaacacgggattatgatcaacgaagccttttcttatacaccgcctgcgcttgcgtgtgcaaaagagatcttgccggcactacttttatcatttccatcaccacttttatgtctctatgaccatcgataaatcatgcatgatcacaaacaaaattgtggcattgctctactaatccatggatttctttttgttgttctatccaaaacaacatgatcctgtttgtaccgaccacgctagctgatgcagacattcatagacactcacccgacatgtggtcgtatcagacgtcacaggttgtgatctccaaaatgtttgctttggtcagtggcctaaagccagacaccgagcccaattaaacaaaaccaggctacttccagttcagaaacaacaacgtctagtcgcgatgcacggattattcttctcaccggcgatacgaaatggaccgtaggacgggtgacatatggaaccggagagaatcgcccacgcgtactcacggcagacagctacgcgtgagccaactgcagcgtggcatgggcgcgaggtggcgccgcgcctggcagccacatgacgccctccctggttggccggcgtgtctcatggcccggggccccctgccctgagactcctgtcttgtcccaacgtgcgtggccggatatatcgatattccatcgccgacgacgatacgtgccgtgtccagtcgcgaccgcccgtcgtcgtcgtcgcagcagagaagacactgtcgatctcacgctgacatgatgcggatcggccaggcacagcgccgaccattcgcaaatggaaatctctctgaatcgtggccagggacggacgcttgccgacagttgcgacggagacgagcagcggacgcggcggatttaagttgacgggcgacgtgggttggtgaggatggagaggagagttgatcatggtcacttccgagtcgttacaagtctttgattttgatttagcagctgaacctgatcggcattccttcctactactactacttccacgacggttctactacctaccattgccgcgttgtctgcttcaagaggctaatactagcttaattagctaccaaccctaccgctagtatagctaattgtgagcctccagaaacagacaccagcgcgagattgcgagatcgtggagatggctgcattcagggagggtcaaatttaatttggatctgaccggccaccaagccggcaggtgcagataattggatgcatatactccctccgtccaaatataagaatctaggacagttaattagatgtatagtactagaaaatatcctattcggtcctaagtttttatattttaagacggagagagtatcacactactagtatactactatgtcctaaaagaattaaaccctgagtctgaatctatatacacatttctattttaagatatgtgtctgatttaaatccaggtttaatttttttaaggacagataggtatgcttgtgctccatatacgtacacagtgcgttttggtcttgttggtagtgagtgtaaaatacgaagtgctcgtgagggaacaacggaagaacaggacgaaacggcactagtacccggagttgctataaatatagcgtcatatgctatagtcgatttttttttcagccacttacatagtagttacacctcatttacaccccacttacatatgtaattagtatgtaattttcgaatttacatatgtaattttagtacttacatatgtaattttgagacttacattgtaaatatattaaaattacatatgtaatttagtgacttacaatataaatacatgccgactattttttgataaaaaatatggcgtcataaatatagctacccctagtaccagcgtcgatctctgtaacttgggagatgattcgatcatgcgtctgtcgcgtggaccatggacaaattacgcgactattcgatcaggatcattttgcaaatcgcattgatcgcatggtcccaattaaccgactcgttcgattgcgtacaagaaatttttaaaaaccaagagacaagatcacaccaaatgatcaatctatacctaactggccaattattagcatttggctcgctatgcttgaagagaaaacagagtcgatagtgtagaggcgtcccctgtaactaccaacggtcgtggtggggcccgggagggagggagggccacgtggttgggaggggggtgggggcccaccggtgctgtcggctgtatccgcaacgtggtggggcccacgcacacccacttgccacggccagagggtggggggcccacctacctcccttctcctgccttacgtggcggctcgtagttgtgggtcccacttttttggctcctaggatccggtgcggggccctcaaaaatgcgagatttggcttggctgcctccgtccctcccacttcactgctcccacgttgctccacatgttctcatgaatgatggtgctagtgataccaccactgttacaaaatttggtcaattatttgtatatgtacacaatacattggacatgctatacactctctctgttacactgtagacatcatagtttttttttaaaaaataaaataaaatgaagctttgggataaacttaacgttgacaaaaggttgctttcctaaaaacaatgaaaaatatactactaatctgtatgagcaaaaaggtttttcgcacgatcagtgtgtccatgttcactggagattctatgaatgctactaccacactgttagtacaaaatctggtcaattatctgtatactcatcatacgacatgctgtacactctctctgttagtgcagcgcagtcttcatatgtatttatagtttcttttgtgaagctttgggatagttaaacttaatgttgccaaagattatcatcctggaaacaccgaaagatctactagtaatttgtatgaacaaaaagggttttggcacgatcgactgatgttcacatgcaggagattctatggaatgtgcttggggtgatattcctccacggcgcacgcgcgtacgtacggcagcgattgccacgataccgacgtactgtacgtgtgtagtgtgttcaattcgatcccacagcgaaaacattccggcgaagtgaagaatccgtacgtcgacgtctagctgcccacgcatcgtcgtccacttctctcgatcgagctactaatcgtaaacagtacgaaaagtatatatatggagattctttcacacgctctggccagtataggcttcaatctccagctacaaattaatacatgtctaaagcaaagtaggaataataatttagaaccatgaatcttcttatcttccctactaattactacatcctttgttttttactataagttgttttttttacattttatctaattaaacttttttaagtcgatcaaatttatagaaaaaaattagtaacatatataatattaaacggagagagcactaacattttgttacaccgtactatatgattagtggcgtccttggaaatactaacaatttttgttacaccgtactgtatggtatgatcagtggtggttcaaaattccaaggaccacccttcgttttagtgtaggagtatcccatcttttaaatctgatgaaaatattaacaaaatagatttaattttgatattatgcagttttgatgtatatgatatatagaactacccaataaaaattcatagaaccgccactgcgtatgatgcatggcagctagctggccgagctagcacacaaaaagtgcacctatcggataagccgataacgcacttgccttttgacccttttctgcaccattaaccggagtatacgtacgtacgtggtagagttaattggtctcggcatgggcgtgagaacgcattctggcacactatgggagattggagagtatagtaaaaaagctcaaaaagtacctaatgcccatatactagctactagtattcctagttgctttcgatggaagaaagaataatacgatggccgtgtcggcccaatcgacgccacatggtacaacatgcgcgagtacgcgtgtcgtcgctctcaacgtagtacgtccatttgacgcgctcgccgccggcagatcgtccacccttgctttttttccccgggccgatcgatcgatacaaccaaaaccggcaacgtatacctgctagccagccgtgcgtgtggtgtgttcgtccatatgcgtgcaaaagctcaacgatcgaacggagaaatggagcaaaaaggcgcttttttacgcccgtctttaatcggaaagaaccgcccaaattgcgacgtgcttcaacacgcttatgtactggatctatgctgttcttttttttaatgcaataatttctaatacacgttaaccacattcttctgattaaaaaatatgttattaacatttattttgttgtcgtctgtttctattattaaagttacttttaaacatgatatttttttaaaaaatctatatcttgactttgaaggcaaagtcttgttcaaaaacatggttcaaacaatgataggatagcagtgacattggtattgggaggacgcggagggtccctacttgacacataaaaaatgatataattaatcgtataatatttatctcctgttggtgaattctacccgatattagagtttggtggtatgatttttaaaatgtaccgagatatattatatttatgcttagagactgtaaaatttctcaatccggtcggttgtccggcaggaagactgaatgaatagtttggtccagagtccaacaacagtactcaacatgtgctgccttcagtgctagctcctacattactggaccagcaattacacattatatttcacataattgggtgttaacttccaaattttccccactaaccacttcatgcccctttcccccacatgatgcatcaggttgaaaaaacacagaacatgcagctctgccacctggagttctgccttggccaaaagcagctcagtatcatctgaaacaatgtgtaatttgcatcatgcatggcaggataagcagggattaatccattattaactgctactaccatgaacagctagacaagacagcgttgggtcaattaggtgggggttctgctgcggataacgtacgtgacggaaccaacaaccacccagatgatctggacgtgcgaaaggaacgtgtagctatagcttaattagtttttggataacaatttgggcacaagctggattagggataatgatggccacggcgtcattaacattagctgcccatgcttagattaatgcaacagtactctgatgaaaggtggcatacgtgttgcacaacaccttgatttgaaacggtaacctatcagttaattatgcttctgatcatcagcctgattgaatgatggatttcgatctgacggcatggctggccatgcttttcaatagttggagttggactattgacagacaagaagtattgtcagtactcacccgtactacttcctctgttcgaaaaaaaacccaacctagcttaggatgtaatataatctagtacaacaaaactctgactagattcgttgtactgattatgtcccatcccatattaggttgtttttttttggacggagagagtatataataaaggacaatacttgactgttaatccaaatactaccaaaatgcaagccaagaatttcacttgaaaaacattgttccattaaaatatagtactctctccgtcccaagatataagaggttttagggttggacacggttattaagaaagtatgtagaagtgagtaatgaagggttgtgattggatgagtagtggaggtaggtgggaaaagtgaatggtggagggttgtgattggttattaggaagagaatgttggtggaaaagttgttatattttaggacaaatactgagggctaaaaactgttatattttaggacggatggagtaaccggtaccggatactacgaatctagatatacttcatttaaattcgtaagtactagatggtgtctataagtactactatattactatattttgaaaatgaagtactcctctcaacctaaaatataacaatatagaactgaatgagacatgtctagtcctacgaatatgtacaagcttataatatgtcacatccggttctaaattattatattatggacggatcgagtataaaacaagcgcagaagttaggtagattcgttactcttcaaacaagagagttgaccacaaagatatttttgtaaaaaagtaaaatttaattatttgggtactcttcgtttcgtgcagataaggaagatcagttcaactcttccgtcattatggctcgaactcctgttgctcacataatcagctagttaaatccatctagtaggtatagttgattgcagagttagatcgtaatctgggataggctgatggcggcaagtaggtgtgcaaacctttggcgccaagtttcaaatgctaaccatcttccaataaaaaataaaataaagtgctcatcatcttgctgattattctccaagttgctagctcacctacttcgttgtcagtcgcagaggatatcttacaggcaaaaggaagcttttcacttcacaaagatcatggccgaataataatggagaccataacgtaaaagatttcactgaaaaagaagtgagaaacctgaaagacggatgtcagcaggtcgagtaacactgaagcaaattcgagttgtgaacttgctggcagagattaggatagatcgatcgattagagagattttgatcaaagaattcaaagaaagagataacacaaaccccacatctcgattacgacgttctctcaaatcgatcgacagctaattaagaccacagggttgttactattagtcggcatatgttaattagaggctggcattgcgacagctgagcctctctgaagaacacacggttcttcggattcagaaagatggatgagattacacggttcatggcgattggagatgatcatgttttcaattgttttcaattaatttctagaatcagattcgcagtaggaaacaggcctaaaagctgctgccatagcatggtggcttaaatcatcgtagacaattaggtcaaccagcgaatatgatttttagctttctgcacttgatgaaagccttgattctctggtgaaattaacgaatgatagtgagcaaagaggaatatggcatttcttgataatgcccgacagccaaaacgagagactttcacattagacctgcaggactggatggactgaacagaactgattctgaagaaaaagaaaaaaagttagccaggtcttccaatagtcaatctcgagacatggaagcttcgtactgaaatggaggcatgaatctttaccagtgccagcagctgatcttggtacagcttttatataaagaaaaagagagaacgaatttctgtcttcttcttaggctgtgtttagatccaaagtttggatccaaacttcagtcattttcagtcacatcaacctgtcatacatacaacttttcagtcacatcatcttcaattcaaccaaactctaaactttgcgctgtactaaacacagcctataaggcaaatagttatgttgatggcaggtgatgaaagtcataaaagtcttttacatgaagctcattagtacaagggcccatcggagtgcagtagtttggtggaaaccacctgaactctcccgggagtaaaaaggttctccttttgttaacaaggactttaatttgatgcagtcctgtcattttaaaaactcaacgcttctgaaaccagttcagactaatcaactacagtcccaacttgagggtagtgcgacgggtattgtggctgctggtactcccgcagcagtaacgcagaagatctgcgttcaggaaactcatgatttttttttcaggagttttatattagatcaattcctcttaaaaccttatgaaattctccccctcgaaactagcactaacgtatgaaacgtacaaatgcattgtcaatgtatattcttgttgggtgggtatccaacacataagaatttagcttgtagctactaatttaggcccccgtcgtatggctaaatacgaataagcatatgacgtattaacaaaacaataataacttatactaaaacttatatatatatatatatatatatatatatatatatattctcagcgatttaaacgtcaatgctgaaaaataaacttcaaaattaagttttgaaatttatattttggtattggctgatgcttaatagaggaaacgattagtgtattattaatttttagattagattttgtagacaatccaggccttgcttgaggaagtttcgaatcttcagttctcacaaagattatgagaatcatctctagttctcacccaaattataaaaatttataactataggacctgttcggttgtccagcgatcaccaataattacgcgcatacataaggtagcaacatgtttcaattgtagctattgtagccgatcgccgaataagggcatagaattcagaaaaaaaatatataacccaaaagctagaaaaccaaccattctaaattccaattcgttctttctcgggaccctagactcccataaatgatgattgacatgtggggccccaccactctcgggtccacctgtcagtgaccacgtcagaggatccctttcccctaaataggtcttatactgtttgagtagctgaagattttagcgatagctgttctgcaaaagaagggagaaaaaaacatacaaaatcaggtgtggtcctccctgatgctagattttcacagtgaataaattatgaatgacaagattaagagtaaattatgaatgagaagacagagagaaaggggtctctgatagtctgatttttttgtcctttctcatcaaatgagtccaaactccaaacaaaggccaaagccgcctatttaacccctctcctcctccctccaaacctcctcacacacatcccaaaaaccaaaaaccaaaaaccaaaaaccaaaacctctcctcttccctctccttctctaccctcttcttcgtcctcctccatccgagaggcagcaagccagcaactgcacgagcaaccacccgtagtcagtgacctaggcggcggagggagatcggccggcggcgagcgacgacgatgaagtacgtgctggtgacgggcggggtggtgagcggcctcgggaagggggtgacggcgagcagcatcggcgtcgtgctcaaggactgcggcctccgcgtcacctccatcaagatcggtaactcccgccgctcccgcctccgccgccgcccgtttttctctctcccccgaaacgccgccgtacttggcgggtgccgtttaattatttttttcctcggtcaaaaataggccgcagcgtaatgggtggccacgtgatcgcacagagcacgaacgccacgcatccccgtacatactagactgcacttctaaccatatactaataccgaatcatttttctttcatttggttaaactagctagctactcctcgagatcactaaactggagaaaacacagttaaaattcttgtttttttttataaaaaaattgttttaaagatgatgggctcttggatggatggatggataaagctctgatctttcttgttaacgggaatggaagtgctaacctttctgcaatctcaacagtgccatgttgcacttttagtgatcttgtttcctcacttctctttcgctgtagttcatcttttattattattattattttgggactaacaaagtcgttccctcctcctccttttgaaccaaccatttcatgtttcatttcttttgaactgtaattatactcgtcgttgctcgctgatgaggtggccatctgatactgtgtcagtgtcactgtcttggttccttgaaacagatgagtttctatattttatatgggtgtagtaatacaggtcaaatttgtcatctcgtgctatgaaaatttgtcttaactgatagctttgtctcttcatccagaggccaggtgctgcgcacctttcttgggtctagtacttaacaaactattatttttcttgtctcgtcacttgcaacctccttgactgtttgtgttcattttttaggtactaagtctgtacagtatgttagtaaattagtgaacaagtttatgaaatagttttggctttgtcatgtgatgatcgatgacccttctgatcttttacctttgttactgctttgctgcagatccttacctcaacaccgatgctggaaccatgtctccattcgagcacggtgaagtgtttgttttggacgatggtggtgaggtagcagctctgcttcaccatctcctttcggctttcacttagctatttcattatgagatagtcgcagagagtgcaccataggttacaaaatgcacgccagaaactgcactgcactgactcgagcatattctcctcatgcttggcttgaattatcatggactagcagttggtcactagcagcattccatgcacttgtcctgttgtccacttgtttgtagaaaggaggttccattgtagagtgtgtgtttttgtgataactacaaaattttctttctttgactaaactgaacttcatttcgttctctctttttgtctaaggtggacttggaccttggaaattatgagcgatttctggacatcaagttgactcgtgacaacaatataaccacgggaaagatctatcaggtaattggaataaagagtctctatctgagtgcgcacaagactttcagtatgacttgctttctagtccaaagttagtggtttatatctcacaccacagatctttttctattccgtttatacatgtggacaatatcctggttctgtagtctaaaggctggtgatagacatgtcgatattgaacctgtcatagggtagattcaccgtgagcagtttgaatgtcaagctgcagctgtttgctatcatgcaactgtcggtatttcaggaccacttgagtattatatgcttctatgagcatagataccctgctaattatacctatttttctaagagtaaatttaaacttaacaagaatttatcgtctactaattattaatatttattcttgtagggctgcaggaat

SEQ ID NO: 78787 - DNA, 60973 bp, Oryza sativa
  unsure (1)..(60973): unsure at all n locations
ctattttctgtgtgggaagataccattgtgggccaccagtttaagaggatggtctgttttgacatttttcacatggtaaaagtccattatacatccctcaactatagcctttgtctcatacccgtcccttaatcataaaaccagatacctccaactttctaaacctgtcttgtttaccctctttgagtagtttttataccggttttatcctaagtaacacccacattattaaataccaacgggataccgtagtctaggttttttgagagggctgctgcagaacgggatcctgttttgtagcagccctcttattaaaacatgtttttcatctaacatggtattacaaccaggaaaataaattaaaataacatttgagacccacatgtcaagtgtactttttctcttctcctatcgactgcttcagcttatagggacgatgtagcaagggcccctctcttcgtctcatcccatccactgagtagaggtggcaggaagcggcgagcttactggcctcttcccctcggtgcccacctcctcctcaaggccctagagtttgccggtgacgggtgcggcgctttctagcaatgtagggaagctataggcggaggaggtccatgaccacaaggctgttgtagtgcaggaaccaacctaagtagccgataatgttctcggactagaggtggtgacatcattgatcctgggctcacacccacctacctcccactagcgtcaccttctttatcacggatggcgatgccaagcgagcctcattaggctccatcacgggtggaccgtcgttagcgtcatgctccttcccgtcagcggttcttcctccttccacagtgcctccactttgactatctcccatctaccacatttgctctagccaacgtcgggggtgacacatgtagccaagggcgacgaagaggaggtctcctcgacctgtggcatcctttaccctttatcctcgcgcctcggcatccttgcgctattacagcacgaggccctcgtcggcaacatctcctcccatggtgagggagctaagcgcgtgaggattctaccgacgcaacaatctggttgtcgcaagcctcctagaccacgacgcattgggggatcggacgggacattgggggtggaagacagtggatagtgtcgacgagatatattcgcaaacggcatttgtagagtatggggatcgtcggaaccaggatgtatgtgagatcggatctacggaacacgagacaaagatttataatggtccaggctctcaagatgagtaataacttttaccctgctccaatttatatgtatatatggattgaaatatcacatggattacaaatgtggaataggacgattagacttatctgccgactaaaagttgttgagaacggtccgatgagataaattcagcgaataggacgctagcttcctttggattgcttctgggtgtggatttggctatgatttgtaactcgatgtcagggtctgttatatgtactgtagatcatcttcttctctatggcttctaaggagaccttatcttccccgactaagattctggcaccttctatttcggaaagataatttccttctttctttgtcatatttcccgtatctcccatattctggtttaaggacatataacaggacacgggtttaaggagaccttatctttcccgactaagattctggcaccttctatttcggaaagataattccttctttctttgtcatatttccttaactaaaggatactttctcttataatatcaggtatatagtattatcgtatgccacgaacatgtgtataggaggtatgccttatccttgacactgatagatgggacaactcatcaggggaggaagacgatagacgggatggcacatcggttgaggaagacggctgacgggatagcatatcggggggaggaacatgatggatggaacggagagctcgagcttgtcacctcccttgtcaccgcccctttcccttgcctccctcctctcatcctctgccgtgaaccgccttcctcactagctgccagctcgttgaccctgcttcaactccagatgggaaggcgagaaggtgtcgagtaaatcagtggtggtggtggcggcggtcgtgatcaagtgcttgtgcaggatgggagggggtggcaacagttacatcatcgtcgtgggggcatgggatactgggatgcacgcggtgacatgagggagtgaaacaagcagcgggtgcactgcggaagccaatggtgaagagtcgcaacgacatgctctcgccgggcctccccaactctaatgttgtcgtcggcgtctcctctccccaagcttccccgaatgctcgaggggttcggctagccattgccaccaccctcccgggctccactaccactggacagtgagaaaggacaaaggaggaagatggaggaagagagaatatatgaaagaggacagctaggggatggaataccattcatctgacggtatagtttatgatcttgatcgtgcacgacatgctgctcccccccccccccccttcccggaaaggacgtggcggtagtgctcatgtaatcaagtctcctatctggattagtttggttgaactgtaaggaagcgggactggttggcctaggtgggactcaggtgggctgatactaagaaaagagttttcctattggtctaaacgctgatatggactaataatagtctagtagtatctcgttaggccatatgctgatgagattaggacaattgatattccctccatttcaaaatataaggcacaaccactcttaacctaaagaccaagaaataattattatcatcttgtagtttggatcatcctaataaatataatggcatgcatccaatagaattagataacatgagagtggaggattcaaaaaagtaataatttaatagagaaaaggtcatagttaattgtatgcttgcatacatgccttatgttatggaacatctaaaaaaagtagtcgtgccttatattatggaatggaggaagtacatatcttcacaataaatattcttgttgggtcatgtgctaattaggttagaccaataaagatacacacatctatgactaattattacaaagtatggagaaatcatgtacttatcatctatgaaatcccatgatacttggtactacatagtaccgtatatgttatgaacctacaaggtaacagacctggtactccatatgtatcatatgtggtatctaggtatcatacttatatttatatccaatatctaggtatcataatttgtagatatcgtgagtatcatatatgatacttgggtaccatatttgataattagacctggtacctaggtactagatttcgtaaatatcgtgggtatcatacatggtacctgagtatcatacttgatacttagacctgatacctagggtatcatatatggtacttgggtatcatacttgatatttagacttgatacctaggtatcagatttgtagataccgtggatatcatatatggtacctgggtattagacatgatacctatatatatatatatcagatatgatacttaaaacaagataattaagaaaaagataaacataaaacaagataattgaccatggctctttcctgcaggcccagctagcatgtgagcacctcttgcgtgtgtcctacgactaatggaagaagaagtcacgttcacactcggcaagacaatgcgataaaagcccaacaagttcatcatgtgggtcgtggggagcctatcgacatcttgcatatgaggcagacaacgattcgctctcattaatcgtcccgtgacgacgggatatcgttctgtagcttttcttggaaagagagaggaaggagaggtgaggaagaagataagatgaggacgtcactaacatgtgggatcccacctgttaacttagcgagtcaaaaccacagccaacttgccacgtcagcaaaaatcactttccaaaccatcgaaggagtcaatttacacgttttcaaagatttggagacgttatacctgattttgcaattaagggaggcgatttaatcagcactaagagatgaggaagagaatacagacttatttctttcctgctcttaagttactacatgggctttaatggcccacctaatacggctgtggcaaacggtgcagcccatcaactagccacgggggacgttttactgcggttagtagctcgatgatccgggcccgcatcgttccgctaaagtgctgaacactctctgctgtgaatatctccctacccagaacaaatttgctatgaatcaccccaaaacgaaacgattcaagtaatactgtacctcgtagtccgatcttaaaattcgctactccagaaatcgctttggagaaccgcaggagaaaaagaaaaaacgtcgagaaaggttgtcagagtacgaggcttcgtacgagaccagataggatagaagtagtacaacggatggcgcgccgcggcacctttttccctctgcagccgctacgcgtgcccctgcgccgagcgttgttccccgtctgattctgaccactttggtcactccgtgctgtacctgtaccctggaatgatgaactcgtgatgttgatgcaccagcatgcatgcgcgccgaggccgatcgagcagcgagcccgcccgcacgcacacacgttactccactgttcatggcgaccgctggtcgtagtactcctagctgcaccagttggcatcgatgcacgaggccacgagccacagaaacgaggccgtgcggtcgtccgtgcagtgcacacgctggccaatggccatgccatgcgtgcgcgacgtgatctcggatggattaatctatgatctcgaatagattaatctatgatgtagtagtacacttgatcgatcgagcccctctctctagtctctctacccaggacagggccagcttgcgtccatcgaggcagcggatgcacgcacgccacccgccgcaagattccaaagccatcagttcccgcgcgtgccaagccgcatcatgcgcccgtcgcacgtgcgaggccggggctttagctgtcgcctgcctggtcgtcctcgtcagttcactgctccgtatcacggagaggcccccccgccgcggccttttcgttggttgattagcgcttatcttgtcgcacgaactgatttaatatctccccaacttgtgttccgaggcgacaagagaagacgaaacaaaaaaaactcgagcatccagtggcagatcgatcgagaaaacgtacaagtcactcgcgttgccgtgaatattcaaatatgcagcgtgatggtgttggggttcatttcagttcccgtcctggctgtccggctccgctgctggtggttgctcgatttgaccgggcagattaaggttcggatcgaggtggcgttgcatgtgcggatgatgatttgttaaggtgggcaatagctcctaccagactccctgtactgtacgtgagtacgttactaatcctgctacatcccggaagctgcggaccagcttcggttcctgtcaattgcatgccccgatcgatcgcgatgcacgtacgggctcggatcgtaccccgtcgcgtttaagttaataatcgacacacgtgcaccagcattaatatgtcatcactaactccaacgacgtgctccacgtacgtacagactcctaaaccgggtactgtagctggcatccgccgttcgattttgctcgtcgtattcgtgtgccagactgccagggcacatattcatgttccaaaaactgatcgatgtgtgtacgagcgcgctcacgcgaacgtgtagccggctagccgctcgtgcgcacgcggcctgcgtgcaccggtcgttttcagttgtgcgcaagcgcacacgcacgcgcgcacggacgtgtcgcgcaccaaccgcgtcgccttttttgccctccccggctttccctccctcccgttttcgtcgtttcatgtcgacgtcgccttaatttgaggcgtatgggcgtatggctaccgctgagatcgacgtgcgcgttcgccggccgtcgctgcccacgagacgttcgtacgagaaatggaccgccacagcgcctgttctactttacccgttcccaaatttttggacgaaatgcagcggtggtgtcacggaaagccccaaaggataatgttaaacagatcgccgttaccgatcgcagcttatagtagagatctgatcccagcgcgtgtagttcatgcatcacgctgcacagctgggcgagctggcaacagactagtagtagtcctcgactcctgaccacacctaacgaagcgacctgttgtccggttgagaccggagagacgggcagagggtgtgaaggacaggtcatgtgatggtgaggaccgaagaggagcttgaggtgtgtcgcccggtggatcgaggcggtcggtagtcggtacggtacctagctgggctgagtattcgtctcatcttgggctttctggcctgtatcagtaggaccgcaggagtatactagtactagtacgtacgtacacaatatactagtaccactgtactacgtacggcacatggcatgttccccacttgccctgttcgttcatgggaatcggatgagcaactttaatacaactgcaagtcagtcttaaacaaatactgcaagtctactactgtcggccggagtagcttaatactggagtactccactatttacgccgtgtttagttctaaaataattcatcaaaatttcaacttttccatcacatcaaaactttcctacataaacaaactttcaactttttttatcacaccatttcaatttcaaccaaatttttaattttggtgtgaattagacacagtccgtgtcgaagtagtacttattacagtactgatctacagcattattgttgtagcaggcacctgcagatgcagccttcctgatgccgccctgatgacggatcgtcgtttggagaagggggattggaactgatcatcacaaagaaatacggagtagagtaactgcgatatgtagtgcagtctcctaacctcgagttcttttgagcagtctgaacaagacagataacatatgaccgtgttccagagtgcatcggtaatttgtgaaagttttcagaaaacagagaactctatacatactaaaaacacacaaagcctgttgataataagcacgtgaccatcagtgcctgttgctagattaattctatttacatgtgtatccatcagtgcttcacactacagatcaaattggcaagtcgatcgatgccactcacggcgcctagctcggcgcacacttgcacaggcaatagattcacccatcagccatatcagtccatcgcgcagcggcaagttgggcctctttcttgcctgcctcgtaccgtcgcgagagggacaactaaccacacgagcgcgcgcgcacgagcaaaagagagcacaggagataagcacgtagtagctaccagctagcgactgccatcccattgaaaggggccgagatcgatgcgtgcagcatccaaagcatatatgcatgcatccacctgattattcgtcttatcaacacacacatacgaaagataaatcaattaatcatgaacaggaacgcacgaacgtccatgatcgatcacgagctgatcaaaaatcatccatcactcagtagcccggttgcattcagtcgacactgatgatcgatgatccatgggcgcacgggtcgctcgccgcggtacgaacgtgtacgcgcgtgtggcagaagggtgtcgcgggtgagccgtgatatgaccgcgcgcgcgcacatgccccacgtcgaccgataaggggcggcgccggccacaccgcggcgcgacggagaccgctgcgtggcgatatggaggcagcggcgctttcccgctggggccgagtgcctctctcgtccaaccgcggtctcgatcgacggcgacgtacgcttgtagatggctccgtcggtccgtcccaacaatgcaccaccgtgatgaaatcaacttctttgccgttcataaagttcgtattctaccgtaccgtacaccatcgggattttacactacgccagctcaggttatcagtgatgggttcaaatcgtcacttttgatggatttgacccttgtcagatattagtggttaacgatgactcctctcaccttttacgagtggagactcttacgtggtgaccataatatgtgacgggccacaaaatttcacctgttacacaggagattgttctctaacgggcaatatattatcacccctgtcactgagctacttaatgggggcaaaaagagattcaattcacatgttagcacagtgtcactgatatatattaaccgtgagaaatggttaattcttgttcatcgttgtcatattaacacaatgtcaagaaaaactacaaacctatagctgattgattgagatcctatcgatattggctggccttgctacatcgcatcagcctgttgaccaatcggctccttgatcttatatgatctatctatttatcttgttagttgcaggatcaaactaattagcacaccgtaaacccgattgataggaccagcattggaactaattaaatagtcctcctaggccttcgtgtgtgacgaatttcacgtaacaaccaacgcaagctcgagccaccattaggtcatgactagtcagatccggcgtctcccgacctcggggatactcgtgggcgacgacggcggtggcttggggattgaagttgcagcgacagacagtgctcagggatgcaggaggtgggtgcttggggacgaaggcaaagcccacgacggcgagtgctttggactcggcggctggtgcactcgatgagggtgaggaggtgtgagagagagagattgtggcctctggtctcaagttgttggtgggggatagaaaagaagagagagagagagatgagagattgtggcctctggtctcaagttgttgatgggggatagaaaagaatatggttcctctggttttgtgtgatgggacttatctttgatgggtgcatattctgtacccgtcacagatgaagagtcgcctctaacgggtctatgtttgaatctgttaaatgtgagttgtgccgagtatgtacaagaggcatgtcacagatgtctacgtgtgatgagccatgtctcatagccttatttacaacggaatttatttggatccgttagagataaaggtcgtttgggacgagacattttggacggtaagatatagatcatcagtgatgtgctattctgttgtagtgttattcagaactgtcagtttgattatattggactgatgtggaccaacgcttcaaagtgatttctattgctccagctagcataagagtagtactacactatccctctgtctcataatataagggattttaagtttttacttgcactgtttgatcactcgttttattaaaaaaaatcgtacaaatataaaaaacgaaaagttgtgcttaaagtactttggataataaagtaagtcaaaaaaaaataaataataattataattttttttaataagacgagtgatcaaacagtgcaaacaaaaactcaaaatctcttatattatagaacggagggagtatatattagtgcacaacttgaataaattagccacttaattaagcccggcccatgcctccccctcatttccataccatcgccggttctctttctagcgggcatggaataatatattgagatagcaatatagtaggacctaattatagcgttatgatagcgaaaagttccgattgcaccgaagggaaaggaaaaggtagagatttggtgcataaatattgcctgttgtcttcatgctcccatccttagcccatgtttatttgtctcatccactccacttacaaaaaaggagggctagctaatgaaatgatacgattaaaaatgatttctcgaaaagaaggagcggctatacttaaaaaatttcttgagggccactaactaatcatacgcatcgatcattatagcgggccagaatagctttttaagtacatgcatgcatgatccacggatcaattggatatttctggtcagacgcacagtattatattttgttggatcctttcagtactggcttttctcaaactaacactgcacggaaagacaatgctactaccgaacggagaaatcgttgaagatgaatgcatcgaatatccgacgaacggcgccgggtttgccacaagcagagaaatcaattatgaaagagctagtagtactccccaatttcttttcgtcaaaaaagaaaataataaatctgcacacgtgtgtgtaagagctactcgtcgcttaacagcggatgatctttcatgacttgatagatggttgttgttaatttgttgactgtgcattgtgctagcatgattggaatgttcaagatgaacctagctaacttgataaataaatggtggccactaacagtacatgaaggtgaaatgagaacgatgcaccataatttttccccgaaaaatgttccttttcttttcacgaagatatgcaatcgtttgtgcacaatactagtactactagcactatttacctgcccggatactgcgtcactcaccatgcggcataccagtttttggacggaacggcgttgcctgccgcgcgagcgtggcgtggcgccggggtccccatggcgagttggcttggcccggccgcacggggggagcattaaacccccgttggcctcttccgccccgaaatcccgttgcccccgacggaaatccggcaaggtagagcccgcggagtgcgaccgtgacggcgaccgcgaccacgtgacccaacctcccctgccccccctagcgaagaggccgagcaaaaatcagcaaacggccggaccacgcgccgctctcacgcaccccgtgggcagtggcggatgcgtacgacgcgcggcgacgggctcgggctagctagtgggctagcggctcgatcgattggtttacagttttagcccgcgcagcacacggcgcgcgcggcggtcggtggagcgagcgcgacagcgcggtgcgggtgcgtgtgcgtgtgcgtgtgcgagttggggtgggtgggtgggtggtggtggcccgccaggcatgcccgcacggttgggtttgatgccaacgtcgcaccgttcagttgatgtgtgattcttgcctctctgttttcctttttctttcttcttctctcggtttgctggttgatttatggggggtgtttggttcgttcttcatcgtttccttgtgtactgtttccttgaccagaacctcgcttgcttgcagttgcagactcggacaaagctaaaagatcctcgtacttgttggtgttatactactacaaaggaggccactcctgccgactgtgtccaaaacagtacacaagtagctgtgactgcctgtgagggggttcaaatcccgtcatcatctctacctattactttcttcaagtacagtatgttttaagaaaaattaccacttgattaatttggtaatcagagcagccagcttgtgaaattgtgcttctcccatggtggccgggctaaactagtagagcttattttctgtagaatacctcctgatgatgtaaccagaaattatctatcaataaagatgggttaagcatgatttcgcacaggattgaccctctccaaccaaaacccaaccaaatccagggagtcatccaaaaaatatttaagagcaaagctaaccacacaagcagatactgcaacaagtggcctttttttgccggttgcaacaagtggttttcataagttttttttagataaagtggctttcggaagtaaatgtgaggcaatgaggcagtccagattcaaagcaaccctatcaagatcgaagctcaagtccagatgtcttaaattaggcagccgtacgataggagaaaaactggaggtagcagctctccagctggctggctaagagctggaactccatactccatccgtcaaaaaaaaaaaaaaaagacaacttctgggaatgaacctggacaagcatttatctagattcatcctcagaagttagttttttgtgggacggagggtgactttgcgagctgaatcagctgctaaaaaaatggctttgtgattggttttcctccactccttgaagccacactaaacaccagctgtgtaataaagggtgcgtgcctcctgtcacaccagggtccaattttgtcaaaagatttttctttaggccaggaggaggagattagtatggtactagaagcgatctctcgctaatctgtcaaggttcgataggctctttcaataaagggggactagtatgttgaccaggatacgtaatactactagattttagcaaagcatgtgaatgggggtctagttgggattagttattagcttatggatgatctgttagtagtaaagaattcagagttctcgagctgaatggttcagaaaagttggttgatcaattgctacgttacatataatcgggtgggtactccatagtataattaaaccatcaagttgaggaaccttaattggatcaaggaaaagggggttaattaagatctgaccgatcagcttcttaggcttttccgagttatcagtgagttggtgcaggtgttatatgtcagaaaattctgtcatcattggttatttatttatatctgcttctattggctcgagcacgctgtcatcggctgttctttatagctgctttaatttgttagctcaagcacgaatcttcactacgtcatattggacccgtccagttgtagggtcccttttaaattatagggttgaaaaaaatagagaaatagaaaaaacacatgattctgatagggattgaagggtaaaacagagaaatacaaaacacagaaaaaacactggaatggtcgtttgattggagcgcatgaaaaatacaggaatcggatgagagagatagactcaaaggaaatttttcaagaggttggagctcttgatatatttcctctaaaatccacatgcaatgtgccattccataggaatttcataggatttagaaagcttcaatcctttgaatcaaagggccaaataggaaaatttcctataggatttgaataatatgaaattcctgcataaatcctttgattgggcccctttgaatcgcaggaatggaaaaacggaggaataggaaaaacgcaggattctgacaggaatgcatgtgtaaaacagaggattggaaaatacaggaaaaacacaggaatgaccgtttgattggaccatataaaaaacgaaggaatcggatgagagagatatactcaaaggaatttttccaaaaggttggacctcttgctaactttcctctaaaatctctctataggattacccattccataggaattttaaaggatactataggattcaatcctttgtttcaaagggtttcatagaaaattttttcataggattaaaatccttcaaatttcctacacttttcctacaaatcaaaagggaccctaagtttcgtgcttaatggatctacatccagtacgtatacgcaggtcctcaatcatacggtccaagtcaatagaacaaaagaaaaatatcgcaccagctgccggtacgtacgcaggtatatgattggggtacatcttgcacgatcatgcatatgccccatgatagacacttgtatgtgacagagaattttagtagtattactccagcagcaggcagtactagtcagcaagcagctgcctgggcatcgatctgcagcaagccaacgaaccgtagccgcgcagacgtcgatccgtcacgcaatggcactatggcaggtatgggccgtatggcgccatggcaatggcatattggggtagcatgcagcgatacatggcaggtggtggtgactctctcgctgggacctagctagcgagtgtgcgtgtgtgcgcgcgcgcctgtggttggtgagagcgacaggtacgtgcatgcgcgcgcgacgcaaccaccggccgggccacgcgtacataaaagcagggggccagccgcgggcaactaaccgatcgaggaggcgcccggcctccgagcctcggacggcgaccgtgcggggcggccacggcgcagcgaggggacacgcggggccaccccggcctgccggccgaacgcgacggacgaatcgatcgatcgatcgatcgatcgcccgcgcgcccgcgatcgaaagctacggcggtgacggccaccggacgagccacggccacgcgcacgctcgtgctgactgcggaccgcgcgcccgggttgcaaacggcacaggaatcccttgttgcaaccgacgaaccgagctaagacaaaaacaccttgcattggaacttggaagtaatctttgtaggcacccttgacagagttttacgcagtagtcggtatacaccgtagtagtaacttttttgcgggtagtgtcttgagatctgcaatcatgtccaaatctattggaaaggggagagcaaggaggagtaataaaagacaaaagaccggtaacacctgaagtgtcttcgcacaagtagcggcatcaaaaagaagaatgtatggtgatgccatgattgcagggggcctaaagacggaatggccatcgcacgttgttggtgggtagtagtagaagctttaatctaagctaagttcacaactatgggtctatctggtagaggctcaactcctaaatttagtttcagaagataagtttgtagtggagttatgaagctgcctaaacccaacttcacctatctagctagttcgttttgtgagagagtttcacccagctctactcctatttcagatgaaactgaaactatttggataattgaaagatagaaaaaacatcatcctatattcacgaagcaattgcgggcatagaaaattttcattgggtgatttaatctgagcttgcaaataaaaaagacgtgtttctaatctcactctcttttctttctattaaaataacgatgcacacgtgcacacccataaatatgtctcttaacatatgctaaaaagagacggagactaaaaacatattcgtcaccccactaaactcctattgaaagtgcactcatgtctaggtaatatttcaagtctaatgaataagtcacgtacctgcgacacttcaccatcagtagtggtgaaaaaaaaaaactcaactagtggctgggatcgacttatatcatgcttagttcagatcagctctaacttgtagtcataacaagttgaatcaagctaggcttttagcacgtgaacggcttgttagtataaaatagggtaaattggctataaaatatcaccatatgttcatattcttagtgcatattaactagcatttagtcgtttaattacatgttaactatatttaggaaaatctttagtaattagtgtttattattatgtcaatacctactaaaattgtaaatttaaaattacaattcataaccactggaaaaccaaatacaatatcataaacgttgctcaacagagagctacttgaagatctaatgagataaattattgttgggattattctcatggcaatcaataacccagtgaagctgaaaagaacatggattcatcgcaacagtatttttcattgtatatcctcttctaaagaaactgtattgcactttaaaaagaaaaaagacatggtactgtattggcatagtctttacagttttttttttctttttgcaagacgatgcatgcccggcgtacacggcactaatatattatatactaaaagtccattaaactccctacaaacgctcctaagccgtcacatggtgtttctacaaacactcctaaaccgccacgtggcactatctaatctcaccgttgattttctcttaagttggtgcacccgttaatttagaccattagattagatctattattaaaaaggtgatagtttttcctaaaaaaaatatgcaactggtggctaggaaaaggaaagaaaactaaatttccatacgcaagtataattgagaaaaaaaaacaaataaagcttcctactgttaggcggaagaaaaagaaataaacatctaagtacgataaaaaatgataaagccaaaaaaaagtgtagttagtaccggtggaaaaaacgaaggtctaatgtacgattttgtataatataaaatataatattacataatatacagaagtacatgcatgtaatctagatctataatataaatatcaaatatcaaatatcaaatcaacggtctctaaacattatcttttaatttatttttaattgtatgcccaatttatgatccattgtattcgtttaattatataaagtaatgatgtataaaagtaatattatgatcttaaatacatcatgacacgttgggtcgacatacaataggtaactttagacactaaaaatctattaaatttcctacaaacgcttctaaatagccatttggcgcttctacgaacggttctacgccaccatgtggtgctctaataaattagagaaaaccttacaaattgtgagaaaaaaatcatgcaatcatttttattggttgacctactattttaaaatattagattatatttatttaaaatacatctaacctgctcaaataataaaaatcacgtgaatagttgtacgtatatatacatacttccgtactttgctagcttaaaaaaaggaaaaaatgtaattacgattgaaaaaagaaggattagccctgccacggtcccacctaattgttacgagttacacgtacataggtacctttcatccaaaaaagtgaaaaaaaaatctcaaatgtacaatgcatactactattcaccagattgagaaaaaaattctcccggatatgtacaaaccctgtcatcggctttcacttaaatcatttagaaaaattagaaaaataaaatctccacctcctcctcactctcacatctacgcaacactgtcgtcccctccctattgttttatctattaaattaaaagagaaacaataaataaagtttgatatttttttaatacatagtagaaacgtgggcactcacaacgcgcgtacactcatatctatgaacgcgcacatgcacatactcctatgagtacttccgagagattaggctgatatatattgagattgacaaagtcactatgtatgtctcgctgtcgacgggtacgtcacctactactgaaagaatttgtcaagtctgggatatgaacccgagtgggtaaattccatcacaacgaacctaaccagttgagctacattcacttcacaataatattggatattaaaccgaccataatttgtaagctacatttctagaatacttatatgccttttaaaccagtggaaacattatttctaacagttatatctatcttgtataagaaaaaccagatgtgtatacatggtacatcacatttcaaaaatattattgtgcaattatatttcgatttcacattagcttgcatggaacttctgacccactctacatgaaatgttcatacatggatcatggatcggctctcaaattatatcaatcatattagcctatataaacccatatatttaatggagcatcatgtcccacccaattaatccttgaataaaccatgataatatatatgcaattgaaaatgaaaaatagcttagttttactttacacttacttttcgttgacatgttttctaaagaaaataagtctactttcttttcaagtgatgaagaagattataaataatttcttatagatattacttaaatatgatataatataaaactaataggttagaaaattataaaataaattaatgtcgacgaaaacaatttatggacaaatcgtggtagatgttcaccggttaatattttgctcttatgagtgtctcaaacttagcatgtgacacatgcccgcgcattcgcgcaggctaccttcctagttataacgaaatgtcgtatggccgtaaggtgcgtattttgttaacaatgtataagagatcaagaaaaatatgagagaaacgtatgtgccaaatattgataacgtataaccattcacacatactctctcctgtttaaaataactcaatttaagaatataatatgatatattctattataataaatttggataaaatgcatgattaagttattttgtgatagagaaaatacgtcggaatatatattaacactatacaaccattttgtcaattgaccacgtttgtaccggtgaaatgggatcaactttttgctggtgatgggcaacagtagccattcaagaaagctgcaactttactgctccacattcatgggcagggcgcattcatggtgcgtggtaaaatgcctcacaaatatgaatgcacgaacaaccgaaccacttaggtcgtgtgtagttgttttggtaaaaaaaaaaaattaacgtacagggacacacatttgaagttacatatttcgtctgtaaactgcgaaatgaatctattaaacctaattaatctatcattagcaaatatttactgtagcaccacattgttaaattattatgtaattaggctcaaaagatttgtctcgcaatttgcatataaactatacaatttattttcttttccaaatatatggtgtgatcgaaaagttggaagtttgaaaggaaactaaacacacagccttagtcgcatgtaatgtcacctagagagagagagacccccgggggggacgctgttatcagtgcagaaagtcagcaatgcaacctgcgcttttgttttgctagattttcacatactcctggccgatgatactactgctagatcgctcagccggtcactcgtccagctacccagtcactgtgccatgataactctgtccctggatgccctacatgtcctctcccaacagataagggtggaagcattaggccaagcacagccatcctggggcccagacttgatgccctccttttgaacacaagcacaaattgagaaatacaaatggtgatacacaaccatacacgcatcgcgccgacaacaatgctagattgctaggtactcctacacttcgaaacaattaaagtgccatgcatgctgatgcacgacaaatctttaagcatagttctaaacgcagtgcaaaaataggccgaggaacatggcgcattttggggctcctaggaattaaataattcagcaaaaataagtgaccacacagtattggtttgttgttgtttacgtgtagaaatgctaccaatttgttcgcgtcagaagtgcattccccacatctaaccaatttcaagcattaccatccaattcatagtatagtgctataatctagtctttttggtctttcaaaattcggtcctttaaattggaagaccgaacttgtcaatggaagtatttaaactggccatttggttaaccgatagttttggtctaaccaaacattcatcttccttgtaggattgtaggtgagcaagccgcacacttgcagatgacttagacgcaaatgtggtacttgcctttaacataggcttccggctctcccccaaggagatggttgccatcgaccatcgtgcactgtcttttttggtgatgctcgaggacgtgaagtgcacaaaagaggagacatcctcgctagctatggtgcgtggagtggagaggctcaacggctgtcaccgttactccttaggtgttggtgcggttgtggtggctcgttaccaccaaacacccggtaaacatattgttctccaagtctggtttatctcagatctgatctgaaacatgtgacctcgatgttcaacaaatcacaatctccttgtcatcccctaccttgttattcctccaaacctcaccaccaaacactaacaagagaagagattgttctccccttcctccctctctatgtaccactttatttctagcaccttgccgttgaggcagcggtggccaatgagggacaaaagccatggagacattctagccagagaggtccactcaagaagttctgaggtgaggagaggggagaggagcgccaagataacatacgaggcgtcaagtgctatcgtggatgaggaagtggaagggatatattgatgaatgaggaggggattaggataaggcttgaatagatcggtaattcaagtatccgatgcaataaactaatcaaataattggtcctgtaaacatgagacctagaccgagttagggaccaatgatcgatactatgttttttcaggtttggtctcgggttttcagttttgatttttgtctcaatttttacccatccctagatatagttcgccatcgtcatcacctattaatgtcccttatatagcgtgtttccgttaaaattcttcctgctagatatgttttgccttttctttttcagttttgcgttttacctccccatctcatcacctccattgcatggaacttccttgctatggcgtgtcattgtcactctccacacttctgttatcttcgccaatttaaatttcacttgatctcttgtattacgtccaacactgtattttttttctttagaattgcattattttgatatcgttttagtttgtgacattgtcataagaacaatatcaaacgcatctgttactgctgccaccaataccacggtttcttttttccttaccatttatagggcgaatgaatgattttttcttgccttcacttcctttatttgccaccaagcctgctgaagttgcacctcatgttctcttctatcctatgttgtgttacattaaaatcaatggccaaaagcttatattggtactggcgtggatggtctttctaagattgtcttaaatgtgtatgaatgataaatgtgtatgaatgtaggcccgcattgctaacataattcaagagtagcatgtaggcccacattgtaagagtaatttattctagactaaaatagtgtgttatatatagttatttttaaaaaagaaagtctcttaactactatctccttcgtttcatattataaaactttctagcattgtccacattcatatatatatatatatattaataaatttaaacatatatatgtgtctagattcattaaaatctatatgaatgcgggcaatgctagaacgtcttataatatgaaacggagggaatatgtactagctacttgaaagttgaaattcctaacaactttgacatagtgatagttttgatcgaaagaagtaattcaaaaaatccattgtgctacagtaaaccaacagaagtcatcctaatcctctgtgggagcatttccaagtatcaaatggtccgtagattcgtataatcgtatttcagttgattctacacgaagagcgtgtccaattacttttaacgactcagaagttgtaacccatcaagccacatggtggtacagatgcaactattccaaggggggataatgatagcactgggcgagcaaaatttaagccagagcgctaacgctatgcggacaggcagagggcccactcccttgtggtgatgtcagagactccattctgaggcacagtttgtcaatgtcaccatggctcctgtagcttttccaggctttgtgtttgtgttggatgtgtatgtgttccactatagttgcacccaggggacagactccatggggactttttttgagctcctcgaagcctcaaaggtaaaaaaaaactgaagaaaaagaaaaactcatttggcctagagaaaacgacctgtctagactgtggagattggagaagctacttgtggagatataaagaccaaaaccagaatgcctttcagcaagttcatgaatttttacccaatgtgactagctctgctctgcactaaattctctcacagtaaaaggaatgggcaaaccaagacaaggagcacactgcaagctcaaatcctgaacttgaaagcaaccatacgtttgaacaaccatcttgaaatctgggggaatctgcatgcatgccagtgtgccgctcactttgcggacacacacatcattagtttgacaacgcccaagcatcggacacagcaccatgcaagtataatagtgagggtggttattataagattgggagccatgttacctaggcgattaggataatcagagaggacaaaaaatgcttaggggaacctttgaccaactaaaggctaagctaagcccctcttatgaaatgatttgaagacaaagcaagctagccccccgaaattaaagaaaggtgcttgtgctgcgtgagtgcgtcttcttgcgtgggtgtgtcactggctcactgcacctgaccccacgcaagcaaagccatgctctacctcacatggaaacaggagctgtgtcagcctcttgactggccatttgctgttcaacctgtcatgtttctctctcccacaccaccaccctcctccaccaccccctccagtggtgcttcttctcagattcggatgccatttacttgcaatgaccaccctgcaataatatccatctgcaataaatattcattgcatgtttgatgaactcatgcacatttaaaccattgtcaagagacaagagaaggggaaaaaatgacgaggagcaacctaggcggattttgattttgcgccaaagaaaattcaacatttatatatgtacatacacagctcttactgcgacgcgacgggaaaaacaaacagggagacgaagaaagctgcgaaaaaagaaagaagaaaagatctactcctataggtacataacaacttcgactgatcaacctacagctggaaaattcttatcttgtagcaccatcagaagcgattgctaagcttgtgtggagagttcaaaatggcatccatctgattctgaatgactgttgtttctacgggcatttcgccgccgactggcctcgttggtggccactcaccgccggctgtttctcctgtgtgtcggtggttgttgtttctaatccttctcctccttggcttccctgaggggcatgtcaaggaccccatagcctccctcatcgatcgagcccgctgccgccgacgaggtcttcgagtcgaccgtcgacccagcttggatctccttgaacattgccatcaccttcagcatcgtcggccgcctcgacggccggtcatccaagcacgcacaggcgattttcaaatgctccagcagctcaagctcgacggatggatcctccttgagtagctcagggtcgaagacatccgtgatcttcaatttggtgtgctgcttgacccaccccacaaggttattgtcctcgccaaagtctgccgagtccgtcggcggtttcccggtgagcagctccagcaacacaacaccatagctataaacatcacccttggtggtgcatctgaagctctggtagtactccggtggtacataccctggcgttccagcaagagtggacacgctaaggtgtgtatccaccacgctcatcagcctcgccataccgaaatcagatacccttgcttccagttgttcatcgataagcacattgctcgacttcatgtctcggtgaatgatgtgaggaatgcaattgtggtggaggaatgccaaaccccttgctgctccaacagcgattttccgtcttgcctcccaattcagctttttaccgatctttttgcggtcatgcaacacatcctccaagctgccaaacttcatgtaatcatacaccaacaaccgctcctcaccagccttgcaatagccaagaagtggaacaaggttacggtgtttgatcttgccaatggtctccatttctgcagtgaactcccggtcaccctgcccgctcacatgtattagcttcttgattgcaacaaccttcccatccttgagctgtgccttgtagacatcaccaaacccaccagacccaatttggcatgcgatgtggaagccatttgtggcctcaacaagatcagccagggtgagattctgcaatggcttctcgaatgcagccaggttgatgctaagaagatttgtaccggagagattttgcctccaatcagaattcatagttgcagaatgtgacctgctatcaatatatatatcacgagaggtactcgcctcctcattcttcagcctccgccgcttgctcccaatggctatgatgatcacaattatacagaacagtgagaataacagtcccatagcgatactgcttgccatcgatgcctgcctccggtgggattggtggtcattggaagatcttggggaactatggtcacatggtggcagtgggaagccacataaaccagtgttattctcatactggctcttcggaaatgtggcaagggaaccaagctctggaattgttccattcagctgattatttgacagattgatctccgacaaggaaagtgccgagaaagagttgggtattggcccttccaactggttatacgacaggtcaagcaccgcaagcttcttggcctctgctagccgcgatgggatggtacctgacagtaggttgtgcccaagattcatgatcatgaggtagaacatgtcccccagctcgccaggaatcgccgagtccagctgattatatgacaaatcgagaaatatcatcgaaccattcttgttgaaggtgtactccgtgctccccacatacattcttgtgaagttgcacagcttcttgctcggcatccgactgaggtcatcaggtcggatgctggtaaactccagcaagctccccttgccacggcactcgctgctcagctcgtcgttgcgaagataaacgtaaggccgtccaactatgaggccaacattcatcttcccagactgtttggccagctctttgggtattgatccattcagctgattgctattcaggtccagccacaccaagctctggcagtcaccgagctctggcggtataggccccgagaaggaattgttgctgagcttcaagatagccaagtagctgagcttcccaagccatgaagggattggcccggacagccggttgctcgccaaagaaatccagttcagcttggtgcacttggctagctccggcgggatgctacccgtgagcccgttgtagtcgaggatgagatgctcgaggccctgaatgcgcgacagggacgccggtatctcgccctccagctcgttctgccacaggatgaggtcctgcaggttgccaaggtcgccgagggatgccgggatggacccattgatgtagttgaggctgaggtcgagggagacgaggctggtgcagttggagacggcgtctgggatgccgccggtgaggtagttgttctgaaggtacagcagatggagcttggagttgggatcttggcagagggacgacgggatggtgccggagaaggtgttggagctgaggtcgagctgctggagctccggcagcgaggctacggtgtccgggatggagccgttgaagtggttgaaggagagggagagcgccgtaagctgctgcagctttgcgaaagcctcgccggggagctcgccggagaagttgttgttggagaggttgagggcgttgagcgacgtgaggccggcgatgtccggagggaacacgccggcgaggtggttgaaggagaggttgagcactttcagaccgcggcagtcggaaagtgccccgccgggcacctcaccgacgatgaggttgccggagaggtcaaggtactgaagcccggagcagttggtgaactccgggacaccggagatcctgttcagggcaaggtccaaccaccgtactgccccgactccggcatccaccatccaccggaggtcgctatcgtcggtgatcttgttgttggacaaatcaagcgagtccagcccggcaaagcccgggccaccaccgccaccgaccttcgccgcaccaaccgcatcgccggagagattcagcgtcttgaggccgccgcaggcgctggccagggccgccacgtcggcgacggagccccggagcgcggcattcccggacaaatcgagcgcctgcagcttgctcccgcacctcgcgccgccagccgccgagagcgcgccgctgacgttggcgccgcggaggctcagcacctcgacgctgccgagctgcagcagggtggccgcgacggcgcggaactcggcattgagcggcacgccggcgagcgacagcgacgtgagcctcccgttccggcacccggcccccgggaacctgcacgcgccgtcgccgccgctccaccccttgagcgccgcctggttcggcaccgcctgcctgaactcctcgagcagctgggcgtcgtcggccgccgccgcccccctcaccaccaccgccgccgccacaaacagtgccgctatcgctgcccacaaggaatccatgtacgagcgagctcactgcctcacgaccattagagagaacctggcctgctgcgagagcggcggtagagagagaaagtagagagacagaagggggagagtgggaagtgatgaggaggagatggagagagagagaaagagaagcgaagaagaaagacgcaaacacagtagagggggagagcaattaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttaacagctgtaggtgagggaggagtggtggggtggggtcacatggcatgtgctctcgcctgcgaatcgcagcccccccgcgcgcttaagccgggtgaggaggagagcagaggagaggttaagtattctaatcccccgcgcttatccgcggcttacggcgaggttaaatcccgatccgatccgacggccggggacagccggtggtctgctcgaggcgcggtcacgtgccgtcgcgagggggagggttgcgcgccggattgaccggactgccctcgcgcggcgctgcggcgggctcgtgggcagcgcggggatttcacgcctgtggtgtggcctcgcgcggatgggctcgggtcgcgttccgagcgtgcggaatccctgggcgggcgtggactcgtggagggaaccggacgcgtgggcttgcgttgcttcgcgaagggttttttgtctttaatttccgaagtggggtggtagatccgatccgggagccgaagaagcgtgcggtggaggctgcggcgtgcgacctttttttcagggtgctccgcttccccaatatgcccacgacgacgttgtcacttgtcactaggggtggaaacgagccgagcggctcggcttgcaatggctcgcaacaagctagtctcggcttggctcggctcggttatagcaatgagctaaaacatgagcttggctcggctcgtttgtggctcgagctagctcgagctggcttgcgagccttccattaagctatataatttataatcattaaaaaaagtaataacaaataattaatatgtaaaattaaaataactttatatattcaattcatcaaaatataaatgataaattacatattgacaaataataacttcactagaaaataaaatcacccatataattaatgatagcgtaggctcacgagccaaatcaagcgactcgcgagacagctcaggctcggctcgtttcagaaacgagctagaaaggacgcttaggcttggctcgtttggtatttaagccgagccaagctaagcgagctcgagccaagcccgagctgagctcgcgagcccaaactttttttccacccctacttgtcacggagccgacggtgcagtgatcgcctgatcaggggggaggggatcgcgtacgtacgtttccctgccctgacaggcatgagatcgtcacacgccgcggatacactgcgccgtgaaaataaagataaaggtttcctacccgcaaaagaaagataaattttggctagaaaaagattaatggtacatgcactttcaggttttactgaccatttacaagatattgtcgtacagtgttcaatggaatcaattgtgtgacaataagatcttccttggtatgacctgagacagtaagaattgtgtacgcatgttagaggtacttatcagatgtatatgtctatgaaaaggaatgagaactctatatcggagcacatatcataaaccttgattcaaaataatgaattgaccatgagaattgcctgacaaaatcaacctaaactatccatgcattgggggtcagatcgacaattggttaataaatgtgttaaggatggtaaaagaagcaaattttgtttatgtactctatatatactagactaaattaaaccagtggataagggggcagtccaatgctgcactgggtttcaaggtagagaattttacgtatacactgtattagtataatatctatagtcggtataagtgatcaatgggtttagattaaattgttatcacatcttttaatcttgtgacaaaattctaaattgtccttattataccgacaatatatattaacaatatactatgtattaagtaaaagttctctcgaggtattgcttaccggcaaccgcacctcaatttacttcatattcaggggacatgagaaatcaagaattaagaaaccattgagacggtgtttgatatgaagataaaaattaagtgttttatgtaaaacgaggtgataataacgtgtgattaatcgagttttaattattataaatttgaaattggattaatctgatattttagaacaacttttatataaaaagttttcacacgaaacatgccgtttagtagtttgaaaaacgtgccacttttatccaaaaaattatccactttttttatggaatctaacggggcctgtgtagctttggtgagaatttgatgggtttatcaagtttctgcttctaatccctttactatatattatgactacatattcttgaaaattatgagagaatctaaacagtttaagggaggtagatattatgaaataagttacggttattagaaactctcaggcaaagcttaagatggtacgatctccgctactgaaatatctctcctcagtgctgtagcatctactcccttcgtcttatattatattaagtttattttttctcctctcatttatcatagtataaattaatttttaagtaattattgtatcaaaattgtgaaagtagagaataattgattatgcggcttaattagctagagtaagttaaactcaacaacgaaacatgatcaagatatatagaaagcgaagtgtgcgtactgatctcgtcacaatcctattaaaaaggaaaaactaagtatgtaagtaaaactttcctttataacggtgctcgttttatagctatgtatattcacttatgaatatagagaggctgacttctaccccttttttttttcaaaaaaagaaatgccccttccaatcaagtctgcataggcatatactccactgcaagtatatgcttatgcatcaatgttgcctagtatgacattggtgaagaatacaatataccatatttcttttctgtattccactgcaaaaggcgagatagccattcaaaattcctcccatacatatataacatggctagaattatccttcgaatttttcctgcagtacaaacagccgtatacagaacaccataaaacgtacgcagctgctaattcatgattagcacagcaaaacccctggctcgaggtgattaagatctagtaagcctaaacaaaacaaacgtaaagttcgaaagattcagtcaaggcgagaaggggaaaaaaaacaaagcaaaaggagctttattagaagtggctccatgatgaggttacgggcacacccgtgcgtctcatccgagcgcgtcatattggagctacgaccgggagcacaatacccgtgtggcgtgccatgtgggccccaccactcatgccacagccgatccggcccaagaccatccctccctcccctccccactgacgtgtcggccccacgatccgtgggtcccgtcctccagtgagacgagcgtggccgtggacgcctgattggacaagtcactgggagatgtcgggggatggattggcggggcccgcgccgtgacagtcagcacgtgcgcctgtcccgggaccacggccggggcgcgatcgcagccgtcggattcaggttccgggagggggcccacgcggctgtggccgaacgcagccgttgggtgtgggtgtggtggcgtgggaggggtaccgggtacgggcaatctgccgttagatctctcaccgcccccgtcctttgcctctctccgatggagaaaatggtcacaacatacgaaccggccattcgtgttgttttcttccccctgccttgaccggggtggcctcgaagcaaaaccggttcgcttattaccggattgatggcggccacaagccctacacatcgtactacgtacatcgatgatcgatctcttgtgcatgcagctgcagtgctgcatggttatagcaccacagtaacaatactagtatggctcatcttaccgacaacgacaaggtgacaaagctatcttaaaaaaacaaattaaaaatctcgcgaacagtttggttcgtcttgatgtttttactggaccttggtgtgctagtactacgtagcacgaggtatcgacggaagccgtgctgcaatggccgcaacaaattaaagtctaacaaagagccgcacgcgtgggtaggaagtggtagtaaacacctccccaccgtaccgtccgcgcgcgtcgcgtacctacgcgcaattgtcttgtacgcgcgcgggcggggcgagtaaataccgcgacgtaccgtggcgtacgtggtgtggcaccgtgggtggggctagccgccgcacgtgagagccggatagagagggcgcgcgggccggcgcccgggcaattatttagctccgtcgcatgagtacgcggcgtaaaccgtggggctaagccagtagccaccaccactccccatcgttgcactttgaatgctgtgatggcgaggtggtctgctttgcttgctcctgcttaagcttaaatacacgaccctctcctcctttccagactccaatccgtcgacgactgggccggcctggcgcggtggtcaccatcgtccggtgcttcgacttgccgctgggggtagtaggagtagctaggtttgtttgattgttcgtatgtccgtcccctgcaacagatgtctgttgcgtcgctaggttggggtcgcaattaaactctctcgggggacgggactttgttcccgttattaattctatcgtctttgcttttatcgtgtcgtctatctaatctaatctacgtagcccgaaaccccccaacattgccagcgcccagtgggccacatcacgtgtgtgggttgcgtgggttgggctggcaaatactacaccgtgggcttccacctttgcagagcactactggtctatgggttctgttccgttctgttctggcgctcctctctacgggtgatcgctaacttgccgtcttgccggattgcccgctggaaccattgtggggtaggatatgttcggtatgatcaaacgtcagctaaaatgtttgttgaaaaccgacgagaattgccaattaggcagtgctgaccgaacaaaccggccgggtcgagtgctcgagtggattgtacttccacacttgtgcttataaaagatttagagatgatggagctagaaagcagcacatccacgctaggattgctagctatagaccactgcgaacagtaactgtgtgttccagtgcaattattttagacggcatacctgacgccaaaacgcatcacaggcgcacacatgtgtggcgtgcgcttgaacagttgcacccgctttcctgccggccgagattggcacacagcattcattctctgaaatttttcccatggattcaaatccggccggtggcctaccccaactgacggattcatcgttttttcctccaaccgttcgatcttcacgtcgctgccaatccggcggataggagagctacacgtggcagttgacgagacggacacacagaggaagacagattagtcagaagtggctggcgaccaaagtcaggtcagatcagcgaaaggctaagctaaactcaacgaagacgtgacgaatgtcaaatgacgccggttgttcgttgctccctgcgtttataaatccgatcggaacgctgcactgcaagttcgcaaccaagaatctccagtcacgctagcctttctgcaagcgtagcctgacgagatcgaccacaggacaacacaggagccaacggagcgggacgccatgaggcctcaagctctcgtgctcgccaacttcctggccgccgcgctgctgcacccgttgctgtgccaaggcgccgccgccgcctcgcctgcctccatcgccgggaagctcgccatggacggttagtgcttgtgactttatacgcgcaccaagatttgcgcatcgcggcgtcgcggctgccagttccgggctaacattaggtgagttgcctgcactctgattgaattggcgcgtgttgtttgcacctcttgcaggaatggccatcgaccaagggatcgatcacttgctcgtactcgcggcgatcttcgtcatgtgcctgttccgctgagtggagggctggaggcaactgaacagctcttccctgaatattagcttctttatttttcttaatttgtacatgtacatgcatgtgttctttaaaatcttgcccaaaggttgtagaattttatcatgccgaagttcaacgaagacgttgaaataagagcgaattatgatacgtgttgtgctccatataatttattactaacggaagaaatttctaaattgcaatttttgtacccattatgtgtccagtaattcgtttatgtgccaaccgtgaagttcgttcaaataaagttcttcccaacgtactcccccgcaaaggggaaaagaaaaaattacaacatagtactgatttgtgtgccattgagctaaactaagtccagtgttggctcttagaaaatacacgttaagactattctaaaacaattgagataataaaaactctaaccattaattaacaattgataagcctccagcgtcgtcggcactttctaccacacatctccgccttgccgccgccggagtgtgctgctgaaagttacgaggtcacatggaaggtgacgtggatttcatagtagaggccacaatttatttatggggaagctcttatgtgttagggcacccacaatggttatctataggctctctacaagatatccatgttagcatattttcttacttggaagagattaaatgaagagagagaacaaagctatctactaacctgtagatagtctatagagaaaaacgaggcaatggattagagagttatagatacccaagtagacataccattaaagtggtttactattaatctagtctattgctgagatgtacatgttttataggtagcaccttactttaccattgcggatgctcttagagctctttgtcgagccgcctgtgtagctccaggggatccgtctctaccgttgccccctctccaccataagtgccatctggatctaatccactgtggttcgggcatccaaccaccccgttccacttactcagatatggcgttgctcgtcaccgaccgctggacctcctctcctgcctgttccaccaccctgttccacttactcagacgacaatgagaaaagtgagagatagaggagaagagagagaaaaggagaaagagatcaagagggtgttgatgtgggtcatcctgacatgtgggacccacgctaactcaaccattacgttggataaaactgttgtcaataccgtctaaggatcttaagtgaccggttttttaagttgagagatgccatatatctaatttttcgattgagagatgatttggtagttcggtgacagatgagggacctcgtatgtactttttcctgctgaaaatatgtgaattggacctgaacgatatcgtattgggatttagacgcgggtggttgaatgggctgaatcactatgcaacgtacgcaacgtgccgtatgccgcctcacggttccgaacctctccaccatgttggatcctgggaagcccacacacgatggcttacaaaccaacttgcaagttgcaacaaaagttacgtacccagcatcgctgcgacgcgctcctctgcgcaccggccagtcaccaagcggtcgtcgccagtcggctgcagcaagcgttcgcagcttggccgggacaaccgaaggccgtatggtgtcaaacgcctcggacacccgcgcgcagctccgctagcacgtaccccacgcatgagtgaaccaccacccggtcgtccgtgttatgccaaacgcaagaggcagccgcacgtccgcacccctcgccgcgagaaccgatcgatcgatcgatgccaagcacttgccgtttcttcgaaggagcgctcaaaaggcagcaggcgatgcgccccgcccggtttgcgccatctacgccatgccagattgccgatgcgcgtgtattaatcaacggaagggagcgacggatcgagctagcgccaatgcaaagtaaagaacgagacgatcgcagagcatggaattgatatatatctggggaatgaaatcgcggcatcatgccgtgacagagttataataatgaaatcaagggcgccaatcctggtctttaatcctgacggtaataagtaaaagaatcgcgacggaatacaacgcaaccatgtatgtaggcatgcttcttatccgatcctgcaaggaattggaaagagtttcccagtgaaagtccttgacggaccgtgcgagaggaagatccactgcctacagatacggaactgcctccgtggttacagattcatagccgcatgtttttctatttacctagctgttctcgtggcatgcatgtttagctcgatcggccgtcgagtcgtcgaccaccacgacgagcatctcttctgcatcttgcgagcatatggcctctctcgatgctgtcctgcgttcagatagcgtcttcctatagctccctgcaggtacgtagcagcactactacgccgcctgtacatgttcctttttcctacctaatcaaatgcagcaaaatcttgttcttcgtttttacatatttgctagaaaatttgattcccttcgtgtatgtgcgtgagcgtgatatatatacatgacggcaaggcattttgtttttaggtttacttactagttttttatgtggcgtgttctaatggcctcactcaaatactgtagttgaactcatggcactaacagaaaagttttgttggattagcctcatgtggatttcggttcaccacgggtgcagagccgcaaagtctacttctctagtcggccggcctatatacttttagtaagtgctgaaatcctgaaattagaaaagtgaacattaatagctctcgtactatatactcccccgtctcatttttaattgagtccagttgtaagtttacgtgttcaatatttaaccatctactccctccgtcctataatatagcaccctagtaccaaacgagatacttgaacgagatacttcatagtacaacgaaacatgacatatttcatgtccagattcgttgtactatgaagtgtctcgttcggtactaggttgctatattatgggacatagggagtatctaatttaaaaattttttataactaatatttttattattattagatgataaaacatgaatagtagtttatgtgtgacttacttttttaaaattttttaaataaaacgtacagtcaaacgttgaccacgaaaatccactatacttaagataggattggagggagtatatagtattacctatgtcccataatagatgtcgctttaactttttgcttgtaacatttgatcattcgtttaatttgaaaaattagtataaatataagaaaagataagtcataattaaaatacttttaataataaaacaagtcacaaacaaaataaataataattctaattatttttaataagataaataattaaatattaaaaactcaaagcgacaagtaatatgagatggtggtagtacgatgctagagtactacagtaaacacattatcaggaacagtcccgtgcaaagctggtacgtcctggtgccaaccatggggggtacatacatataggccatacgaaagtctgaatttggcttagtttctgttcatgaaggtatcgtcaatgttgcagagcgtatatgtatgaaaacagaccatttattggagggacaccatccttggcaagttataattaaccattggtttcgtctctatcatgattaagccccctcacgtactatcatcagtacgcgacctgaatataacatcaatatatgactttgtatgatgtcaactgtaagagctactacatatatatattttatattatacagtacaacgcactcataatgcacgtgcacttacctctataaacacacgcacgcaaattctatttcaaagactaggccggtaaatccttgagataacttgtgtgtttgcatgaactatttattttatatactgtgcataagtgtatatcttgctttagagtcatcaagatcaaaacgatttagtttaattacaatattagtattgaatacactataatacttaattatttgctgccttttatcttcttaatttagtaattattaaatacattcattaataaatacaaggttgtacttgtcatgaagtcttaatgaatttttgaatttagaattaataatacgtagctgcactcggtttggaatcttaatttagttttttcttgatataataatttcaaaatttagaagcaatacattttatattaccaatttaagaaatttgaaactaaaaattaattggcacccagttatacatcgtaactggtgttgagttttcttctaatatcatactaccagtttttaataagtaacaccattaactttttgacacatgtttaatcattcgccttttaaagaaaagtttacataattatcggtatttattttgtttataatttggttttagctataaaagattgccagatttatttattattttacagtgccgattagcgctacaacaccaggaaatttactacagtgtgctgcatatcagcatatatatgtgtacattaaggacttaggaaaagttttgggtttggctatcacatcggatatacggacacacatttaaagtattaaacgtagtctaataacaaaataaattacagattctgccaggaaactgtgagatgaatttactaagcctaattaatccgttattagcaaatgtttactgtagcaccatattgtcaaatcatgacgcaattaggcttaaaagattcgtctcgcaatttacatgcaatatgtgtaattggtttttttttcttacatttaatactccatacatgtgtcgtaacatttgatgtgacagcatgaaaatttttgttttggaaaacaaacagggccttagggtaccctttctctctccctttatggaaactaccaagaacgaagagctagctagatatttcactaatagctagctatatcatacctatagttcttgacccaattattgctcaaaagaaaatattatctctatgttttattgaccataatctccaccattgctaaaattttagtccaattattaaagttacaaaagaaggcactgatgcttctcaaatcaacgcggataacattgtctgagaagcgaagttggaacctatccaaggttttccatatgagtttaggcaccgatctataaccgctaaccgctagtctatgattttgtttttcattatctgaaaaaatgattttaaaatgattttgctgttgattgtcataacctagtggttttttttatagaagtaataaccgatcattttattttgaaaactagtaagtctcaaaccattttgtccaaaaaattttagtacaattaagaaaaccttgtttgaactattgagcggtttctaaatgcaatgccccttgtatgactggttattgtgataaatgactggttatgtcgatactgtaagagaaaatccaaaatatactattgacaaacaaccaattataaaaaatactatcgataagtgtgagttttataaaatgtcattgcctaagtgactttgtaatagaaatgtcatcgtcgttaaggttatgtcccgctccattaaatgtattgtttatcctatagcacttgacaggggttgctaacggaacattaacgacgatgatatttctgagataaagttacttgtataatggtatacattaaacacatatttaatgtaactcgtactttttgaaattaggcgcttgtaaatgccatttatcggattttctatattataaaccctgatcctaactctagtggattcctgattagtggactgtggcacacaccctttcaaaacttttggtttgaactctttcctcgcttggtcgtatcctgcagatttgagcccacgtcaaaagctagatcaccaacttgacgaggtaacaaaggagagagcacgcagagtcagtatataatataggcatagccagcagaatggcaagacaaagcagcactgcaggggcatccatactaccggtgacgaatatcggcatggccgcctccagaagcgagcttctccggccggcattcggcgagccctctccttcgctaggaccattcgtcgttaaccctcacacctgcagctacaggtgatcgaacaacctgcatccattatacatcgatcacgaactgaactgaactgaactcttgtacatcgatcggtctggtttgagtggtccactccaggtggtggcagaagttcctgatcgtgctggtgctgtacacggcgtgggcgtcgccgttcgagctggccatggagaagtcggcctcggccgcgctcgccgtcacggagctggtggtcgacgccttcttcgccgtcgacattgccgtctccttcttcgtggcgtaccgcgacgcctccaccggcctcctcgtaaccgaccgcaagaagatcgccaccaggtatacgtgatgctgatccgtcactgcatgtccatttttttttcctttttgctgctctctctattttaggttgtaagacgtttttactttaatcaaagttaaactgctttaagttgattaaatttgtaggaaaaagtaggaatatttttaacccaagacaaatttattataaaaatatattcaattattaatttgatgaaactaatttagtattatatatattactatatttgtctataaacttagttaaactagtttgattttaaccaaagttaaaacattttataacctgaaaacctgaaatggagggagtatctccgtcagagagttcaatatttatcgatggacttgcatttttaggcacctggcacgaccatgcttggcgctggatgtcgcctcaacgattcctttacagatgatctaccggatagtgagcggcaaaagacaagcattgtatgggttgctcaatcttctccggctctggcgattacggcgcgtcagcaagctctttgcaaggtaaatactccacatccaatggacgatctcggtcaaatagattgtgtgtgagttcataacttcatatacgcacgaatgattagtacgtgagtgtgcagtactttgtgtgagtgtgtattgcagacttgtagagttgtgatcaagtacgtatggctttttgtacgcagcatgatttaattagctcctttgaaatataggattctcaaaacataggaataggaaaaaatataagatttgaatatcatgctcttgtaaaacctataggatttcaaaacacaggaataccagaactagtgccttcgaataattcacatgaaataaaatataggaattctagaggaaatttatttgagtgagagagagagagagagtagagagagaaaggaagagagtgcttattttcctttgaaatgaggcataggaaattaaatctataggattttcaaagttgtagtattctttcaatcgaaaggacactataggaatagaatcctaaggatttggatcctttgcaaatccaaaaagaaaccctccaaatccaaaggaggccttagcactactggcctgacttataaggtaatttattatcatagtactcccaccattttcaaatataaacatttcttggatttaaattttgtacataatatatgcatttataagcatttgtatatactaactaaaggttgtgttcgccaattcgagttgagaactcttccaccattggacacaaaacgaaacgacggtttagtgcgtgattaattaagtatgagcaaaaaacttgaaaatgaattaatatgattttttaaaacaatttttctatagaatttttttttaaaaaaatgcagcgtttaacattttgggaagcgtgcgcgtgaaaaacaaggaagatgaagttgggacaatagattaaagaatatagcctaattgtgccatcgttcacgtcattcaaattcctttctattttaataccccctcccactctcgcactcctatcaatctctcatttaatgacgagcaatatatattttcttaatcttaatatctgctaaataacctagaaattcttatgtctttggaagaacggagagtaccttctttcatgatatcaaccttgtaagtgagtggaccaagagacttttctttctttgtctttatcttcagtgcgagtgtgggggaaaagagctcgtttaagtggcttggtttataattgctgtagctccgagcctccgattgatcagtttttttaagctaaaattattcaaaaatttgtcagttccctagctcttaacaaaaaattgtcttaaataattcagaaaaatacaataaataaatttctagaaagcttggccgcctcaatttccatccctgtagtacagtagtagtgcagatacactacgtgactttgagttggtagcatgattcaccaatgggtggcatgtaatgctatatgaataactacagtatgcatatgtgatcatcattcatcaatgaccgatatgaaattctgaatcttgcaggttggagaaggacattagattcagttacttgtggaccaggcttatcaagctcctctacgtaaggccacgccgttccacccggagtactatatttcggcagagttcatacaaataacttgctacgaaatcttgtgtgctcatgattgcaatgcaggtgacgctgttcgcagtgcacttcgcctcgtgcatctacctgtggatggcgttccaccacaaggcgaaggagctgacgtggatcggcagccagttccacggcttcgaggaccgcagcgtgtggttctgctacacctgcgccgtgtactggtccatcaccacgctcgccaccgtcggctacggcgacctgcacgccgccaacacgggcgagatgttgttcagcatcgccttcatgctcttcaacatgggcctcacctcctacatcatcggcaacatcaccaacctcgtcgtccacgaaaccaccaacaccttcaagatggtaaatattggcaaaacctgatcatggttttcttttctttttgacacgngattggtgacatggcattggtgcaagggacatgggcaagactcggtgttcggagaacaaccgctgcgggggatgaggacagatgatggaaagcctgcagctagttcaggcggagagcactgcacagaatgctgccgactgccaagccggcggcaggctcgccacacatgtcagaggggcggccagactgctacctgttcaggcgtctcgacaagctcgtcctgccgctggtaattgaacaccagtacaaacgccttggtcggaatagctctgcgtttaccggtgggtgactgactaaataacgtggtaaattcaggtcgcggagatgaaggcagagtcatttccccccaaggcggatatcatcctggagaacgaggcttcgacggactgctacatcatcgtgtctggtgaagtggtaagaacatgcctcgtgtgacgtttgttctcttcgctgttcatgctctgacaacctgcatttctcttaatcttttattttgtatcaggaggtattgacaacccttgaggatggtacagagaaggtaaagcacacgagaacccagttgacgcacttagtatatcagttataccatttcaagcttagggtgtgtttagattctaaaattttttggtaaaaaaagtcacatcaaatgtttggacacatgcatggagcattaaatgtgggcgaaaaaaaccaattgcacagtttacatgtaaattgcgagacgaatcttttgagtctaattgcgccatgatttgacaatatgatgctacagtaaacatttgataataacagattaattagacttaataaattcatcttgcagtttacagacggaatctgtaatttattttattattagtctacgtttaatacttcaagtgtatccgtatatttaaaaaaaatttggccaaagaacgaaacacggccttactcttctcagtatactgaactttttccggcatttgcatactgacctgaaaaggttctgatcaaaattgtgacatttcagcaagtgatgagaatagggccacggggaatggcaggggaaattggggtgatgttcaacatcccacagccgttcaccatccggagcagaaagctcacgcagctcgtccgtataagccacagccatatggtctcgaccatccggcctaacactgcagatggggtcgttgtattctccaattttgttctggtatttgattttattcaagaatgcaatatagatatttttttctcagttcacaatttctcacaacgtttttcagtaccttgaatctctgaaggtgaaggcaaaggaaacagcctttgttagggatcatcttcgcaatggctactccacggtattaggaagtgcaaccatgtttgatgtagatgaatccaaagagtcagctcacaaaatgttgccatgcaaagaacccaaacgggtatctattcatgaacacctcttaaatgggactggcacagcactgaacggctcatctgggaagctcgtcatactgccagattctatgcaagatctgatgaaactttcaggtatgtaaattgtgctctgcataaagattaacatcgtcagatgttcagatcaagcaacagatttatcatcgttgtgaatggatacccctttgcagaaaagaagtttgggaaggcagcgagagggattctcaccgtgggaggtgccgaggtagaggacattgaagtgataagagatggcgatcacctgttctttagttggtaggataagccatattgccttggcagaacattatttagagaacacttactctctcaacaatttttttttcttgagagcgtactaatgtgctcctgcagaagaattgtattttcacatggtgattctaggcactcttctcgatcttgcagtagcctacgttgcgtactttgaaaatgatactaataactgaatgagactcaacctatagttgagagacctaaatgctaaaattgacctttttcccgattccatgggtctaaacccagaatcttgctgtagccccagcacagagcgtgccgtatccgtccatggctgccgccaactcgcgtcaattcgtaatcgtattcttatcgcggtcggcaacttggaatctaggacccattgtccgattcggacttacagttatttgccataaatacaaaaacactcggtggaggacgcggcgagcgtcgtagacttgtagtaaactgcataactcaaacattacgttgagcattccgtgagcttgatcgtctcgaccatggcggcggcggcgccgttgacggtcggggaggcgcggtcgggcgtgtcccgtgcccaggtgtgggcgtgcgccgtcgtcgtgccgtgcttcatcgtcggcgcctacctcgcggagtcgtacggcgccgccggcgccgcctcctccttcttcggcagcgtcccgtggcggctgccgctgctggtgtcgttcgccgtctacctgtccacggtctcctgcgtcaggtcctacgtcagcctgtacctgcggccgcacacgccggcgcacgtcgacagggccatccagagcgtcgggttcgtcggcgtcggcctcgctctcggcgtcgtccaaagcgtcgtgttggttgccgccggcgacaaccgcgtcgtcatggccctcacctgcgtcatcgccgtgttcaatgccggggcgatcgccttgtgggcatggcttattgcgatgtaccgccgccgacgggccggagtatcatctagctgtggcaagcaattctactgctcctgatgaaagaattctacgcctgatggaagagagaatctagcccgtagttgcaacgctgagatttttagttgtaattaatgtttttgatgtttctgttcctgtaattgatagggatatttggttagttcgttcagtgatgtgtttggtgtttttctcctgccatcttttgtatacgataccgtcagcaatatggcgagattcctagatagatatacctatcaataaatactaacataccctgtcaatggtacaaccgcaggaagcgccaaacataaccctgggttgacacgagatttacaaatgcagctgtacaatgtgcatttgcaagaagtacaaattgcctatgattataggtccaaaacttaatgaacccaatacatactgatttgtcatagtaatggactaattgtatcaatcccaaagagacagatacaacaattaaatgagaaccactattttgattacaagaaatacaaaggagacctacaccacaatctgcactgggtgtagtcgtgtaagctgatcaaatcaatctaaaatcaagggatctgaaaatcatataatatctaaagttacagatgtaagttcgactaccacagcaatccttgtggatccaactactaacacaaaatccatgttttagccctgaaataccaaaattaaacagtttattctcaacgtccaagacatggggtgcttatattacaagacttgcttaagcaagcatgcattccagtgaaaaacttagatactagataacaagccaacaaatcatgttcccaaagttatctttttaccaccaatatggcaatagatgtatggaatgccaccaaactctaacaggacatcggcatggcaaattttagcaaccatccaaataagaccaaattcaaggggtagtatcaaacaattgaaaaggcaagtcgaggcatacaacaaaaacaccctaaggacctgctgaaagaatattaacatgatgtttttcctaacatactgccagcagaacaattgtgacccggagattaaaatcaaggacacaactggcatgtcaagccacatccacaaacgaaattaaaacataggtttataagtatgtgtacgatgcttgcaggtatcagaattcaaaaaataacaattgaaaagcaaccaagggacagcataacaatgttagataaaagcaggatgtcaagagggactgataaagatacattcatggatatgtgcccgcaatgcgctcacaaagcaacaacttccaaggaagactggaaacttaaattaatatagtttccaacagagtttacagtataaggatttatgagcagcaagagcaacaaaaaattaatccaggaatggtatacagagtatgttaacaactgcatttctgaagtagctatcaaatagagcagtccaaaagagtgctgacactacataaatcctatgtgcctgcacaacttcccgtttaatgattgggtaacagagtcaaattgctactgtgcaaaacgttgctcagcctcagcaacatttcaaattcactgctaaaacattgcctcaatcttttccataacaataccagtacgaagcttatggtttagttgcaaagggtatttgccctattttctaccacaaaaatttcaaagcagtgtattttactaagtgaacatccttcttgaagagatattctgtaccagaaaagttttcctcttaacatgatattctaatgacatatacaactataagagcttggatgctagttcaacataaccacataaagcatgcaaaatatcaaacacaacaaatctaagtgtgatgctagaatgaaacaggcctgtcactaaattcaagatcacaaactatcttggatgggtattcaagatgagtgataatcctgtatgagtaaaccaacctgatttcccgaacttacagaccctaggctaagaataagcattcacggcgacattgctctactcttcgccaccaccatcatccccaaacctcttgttatcatcaccctcaccctccttgaggtcaccctcctccccatcttcctcagtgagacgcgcaatctctgcttgcgccttctccaaaatctccctcctcctcacctcaagatccctttggagatccctccgcaaccactcaacctcagccatgtgctgcctcttgctactctccaccctctcatagacatccccaagcttccgaatcgactccacgagcaactcaaagtcttcccctttccctgcaccagcctcgtttggctgctcttcacccaattccgcaccagacccagaatcccttgttcccgcgttctcacacccgcccagcacgtactccgcggcgtccagaccccaagattggcgcggcaccggctgcgtgtctcggcggcgcgtcactacgggtggctgcaacgggagcggcggtgggcacatgagagactgcatcttgtcgaagtagatccacttggaaggcgaggggcggtcggngcggtcggngcggcgggcggcgaggcgcatcctctccttctccttcctgtacttcttcctgagggtgtcgatgcggttgcggcactgctgctccgagtagtacccgggggggcgggaggccgcggcggcggcgaggcgggagacctccagccactcgtccgcgcggaggctgcggcggccggcgcgcacgaagcggtcgccccaggcgtcgaggagcgcgaaggtggagccctccgaccactcgggcgtgccgcgcgcgggcgtcggcgccggagcggtcgcggtcgcggtcgcgggggcggggcgcggggcgaactcgaagccttgcgcgtagcggtcggtgcggcggcgcttggagcgcggggagggggaggtgccggaggaggagggcgacggcgagggtaattcggcggcggcggcggcggcgggcgccgcgccgtcgtccatgagcggggagctagggtttggttccggggataggggtggctcggcgagatggatcggccgtcgagtttgcgggcaggtcacccccattgcctcggcgggggtcagccggtcaggtgggcagtgaggatgaggtgggggcactgtacggtatctttttttttcttctttcaatataaaaaatattgaaaaactgaaaacaaaactatataatgaacaaaatacgttaatataaactcatactggctcaaaatataagtatttttagagctcgatacggtcttcgagatactactttaaccaacagtatctataaaagtaaaatattttaaatataaagagttagatattatgataattcgtttaaagataaatatagtaacattaaatttacatgattaattgttttaattgttttctattagtagtcaaaatttaaaaagtttgacttagcactattctaaaaatacttatattttagaatggatggagtaataaataaggcaaaattctaattataaaaccgcacaactttatataactatataatatgatgagactaattcaaggttacactacataaattacaaacaaacggtcttcttcgtaatcatgcactttagttaaggatttgattccttttaaccatgcacttttgttaaagatttgattgaggagttgatgggtatctacactataggtcaaataaagaaatagaggatagttatagatgcatttagaaatacgttaattttcttaagaatatggtaagattcaaaaacagccagtataacgtgaaataatttatgtttttattttcatattatttttaccattttcatcttagttttcagggttaactattttcacatggtcgagcagtaaaagtaaaaaagaaaacgaacgtaggtcgatcaggaattttcaaaaccattttcacctctaacggtactttcaaaacggacatattccctccgttcctaaatataagacattttggttggatgtgacatatcctagtacaacgaatatgtataagctttatgtccaaattcattgtaatatgatgtgtcatatccaataaaaatcccttatatttaagaatggaaggagtactttatactagtataaaaggagtactcgtggttatgcatatacaagtacatttcggtggccaattcctgcgtacatctcgatgattgattatgcattttagtggtgttcttttctcatgaaaataaagattaagttttttttatacaaaataaggtggtattaacgtctgattgattgagttttaattattataaacttgaaaaatagattaatatgatattttagagcaactttcgtatagaaagtttacgcatgaaacgcaccatacatctcgatgattgattatgcattttagtggtgttcttttctcatgaaaatgaagattaagtttttttttacgcaaaacaaggtggtattaacgtctgattgattgagttttaattattataaacttgaaaaatagattaatataatattttagagcaactttcatatagaaagtttacgcatgaaacacaccgtttagcagtttaaaaaacatgccatgaaaatcttaatcttcattcaactcttgctggagaaaagaacgggtcggagtcatcagtcatgcatgactcatgacaacactaaagttccgtagagtgtagtcctatatactgttgttcaactaaccattgattgatggaagagtcctacacacgtgccagcgtgcgcaccatatatgcatatgaaaatgggcaactatacaaagacgtacgttctcgatcaccgaaagagaaatgtacatgaactaaaacattcgtacgttctcaatcacacacacacacacagagagagcgtgcgctatatatgaactagaaaacatcctctatcttgcagttacgttgcactacatgttgcacatcgcgcaatgaccagggccgagttgttcggcgtgcatttggatgtatggacacagagagtcacagcggtagatccgtcggtgtgcacacatcgtctatacaacaggataaattataagtgaaccattatttttcatgatttaaatatattctaagtgcacgtgaaggtgggccaggcgtgacgtgaggactgaggaggctgaccgtggtaaactagtcttagtttagagtagcacatacgcctacttatctccgggcctctacatgctgttgtactagtagtgctactgtatactagacttttctactactagcttttcttttgtactccaaatgggcttgattgggctcttctaacttcatctgggcctccctcgtcacgagaacccatgggccgtccgcttgacgagagtctgtcttgttcaaatggaaaatgaatctgtcgtgagttgcaacgtatgtaagcgcaggctgcgccgcagtggcacagaccacagagaaagcaagcgacctgtagacgtgtgagtgagctggccctggtgccactactacagcaccgattgttccgtgcgggcgagccaatttttgcgtgcaggtggacagcccgcacgcacccagtcatctgagaaaatcacgattttcacgtgcgtgcgggcccacacgcacccagtcatctgggaaaatcacgattttcacgtgcgggtggcgcacccacacgcgaaaaccgattttcgcgtgcaggggcttaagtcgctcgcacggagaaacaaaaaatcaaaaaaaaagaaaaaaaactaaccctaatctaccgccgtcgctgcctagccgaggcccgccgccgttgacccctcctgccggcggccactgacgccatcgcacctcctgccggcagccaccgacgccatcgcacctcctgccgacggctccacctccacgccggccgctaaagacacctcccaaccgccgccgccgctccgatctgcaaggggagggggggcgcgccgccggatccaccgcccccatgcctcccctccgccggatctggaagggtagggaggggagggggtgttgtggtcgcccgccgccgccaccaccgccgcctgcgcggtgtcgccgcggtcgagggagagggaggaaggcaccgtgcgccgccggccgagcgacagcccggcaggagtgggaggagaggagagagggaggtgggaggagaggagtggggagggaggtaggggcggactgagtgcgtgcacggttataaaatgcgcgagctgattttcgcgtgcggttggcttaagccgcccgcacgggataatgtgttttcccgtgcaggtgatatcccggtaccggtcccctattttttcgtgcggttccacttacggaccacatgaaaacaaaatggaaaggtgttcaggaaaataaatcatgcagtagtgtgctggcattaagttgcatatgcttcttcttggagaccaaggcagagcagctagcatatctgcatatgcgagtttcagatgcttcttcttggagaccaaggcatgcaagtgcagtagttgcattagtgcttaacccctcctaccatattactcttcgcttttcactttaagacgaaaataagcggtttcaccgggaggcaatgatgttaattcagagcatcagaaattcataagtgatgttaattcgtctttgacccgttgcttatacctaaagttatgttaattcgtctttcgggaagtattaatagttactgtaatggtagattattggtacttcagtactactgatgggctacgaacctggttcttcgtagccaaaatgatcctcagaaaaacgacctgaaaccgcatgacaaagagagccacctgtgattcttcagccactgaattactgaacttttccatgcgatgacgatgtggcgtgttttcccctgctccaagcgaccaagcatgcatcagcacagcttcttgatatgcaaaagcaagcgtgtagctatctagctttggatttttggaagcactcacaagttaagccatgtaatggtaggagtacatatcgtccacttgtttcttcagttacttgtagacatcacccgtaaaccaagggcagttttcttgcacacttgcagatcgagctgaactatttatatttatgcggttccaatcattcctgcagcagcttggcaatttgtttcggcaatctgcaaagctgtttttatacctatactcctactactccctccgtttcacaatgtaagtcattttagtatttttcatatttatattgatgttgatgaatctagatagatatcaatataaatgtgaaaaatgttataatgacttatattgtgaaacagagaaagtactgcacttctgttattgctttgattaaagttgttgttttttgccatggctgcactacacaccacacagccatgtcctcctccagcaaccagagagcagcatcgcgttgtgtgcgagcccaagacgctactagtcaaaccaccaagacttctcgatcagcgctgcccaatcacttcgacgtaggagtacccctacaacgccatcgtgctaagtgcaaacaaaacacgaggacacagatcagatcagtcttcaacctcctcgctgagaacacagagaaaggccggccagccaatccgctcatggcagcatctgaaagtgaaaccaaaacttgaaaactttgcaactgcaacgttgcatcgatgccatttacgtgcagacaactgtgggcttgaaaactttgcatcacaaacaacgcgttgctgcaggtagatgcagagagatagatatgtcatcaggctaaataaaatatactgcgcgcgcgcgcacacacacagagagacgcagtgacagcgccaatgcagtcactgctgcagcctgtgtaaaatgtaatcaatccaaggaaaagttaaaaaggccactgtaaaaaacgagtaattaaagtggagggtggggagagagggtacagggcgagggctccgagcgagagggaatttttcgtggctgccgacatggatcgggttaatctaaaccggccttgccttaatcatcgtaccgcacgagagggtttagcacgaaggtaaaggcgattttactgccgctgatacacggttaccgacgcgataacgacaggttgggaatcgacacctgccccccatgacctaatgcacggacgctaatcaccatgctacttggcatctagtctgaatctcaagaaaccataggacagtacgtgcgtactactgcatttgcccggttgtaagctcaaaacgaaagaaaaattattaacctggttagggctttagggcgcctctaaactatgtatgggcttggttactagctcgatttttagcgtattttttaaacggttaaatggcgtgtttcatatgcaaactatatagaaatctcattcaactaaaacttcttaggctgtgtttgaggagaggagatagaggagattggtaagatacgtaaaacgaggtgagccattagcacatgattaattgacaattaagtattttaaacttaaaaaatggagtaatatgattttttaaaacaactttcctataatttttttacaaaaaacgcaccgttcagtagttcgggaagcgtgcgcgtggaaaacgaaataaaactcactcacaatcacctagatcacccaggaaagaacacagtcttataatttttttacatatgaaatagctaatactcaattaatcatatactaattatactttcattttcattttacatgtgactaatcatctgttctaaaacagacctaagaatgcaccttcagagtggcttttgttagaagcatttcaacctaacacaattttgtgcaaacacaggtgaattccacccatgtcataggggcatccacaatgtactctaaaagtggtccataagcaatacaagtataatatttgattcagccacctaccaacattgtggaactagtccataggaaagaaataacaaaagctacccataagcatatgagctgcccatagagaataaaatatatcatttgtctctatctcttctctcctactaatactatttgctatccatatatactgtgaaggttacaatagtttaagtttatatatgtgggtcctatctttatagactacttttaccatatatattgttgttgcccttacggtcaggatagacaagtctcttgccttagttgcctgcttgaaatactatcgccaacgaaatcaaatgacgacttgtattttccgtaaattgatcaattgaaagaacaaaaggcaacgtgcaaatgccacgaagaacagatgacacagcatgtttcaaccgttaagcatgcatgtcacgcatgcttaattatagaattaaatttgaaaatttactgttcatttaatttttttctcagaaatattcgggatgcaaaaacttatcgcactttcgttgagtgaaaatgacgcggggatgacgtctcgggcggtatcgctcgacgagagcgagaccgttcggtctcgcagaaacaattagcgacattgtcaataggattcatttgattagtgattaattacttaattaacaattaactaataataattagtgataatcaggataattaactgctaattaaatcggcaaggcacgctatcgctctttgcttgggcgatagcgttgtttgctggagcgttatcgctggttgcttgagcgagaccgtgcggtctcgcaccgactgtgcggtctcgcactttcactgcacgataccgatcgtgatgtcatttccacaccattttcgtgtaatgattgtgcgagactgatggtatatttatgtaaaagattttgtatcccgaatatttttttttaaaaataaatgaacaatatattttcaaatttaattccttaattataccgtagagttcacaagaggacgagaagatgccatgttctacgagttttaacttgtgtggggtactgggggtacgaattctgtctcgcgtcagacacagaccagcgtaattagcatgtgccaatcgcttttattagcggtaaaagatgggaaaagtaaaaaaaaaaaagggaaagcaacgggtccctactccacagacgtacgatgctcctcgagatacacgccaacgtcgtacacgcgtcgggcctagctgtccctcgccacacaaggcgacaaaaaatacgtattggtttcaacgttttcaccgtggcggtcaaaataggacggaaaaaagaaattgtaacgctgcccgtttgccacctcccgtcgtccacacgtgcaagcacaattgcttttcagataaagagtagtacaatgtttggtactccgtcaagcacattgtatgagtattatactggagtaggagtagttattttaagcaaagcagtatctgtcacaggtaaatcactgcaattagcgagtcatggctcatggaacaaacactgcaagaagtgcgggaacttttttttttggtcatttttgtatgacgtgatacttacgttcatgactcatgacacgcaagagagcttgaaaagcaacgcataagtacaaaattatttgttctgtattgttttgttttactatatcttctcatgaaacaacccaagtgacaactgacaaaccgggttagtaagggggtgtttgagaactagggactaaatttagtccctctcacaaaagtataagtccctataataggggcttatgtttttgtgagagggactaaagtttagccctactttagtcctccaaccaaacaccacataagtaggtgtttgggagagagaggctaaacacaaaaacataagtcccacttaaatccctccaaccaaacaatagagtagcacaagtgtagacccaaagaagaaggaaaaaaaaaggaacaaaaatgtctcacacagtcacactaccaaagagtagagagagactgtctttttttttttaatttagagagtgtcttccaagaaacaaaaagaaaagcaagggaaaagaaaattcaaagacgaaaaaatatattaaaaaaaaactaggagagtcagagacagacacagagagatggtagtggtaaagcggaggaggggtggggtgttgagccctggagaagccaccgcaccccccgcccgttgcctttgcgctgcatgccgccccgcgcggggacacttgtcttcttcccaataaacacacccacgcacacaagaaacctcacggaaagcagagcagcaacccagccagcggagggtcaggactctggagcggagcaagaagcagattgctgtgcaagccgcctcctcctcctcccccctgcctctctctcctcgcccttcttaaccccgtctcgcgagagaggagaggagccaccaccaccgcctcgacgccgagaaccagcctcgccgtgacccccggtcgccaggtaacaaagcactccaccaccacagcctcggtttggtttcttgaagcttctagtgctcgtttcttggactgttgcgttgcctgttcatggatgttggcgcactgggatcgatgggatgtatgtactagtttgttggtcttccggttgggttcgtcttcgtttccggcgtgagattagatgggttcatcaggtggtgatttgggactgcatgcggttgtctttgtatcggttgggattcttgggtcggtggcgctggcggtggtgatgtaaattccctttcatggtcgccgtaatgcacagcgttgtattgccgccgcatctctccatatatgaagtcctctttaaagcgattgagattgatctgggctgttatggaatagggaggggatggtggggagaagttcgtgttgatttcttgttttgaatgcttgtttgcttgttctagtttttctggtcacgatcatgttgatcaagtgagtgttatacacgatcttgtttttagtttgcaatcttgattaatgagatgagaagatgagatagatgcccgttgttgtaaccagtgattttttttcttgctttttggacctgccgcacagatgccatcagtaaaccaaaccacctttttttcaagtactaacttttttttactattgtttatgtacttatgatgctcatagtcatagatcatcatcatcttttctcttctttgcacctttgacttgatgagttataaaaaagcacaaaagctggaatttcttttcacttttgttcgcttccatcatcattgaccgacctgatatgcaacagaacaaaaattttggctattttcagggacaggttactctcatctttggtgcttgtgaacaagacgacagccaccgctcatcaaagagcaagccatggaggaatccaatgatcagggccttgcacagaagagcactgcccccactgggttcttcagggtccccggcctctttgtgaggctgagcagcaaaggattgaacgcagtggaccctgattctgcctggagcccaacctctccattggatttcaagaacctgtcatcgagcactggaagcacaaatctcaaatcctctgggctactgggtgtcgaggctgatcagaagttcagaactaaccctcccagagtcggcctcggcctcgtcgacgccctcaccgccgacgagagctcctcgtgcttgggtgtcacgagctcgtttcttgattccatcaggccatttcttgagctcgggttgccgaaggcggcgagtgatgctgcaatgcagaagaacggttcaggtagcgtcactctggacgagattgcagactttgctctgtctgaagagtacacctgtgtgatcgagcacggcccgaacccgaggacgacgcacattctgggagacgagacactggaggtgtgcaagggtgtcccaaggagttccaagaagtcaatcttcaccatcgagcccatcggcgagctgccgtcgacgctggcgtgtgctgtttcccgctcatgctgctactgcaggaagaggctgcagcaggacagggatatctacatgtatctgtgagtattcctgaactcgtctgtagcctgcatttccatgagatacttgcatgtttatatctcactctcagttgctaaacctttgtgctggcttgttgcaatgcaggggagagaaggcattctgcagcaacgagtgcaggagggactacatcgatgaggagatcgaggaggtggaggagctcatgatgctggattctgccggttcttctgccctcttggcttggtgaaaatcggcagtagatgactagaagtagtagtagtagtgctggtgagtggtggtgcaggaaagcgactactacctcttttggatggagattcaggttttggtagggaaaggaaggaaaacatgcttcccgttctagtttttctgaatggagaagtttttaatttagccggtttgtgcaaacagaagtgcaacggctaaatgattttcatggattgtgtggggattccccattttgcctgtaagacgagcaaaccccccataatttcacagcaaacagttctccctgctgaattctcactgcatcttctccttgtttctcagcatttttctttcttttctggttggttcgtcattttactttctgaatcttccgtcggtgcgcttgcccatcatgccgatgtttgatgatgggtcactgtgcccttcgagcagtgaaaaggagagcttggaggtgttctgtgcatcataagcagggatcagactctcccaaagggaaaaggtggcaaaagctcagggccggcctcctggtgaggcgtcagaggcactaactacagtcgcagtgcaattatcggcatcccattcatcggtatgtttggatccggaaggctatctagaatcctactatttaggagtacggaaggctatttagaatcctactatttaggagtactaaacgtagattactgacaaaactcattctataacctctaatctattttgcgagacgaatctaacgaggtatattaatctataatttgctacagtgatgctacagtaatcaattgctaatcatggattagtatacattattaaattcgtctcgcaaaatagcctaggggttatggaatcgattttgtcggtaatctacgtttaatacttttaaatagtaagattccagatggctatttaatagcccgaaggatccaaacaagaccattgtgctgtagtgcctgttggctctgctcccctgttgagctccagtggcttgtttacatcgacgcgaggacacaacgcaaaaaacctgcctgcttggctcaatcagtagtggccttgcgccgtactcgaaaggcctagaaggtatccaatgggcaatggctacggcaattaacatccgggtaagccgaaccacttcgatgaagtaacatccaatttttttagcgcggttttattgatagagcataagaaaattataagattacaactctaaaagatcgtaatataccactacccacacactaacaacgtcaacacacagactcaggaaaaggctagcacagaactggccgcctagaccaacgacggaacatagccaagatcgtctaaaacccgatcctaacaatcaatacaaaaccccactctatctaagtctttacgatttagggagggtgagagaaaaatggaactcctctcccctcataggccctctgacgtggtcaacttccagaagctaagacaccgacacaagagcatatgaatctagagcgagcttgcaccaattgctcgacggaacgccaccgatgtcattcgtcaacgttgcaaagagaaccgagactgggctttcgcttgacagccacacttaaggggtgagacggcacgacaacgccctcaagaggggaatgacccttgaacgtcatcgttgctggtccgcccaaggccgtattaggttttcacctgccgtccatcgcctgccgatctaacactaatgcaccattgctccaccgccatctaaacctcagccggcgcacgggcaccattgcacaatgcgccccgccggctaatctccacgtgatgtcacctcattgggctctgcctcgactggcctcacctcccgctgcgcaggccaccgcgccggccaccaccaccacgcgcggccgaccttgtcatgccgcaccagcacacacttcgtctcgccgtcgatgacgccacgcccgcactgccgtagcctagatccgacgacacgcttcggccgcgggaaggcgggggagaggagggaagggtggtgtcggcgggggctagggttcgtccccagttgcccgcgcgaggacgacaggaagcgctttcacacagcaagtaacatctaaatcagttctgagtacttcttcgaaacgcaagatttaagaaaacaaataaataagagaaaaaaggactcacaaaagttcaagggcaaaacagataatcgtcaaaagataaaaatataagatttgattataccgcaagaaaaacgtatgaattagataagagatagacacatatggaacttctcataagattaaacaaaaatcctctacaacttgtatgaattgagacatccttataattttcatagattcaatagtttttaatcatttatttcaaaggaccatataaaaaaatatagattagaattctatcaaatttaaaatttaaaactttcaaagttgcttatatgctacatgctacaagtcaaaagatagaaaaagccattatccctactagagcccagatactagcaccatcaaagaggcaaacccaaagaattcaatacttggccctctgttaaataatcagaacaaaatgaactgaggtagatttgccatttttctcaaccgagcaaggtataggaactgaacaagaccggcatatgggaccggcattgaacatgagaaatggtggctactgcaagtaccacagttcctaccagtaaataacacccacgtcctgcaatccgccatcctactacacacgcacacgagcaagaagtaatactatgccactaaccgttacagtgtttgcccgagactcaacaagtacacaccataacacacaagctagccaccatttatgcccagaagcttgagtagacgtgcacttattatctcggctagtgctagtagaaacttaagctgaacaggactctgagtctgcgacatggtgaggtaataaattgaacacaggagggaacagcatccacttcatagatgaatttcagatgcgagtgatttgcctcggctgaggcatccaatgagcaagaaaacgaccgagagctcatcagattcccagaggcgttagcgggatttgtgttgcaaaatgagcatcccccagggctctcttcccatacaaaatgaatcacatcaaaacttcgccacttcagatctggcgggtgttgtaggacttgcacttctggcacttgtgcgcaatcaaatggaactgcacctctgatgttgccccacaatcgttgcacaatatgcgcaccttcagggtaatgcaaaggaaccaaattagcaagtgtcaacaaactcaacatttggatgaaattcaggcagctaagactcagatttctgacatgaggcaaatacaatt

SEQ ID NO: 78788 - DNA, 604 bp, Oryza sativa
ccgtgcattaaaacagagtaaattgccctttgccctttgaaccgggagacggcagtaatatagctggtttcattttactaggtttgcatcatattacattattattgaacacgaggattgtaaaatatgagtaaaacatactgagcttcttaaatttagaccatatttcacaacatgtttttctttgattttatgaaattttataggcttgatgatgcatcccgatgttaagtgaaatttattttaaaataacttggtgtaaagtgaaagtataagcaaccccctgcaatattacttttgacatgtcgatggtgccacttgctcaagggcctacatgtcagtgattcctaccgcaggagcggtgccacatagcaattgagtccatgtaaaaacaagtgaaacacgatgcaatttacatagtgcaaagtacaatttactcttaagaataatgaagatgatgccatccacatgaagaaatttcttgttggccttgcatttctctgcactgcattaaacaaacaaacgatcgggtcatatagatctcggatagtaatagtacccttgatggtcatagagagtaggtgcacggtgcacccaaattaag

SEQ ID NO: 78789 - DNA, 537 bp, Oryza sativa
aaatagtgtgtagtcccggttcgtatctcccctttagtcccgggtgtccgaccgggactatgtatctgggactaaagatagcgatctttagtcccgagtgatataaccgggactaaagatctatcttttgtcgcggttggtctcgcgcgccgggactaaagatcggtcacacacgtggcgggctgatccatctttatctggggctaaagatctatgtacctctctttttttttcacacgcccccgtttgatgcatgtatatatatatatatatatatatatatatatatatatatatatatatatatatatatatatatatatatatatatatatatatatatatatatatatatatatatatatgcgtatgtatatatgtataaatacatatattacacacatatttataatttaaagcacttaacatttaacattttatgtacatatatattaccaaaatatatattaacactaaagtaaatgtacgtacatatatatacatatatatatatatacatatagggcgtgcaggaat

SEQ ID NO: 78790 - DNA, 603 bp, Oryza sativa
cataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctcc

SEQ ID NO: 78791 - DNA, 723 bp, Oryza sativa
ctagattacaaacgatacgtcatcggcacatgtacgatcggctatcgtttatgaatttaactgtgtgtctttctttgtttattgttggttgcaggatcaaaccaactagcatgcctttgaactcgaaaccaagatttggacctgcactagagttaagcagatatctcaggccagtgtgtgtttttcgcatcaacatgcttttggcacgcccggtgggacacgagtgtgacaagcttccatcatggtggacatcaagtctaccgaggtggatccagacaatgtgattccaataaccatggacatgctaacatcagaacagaagcaagggtttgaagggatgataaatcaactgcaaaatcggtacttacattcatttgttctgactcgttcgggtacagtaattcaaagacacaaggtggatttgccaccggttgatgagaagcctcctttggggaaaaggtgttttcccaaaaaaaaggctctgtaatgatgataacttaagaagtcaaagctgaagactcaaacgggaggatgatggtgctccagagttcaacaatctacaagatcgatcagtgtggtcgtgacactgaaattttgatttaaaatttgattccattttgctctgaaaaattcaatttgaataattgccacaaaattcaaacctaaatgcaatttctttaaaaaaattcaaacatgctttgttgcagaaatcaaattgatgaa

SEQ ID NO: 78792 - DNA, 658 bp, Oryza sativa
atctcacttgtagcatccaagttatattgcgtgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgacgggtcgtaagttacaacccgtcagagatgactcatctaccacggacaggtgggtactatgcgacagtggtgacttacgtgtcacgggagactggcatcaaccaccactaaataatgactataaccaacccagatgggtgatatgggacgggcgcgtcatacatgacctgtgacggcgtcatgacaaaccactcttctctgccctagacctgctcctgtactagagcgggaccttgcatgccagacatgacctgcccctggacatcgacatgcgctcttaggacgccatcggcaagctagaggtctaccaccataccttggatgccccccatctcatacccgtggacgcggacgagcacgctcatgacaacgccgaagacctacttgcgctacaccatgtacacgacgtgcgtaacctggccgcacgagctcatcatgagcgcctggacggtaaggaggaagatcctgtcgccatatcgctccacgtcccgccg

SEQ ID NO: 78793 - DNA, 713 bp, Oryza sativa
cgtctcgaccagtgtggcggaggtgtccttcgcgacggccgcggcgagggcgtgcgatggcaggagcagcaggaagacgacgatcgtcagcgccacccgagtcagagtccccaccctcccggtgccgaggacggcgcccatgaatgaaagtcgtcgccttgctttgcttcgtctcactatcgaaattgtcttctttgctttcacgagttcttctgatctcagatgttctttgcttcttgcattggtgctgcgtctgcgagggtgtgttcctttatagccgtggccactgcagatcacgtccagtttcggacgccgattccgattggtgtcatggaactgaacactgaagccggccgactcggagttagcaagattaatgcggtcgacgtaattagaccattaatctgcggattcggaatcggcatttttatgggggtgacgtaatcaacccgtttaatatcctggacctaattagctcatccacgtaaattcagccgatctaagtgcttgcttggacctggaaacattatacactcgccaaacttccgcacccgtattttttctgtgctccaagggccttcctgggatcgtggaaattttatacgcgcgcaaaacctttacgcccgtattttttgtgcaacaagaaaacatgtaaaacaaaaataaatattttttggtaaatattgttttctttcggaatacatggtagactc

SEQ ID NO: 78794 - DNA, 1117 bp, Oryza sativa
ccagcatgcatctcactgtgagatgggcaaccgagcaaggaggaggccaggagggagtggcgacgaggaaaacgagcagcggaaggtcggaggcagccggcgtgctccctccctctgtccctggcatcctccctcctccactccccacgagcccatccatggcgaggtgcatgcagcagcgcgggagaaactacgacgagcggcggcgcggcatcagatagggcagcgcgggagaagctgtgacgagcacgagacaagctgttggatcttgaactcgtgctcgccggcgacgaattcaccggtgctcgggagtgcggctacagagggggacctgggggaggggggaggggggatctggaggtcaccagttcttggaagggcgatgcagagggggagatcaagctcaccggcgctcgggggtgcggcaatagaggaggagctcaagctcaccaccggtcactcggggacgagagaaaggaaagaaagagctcaccgccggctgcactgtgtggggtaagagagaaggaggagaggaagagaggaggaagaagaagatgacgtggaattatttgacaggtgtcatcctacgatacgtcctcgtgtagcaaaaccacggtaaaacagcttgaggggataaaatgtccggtattgatagttagggggtgtattatatccggttttgtagttcgagggtttattttagacgaatataagaattcgggggtgtaaaatggacttatcccgtctgcaaagctagcctataaaaccgggggctcctagctagcgcgtgctcggctgctcgctgctatcgagcactcctcccatattaactacctctattaaaactattagttaatatacttaactacctttattagtatttagtaatgatagtaattaggaaagattgtggagatttttttactaacaaattgaaaaaattttaagttaaatttgaaaactttcgatttaaattttaaattagattaaaaaactttcgatttaaattttaaagtcaaattttgaaaactttcaacttaaatttgaaaactttcaacttagatcgaaaacttttaactcgagattcgaaactttcaagtccagatttgaaaaattt

SEQ ID NO: 78795 - DNA, 1555 bp, Oryza sativa
gcctccctttatttattatccttatcggtaatctatcctttttatcgatctctctcaccgtctctctctctctctctcgcacgcgcgcggcggcagctcgaaagagggatcagcggcgcaagaggggaggcggcgggtgacgggcggcggcggcgcacctcgccgacgggtggctgcagcaccctcccctccgcgggatccggcgggaggggaggcggcgctctcccctccaccggatctggcgagaggggaggcggcgggcggcggcggcaccctcccctccgccggatctggcgggaggggaggcaacgagtggcgacagaagaggggctcgccagcgacgaagcggatggtggagcatgaagagggctctcctccctcgtctcttgtagatttattttagatgttttggtcgatttgtggattagagtatgttcattctgtgatgtcaattgattttggtagcgatttgtggatgatttggggatttggggattttaaattgatttcggagcaactcgggcgatgacgcagtaacagtgctcagttgagtttggctcaattcgagctgagccggtcccttttttttttttggcttgagcaaagctaaaggtgtcggttttattttcttcataggtgccggttgctactattggtgccgaccaataggtgtcggttgggaaaccggcacctatagccgattcccaaccggcacctatggccctttctgtagtagtgcctgcttcttcagccagtctctaaggtaagaaatcgaagtagcgcaccatcatcgatgtcggtaaggatggcggaggccagccgcgatgatgtcaacggccacggaatgaggatggccgagagctttccacgacgacgagtgagagcttctcgaggccttgtggtggcgaatctgcatgctcgaggcccaaagacggcagatccacctgcgtcaagctcggcggcggtggatctagattcccaaggccctatggttgcaaacctgatgctcctgaggccggtgacggcggattcaagctgtggaggtcacatcgctgtcatcacgatcgtggtcacagtcgtcatcactattgtcgttgtggtggtggtcacggtcatcgttgcaggcccaattgatgtccctttgactcctaaggcccaccaactacgggcgtggtcgatgacggcagtgggcaggagcggagcgttggctgtgataggtaggtacggaggaggaaggccaggagagggaggacttgggggaggagatggggatgggggagagtctgctcgctcgggtgggaaggaggtggagtaggtggtgagagagccaagggagaaggagagatggaaaactttggctctctatgtgtcaaatttaatagtgcccccatattttgtatgccggtctttttaacccgcccataaaaatcgatttttagaggcggggttaaatctacgggcttcccgctatttatacaagtgataacaagaagtaatattttaagtccacctgaaaaataaataaaacgtatgtatcggccaaattgttttttat

SEQ ID NO: 78796 - DNA, 562 bp, Oryza sativa
aaaataaatttatctttaaataattattgtattggagtttgtcaaagtaaaaaataattatattagaaatagataaagtgatttatagttgcgttaagatttatgcgatgggtgaaaaataaaattattttactactaaatcaaattctaaaagaaggcagtctttgcaaaaaatcgacagttttcgacgaaatatttgaaaaattccaaactagtcgtaacttgacttccgggcgaatactcctacatttccatggatcccgcagcccacaggccgagaatccgggcccacgatcgatacggccctgcgggtggggcccaccgctggcgcccgaaacgctgtgcgcggcaaaaaaaaaaaaaaaaaaaccaaaaacccaaccgctgcacggttctctcccgatccgacggccaggatggatccccagcccccacgccctccaacgccacgttaccgatccgcgtactcgcgtctcattggccgcgccctcctatataatcccctctggtccccacccccacctccaacctaccaagccgaatactgattgctcgctcgctc

SEQ ID NO: 78797 - DNA, 939 bp, Oryza sativa
catataaagcagggatcatatgctgagtcagtaacccctgtttactggcagcagcagcagtgtatggtaagctggagtctaatactatcagcatgtgggtgttgtaagcagttgctgaacaaaatcagttaggtggaaattttgtacacttactgaatactcgtgtcagagttcagataactttcttgtagaattttgtatcttctactactgcccattcaacttaaacgttgaaataatctatgcttgccaggatacgtggtaatgtgctacggagctatgccgtttttatgctgatttctgtttcgctgctatattttgttaccaattcaggctacaattcttacaaccaagaagaatgcttgacaagttacagatggcaacaccccaattaaattgttagtttggaccagcgatgtgcatatgcaagcgaatgctgctgggctagcatcgccccgatgaaattgtttctttggtttgacagtttttccttctctaaacttgtgatgtgaaatgatgcttctgaatatgaatgaattatgcgatgattttgttcagaacttttggatttctcccttgttttctgataatcgcgcctgcttggagatttagccgtcaacaacaactcaagattgaatcatacgtaagtgcttgctgatacaatatcaacatggagggtacattgccggttccatatgaacaaacataaaaacaccgaaaccccatatggccattatgccgatcctagcctagcttggcgaggacatcgccaagagcagatttggtcaacgtgtagtacttctccgcctcttcggggctcttgatcttggctgcatggtcaagctgcacaaatcacaaagggggattcttgtcaacaactcagctgagcaacagtaatactttttccgtgttcatttcatattataaattgtttgtcta

SEQ ID NO: 78798 - DNA, 677 bp, Oryza sativa
cgataaagctaagtcatcatttattttattctttatatgatatttttccttttcctctgcctcactacaccaattggccttccattgagtagtgagtcgggggctacagatgttatatcatatttttcataacatttatcttgattgcttgcgacataatctgagtacaaaagtacctatcgagttatggagttctatcttcctatgctttccgtttggtttgccaatggatggttgcctttgggtcgattcctagcacccgggggttcgttggatggaccgagtaacgcaaggtgctaagtattattcggaataaatcaaaagcatagagatgagataaatttattttctgctcttaataattgcaaaagtacctaagtagtaaattctgatccgtgaaactttgttccgtgatactactcatcctatatgtttgttctgcaggatccaaatccaaatatgcataaaagggattcatggctttaagcttatctcttacgctccaggaatggatcagtcagaacatcaccaccggctcgccgtcgtcgccgccgactggagtcttcacctatacggttggttggaaacaccaccgttgttgggcgtctacgtctttaccgactggccgcttcgtccaccgccgactggtgtcttcgcctatacggatggttggttac

SEQ ID NO: 78799 - DNA, 588 bp, Oryza sativa
cttgctacaagatgaaatagaaatatccttattcttgatctgtataaattcaagaactatagaaaaaggatttctgtccacattctggtcagtaaatacttatggctaatggctagtcctaatcacaggtttgtcatcagaaatgaacatgcctactatattccctaggtggaaatatggatctttttccccatttcagaagataggtttgaaatacaaagtatactatatggacaaaacattactggagaaacaattgttacagcgaagaattcaattaccttggccccaagagccgccatgatactatcagcagcccatggcatgttgttgatccaaaccaacacaaatggaccatcaagggatcataactctgaaccttaaaactcaacagaaagaccttgataagaacacaaatactttccatttagtttttgacattttacagtgcaattcttgagttggttaatggcatattcatatgccttgctgcctggggcagcaattaaaaaaagacttccataatattttctcagtttggactgaagacatcattttcctacaaatatgccgatattcttgaacttc

SEQ ID NO: 78800 - DNA, 658 bp, Oryza sativa
cccctgacttcgttttatccattaaaaatttgaatttcaaaacttcaaataatattgtgaagcagtaaataatttcagttgaaaaagtcatcaccaacaaaagttgtataacttatcaagatctataacttttattttggtcatttcttcatccgacaaagtgatagtaacattttcacaaaatttacatatctctcttatagtttagaaaaccatataagagatatgtaaattgtgtgaactatgttattatcactttgtcggatgaagaaatgactaaaataaaagttaaagatcttgatgagttatataactttgttgttgatgactttttcagctgaaatcatttattatttcaaaatcttgtttgaagtagtcctaatttgaaattcaaattcaaattgttgaaacacagtcatatagaaaaatgttcaaaacgaaagttgtagatcttgataagttatacaactttgctattgataattttttcatttgaaatcatttactacccaaaaaattgtttaaatttcttatattttaaaatttaaattttacatagttcaatcaatctcggatggagaaataaccaaaagaaaattggtagatctcaatgaattctataactttgtttttgacaattttttcacatgaattgtga

SEQ ID NO: 78801 - DNA, 8136 bp, Oryza sativa
tagttcttccattaatctatttctattgcttacagatcactcgcgctccctcggctgctgcggccgttttttaaatcgattggcgacggcacggcatggcggcgtgctaacagatccacccacgtatcagatcaaagcagagatgatcgcggcgtttcttcatccaagcgcagccgagtagccaatccgttgcactagtcagcgtgcttcgtcccttggtcgtttccaggcgacggtgccagctgctatcggtgccacgccatgctgatggcgatgaagtcgacgatgcactattttctgggatagatactactttttcctcctccttttttcaaacaactatactcctttttccatcaatgataaaagtagtatcataacatactgcttttgttttgaatatatatactatctttttttttgcgggggaatatgtatactatcaatttcatctagtatacttcattttatggctcattatataaaccattcggtgaaaccaagtgatataaatactattttcttaattatttaataagtaccactcggtgaagtattatgtacttcattaattattttgctaataatctaataaaaaggtgcatccatacataccttctatcgacgatcgatgtactacaatactgcatactaggtgccattaaaaaatagtatatactgcttcaatgaggatttcagtatatgctggatacttttaaaaaacagtacatactcattaactaaaaaagacagtacatacttctcattaaccgattgatttagtatatactggaaactaaaaaagacacaacatatttctcattaaccgattgatttagtatatactggaaactaaaaaagacagtacatacttcttaaccgactgagttagtatatactggatacatgataaaaacagtacgtacacctaattaaccgatcgagtactggatacttagaaaagagcagtacatactcatttcaatagatcagtatactaacgttaaagtaaagaaggttatatactgatactaaataataaaaagtatgcattcctacataaaaaatagtatacatatactgtactacctccaaacaaagttgtatatatgtactgctacaactatttaaaaggtactccagtatatacggcaactactactacgtaaactagtatatatactgctacgcattgcttaattttttgacggtgaaaaagtgctgatacagttcattctgaattctcagtatatactcagtgacgacactgttaatttatgaatctcatcagtgacatatactactttttaaacagtacacgaggaaaaacaagtatatacttgcccgctacctcaactatatcaaaatttgaacctaacgtatgtccgtatgtaccggcctaactgcatgcatccagaattcgaaaaatacaaaagtgaacggtaatttattttcccatttaatttaattatttattatcaactaatggatatccactaagaagagggagtacatacacctgggagtacaaaagagtcgtcctatatatatatatatgtatatatatgtatatatatatgtatatatgtatatatatgtatatatatatgtatatatatgtatatatatatgtatatatatgtatatatatatatatatgtatatatatatgtatatatatgtatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaggtaattgaaaaagtttcatactcatttgaattgggtatatactcaatttcaacaatggtgcccgggcaccatggagcaccaaacaaatttactatatatatatgtgtgtgtgtacctgtccccacctcacatgaaggtttcgggtctcaacccactaacggttggagagaaaatatccacaaatccacttttcttgaaaaattggatcactgcgctatatgttctgcatgctgaggcatttgaatgttgtgcatgcatggcttgttgatccgcacgcatgcaaggccgtgcgaccaggagagtagtttgtgtggaggttgctacggagactccatataagtttacggtgatgtagggtagaagaggagtgagcagaagcatcctttggagttgtgagcaagcagatcatttctgcagatatttgatggagcagaaaccctccggtggaaagggcaaaacatcgtcggcgagttctgttccgtcgccttctgcggtgccagaagacgtcaacgcgtgatgtcgagcggcagaagacggtggtagccgtacgcgcatcgtcgcctgtgagttctagcaagcagcacaatccggcggaggcagaagtcggaaccacttcagctaatggtgtcatgcagcagaaacctgcccgcagattggtacatatcggagattattttttgtttatgttctgttgaaaatttttctcttgtttgtttgtttgtttggttctgactatttggtgcgttctttggtcaggaatgattttgtgcattgcatggatactgctgcccggagtaaagagatgaatcactctctccagaaatatgacattcatttggatggatgtcatcctcttcccatgagaaatcctaggaatagatagatgcgcttggtgttcacttcatgatattcgtgcagcttacaacatgaatttcagaagcagcgaaagacctcggcgcagcagtaatggttgcgaacatgtgtccaaggagaacatgtagccagtagtgaaatgatcagaaaatttgtaatatacctcaaaataaaatagcagaacatcaattgaaagaaatcccaggaaaaaaaaattgcatctcaacaagaaaatctactgcttctggccggcagaaaatatatgttagctggtcaatttaaaaaactggcagaacgtcagctaaagaaattggcagaacatcatcgccgttaaaaaattgttggcagaacaaccacctaatttttctctatacccagtttttaatagcagtacatattctgcctattgcaagctaacagaagtacatattctgcctattgaaagataatggaagaaaatcttctgctcagaatttaatcacaaccgcataaaagaagtatgcaagttcgtgtaacagaaagctaattaagcttccgttccaaaatcaacggataggatagcagaatagagtctgtgagctgtgaaaggagcagaacatcggatggaaatggagcagaagattaaattcaaagaagaaccttcagctcctgctcctgcaactgaatcccatcatgtaatatgtgtcagtgtgaacgcaaaatatgatcttgcggctaaacctaaagtcggcaaagagatattttgtttagggcgatcgctacagtgatcgatctctcatgaacatccctgatcgggggataaccgccatatcctagtgtcggttccccctgtgtgcagtggctataaatagaaatcgatacttaagtgcaaaccctaagattcgattgctacccgatcaagcaaaacccactgagaacacggggaagaaccgaaacacatctctctctgtgcttccaaacaagagagaaagagagaagaacaaagacagagaatgggaacctctggagatcaaggtatgactcaatcccatttcaatttgtagttccactttgtgccaaaccgatccaaaacaatccaacaatggtatcagagccaggtttggcctcaaattggaactcaataagtgtttatgttcaagttgttcttcgttttcatgcccaaatccctctgttaaagttgaattgagccaaaatcatgcaatcccaaagcataagaaatggaattaggccttctagggtttcggcttgaagaaattagaagaaggggaaggaaaatttcatgcaaatctcagacaaatccctaagaaccgaaaccctagctgaagtaagaccccaaaaattccccaaatcatggaaccctaaccctaaaatcatggggaaaaggagcgcggcgggcttacctaagggcatggtggccggcggcgacctccgtgtcgccaccgacgcaataagaggcgagcgcgcgcccgaggacttggtccccgagcggcctcgcgacccgccgtgctggcccggctcctcctctttgcgtgctcgtctcgctgacgccgcttcgctgaggtagccgtcgccgcctcgtctcgccgtcgccgccgcggatcttcctcgcgcgagcgaccggcgggtgcttagggcaccgtcgagcaacgctcgacggggatgcgcgccagctatggcggcacgcagccccggcgagcaaggctcggcggcgccatctccaccccgtcgtgcgccgcttcgccgtcgtctcgctcaccgtcgccgcgggcgtgagagaaagaggggaggagagaatggggctagggttttcgcggggggcggccgcgcgccggttttgtcccgcgcgggagcgatcccggccgtccgatgagatggacggctcggatcggctcgctcccgacgcgggctgacgaggccgtgcgggaggcggcaaacgccggcccaggcccaggttgatgggcctggagcccaggcggaaggcggcgcggcaatgacgggccaggccgagtgcggcctggctcgagaaagtggcccagttcaattttgtgtggctgcatagtaacgggctgcatggtaatgggcctaattaaagattgggctaagataatattacaattaattttttccttttaaagaattatgattatgatcattgtgtttaaacattaaagatattttattatgttttaattaatgataataagaataataagtgactttgttatgtgataaaattatctttcatttatttattttatgatagttacattatatttattacttaaagttattattgttttatgcattatgagtttatttccgctacaaataaatattataattaagtgtgacaaataattgtcattctggccaaagctgattgacttttatttgatcacaaaattttattaattcaattcaaatctggccaaagctgttttgattgaattaataaaaggagttttaaacaaattgataaagtgtggtttgtatttattattctggccaaagctgattaataaatacttattcacaaaattttattgttcatttgcttctctggccaaagccgttttggatttgatcaataaaagaaggtacttatttagctgctgataatgggcaatattcagggatttgatcaatattcacaaattgccggaataatgggcaatattgaacaacttaatggaagtaattatgcttcatggaaggagaagctggaaattactctagccctgttggatattgattatgccctccataatgatcctccggttgagcctagaccagaaaatgataattatgagacccataatgaaagatatgacttgcctgctcagaatagtccttattcttgatataattcttgatcaaccttcacctcctggaagttgcaaacgttgcctcacgactaaccgatacacaaggtctataatacgcgagaaaaaccaatattcaacaacaatcaaatatgcacaacaaaatgtactattcgtgtttgctaatggattccaatcatgctaagggctaaagtttcttaatctttctattgtcatcgtggtctatttaggagttaaccaacatagcatttatggtatacatatatatttggctaatcggtggtttagtctatcaaatggctatggaaggattatggctatatatgcatctatctaaatagcacggttacataccagaggttctgttgttagatggatttaggatcaatcaaataacgaatcatttgtattattatttaattgatggaggctttactttaattatgaacatattttacttgtcacaataaattataaaaggttaataattatccatgctttgtatgttagagttgtttaggttaatcatattatgattacagattatcccatcacataattttacaatgaataatcctaatttacagttgaactataattataattatatgaggtcaagatttataactactatttatctactattcatgtttgttatatactccccagtttaatatatgaaaaagataaattaattgtataactataatgggatatacaatatatgtgtgcaacaacgtataaggttttggtcgcctactgtacatgagcttatttagaaagtgtattactcaatgctccaagtgattcctgaatatattatagtttaattatacattagctagtttctatgagtgatattgtatatgtgatgcgacaagtttaagcactggttctattgggtttctaataagtggtaatcaatttaggcatatatatgctattctatatggtattgcatcgattaatttacttagtgattcctccacatctagctctgttattattctcctaaacaggttaaagattcatctatgtgtgtttatattttagttacataatcacaaggctacacttgatttaaataacctataagccataggtttaattatatggccgtcgaatattaaataagtagtagtattttcctatacatccattcatttgagacatcacttaaaattagtttgtgtggttgttacagtggcaagacatgttagagacaaatgttattacatctactctactgtacaatactaattctatttattagcatatttttaagttgaccataacctaatcatatgatattaattatttaataattataaatatattttatttaatagtaaattatataccattggaaagcttatgaatttagatgaatttaggttcgagtttcactcaaatcggagttaaaatgagcgagttatgctagtttaaagattcaatttcgaattaatccgagaatattgtgaaaatgcactgttcataaatgatttatttttaatcggaaacattatccaaaacccactgtggttgacatgtggaaccggtcccggttgacttagggtcaaacccaatttcgatctatatatcctaaactattttgcgggtataaatattttgttatcataagtttttaatttaatctacccgagcattatatccatataataggctagaaatttctatcgcgatctaaatattggatggaaccctaaaattatcttataatattatacgatttaatttagtctatgactaaacgattaaatgtaatatacgtctgaaattcctagtgattaaatccgaatttctaccgtgaatcgattacttatagagattacccaaaaataatctataatagtctataagaattcatctaattgtttagttattaattacatttaaattactaccgcgaattgatttcttatggaaattaccaagaataatctataataatctatgattatagtatcattttgcaaatactacactttagttaatcctataattaattccaaatattttaaatatcctaaatctcctcctaattcctatttatttcccttttcttttcctcactttctttttctttttccttcctttctttttcttttctttttctctttttctctcttctctcttttcctttccttttctctcctccctcccggcttctttctacctctctctctcggctcttgctctcccgggcggtgacggcggtgggcgcgaggtgagggggggggggagggaagacggctcaccggcggcggcggtggcggcgacgacggcgacggcggcgcagtcgcggcacggtgcggcggcggcgcggcggcacgacgacgatggtgcgtggagaaggggaagagggagaggaggagggaatggggtggggtggagaagggggg

SEQ ID NO: 78802 - DNA, 11114 bp, Oryza sativa
ggtaattttccaccggtagaactcaaatccaggttgttacttttcaacatgttcttggcattatacaaattatcagtctgggtacacaacaccttgcagcaatcaggaaatgtagaatgaccaagatattccacatcaggagaattctaaaaaaaaaagcagaaaaaaataattatagaaaaaaagtaacttaggacaatatataaatatagtcaacaagaataagaacatacagtaacatcatcaaaacgcctcttcttcacattctgaatacaatgagttctgcttgttccttcattattatttataccaattacttgaacaggtgaattgtcaagacagtgaaaagatataccaggctacaacaaataaaaaaaataagagaaagtcaaaaaataaagcatacagaaacatgacatcacaaaatctattcaagaatttttaaaaaaagaaaagacacaagccaataaaaaaggaatacctgtgatgaagaggaagtgacatatcgagggttaagatattccttttgacatgaaagtgacttagcataaccaacagcttcatcttcacaagaatcaattaaatcagggaacaatggtcctcttttgtcatcattgttgagttgagataatcttgatttaattttatttgcaacattcctaacagcagcaacagcagatacagtaggacctgaagctggcaaaataactatgataagaactaacagaatttacaaattttcgaaatagaaaatttaagataaaatctagcaaagaaaaatcacaaaccagatcgagaatgttcaaatcgtgaattggagttattagcatatccaacttcaggggttagtaagccttgatctaggcaaaaataaaaaattaacagcaacgcaaacttaagaaaataaaaaattaacaatgcatcaccaagtaccttttttaaagtttggtgaaagggaaaatctaacagcagatttagagacaataacagaatcatcatttacctaaacaagaacataaagttagaaaacttaagctaaaaaaataaattataatcataagaagcagacacatacccccaattccttatcatgagaaggtgtatggcgaaaacttgtttcattagctttactagcaacagatttattggtacctaaaaaaaataaaacatcaaagaacatataaatagaagaaaaattaaaaaatataataaaattaaaagaacatagaagaaaacttacttccattgttatgagcatcacaagggatttcattttcaacatcaattgcatagttaggctgaaacccagggttgatatcatcaaaaattaagttttcatcaggatcaccaccatctctagaaccagcatgttcacatagcaagagcataatgctgatagcaatatcttcacaagactcactgtcaacaatgtgattggcagaacaatgactaacaaccattgaataaattttctccttaatgaaagcaggtaacatggtaccaatagcagactccaatttatctctgaatgtattaattctattttcagggggtacaacctaaaacaaggaaaattttaggttgtaaagataaatgaatgataagaattaatttataaaaagaaaaacacaagtaaaaataaataaaactaattgaactgaacatgtaccttgaaataagttgtatcattgaaatccttaatgggcctaaggccaaagttttcttcatcaactttgtcaaggtcagaatacaaagtaatcatattattcttccagtgagaaattctaggaaaaccaataggaacattcttgtcaccaaactcaacataatccagataaagcacctagcaaaataaaatatgaaaaagcaaagaaaaattaattaaaaaacaataataatatggaacaaagagaatggaaaaaaaattaataacttactgcccagagaaaccagcatccacccaaggtattaaacttttggatctttttgatggaagtcatcatccattcgtacacaaattttgaccaatcatatgaccgaagctcatcaacattctcaaacacagtcaaatacttggtgctagggaccaaagaagagtttggacaaagaaaacaagccattgcaacaatcaaaaatgaagtaataacttcatcatcagagagagtttcctttcggatgaacatatcaccaaagaatctcacagatggaagagcgctcttgccaaactttgaaagaataaaagactttccagcatcacaatcagttgggaactccataccaccaataggcagacccaaaatatgatgaacacattctttattaattgcaatgactttatctttcaaaacaatttgagaagacttcacatcaacatgatttgcaatccaagaagcaaatttgtttgggacataagcattgtcaaacatcagcaaagaattaaaaccatagtcaccaataatacgcttctgatcaggagataaagaagatagaactgttgagaaatattttgttgagaatctgctatatgagggctcagtcttcgaatgaactttagatttcttatcctaaaaaacaagtgtagaagtgtgttaaaaacttatttactaaattagaatatttaaaagctaaaagagaaagaaataataattacaattacatataccagaacagtacattagcatgaataaaaacaaaaaaaaatcatagggaggtagggagtgagggggtaaccatataaagcctaagaggcaaccatatacactcatgaacagaaacatataaaatttggtcccggctgtatagcctaacatttaaaatcataatatatctgaaaccttactagtaggaaactaatccaagcaaactaacacaaaatcacacatcaaaacagatatacttgagatagcacccaatcttaatagcaccatccatgctgccatacatatgcaaaatcaaacactagaagtagaaattacagtgatttgaaattaaaattacaattgtaaattcaatgcatatagcatgtaagtgtactgtaattttagtagaaattgtctgtaaaattttggaaacctaaactaagctataagtgcagaaaccatcactactgactattattttgcaaccttacaaacctgcacagccccgaaaaaaagtttaagctcatatcatattaaaatctgctgcgtgtagaactaaaaaaaacacttgagaaaactaatccaagcaaactaacacaaatcacacatcaaaacagatatacttgagaaaaaattagacacgatgacacacaaaaaaaaacatatccataacacgtgttatggtggctatgtttgcataatactagattgaattagttacatgggaaacatgaatatgacgtcgcatgcatgaaagctaccaaggatacttaggtgcaggatatgtgaaagaaaacaaagaaggtattagtgccaaacaacgagagaagaaaaaacaaaaaactcaacaacgttggctgcactgaactgtgttgagagaatagatacgaatctgtatagtcacaactacaacctgaaaaatactcacatcttcaacataactaatagtagcctataatagcatggtagcaaggttcagagtaccgcattgtacacatggaccaaacagaacaaatataaaattttattttgcaaaaaaaaaaaacagaacaattccaatctgaaaataactatccacttcattagtactacatttcctttgaccgaattaattctccgtttcattgataagttaacacaagattataagcaacaagaaacccaataaaatagaacaaataaaatgccatgcataataaaatatgctaataaaaaaaagatacatacaatgggattgtgaaaattgacagaagaagtgtcaaccaaattctttttcacttcttgaacaatctacaaatatgaaattgagcaacccattaaacaatataaaattaaattaacacaactcaacaaaaaaatattcacataccattttcctgagcacaacagagagtaaaccatcaatttcaccatgttcaggaccttcatcaacctaaaaaaaaagaaaaataatgtaataccaaattaaaggtaaacttaaacagcataatacaataataaaaatttaaaatataacttacatcattaccaacttcataatcaacatgaaaatcttcacctccatcagaatcaacttcaatgggatttttacccaaccttgatgtttggacacgaggcatctgaaagaacaataaataaacatcagcttggacatgagttaaaatgaacaaacaatacaaacttcactttacaacaaaaatcatacataaaaaacacaatcatgtagaaacttcactttagcacaagtacaacatccagatccatttacattgacataaaaaatataatcactgtgaagctttacaaagtaatgaacacatcatgtatttgctggctaccaaatttagtaattcagtaaaaaaattcactaatacaaacataacaaaaagccatgtcatgattctgaaaaattgcttcacgcctagaatttgccactaaatcacacatcaacaagcacaaaaacagaaactggatttgctaagcaaaaagcacccctaaaatcaaaagcctcccctaaaacccccgaatccgcgcgctaaacaaccattccccaactcaaaagcaacgctctgcagcaacaaaaacaacaaaatctcagatccattccgtgaacgcttcccacagcctaggaagaacaaatctccaaacctggaaacgcaacttggcgaagcagcagcagcatcacgatttcaccgaccaaaaaacattggatgccacacaaaaacgatgagacaaactaaacaaaactacggcaaccaacgtctccggcgagctctccatcatattacatcgattcaaaaacaactaaagccgagattgaaccctaacacaatttgaatcggacctacactgaatcaaatcgaacaaaaacaactaaaaccgagattgaacccgaacacaatttgaatcggacctagactgaatgaaatcgaacaaaaaaaaatctagacactaaatctcgccagcgaccaacctctccggtgagcaaatcggacctacactgaatcaaatcgaacaaaaaaacaactaaaaccgagattgaacccgaacacaatttgaatcggacctagactgaatcaaatcgaacaaaaaaaaatctaaacactaaatctcgccagcgaccaacctctccggtgagcacgcacaccgacaagacagtcctctccggcgagcacttacaccgacgagacaaacctctccagcaagcactcactccgacgagatctctctctcgcctcgcggagaaaacgagaagagaagagaagaaaaggggaaagcgagagagagaaatgcgaggagagagcgggatcagcgaggggaaataaaaaacggctacggacaagcgcggaaatcgaaatttgcacagtgcaaagtaatcgggccagggaatccaacgcgaggccctatccacgtatgaccacgtccaccccattcctggcacaaatctcggcgcagatccaacggcaacaaaaacgggaaatagcaacaaaaaaatcacccgacagattcctagcaaaatcgtatacatggtatacaatgaatgttttggaagttgggccaaatcatgagcacgtgggctacaccgttgacttctgggccttgttgctgtccgtctcatgggctgcctcttctccagttgggccgtactggctgaggcctggagcctggagggcaatgcaaagcggtttcctgaacggtccggagccgccctgagatgcgatgggtagaatcgtggatatataataaatcgaagacccaccgattggtggactcgatccggagcgaggaggtgtcgtcgctgctgctactgcctaccatggagggctcgagtaagcttcccaccgattgttcatctctgctgcattaggctagtgttccggccggtcgccggcacctgtaacttgttcttgatatcacttttccatccgttgtctcatgccacaagaactcccataattttagagttgatttgggggttttctattttccagtatatttttaaattgctaaaataatgtatatatatttttaaaaaaattgcttatattttttttggcaaaattccgcttataacaagtataagcaataccatgaggctcaaaagttatttgaccgtaagatcttcttcactttggtggatagcaaagtgtgctcattctttctgtatgatttgagcaggctagtgtagtgctccagcaatattccttcttgttccaatgtggattatatttgattatatcagaacatttaagattaagaattcagtgatcaatcaacggtactagccaatctgctcatgagtcgccatgtttagagaaaccaataaccatactccgcaagaaaaagttccaggtgtaaaataaaagggaaaaatgttaagctcgtgtgctttagagcaagtattaagtaaagccaactatgcgcttatagctcatattagagttaacatacatggtagatgagctttaagcttatttttatttttcttcttctctctctatctctcatctatgcatttaatgtatttatcttgaattacgtgaatagttagctcttacatgggagctagctctctttattttttaaactattatacttgctcttagtttcttatttttcttctgttattatctgcagtattgatgaccatatatgacatgctgcagatgaaaaggtgcacactaagccaaggagatgataattttcaggttgataaaacattaagatattcagggccagacctcccagaggtatgtggctttatatatttcttatggaagacttatataacaagtaaattatcactatccctactctaactgggcatgtgaagttgtgaactatgcttgctaaatataaattgcgtgaacagatagtcaagtactttattgcttttttttttactgacattcatagtatgctctagtttcctcataactaatacacgatcacttatgtggcaaccataaacagaacctcttttgtttttatggggattaaaatgtaaagtttccaaaaaaaaagaaagaaaaataacatggaccaaccacttcctaggaagagttaacaaatcattgtctatcagtttggtgcagcttatttatccaagcaatgttactcagagcacctagggtagaatgttattatactccatatgttcatattgttacttagttggtgtaatggtttgtctttagagtccctaacattcaacaattatttccgtgcttgtgcaggacatttggcatcatatccattccctaatgccattgcgagatgctgcccgtgctgcttgtgtatctcgtgcatttttatgtaactggaaatgccatcccaacctcatcttcactgaggaaacactgagcttggaacaagatgcacgtcgaaagggtggtaaagcacgcgctttcgctagcaaagttgaccacattctgaaaaaccactcgggcattggtgtgaagagactcaagcttgtaatatgttattctggcaagatcaatgtaagttctctcaacagttggcttcagatagctattacaccggggattgaagaaatcacccttcttctgcctacaaaatatgagggaaggtacagttttccactctcacttctatgtaataggagtggaagctcaattcagtatattcacctcatgtattgtaacttacgtcctacggttggccttggttgcttcacaaatctgacaaagctgtttttatggtttctgtgtattacggatgacgagttagtatatcttctttccaagtcttttgctttggaggagttggatctcagatattgcagtgagataatttgcctgacaataccatgcctactagagagagtcggttgcctcactgtatttgagtgcagcaatctgcaaatgataaacagtaatgctccgaaagtttccacttttacctttagtggtgacccaatagaactctcacttggagaatcatcgcaagtgaagaagctagatatgagctgttcagatgtgcccaacttcatatattattccattaccaagcttccctatattgtgccaaatcttacaagtctcaccttatcttcagttaatgagctatacatattagatatctttgtgatggcataatcagtaatcatgcactcatctcctgggatatgattaatttttacagggtattaatacaccaacagtagctgccaaattccttcatctcaagcacctggatatttgtcttgatgcagataaggccttgcccccagaatatgactatttgtctttggtttcttttcttgatgcctctcctgttttagagaccttcatcttgtgtgtaagttatcattctttctgctgacatctatggtaaaccaatttaaagttcagttttggggattttttctggtgtgttgttcacagccacacacacactatttcacttagctacatatgcaagaaggtccccaatacaagagcatattacatcaacactccccctcaagatgggcaaaagatatcaatcatgcccatcttgttacacattgactcactctcactaggacctaatcccttggttaaacaatcagctagctgctcagaagatttaatgtattgtagtctaagagccccactatcgatcttctctttgatgaagaacctatcaatttcgatatgtttggtgcggtcatgttgaactggattgtttgcaatgttgatagcagatttgttgtcacaatgaagcaccacggtattatttctgaacaaccgtagctccaacaatagattcttcacccacaacatctcacttaaactcaatgccatggctctatactcagcttccgcggtagatcgagccactaccgcctgcttcttgcttcgccaacagacaacattgccacccacaaatacacaatatcctgatgtagatcttctatcatccacactgcttgcccaatcagcatcacaatatccttccacatccaagtgttggttctttctaaaccacaaccccttaccaggagttcctttcaagtacctcaagatcctatgaaccacctctagatgagttgttctaggatcatgcatatacctactaaccacactcaccgcataagagatatctggtctagtgtggcatagatatatcaaacgtccaaccaacctctgataagtttccctatcaactggatcacctgactgtgcactcaattggtgattcctatcaatgggagtagcacttgtacgacatccaagcattccggtttctgttaacaaatcaaggacatactttctttgagagagaactatcccctttgatgatcgagcaacctcaatcccaagaaagtatcgaagaggtccaagatccttcacctcaaaggcctctcctaatcgctgctttaagcatttgatctcttctacatcatctccagtgatcactatatcatcaacataaacagccaagatagtgatgtgtgtccccctatgtctatagaaaactgtgtgatctccattacattgtgaatatcccatattgcacaatacacgcctaaacctgtcaaaccatgcacgtggggattgtttcaaaccgtacaaggacttcttgagcctacataccttcccaacagtctggctatttccaaatccaggggggaatctccatatatacctcctcttgtaaatcaccatgtagaaaagcattcttgacatctaactgatgaagaggccatccaaagttaactgcacatgatatcaaaatcctcaccgtactcatcttagccacaggtgcaaatgtttcatcatagtcaattccatatgtttgactataaccttttgcaactaatcttgctttatatctatccactttcccttcaggggtttgcttcactgtaaatacccatttacatcccactgctcttttccccattggtagtttcacaagttcccatgtcttattcttttcaagggcacgcaactcctccttcattgcatccttccatcttggatcttgttttgcacatctccagtcctttggaataggcactatttgcaatgatgcaatgaatgctttatatgcaggtgaaatatgagagtatgagatatagtttgcaatgtcatgtctagaactaaggtgttcaaaaccaaggcgtataggaggtcttccagcattagatctagtttctctacgttgtgcaagaggtaactctacttgttcaaggtaggagaaatgttaccacttgtctcaaggagggaggaacttgttggagagaggctagaggaggaatctgggactgggtactcaaactgttgcagctgttgtgactccttgtcttgctcttgcataggctcaccacttctctccccctgattctgaatttggctcctctggtgcacttgctccttccctgtcaccttatcaacttggttcttgttccttctttgatatactctcatttcagtttgttgtacttccacacgctccagaggacatgggattgtcccgacaactaccccctcatccttgtcacaactaatgtctactaccttctcaccaatgtccacaaccttctcaatagtatcaccaacaaaactcggaattgacccaataaccacatcctcatcaccttgcttatgtgcatcaacctcaactatctcccccactcgactgtcgatctcgatgacagttgagaactcctctagaaattgatcaaggtctcctcgactcctgtaataaggttcaaactctcgaaatgttacatccatactaacaaataacctcttcccaatagggtcccaacacttataacctttctggttagatgcatagccaacaaagacacattttactgcatgaggatccaacttgccaacaaaaggtcgatgatctctcacaaaacaaacacaaccaaatacctttgggggaactttaaattctcgcttcccaagtaaaagttcagctggtgatttcataccaagtatcctggatggcatg

SEQ ID NO: 78803 - DNA, 3510 bp, Oryza sativa
tgggcatggtccccaaacatcagaatgtattaatataaaaggttcacaactacgaagaccaattccagcatatgtagaccgtgtatgtttgccaaactcacaagcatcacaaacaagtctactcttgtccactttggtaaagaggtcaggatacagcttactcaaactctcgaaagatggatgtcctaattgacaatgaagcaaaataatctccttctcagtatctcccactactacagccaatcccatctcctcttgattgatgtaccacagcccattacgcctgactccagtcccaatcctcctcccagtccccttctcctggaagagacatgaattctcatcaaatataacgatgcacttgaattgatcaatgatagaactaacagagaggaggttgactagaaaggaagggacatgcaaaacagatgacaagctaatagatggagtgcactctactgaccctataccatgaatgagttgagatgaaccatcagcaatttggatagtttcagagggagcaataggggagtatgaggagaaattattaggcaagcctgtgacatgttttgatgcacctgaatctattatccagtctacatgatgtctatatgtggatgcaagtgcatgtgcctgagtaccttcgcccgtgtgggcgtagttggcaaagttaccgaagtggctggttgttgctttagcagaattttgttgattggagtccacggggcccttattcttttgcattcctcccattgtgcagcttgttcacctgttagagtgatagatgagctctcccccatgacaacattggccctaggaccacctaggcctctacctcgacttccaccacggcctccacgttcacctcctcggccacctcggtctcctacatagccaccatagccaccacggctcccattgaagccaccatagccaccacgtgctcctccacgagctacaccccgaccattattgttcctaggagaaggacaattgtagctcacatgcccctttaacccacaattataacactccctgtcattaattgtgatgtatgcagacctcacaggattacttcctttcatcactttctgcctcatctcctcctgaaccatggctgaaatagcttcctccatattaggtaatgtagcttggtgaaacatagctgctcttctatcctcaaactccttgttcaacccctttaaaaaatgaatgactcttctcctttgcagccatttatttccaatcacaatatcatcatcatgctttaattgtaggggattataatgatcaagatctgcccataaatgttgcaactcgctggcatactcttgaactgttctcccttcttgcttcagattatctaccttgtcttgagcctcaaccatcatcataacatttccctctcctgaatacatgttgctcaatgtcttccatataattgttgcattctgaatagcttctatcatcctagcaatagatggggacaccgaagtcatcagccatgctaccactgtagaattagtggcattccacatcttccattccacactagatttatcaataggttcaacacaagtttcctccaaataatgttctacaccttttgctctcagcatcaaccttgcccttctagaccagctcaagtagtttttggtcccctccaacctcacttcatttggcattacttccaattttatctcagatggtcctatcccactcctaagacccatcatacctgtagctatgaggtcctacaacagacttttcatctcacctttagtgaaaaaagaagattctcctgccacactttccttcttcccagcctgcagtgcagcatcctcctcagcctttctttgttcttcagtaccctcggtgttcaccatcttctctgcactccaaaaaccactctcaatagatcactggtaccccacttcccttgcttccccttatcaacaatggtaggaaaaactctcctctaatcttggataaaagaaaaaaggaccaggcttcttcccctcacagaccacaagtcaaatgctcctccatccaggcagtagccaaaaaacaagcaaaaacaagagacgtaccacctccttcctagttcctgcagcaaacaatcctcctatgtcaccaagtctgcagccaagccaccatcctccttttcccttagctgagctcctcacatttcctgtgtgagcagcaggttacaacacacgcgctgcgcccgcgcggccgcgcgcagcgcgcgctcaccagcccctcaacgtggctgtgtgtagaggctggtcaggccggatgagagcaggggcgacgtgcgacgacggcagcggcgacggcggcggcgatggacggcggcggcggcgacagcaagctagggttagggctctgataccataaagttcagttttggggatttttttctggtgtgttgttcacagccacacacacactatttcacttagctacatatgcaagaaggtccccaatacaagagcatattacatcaacacaattattcaagtgccattatttttttattttatgcaggtacaacaacatgacatgaagcatgagtgtgtttctgaagatgcctcacatacgaggcaaatgcctgaacacaagcattccaaccttaagaatgtgatgatccttggcttctgcactgcaaagagcatggttgaactaacatgccatgtcctggagaatgcaacagcctggttgtttagttccagtccattagtgcagcaagcgggagcagcttgagttaccataatcgtgctggtggaactgaaaaactgaaagtgtttgatgtgtccatcagtacgtttatgtgccatttgtttggcacaagatagtaccaatatatagtcacagcaggctgcagtcatcaacagattaagatatcctgagtatttttttgtaaagaaataaatttggaacttttattcatgtagcattttcaaagcacaatgtgccatacagagtacattaacattcaaccaacattaattatttaagcatggattattcgtctatggaaatccttattcgcattgacatggtcagccgctagttcggaggaaacgtaatcgggtagaccggcgtcttgtcaggattgaagagcccaaaatgcctctcggtctcatccccgggcttctggttctcgttgaacatggcgaacacgtacgtctccagctgcccgggccgcttcggcgtcccgttcttgacgttgtcgatcacgccctggttgtgattcctcgcgttctccacgttcgccgcgaaccctcccgccgacggccacccgctctccgacacgacgacgcggacgccgggcgcgccggccttctccagcgcggcgtacacggcgtccaccatggcgctgaagaggttggtgtaggtgaggccgctgtcgttgtccctcaccgtggtgcccggctggaacgtggcgtatttgagcgggatgtctcgcgggttgtccctgtaagccaagtaggggtacacgttgac

SEQ ID NO: 78804 - DNA, 38391 bp, Oryza sativa
aaaaaatttgaataagacgagtggtcaaacgttacaagcaaaaactcaaaatcccttatattgtaggacggagggagtagtagatatcagtatatcacactttgtagtataaaatttggtatctttaagttagtaaatacctcggggtaaaaaaaaattagtgtaaaatttaggtaccttgaggaccaaaatttctcaaattactactacagtttgcatctagaaaaatactcacacagtttgcaccagaaagtagttacctgaaggtccaacaggaaccacagtgaccctggtctttcacggggctcacgatcccatcctccctccagtctttctgcagtaactaaaacaatcaggaaaaaaagtcccccaaaattcagtgctaaaacgtacaaaatgcataacctgatgggaccgattagcatgcaaggacacagacacacagtgtatggcctgatcaagcgacccaataagcatgtaacgacacactgtatggccggatcaagcgacacaataagcatgcaaggaccacagtcttgcgagtatgaatgccatactctcacaactcacaatcgcacctacaaatacgggcagaaatgctgtacactacagttcaacccctcataaaaaaagatggatgatttctatttttcagaaaactaaccaggcatagcaggctcgttgttcgtatcagtaactacatcatgtgcagaggtcacagaagaaattaagtggtcattaaaaaatgttctttacggggtatagaagccgcgaccgcgaggacacagtaacacgtggtagggacagccaatcgaatcgagcgaacgctgcagcgatgagcaaagcaaatcttgctgttccttgcaaagcccagagttcagatcagaaattaaaaccctctccgagcctgatccccagctcacgcatggcggatgatgcaagaattccccaagaagcaattcccacatgtgtgtgtgtgtggctacctaccgttactaccacgttactacagtacagagctttggcacttacggtctccgggagagcggcggcgtcgcgcatccggtggttgccggcgagcgtcgccgagcagttctgcgccgcgccgagccggctcgcctggaactcctcccagctcatgtccgcgaaacctgcaaaagcaccgcgacgggggtgtgtgagaggaggattaggaggattaggaggcgctcggctcgaggtcctacggttgatgccgaggcggtaggggaggcccctccggttggtggagcggacgagctcgaggctctcggagaagatccggaaccgccgctgcacctccgccgcgtcgccgtacctcttcccatgcctgcgcgtaggacgagatcgaacgagaggtcaggacgacgaggaagacgaatggccgcggcggcggcggcggcggcagcggcggtggggtgggattagggggaaccgaacggggggggcggcgccgacctgacggcgaagcgggcgaagcggagggcgtcgcgggtgcggccgagggcggcgatgacggttgactcgagcgcggaggcggcgtggtccgtgacggagcggatcgggttggagtcgtcgaagccggaggacgcggcggcgacggcggaggtcgcggcgacggcggcggcggcgaggaggaggataatgcggcggtgggccatctcgccggcgaaggtgacgatatttttttactggttttggtgtgagagtggacagtgggggcaggaagcttggatggatctctgggttttatatagggcttcgcagccttgctggccactggtatgacttggataactttggttgcgtctttttctgcagttttgaaaatttcagttagctatatttgaaatccgattaattagaaacatatttactttcattatcattttacaacttcttgatctacagtatcatgtacattagcattgggatcatgcatctctgctgatttttttaatcagttattactttataaaaaacaattcctagctattaatctagacatatatatatatatatatatacatacatacatacatacatacatacatatatatatatatatatatacatacatatatatatatatatatacatatatatatatatatatatatacatatatatatatatatatgtccagattcgtagttaggattgattttttttttacggaagggtatatcacatgactgcgatagaaaaatatacagtgcacaagtatgcaacaggcacgtgctaagtaagcaatgggggaacccgtggatattccccaaaattttcatgaaaaaacataatatatgtaagtatattatactgtatatatttatattcgaatgtgcctaatacttctttttcctcaacaaattcactcctgcacttctagtaaccaactgtctcaaatctcctaacactagtgtaccagatacctctatacccacctaataaatactccatccgtcccataaaaaaaccaacctagtactgaatgtgacacattctagtactggatgtgacacattcgtttttttggatggagggagtattgtcgtgttcgccactgtaagtaagtaagagtgacccaccagtaaaatcaatttttgaaacagagaatgagaggaaggaagtacgcatctgtcgaaaaaaatgatccaacaactttggaactgaaaatcctctctgatatataaaaaaggcaaataaaattggtgttggaaagtcatgttcatgcatactacctccatcgaaaaaacaaacttaaaattaaatgcgacatatcatagtacaacaaatcatatccaatccagattcagatttttgtaggacggagggagcaaggttgtgttattccctttcttttctaactcatcttcatcttttcttacgtgtatgcttttcacgctgttaaacaatttgttttttacaaaaaaaaagttttctatagaaaagttgttttagaaaatcataataatttatttttaaaacttttagactaatatttaattaatcacgtattaataggtaacgctattttccgtgcagggaggctcccgaactcggccagaaacttgtttgcttttcaagtttccatctcctcttaaaaaattaagggctgtttggatcagggactaaaattttagtctatatcacattagatgtttggacactaattagaagtattaaactgcaatactactgctagcgttctgcatctgtataggtgaacatccaaatctgcagcggaggaaaggaaaggtacccatgggccatgacgccacgggtgacgccgatcgatcgatcgagacgcacgctccgccggcgctcgctgattggcctccagcgtccagcggaagcttcagacaaacacggcgcagaccatgcaccaatgcagtgctctctgctctgatattttcgttctgaagctgagctgagtgagtagccgatgccagagcgagacgggaacccatcgcgtcgtgattggctgagcagatgagatgcagatgcggttggaagaagaagaatggctggcagtccccgatacgacagcagtatgcatggagtcatggagatccgtctcgggcacttcacttcgatctgcaagtgtccaagattgcagctccatcccaaaataaatttatttatggtttcttcgatatttgactgtccactttatttaaaaaaatataaaaaaatcagcgtaaagtattatttatgttttattatctaataacaacaaaaatattaatcatgaaaaagatttaataagatgaacggttagatgtcgaacacaaaaatctataaataaacttattttaggatggacggtgtatatgcctttgtctgtgtgcatatgtggacagtatggaccctgaattcatgcagactaacggttcattggatcggctgcatagccgtttggtctttttctcaagagtttttgaaagcatgcggatcacttttgtttgtaggtgacggtatatatgatttcgttgtggccgttcttcagaacagaggcaaaagtgtcaccgttcttcagaacaaattaattagcaaaattaaaaaaggtctgagttacctagccaaaaaatcttaagtgggctcatgttttctagtggacgtggatatatgtagtaggagaattgtagtatagtaaatttctgtttccttttttttttgaacgtctttgcgtttgatttacgagatagagtatgttgaaacattgctacctagcagtaaaactgtgcaagtactagctatcatgaacagcagtgcactaattaatctgtatgaagacatcaacaacctcattgtttccctttccgttgtttagagtttgtgtttagccgccgtagttttctaagcttcagcttttttattttgatttttcttccttccgctagcataagtcggtctggctgattgcattgtgtaactaaaactcttttcttctaatatattgacgtgcaatccttttacgcgttcacgaaaacaacctcattgtttcgcttctatatatgctgataagctaaaaatttaattttagagttcattttatgggttttttcatcgtagtttattttatagcatttgctttcgaatctctaagaacatgtatataaaaattttaccgataaattatttgttagttgctaataagccgtaggaataagcataaacataagcgaaacaatatggctgtaagcatggccgtgtctttagtactggacggtgcatacctcaaaactcactgtaacccagtgatagatgtaattttaaaatatagatggggtggcatctagtaagaggctaatctggatagccctagttggatgatggtgcaacacacataaaccatagtcaccggctcatggcaccggcacaatggagaatggcacgaacatcaagcaagttaacaacgaagatttaacagttgaacaaatgccagagtcacatagacgaggcaatgagtatagtcataaagatgagacggcgatggaggcctcttgtcaggaatcaggtatgaaaatggtagaacccaacattattaatttaaatatgatttacaaaatttttatatctagaatgtccattttattctcccggagtatttcgttggataactaaacccctgaaatattttgttctcattttactccccccctaaactattaaaaaatggttttctttaatgcttaatagtatttctcttcttggtttctctttatactacttgtatgttaagtgttgtcgaaacgacaaccgcatacgtcgaaagacgtggttactcaacagtggttgaaaaaacgaagtgtattaaattttgaatttcactcgggatccccccgttacatggccctagggggctatttatagccctattacaggttcttactactagggtttaggttatacaggggaatttacatgattacccttacgaaagggacatttacaggggtacatgatgatataggggctcatgggcccctgatgggccgtctggcgatcacctgccctattgcccctaggcttgatgggccggaaaggcttcttcggccctcgcggaggcgaacttgccaagtcgaagtcgtcttccttcggcagatagtcttcgccttgcacccttcgcctgagacgcctctggcctggcaaggcactcgtacgactcttcgcctcgcgccgttcttgctccatagccttcgccatgggtttcagcagatttggtcgaagggcctcatgccatccgccaacattaagtataatttttttaagtcataaatgacaccattatcaaagtgtcagaatattttcaaaattcttaacaaaatattaaagaggtaggttataatagatctaccaatcctaccaaatttagtttatatacgggttatatatagagagagaaaatgagaaatattgttagggagtaaggtgaaccgccttcaatagttcagaggtgtaaaatgagctaaaaattatttaaggggttaagtgctctgttaaaatagtttgagtgagtaaagtagacttttttaatgtgtatttaccaattagctatttaatttagactttaatatggtactaaaataaataaaaataaaatcaaattttatataaggcctgaatcagaaaggatcaaaatggtaccttaatactcattcggtcgtgaatttcataaataattttatccctaattgaaatacttgatgtatcggatggtttgatagtgggatgatgactaatgtgttaatctaggtatgtgaagtggcactgattgtagccggactggcaaacccacgctacccaatcaataggtgtgtccgtccctcctgtatccttcttgagaagtctgcccctgcagctgtttccttcttgagaggacaggacgagagattcagattctttcggtgaatattcacatgacaagtgcctcaagagatctttacttatatactgcctccgtttgaaaagataggaaatttctagctatatgtttagataagttacttacaaagacgctggaacaaatgaattgatcagcttaagttttgaataagttagttggcataactcaaataataaaatggattcatcagcacagagatatttatcgtgtagcaactggcagcacaccatcactcagcatctggagacgatggctgcaataacaaatagacagcgaaacggagagagactttcaaggcaaaatattgttgccttcggagtgtcaagtgtcaacatcaacctattattccccgaaaaaaaaatcagcctattatttatttgccagaaaagaaaattcaatgtgtgttttcttgagaaggaaaaacacctaaagtatcacatgcgggaccaaaaaaaaaaagataatgttgtgtgcttacgcacgagatgtgggcaggctaatgccttatgacattgatcacagctaccggatttgatttgatttgcaatagcaaaccttcttagaatatgtattcacgtgtgtcgacaaatgtaggagattccatctcggttggtactggtacatcaagaaaatgtcagatatcaatagagaacactattttactttctccagtaaacctgcatgacattagccctactagctaattcatcattcttctaattttgtaaaatattattgctacagctacgaatgatgaattataatatcatttatctgaaatgacatatttatggcatgatcgaattaaccctaaattttgtaggttaacccatgcagctttgggcttttgccccatactttgtcggctgggtcggttggtcggcctagcctacccacatcccaattcacggcccatgtaagactaactgcaggattgggcccacaaaagaacggaaatcctctctcagttccttgtgctgcggcccacctattataccgaacgaaggcgacagggccgtagccatcggccgagcagagcgggctagcgaggaagcctatgtgggccagtgaatttcggcccaactactgttgcgacctgtatggcccaggcccgtttgatgcatcgcaaccatcggttgcgaactcgcgatcctgtaagtcaaccccctgtgctggatcgtgtaccgtacttgcggtccatgtccttgcagataggttacgctgtcagtttagtcactgcaggccatgcttaccttgtggttcagatacgcccgtgtccgtgcgtgtgttaactgtcggtcactcgtttcttccgttcatccataagcatcatgtaagcaagcgtgtcacattctccaaattgagcttaatgatttcattaatcgcaagaaaaaactcgcccatcagtcataaatttaaagctcaacgcataactatctcatttcccatgtgcaagaacatttttctccccatgctctgaagtctgaacttcttctatttgcaggtgaaggcgtccaaaaaaattaataataaaattcagaagcaaaagaattgcatccaatctctgaatgactgaatccgccgtccatgcttggtatggtaagattaatcgaaaaccttaccaatccctttcacgatccacgtatccgtttgagtttttacggcgtgtgagacgcagaggtttccgtcgttttcgtctcacctaacctaatactgctgcttcagagttcagaccggacaaagattgaccgtgaaagtccagtccataggttgctaaagtatgcgttttgtgaaggtcatcagtttcgtgttctccttgtatggcggcgcgatcgatcattggcgtcattctatcttcagaactcgcgtaatccttcatcagttggtttcagtttttgccaaatgatccgtcactcgtgaaatttaccagtcacagcagtacagcacagtggtttcctgctgatcagatcattttttctagcaaacagataacttagatctcaaataacccaatctgaaattcgttcatatgaagatttaaactcaggactacttagccctcaaataattaaatctgaaattcgctcctatagagatttgaactcgggatcttagggtgctactcaggtcactgtaaccactaggcacagcagtacagctcagatcatttggaagaagaggaaatgaatcaacagtgacaacatttaattgaaaaaaaaatcagcacgaggcacaggaggaaattgaatcgattgacagtgagaacgtttaaaaattgacaaatttgcaggaggccgggcgctcgacgactgaattcgtcaatgagttatgagctcctaatcactagctctgacttgcacgctccatttgcacaactagctagttcatatgcttccggctccactaatccgctaaaagcaacagacgcgatcaagcaaagacggctgacctgggagtaaactcagcatgctgtcacgcccccgatcgcaaccagcggcgcgtgcaaatcgagccggaaaactgctgcaaggacagagacgatctcgtatatattcttttcttttgtcaatttgggcgcagggagagacacctatccatctacctgcagctgcaacttggtcagttcgttcaccacaggccggcgatctgctgtggttttcgttgtggactatgaaacttttgcacaagtcgcgtgttctgagctgactaaaaaaaaatggctcttgcatcggatattcttttttatttgtatatcatctggtcgcccaactacacgcacggcaatgctcgtaaatatcgtgaggctaatcaagctggtttcagggttaattaaccataacaagtacggttgcatcatgagcacgtgataaatcgtatataacaaattaagcagcatcaccacttgggtaagctgtttagtctctgattaattagaaaggtgcgaaaaaagatagagggaccatatactgtggccaagttgacatcttttttgcgcactgatttcgcatttctgtggttctgcatgccctaaaaagttatctcgactggagaagaagcagtctggatagctgactccattaagaacggcgagctgggtgattaaagagggattgcccagctcatgaaagcatgatgtagcatctggtcgaatggttgatccccccttgatcatcttgcttttttgctatggacctcgtgtcgtgtcaccacagtgccaaacgtgctaaattattacgagaaagcaacgcgattaattagctcgtttcgttccgagcaaggagactggctatgctactgtatgtgtgttcatcacagaagaaacatatatatgtgtgtccgtcacacacaagaaacatatatatagtccctccacagttataaataactgtcactattgatcagtacagttttaactttaaccataattcttttgaatgaatagatcatgacgtgtttttaaaatgaatagatcatgatgtgcgattgtttcatgactatattttaagatgtaacactccttgttaatatgatatacttttaacttttaattattttatacaatttttttaaaaaaaaggcggttaaagtttgaagataacagtatccggtgacaaatattttgacaatagaggaactatgtgatgtgcatacatacgtgtgggtgatttcaccagcacagttgcaagagtagtagtgcacactttgatgaacataaaagtctgaaagataatattttatttcttcttttttccatcgtaagaagccatttggcgggccagtcaacatgtacacgtcaccagagttggcaggaaaaatatctgtctattttatgaggtatctagcagctgatggtcggttgacaatgatgcatatatattggtgctaaaacttaataaactaccaatcagaaaagcgtatgctgcatgcatgtatgtactagcgaacccctagatatataaaacatattgtactagctagataagaaagaatcaaatcaaaaccgcctcaactcgaaacagggcgagagtacgtgggcgacaggaatatatccagtcctttttatccacacatcttcagaaacacagttcatcctgatatcaatatcagctgaagcacctcaggttgattagttttatggatttgatgtgttcctgggaatgtttttagtcaactccccatcaatcaaataggctaatttttttttgtcaacttatcagcctacaaggtagcaacgcaatgcatacataatgaatccatacatccagtagttgttaacaacaacgaaatactacatcagtaatactccatatgcagtatgggaaaaaagaacattaattgatctctagaagaagtagacggcctaataattaatttcttaagcctctcactccttgagcctctgttacatctatcttacgtatgcaggcaagttagaatgcggctggtcaagatggtgaatgcatatgcatcatgcatgatatattccaagtctccgtaccatttctcctgcgttaattcctcctaattactcgtaaaatcattttcaagatgatgaactggtgatgccatcctttcgtaaacttctgatgtgatttaccctctccaagaaaaactcaacgaagtctgcacatatacagtactctcttttaattatcactaccagtatgtcttaatgatccactactcaaagccttaaatttcacgccatgaaagagatttctttctccacggcgattttttggtctccacagatacagatatttcagtacccaatctgacgcgacaaagacgttatccagacgtcgtacgacgatttgtacttacacgtaagattaatctgcagatgagaggagcatatgcatcgatcggcttctcttctgaagactcttctgaaaattggatgtcacgtacatactacgtgaactgtgctgagaatattaccactcttggaagttctcctgatgcacgtatctcagattgggaataagttgagtatagaggataataagattgatgatgatttgcgaggaaatcgatcgattacctaacgcaaggcatggccaataaaccctaataaatgaacgagatcgaaaaggatgtccaagatatttgggttaggatatactgttaactactgtacataggtatggattttggggatatttttgggcgattatcttgaagaattgacagaaattagtaaggacgacggcgactaggttgatataagcgatgatgttaatcgcagtgtgagatctgaataagtaatggactgatcggcaacttggaggatcggcgaggcagacatgaagtacatatcgcggtacagaggtagctgcaagtttgtccaccgcattggttgatgactttgatctcggtgcaccacccaacgtcagaaatagactaccatgggtggagaaaaacacgttgctaattaattattcactaatgatgttcttccggaaaaattaattaactgatgatgatttcgtgaaggagttgatcgactctcggatagtcgctgaaaatcatgcgtgcataaaaagtccgagcaaatggaaagaaggaaagaaaatgaaatttatactgagcaaccgtgtcggtcatcgcctatcatcaaccacaccctgcacgtccaggtgcctcgtccctgatgcatccacctggcgagccatatctttatctagagaactattaatttacaaccctgttttgaaaaattccaaaacgagatattgtaaataaaaaaaatattggatttaaggtccatgaacaactgaacagtgattctagatgttagattctttttcacacttcccaagctcctaaataatacgttttataaaatattttttctaaagcaactgttcaacatattactagttaattcatctgtttatagtttcaaatagctataaaaataagcgtattcatcaatttcagttatcttaaatggggcctagcggtggatcctggtaataaaactttcagattttgttgtgaatttagcggagatctgttcaaatttcaaaatttctcaaggaaattcctcccaaatttaaaagcctctgtggcactcgccctagagcccaactgacccacgcgcaaaatctgcgcgctttttgtgtttgtgcgcgcgccctcatgcacgttcgctagctgcaccgcacgaccacacccccggcccgaccgcccgacccgacagcgacgacgacatcgctcggacggcgggccggacggcgccccggaggccacgtcgcccaacagcgagaccccggccgcttccaccgttccacgtgacgcgcccccgttcggcgcgcgcgccgcgagcggatgacgcatccaccgagatatcgcaagagcgattgtgaaccgcgtcgaggtctcacgctctcacacctgttgccgctgctgccgcagcgcacgcgcgcgcgcacgtacgtacgcgccggtgttgatgcggctgcggcttttttttgcctgcccttttacgccggcgcccacagcgccccgcccaccacacgtgtctccactcgctcgcctcaaactcgatcgcgcgtccgcggccacgtcgccgcggcagtggcagcgacgcccgaaccgacgaccgcgttagtacgtagtacaacgttgtcccgcaccgcgacatgtgtggtttcgttttcttttccggatggttgacccgatcctcgtcggcggccggtgtcgctgcgttgctcgtgcgatgcgacgccgacgacgccgtcggccgcttgagggattcggtgaaccgcggtggctggaggggggcgcgttacaggtgggcgtgggtacgtacgtggcgagctcttgcttctttgggaagagttgaatccctctgaattattgtgatctgccgtttcctggatcctttgtcaggcgtcagcatttgtgtttcttccgtttggccggtgcatccatctatccgtcatatccattgttggtgagagtgcaaaggttgacgtacaaatccatcaacaaatctggtcccatgcatgacgaaactgtacagtgcaaagtccagcgtgcgtgatgatcgtggctaacgtttaccataatcttttggagtgtaaccaagcatggtatgctttactgttgcaggaagacaaaaaaaaaaaaggcaaaacatgtcaccaaccaaacgtaaaattcccattaattgcactatatatgaagggttaactttttggaaaaaaaagaaatatatgtatttacacgttatatatgagggaagtagaagaagcatctagaagtggatatatacacagaaatgagtaaatgacacgaacaacgtacaatccaatccttcagggcgtgatctcaacctcatggtgataatcatttctattttaattaggacaccagatgagttgtgcaaccaagagactgaattccacgtcaggacgtttctttcatcacttgggcaagaaaaaccttgtggtttctgtcccgtttccttcagttttccccaagaagtttcaggaataaactaaataatcctctgtatcaggaagaggatagcaccgattagaataatctggtccgatgtgcacgcttcatttacaaacgtgtaagtatgcaaccgcctgaagatctttggagaaaattgaattgatcaaatggacggacaagacagctccgacacctaaacacagactgtttgggatggccccataattcaattgtctctgtagcaatcgacagcatgttctcctccctttggcctataattcatcagagaatttgtttgtggggtagttcagatacggtattgggcactcagatgcaatgtctttgggaacagaacagacgaacaattttcagtccctttcgttcagagaaggatataaaattagaaagatcctggaagcaaccaaagcagaagcatcaggttctagtagcaagtagcaagcagacgacacagagtcacagattgactgatagtatactgcacgtggacgatatacttctgtacttgcaaatgcaactcttctgtacttgatagttttggctgaagcccatgggaaaggagccaaagatctgctggaatcaaattcctctgcgctgcaactagtattaagcagcaaactagagcttctttttttttacacccaaactagagctattagtagtacttgtcctagcttctagtaatctaattagcctcctaaattcacctagggattagccttggaccattttgcaactgaagggcgtggatgactgagattgcttgtgagattattgtgatgttaacactacatcgccacgtgtcatcgtcttgttggatggggccccacctctctcgttttaacttataagccacctcggttagtatccacaaagtcaagttggagagtatcatatgcggttgtgcacaccaagcagcaagcaccaaaagttggagtctcgtaggacgtatggatggttaaccataaagctacttgaataaccaaataaaggtgcctttactaaggagagatcaaatccacggctgatgtcgtcgtgaaaaccacctgtaacaaaataagaacaatcctttttaatatttaagttattatcggtgccattcatcatcaactgtcatcagtccattcacatagaagggctcgttttaaccataatatttctcctaccgactaccagccactcatcgaacaaatccacaacacatactacgcgcgaccgctgataagatatcacggcgcggcggtttttatggagcggctcaactaactatcaaatatttatatatttttatattaagtgaagtaccaatattttctctttcttcttcttgctctcaactattgttttgaagtatgtgtagacaagttacaataaatattgattccacatacaaataaagaaaaaactaggttcaacaagtaataacgtaatagtataatagtggatagattcattcaagttcggataagcccctcacagtcctaattccatagttttaaaaatttgggtcaatttgatcagaaatgtaaacaaacaaccctggtttgaggattgccaccccaccaacaaccctctatcgtactagtctaatagaccagtattgtcttgttccatgtcccccctacttcccctgtttgcggctatcacatcaacccgcggtttttgccgcgaaccgcaatccgcccgtgcggcagccatggcgtcgcccacacttataaaagggccctgcctctccagctttccctcctcaaggctcacctcctcctcttccctctccggcatctccatctctcagctcctctgctagctcgagctgctcttcccggatcctagccacatttcttggttctgatctctctcgggttgttttgaaattttctttggttcaattgccatggccgcgcaatcttggaggtccttcatgtgctgcggcggcggcgctgccgtccacgacgacgacgactcggcgccgaggcggcggaggatcgcgcgcaggggggacagcccgaggtcgtcgtcgaggatgtcgttcacgagcctcagctcgtcggggacgctgtcgccggaggacctgtcgctgacgctgtccggctcgaacctgtacgccttcacctacgccgagctccgcgccgcgacgggcagcttctcccgcgccaactacctcggctgcggcgggttcggccccgtctacaagggcgccgtcgacgacggcctccgcccgggcctcgccgcgcaggacgtcgccgtcaagtacctcgacctggactgcggcacgcagggccacaaggagtggctggtgagtgcgaaacagagcgttcttggcaatgcaccagctcgatcgatcagatgataatcgaacacaattcagctaattgaatccacctaattgaattgcggatttgggtttgttcatgtaggccgaggtgttcttccttgggcagctgaggcacaagaacctggtgaaattgattggttactgctatgaagccgagcatcggatgctggtgtacgagtacatgagcggcgagagcttggagaagcatctcttcaaaagtgagtccttgtctttcaacttgaatcaggttgatttggtcgaatttgagagtacagtagttttttgagaccaaaaagttaaaaaaggagtacccaattccacatcttttcgtaaataaagaaagagggagtacgcaacttagaaatttgagcacgtatgggtgacatatggtcgtccacttacgatgagctgttcctgtctccctgcctttagttcctcccttttttctcccttttctcaaagtcaaggtctctaggtgagctgttatatgactcaacaaatataaaaactcatgtttcttttcaaaaaaaaaaactcatgtgtttttattaggtggtcacattttgtcaaaaaaaaaacagcttgttgaacaatgtggaggaggaaactgacttgaaacatatttatctcctgcagctgtcaatggttctcttccatggatgacaaggatgaagattgccctcggcgcggcgaaaggcctcgcattcctccatgatgccgatccgccggtgatctaccgcgatttcaaggcatccaacatcttacttgacctggtgagccaccctacaattcagttccaatgtagtgtaattgttattcatttattccaatggtagattagaacttacagttcaaagttcaaacaccacattgtcaagaaatgacacggtttctgaaatgtccctttcatttgggaacagtaagttcagttaccaacaaatggggtcagtcaggcagcacacgtcacttctggatgaatgcgaaattagtaaatgtttggggcccaaattcaaggctgccacaaacaaccttcgcaaaaaatgacttcattttttgatcgagaatttaaactttttgaccaattgaatcattccaatgaccgtgcaaaaatatccagctgcgccacacgtttctgaactatgcttgcagtggcccagttcgttatgggcaaaagccttgacttggctgattagaactttggaagatgcatgccaaacttcagaaatcctagcaatcctgccctcacatcattcacctaatcaaaaatatctagccgtcattatccacctcacccaagtagcccacggattattaatacatgaatagctttgcaagtgatatcttgatatcccacttccattcacattactaaatctcaacttgtgtgttttcaggattacaataccaagctgtccgactttggcctagctaaggatgggccccagggtgacgctacgcacgtaacgacacgtgtcatgggaacacatggatatgcagctcctgagtacatcatgacggggcatttaacagctaagagcgatgtgtatagttttggagtggtattgttggaacttctctcggggcgaaagtcagtggaccgctctcgacgcccgagagaacaaagcctggtggattgggctagaccatacctcaagtgggccgataaattgtacaaggttatggaccctgctctcgagtgccagtactcgtgccagggtgctgaggtggcggcattggtggcgtacaagtgtctgagtgagaaccctaagtccaggcccacaatgagggaggttgtcaaagccctggagcctgtgcttggcatggatgacttcttcccagttggcccatttgtcttcactgtcattgtggaggacgagaaggtggttaacatgaaggtggacatgaaggttgaggttgaggagaagaaaaacactcaccaaaaccatcaggacaggcatcgacagaagtacccagactcggcgattcacgctggcattgtgctgcatgaccgtgatggtgtcatcggaggagggtacaccggtgcgctgcgacgacaccggaggacggcgagctacaacaaggagaggggagcataggaatagaggtggggaacagagtaggagaaaaaggtcatgcatgtacatatgctggtgagggtgtggcagaatgccacatttgattgggtttagtttttggtgttgtcattttttagctttcttcttgatggtgacagtgggtgggtgtaagataatacaggaatgcaaaatagtgtgatgaaaagttaggcttggatttgcaaggattgttggatgttgtacgcaatcaaatggtctagttaaaaggatgccccatgcttctttttttttttttgccccttttcgttttcggtttatattggcaagtgtttgcaattgaaactgagaatccgaaaatataaaagaaagacagcaaactataaaatgtgataaaattgacactgtcaaaagttcttttctttgatgaagacattttcacaagacataagttgatgttgatgagtggattaacgacggcctcacatgaccccaattacccatcgtcaataacctatctaggccggggccgagggctgacacatcaacgattaatcatactgttacatcatcatttatctgaagaatttactgttcgctatctacactgaacccagttcagtctaaactacttaatttgttcgagacttcgaatcatatacagatcggtaatatcagtggaaagaagcttctattaacttattaaattaatagaagaaggagcatccacgtttgctttcatggtgtagaaatttttatattaatcggagaaaaaaaaatagagttcatatggaaataaaatttaaaaatagtacaaattcgaaattaaaaaataagaaatattgaagagcaaactagagtccatataagtaacttattaaagtgatagaaaatgagcctacacattcactctcatgatctagaaactcttatattaatcgaagaaaaaaaatagtgcccatatagaaattaaatttaaaaatagtataaattcggaattaaaaaataaggaatattagaaggggagactagagtcgtagaggtgtacaatttagagctaattaaaattcggaattttaaaaaataagaaaactaaaagtagatgttagagtccatataaaaatacaactttgaaataacaaaaattctaaattaaaaaagaaatattaaaaaagtgtctacagtccataattccatatatgaatataagttagaaataaataaaattaagaattaaaaaaaggaatattgaaagatgagtttagagtccatatagaaatacaaattataaataataaaaatttagaataaaaaagaatattgaaagaaaagtctagaatatgtataggaatttagaattaattgtaaataaaaaaattaaaagtaaagtttagagttcaatagagatacaagttagaaagaattaaaattctaaataaaaaaagaaaattgggagaagagtatacagtctacataagaaatttagaaataactgaaatttagaattaagaaaaaagaaatattagaagaagaacgtagagttcatacagtaatacaattttaaaaaataactaaaatttggaattaaaaatgaaatatcgaaagaagagggtagagtacatatagaaatcttatttataaataacataaattcggaataaagaaaaaattattagaacagagtttagagtccatattggaatgctccctccttcaaaaaatctaagacctatttcattctttggtttctccaaaaatctgagtcctatttgtagtctccatgtgctaaattaaattgatgatcggaaaccaagaaactattctactacatattggttgtatgttcattggttttgccacagggtgagtgagttaattgcttcttggttttgatgaaaaagaaataggtctcagatttttggaaggagggagtataatttagaaataaacaaaatttaggatttaaaaataaggaatatattatatctctactattataaaaattgaaatgtttttgccggtattttggtacgtcatccataaatgagtcggttttaaagttcgtttgcttttggaactacatatccgtatttgagtcggtttttaagataattcacttttagtaatacagaaggaatcatataagaaatatgtttaaaaaaactcacatgctaacttgagacgatcatccgtgtttgtgttggttacaaaatatgaaaatgtttccacggttcgtcatccgtgtttgagtcggttttaattttatgttttggttttaatctatatcttttctctactattataaaaattaaagatatttttaccggtattttggtatgtcatctgtctatgagtcggtttttaagttcatttgattttggaaatatatatccgtatttgagttggttcttaagatcgttcacttttgataatacagaaggaatcatataagaaatctgtttaaaaaaactcgcatgctaacttgagacgatcgggctcctaactgcgctcccacaatgaatttatcttaactaaaccatttaacaataataaaattaaaatatacttcacccgttgcaacgtacggatattttttctagtattattaaaaatgaatatttaaagaagggttcaaaaaaatataatttaaaaataattaaaattttaattaaataataattaataactatcacgtatatataatataatatgaatattacacattgtgattagtttggtcaagttagtatataatttaaaattatgatgctatttaatatattttaataataaaatgtgaacacatatatgctgtcatgtgagaaaaaaaatataatgatgtaagctgcccaatctacactggtcaccatactagttagcgaaaaacaaaaatttaccttcatctgctcgattccattccgaaaacagcccagacaccgttgaggtgctcgtcctggatcagggctatgtttagttcagcgcaaagtttgtattttggttgaaattggagatgatgtgattgaaaagttgtgtgtgtatgacaagttgatatgatggaaaaggactaaagtttggatcaaactttcgatctaaacacaagtcctgaacggaggcggagaagcacgactccagtggatcgcccgcgaggggcacgccgccgcgatctcccgctcctctccggcgcgatcgccggttcgccgttgcagatcgaggaggagagagaaacccaccgcgtttcgagtttcgactggggtcggagactcggagaaaagcgtggggagggtcggagggacgcacgtgacgaacattgcaggatgtagaggcccagtagagaagagcagcccaactgcccaagcgatattttaggcccattactgacggcccatactggatccaattcccgtcggcctcgttgtcgtgggccggtgtcgccgctggacttccctccgggaaagggacaacggagtccggttggaatcggatacggtttcccagtcagatcagataaaaggcagcaacaggctaatcccagggatgattagtcgatcgacagatccatccatggagagcggaggcgacgccggcgatcggcggtggccggagtcgcaggggaacgaagagaagtcacaggttcctagctccctcgatccaaacaacacggaggatgaacaccaggaggagaacaactcggaggacgaggaagaagagcaagaggaattcttgtacgaaatcgatgacgaccactatgtgccggaaacctacggcttcatgggctgcaagcacagcgacggatccatctacaggcccgactcccacccattccaccgccactaccgcctgggcgacacccgcgagactcgcctgtggcccaaaaggctgacgagtccgaccgatcgttgccgcccatgctggaacgcttgtgaggtacacgtcggctgccgcatgatgcaaatcttctccgtcaagatagcagctctgtccgccgccgccgatgacaacagcggcgctccggttcagatctacggcttcatggctgccagggacctatatgaaccactgcgtaactatgtcttcaaccgcagccgggatgatcccttcgttctgcccggccactactccgatcccgattcgctcataaaaatgtcgggccctaagcgaggcatctcgctgcaaaaccctgccttgatcgagtacgacctcaagatcaagaaaggggaggaggaaaaggatgacttgtagctcatcgacggggtgaccagcttcagcgaccttacaccattccacggggtgtatagccggcggatccatggcatccatggcaccgtagatatcagcttagcacttatccgcgatgggaaggaaggcactatacaagtcaggattctgaggctaataaatgacggcatacacctatccctctcttgcttagtccaccaaatacctgaggaaatcaagctcttcgatggcatcgttgctaagccatcatatctcggtgactttgtggttgccgcacccctacgcactgtgctaattctggatttcaagattacgccggtgggtgcggcggtggctgtcagcaaaaatgatgactccaagcatatccgtcgcttctgcaacttcaaggttaccgctcatttaggtactattgaacgaatccaccatgatttcgcaactatagatacggtgcttcagtgatcgaatttgatggagtaattcactagactagtggtgcttttgtcccctctgttcgtttcatcaattcggcatgtcatttaatcctcggaatattatctctaaaggactcatgacgaattttatcttcagcctgacaagtactatctccgtactatacaattggtcgactcacaaaatattattttagttaatccctgggattagcctgttgctgcctttttatttgatatgatgattgggaaaccgtatccgattccgtttcccggttttacaggactcgcttttattttcaattcctttgatgattggattaccacgtcagtatacttggaccaaaggcaacctgccacatcggcaaaaccgctttcaaaatcactggataagtcaatttgtatccgtttttgaagttgggagacgttatatctggttctgcggttgaagcctgagggatgtgattgaccgagggaagatataagggatgcacatagatttattcctatccacttcctgtctgtatcagggccgaatcaacagccgacacttcttggcgtcgtactttcggtccatatactagaaaataacacgcggcgttgccacgtgcaacactcgatgggccacgctatttgaccctattgagacataatgatcagtgcactgcaagttatagcaaaatactatattgcacatcatgattattgtagcagagtaaaaaacgtgaatattaagaaattgcctaataccaaataaatagaaggggtgaggctgcgaacccagatcagctagcccaccatcttgtggagctagccgaaaaacccctaggcgtttctcattgtagcagagtactaaatttaaaagattaatttatgaaactacagaacaaaacactgtggctatttatatacaaagattacttaacataagaactggaagtttgtaacactcatttgaagagtatgggttggtttggtttgagatctaaataggccttaccaaaatttgacaatgccaaattttggcaagttttgcatgactaattttggtaaggtaaagttgtgtttggattgaagccaaaatagcctaagttcactattgaaatggcctattttcttaggcatgccaaaatttggcttcaaaccaaatagacactaaacactattgaaattgtcaaatattggtaagcctaatttaggccttaaaccaaaccagccttatgtaacatattatagacatttgatctagagcttaaataatggaagattttaataaagctccatgtcaattttgcattagagtaattggcgagtaaatgagtccaagttcttgtcagtgctagatacaccaaaagtaaattggcttgtagatgagaagataacaagtgtccatcttggactctaaatagtaaaagtaggctatcttgattagagaagttatcaagtagaacgcttctttttatcctttatctgaatgaagccgtagtcagtgttttttccttcatcattttatatcactaatacatgtgattgcaggtcattgacctcgtcctcggcggtgcaggacgtgctcgccgcagaggtactggccacatcaggttccatatttactccaacgtaagaagattcgtgtcccttccggagacatcaggtggctttgcagtttttcattttactccaacgtaaaattgttttttatattttagtcctttttaagtgtgggagtgctgaaccacgccatgtcacgtgacaccgctaatcgttcgataatttgcatggatttcaatattagagatataggcctaccgtcgttgacgggccgaatttgccgggcggcgtggtgaagcaacggcggaaataaaaacattgagctcgcaaagctggctgacaggtgggaccccggctgtcctcgccgtcgcgcagcaaaagtcctcgcgaaacggcagccaattcgacctcaccctgtcagaaaaattattcagcgtgtatggctccatatcttcacggtctattggcgcttcaatggttcaacctcgtctcatagctatgaaaaatccttgaaatcatcatttctttacaggataaacaccatatatttatgaaagttcgaacttaatcaaaggcctaacaactaaaaaatacaagaaaaacaacaaccaaaaaaggatctagatcaacataagcaaccactgagacagcatgggttacgacaccgtgggcatcgacaaccctctgtacaattcttgcaagaccagacacacccacaggaacattcagggcacgacggtttcgggaggctgcagcagtgtccctcgcagcaggaaggctgcccctcgcagcaagacgactggcacttgcagcacgaaggctgccgcttgcagcatgacgactggcagctgaagcactgcgtcgtgcaggggcacttgcacaggctcgagcagcagccagcgcaggagcatttgaagatgttgaagcagctggagcaacgagggcacgagcaggagaagcagtccgcgcagcggcagcactgctcgccgcagcagccgttgcagcttggcttgcagctacagcaattggtagagcacgagccacaatcgggtttgcattgggcgcaagagcacgagccgcagccgttgcaaccgcagcttggaaggccacagccgttgcaaccgcagcttggacagccacaaccgttgcatccgcagcttggacagccacagccgttgcatccacagcttggacaggcacagcccttgcagctacagcttggaagggtgcaagtgcagcaattggggctagagcagttgcactgggacttgaagcatgaagggatcttgaagcagctgtacagggatttgaagcatgaaaagatgttgaagcaggtgcagctcggtttgcagcacgatgtatcgcagcatgagctgcagcttggacaggagcacgagcagttcggtttgcagcaagaaggggtcttgcagcaactgcagttaggtttacagcatgagcagcagtctggactacagcatgacccagcgcagcacgcactgcagtttggcttacagcatggctcgtcgcagcatgagctgcaagaacaattgaggcaccttggtcttttgcacttgggtgagcacttgcaacagtagcaaagacatgaaatgcagatacacaattttgatctgcagggaaaatattttcaccatgtaaaagctcagtttggcagtagtacagattattatgccaaagtttctacatgtaatttcagccgcaaaaaaatcaatgttaatgtaaaaaagcactagtttttccttttttagttttagataacaaagatgattacatccctggactagtttgctttttaaaatgcgtcaataatattaatgtggcatatagaaaactactgcttgtttattgacttttaacatacaaagggactagaggcactttcagactttcaattccaatagtgacgaatgcttttttttcgagggaaatagtgatgaatgttgaatccaacagaaaacattatagatatttgaatgttcttgcccctcagaacctgcgagcaaactatattggatcaaaacatacccgatccaccgaaaaagacggcaagatctgtgcctccttctctttctggaaaaggaaaaaacaatgtcaaaactcgtaaataaacagcgaacatgcttaaaatgggggaactgaaagtttagaggccatacgttggtattagtgggtcatgttttgtaccaacaaactcatttatcctgacaagtaatgtaagaggacattagcaacctgcaaaaggacataacttgtagtaatgaatacaaagtatagtccattgctcagacatttatatttgctttcactacagtcatgtgtccctcaatttgagcacacatgttcaaaacttcaaatgcgatatcggaatattacataattccaccacaaatatacaatgttaagctaacgtgataggttacttgttaaaaataatctgctttcattttttaaattgaataagaatatgtgcacatcgcatggaaagaatcggtgaaacaaatctcaggactgtgagctgtaatatggaactcaagcaaagaggacgtcatactactgttcaatatatttagttcaatataatttttttcaaattgttggaccagtgggccacaaaataataactgaggcagagttataggcaccactaggaacgttatgatgcaggtggggctgtttgataagtagctgtcaagacagcagttttaagaatttctgtaatggtacaagtacatatgcatttcaaacaagacttcaatgctggtttcctttttctttttcatcccaaggtaattttaacatatggtgatttgctaaggccctgtttagatccatttgaaatagcaaatggcaaatggcaaaagttttggtggcaaaagttttagtattgtaaaagtactagttggtgtttagatgcatcctaaacttttaccattctagcactaaagtgagagagagaaagaaagagagagtggttccaaagcactttttggcacaatttgctactatagactagcaaatgccaaatgccaaattgccaagttttgttactagtgtttagatccaaaatggcaaaaggttcttcaaaatggcaaactgccattttggaggatctaaacagggcctaagtgtgacatacaagtgcaacaagattttatacacataagtacataacacacttatacaagatttttccctgggggagaaaatgcaaccaaattttataaaacagagcataagacattagataaggacagcaataaaattaagctgacatttcatacttgacataagctcttcaaatttctaaaaacttaaaaacaaaatatctgtaatgcatgaagggcagtagtacatactctttaatgcatccagaacgagaaacgggctgagctccttcaaggaagtgaagctcatcctacaaaaggagctttgtgttagaccaatattgttctctcatgtgctagatgcaaacccatgaatttcctccttgagctagaaacaaacccacaaaagtttttctacctgttgaagtaaaatagactatgcacttaacatgagagaaatgacaaaagaaaattttgataattcagtactgcaggctgagtgaccatgcaccacaatggaaaataaaaactaaacttttgaatggagctggattctttcatgttaaaagacacagttgcagaaataaaaagtaaataaaggttgttacttgtaccaaatctgcggttaaaacttaaaacccattaatcaaagcctggagtaattgaccagtacgaacggtcccataaagattcctgctttactgtgtaagtgtaactttgatgttgcacaaaagcgagatcgggtaccaaagcagggactgaccttgcaagaaacgataaaaagatgtctaaagcgcatttgattactactacaaagaagttctctgatatctgaagagcttctgaaatctctgctccttaaaagcacagcacagtgtcaagaacaacacattcttccctccctcgttaaacacaaaatctagcaacatcaaaagcctcaaaccatggtggcagcccataacaccaacacggcaccacccatcgtgcaaagccctcatggccatgccgtctgcacgtccagtgtcgacgaagcaatggcggagatagacacgtccactgctatggctctccctgacaaggccactcaggtcagttgtccatgcccacgctcttcttttctccaacgaggagcccaaccaaacaacgacaaaggtagtacagccatggcgccacgcccaaagagggccaagcttgtctcgccagcctcggattgatggcgccgtgattcacctccgcctagaaacagtactacaagtactagaatagcactagctaccgcaattaacaacgccattactgtacacttcacagcatcctacttgcagtagcgggtagctccgtactcggccgcttgggttttgaaaaatgcgcggcgaatcggatctccttttttttaaaattaatcggtaaagtcaaaggaagacgaagcaagtagagctcgggccccgagaatttcgagcgagcgagtgtgaaagagaaacctatagagaaaaacgcagccgccgccgccgcggggcgctcaccttgaggaacgtgatctcgcggctcaggatctgcacctccagctgcatccgccgccggccgcacaggtccgggtacctcggcggcgacttgggcctcggcgcctccatcaccaccgcctcctcccccatctccacacgcagcacgccaacggccaactcagaaccacccctcgccgccttcactcatgggcattatagcagcagcagggggcgtggtgggtataaatcgccgcggcgagcggggggacaggggacagcgcgggcgcagccgtgcagcagcggggtgggggagcgagcgagcgagctggcgtacgaggcggatcgagctagcggcacggcacggcgcgcgcgcccgtgcgaggtgatgcgatgcgatgcgatgaggaggacccccatatagcagcgagcgtgagcgagaggaaggatggtggcctgcgtctgcgcgggcaataatagcagcggagatggagaggaggaggcggcgacgcggcgtgcgtggggtttggagagagaaagagagagagggaagagagagttcaacagcgagcggggggtggggttttgtgtctgtgggctttgttccactgcgacgtgggcccgagcctacgttggatacgctgtcgccgggccgtctcgagggatggatcatggctgcgtgggcccggtacttctccggtatggggccatgattccccagaccatgcaaagccgatccttcgtcccgtggtacagggatgaaatcacgcgttattttttgcacagttcaaattgcaaatcaaataggggaaataccatggactcttccagccccctttgccaatttgtttggattggcaaaaactacacacaaacacaaacagcacccccacccacgttccttgagctaaactccgggaagactgatgtgtgcaaagacagggcagtggtggtaccacagtaccactcctttcatcgcaagtttgtaccaactccgcattgactgccgcgtcctgagacggcacgtacagttgccgagcgagcgtgacggtgcctgcacgagatatatggcgatatggctatggccgcatcccgagcgcggagtacgtacgaaatgaaacagcaagggaataaattgagcagccggcagcgatggccggctttgacagggacgcgaccgaggtatgcgacgacgacgtacggctcgacgccctcccctcccccccgcgcagcggcaaccgcgagcggacaagcttccccggtgacacgtctacatcggtctcgcgtgccgggccggccccgcgcgtcagtcgtgataccgcggccgcgaccgcgatggatcgaaatgcccagtgccagcgagacgtgcagcgcggggtttggattgggggagcagggttgcggtgggccagagacggtcagcgacgcccccgtaccgtggcacgtgatggggtcgccccacgcgcgcagttacggtggagtggagtggaacgtcccgttgaaatgggtgtactagagtagccacgccgtccgatttgaaacgagttattaatgtgggcactcctctatcccttccactgccgcgctttctactactaccaccactgctgctactgcctactccgggtagagctgatagcgcgccgctgctaccccgggtagtatgcgtagtaactgtagtcacgaactggccatgcaggcagccagcgttcagttgagctcagcacgggcaggcggccaacttcccttctgcaaacagcatgcactgatgcacacatgaagatcgtataaaattgcactgcgacgacgtgccggtgtataggactagtgaatttgatgctactcctaccttaaactgggctctcagagtctcattcactgcatatgcgattcattttagctgtgtgacgggaggaacggcaggagagagtcgaggacggggggcgccaacgttcgactgtaccgtgggcctgcgacaggccggaacgtcacctgagcgctcatcggggaatctgggcccaactggagctttcccgggcccatgcgaggatggagccgtctgttcgctgggccctcgccgacgtggactggtcacaggagcgtgcaaatgggcccgtctcgcgcgcgacgacgacgccaccgaccgggaacggctcactgagagacgtgcgccggtcagggccggcagctggagctgcacgtcgcgcgcggttagcgtggcggattcacgtggactcgtgggcctcgccggtcgacgacgcccagtcacccgctaatcaccagcgcaggttttgtactagtgtacagtctcttctcttttttttttcttttcgaacggctaatttgctgtcatgcgttaggtctcctctcacaatcaccatttgatagagacggactgatcgataaatgaattgcaggactagttcagcacgctcctcatcgctcaaacagtcaaactccccgcggatttgctcgatctgttgtttcctttccatcgatggaaagctcgccgccgtgcgtctagggatctcacaccccgagagatgatggtagtagcaacatacgaggttcagccggccgggcaggcgatgggaccgggaacacacgttgtcaccagtatatgtcgctgcttttgttacccactttagtaccaagcttttccctctgcctgcgcagcggcagcgcgccggaggccggaccggcctactccagctagcaacggtgggggggcactgggtttggggctagctgtgttgtgtgtgggcgcgcgcacggtgcgacgttcacggtcggcagcggtgccgcgcttgccgtgggccgccgccgcgtgctggctagctgggctcgcagcggagcctgcctgatctagtggcagacgatgacggcagatgaaacgaagcgagaacaagtccactttgattccttctaatatgagtccacggataggatagtcccttaaaagcaatctaaactatagatctagtagtatttaaggatctctcaactgcaataacacatcaactattaaaatcattataatttaatttcctcggttgttttaaatgtggttttcgcttatgtggctagataaattggtctagccagctgagccagcttatggagcccacatgttagcagatctatatcaataggctgggtataatagctcagcaaggtcatcgaacttgttagggatgaatcggctctgcgcccttgtcagctagagactcttatcttgattatgtttctcaatacgtaggatgaatttgaacttgttttttatagtattagatgtcaacatactttatattgctaatttcccataactatttatattgaatttagaaaaaaaaaagtacacgaaggatattcccttatcatattagaacccattccccatcttattggagtggtggagttttcacagggaccatactatattggtttccatgaagaggtcaattataaagtcactaacaatgttctcagctcaattaattaaaccttcacccacactctttgactcttctaggcttactctaagaaaaagagaaagagaaagaaaagaatcagaaaagctttgccacacctcacaccttgtgtccttgtgcctcctacaaatagctcttgccattcagtttcctctcagcagcccaacagtcgtcttaaaccatccagctagaagacaacatcctcttaattccggccttaatggaggtagcactctgtgcatcctttgttgccattctgctaaccaccatgctcttcctaaaagccatctcgacgaggtgccgccgtcgaaagtataacctcccgccgggtcccaagccatggccgatcatcggcaacctaaacctcgtcggtgcgctcccacaccgttccatccacgagctctcaaggcgctacggcccactcgtatacctccggttcgggtccttccccgtcgtcgtcggctcgtccgtcgagatggccaggttcttcctcaagacgcgcgacgcggcgttcatcgaccgccccaggacggccgccggcaagcacaccgcctacaactaccgcgacatcacgtggtcaccctgcgacgcgtactggcgccaggcgcgcagggttgtcctcaccgagctcttcagcgccaggcggatcgagtcgtacgagcacatccgccgcgaggaggttcacgcgctgctccgtgatctgcactacgcgtcgtcgtctggcggccgacgagctatcgtgattaaggactacctgtccacggcgagcctgaacatgatcactcgcatggtgatgggcaagaggtacgtgcagggcgaggtggtccatgaggagccgggatcggcgcggacgacgctggcgcagttcaaggagttgctcgaagagctcttctttctcaacggcgtcttcaatgtcggcgaccagatcccgtggctcgagtggttggacctacagggctacgtcaagaggatgaagaaggtgagcaaggcgttagaccagcttctcgaacacgtcgtggacgagcacagtgagcggaggcaacgtgaggggaacgggtttgtggcaggagacatggtggacgtgctccttcgactcgccgatgattctagcctcgaggtcaaacttagtcgggacagcatcaaggcatttactcaggttagcgactgcatagcgtacatcgtagtactccctcgtccaaaagtctaggctgtttggatggtattttcagtacatgtcacatcgatcggatgcttaatactaattagatgtttaacgtattaaacgtagactattgacaaaattcattctataaccctgactaatttgtaaaataaatctattgaacctaattaatccatgataaacctatgtgatgctacagtaaacatgtgctgattggcttaaaaaatttgtcatgaaaattagctctcatttacgtaattaattttgtaagtagtttatgtttaatactccaaattagtgtctaaacatccaatgtgacagggactaaaatttagtcccggggtcaccactagtcctagcatggtttagtttccaactttttcttcaaacttctaacttttctatcacataaaaacttttccacaccacaaacttcttaacttttccatcacatctttccaatttcattcaagcttccaattttggcttgaactaaacacaccccaagactaagaatcaattaaatcactcacgttgtgacaaaaccaatgaacatgtaactaataagtactaaaatggtttcttggttctcatcaataatttaatttagcacataatgactaaaaaatagaacttagacttttagaaaaaccaaagaatgaaataagttttagacttttggaatgaggaaggacatatcaatcaaggggaatagacaattttgtcccaaatttcgtccacaggtcaatttggtggttgatttttcattttgtctaaaggagtcctccagatttgcgcaggaattaaggacaagctaatgcctaaccttatggtaaaatcccagtgaagtatattagtccctccatacttcctcaaatactccgtttcaatttacctatcacgttcaagatttgttttaagtcaaacattttgatctttaacttcaatttctacaaactcatgtagttttacatcataaaatttatacttttggattcatcatgagaatactttaatataatatataattcacatgttgttaaattatacggatttctaaatattaatggttaaagatagacatgtttgagttaattagactaaatctaaaatgataagtaatataaaatagagggaataatgaaaaggaaaagtcactccagcggtctcatctattcgttcccatcaggcttgctcaatgcaagaaggtgaacaacagtagccagtagttacatcatgttagggggggtacagcacacccaggaattatctgagatgttaattaaagtataagaacaaataagggcaaagttgaaaactcttttgttctctaatgaaatcatattagattacttccaaattactaccttcgtcccatattataaggtaataaggcatgtattttttacacggtctttaataacatactttgactattaatttactacatgttatgttctcaactatgaaattagcatcacataaaagtacttaaaaatatgaatctagtaatataacatgcataatataattagtacaattattaataaaaaaaattaccgagtttgattttctaaaaaaaacatatgtaatttggaacggaggaagtaagaattttccatgaggctaaatgttggttctagctttgctcacacatataacaaacttaaaaaggtgggaccacaggacctttctaaacctgcagatatagaattgtaggaatcattttatgaaatcccaaaagcaaaatgattacacggtaaaccttttgataggcaaaattaatcagttattctcctccaccaaaaaaaagttaattattctcccccaagaataagtcaagcaaataactggcttggaacgttggaagttcaaaagttcatactaatatgctgtgcaaatttagtatatgagttgtgaagtgtaaatgactgaaacatactacctccattttttaatagatgacgccgttgattttttctcacatgtttgaccattcgtcttattcaaaaattttatgcaaatgtataagatataaatcacacttaaagtactatgaatgataaaacaactcataacaaaataaattataattacgtaaattttttgaataagacgaatggtcaaacatgtagaaaaaagtcaacggtgtcatctattaaaaaacggagggagtatatatgaaactagaatttcttacatgcatgacgccaaaaattattggcttatatataggagtaaatatcactataggtcgccgtgcataatattttttacttcagtgcaccctttttttcatagttgacaaatactaatccatttttttgtcaaaaaatattaatccaatttgtcttcacaaccaatcaatcacatacgtggacaactgcagaaaatgcacattttttttcaaggagaacacattacaagaatataatcaaattaagatgttacctcctccgtcccaaaaaaaaaaatcaaaccctaggtctgaatctggatatacatatgtccagattcatatccagggtttgatttttttgggacagactagtaagtcgtttctgagttaactagtccaaaacggcatgtgtaggacctcattgctggcggcacggagagttcatcggagacaatcgagtgggccatctcggagctcctcaggaagcccgagatgtttgcaaaggccacagaggaattggatcgcattgtcggccatagacgttgggtcaacgagaaggacattcttgatctcccctatattgaggctattgtaaaagagaccatgcgccttcaccctatcggacctttgcttgcgccacgcctttcccgtgaggatacgtctgtgggtgggtatgacatacctacgggcacgcgtgtattcgttaatgtgtgggccattgcccgtgaccctacgctatgggacgcatcggaggagttcatgccagagagattcttgggtaagaaaattgatgtgaaagggcaagactttgagctattaccatttgggtctggtcgacggatgtgcccaggctacaaccttgggcttaaggtgatccaattgagcatagccaatctccttcatggcttcacgtggaggctcccgaaggacatggtaaaagaggatttgagcatggaggagatattcgggttatccatgccacgcaagttcccactagaggttgctgttgagcccaagctctctagtcacctctacaaaggtgattgatatatgtctctatgtcattactcatgtagctggtacataaaaagtatatgtatttctgaacaagaattctaagccctcaagagatgttctattatgtgtatgatacaaacagtcatgaaagattctaaaatatttgattatacagagtacaatgatatctacaactccagaaaatttctagtctaaactcaatatatatgaagcgggaaaaatgaaggcaatcttagttgtatgtatcattcctgccatgccaatataggtgtggcccttttttctatagaaacacggttctaacataggcgctcacaatgtgagtgtactcacccttatgaacacatagtctctacccctatgagcacctccaaaagtctaagtcagcacatcttgcgattgataaagtcaccgaagacgtctcgtttgtcaatgggtatgtcgtctaccactgaaagaataattaactgtaaatgcgagtacccatgtcaagtccaggacttgaacgtagacaatatagagaagggtgatgtgcatggcttcccttctttcctccatgtctttatgccagaatgatgaaccttccaagtttgaatgtttacagactgaacctacaatacaaccttgttgcatatgcaattaatgcaactatcatactcatgcgaatggcctatcatttggtccacaaggtatatcttttaggttttcttccacatttagagaggtatatacctctcctatttcaaaggtaaaaaaacaaatcagttgaagtaaacagaagacaagtttatgattagcaatgacatgacttctcttgttgttaggaggtacatcaaggtatatatataccacaaagtgtaagtctggaggtatataccttaaaaaaagatggaaagtcaaaaatatacttacaccatactctattagttttggtacttcctttcacaaagaggtctatattaaaaatgaagagatataagtatgggagaaacccttttatttttgtttttaggttgttgtaccatgattttttttcttgtttatcatgttaggagtatttggccttttgatggattctatgatagtgcaaactgtgtaatgattatgtacatcatagttagggcagagattctcccatcctatatttatagttgtcatgcttaacaatattacattagcatactttcggctagtatatatgaaaattaaactggaaatcaagatactaccactactggagaccccatctttcgtgggttggtaaaaaaccacaatagtcccgatttaactaaaaaccgcgactaaaaatcatttttagtcccga

SEQ ID NO: 78805 - DNA, 5091 bp, Oryza sativa
tgcactacgcgtcgtcgtctggcggccgactagctaggttaattacagactacctgtggccgagatgctcccatcctatatttctagttgtcatgcttaacaatatttcactagcatactttcgggctagtatatatgaaaattaaactggaaatcaagatactaccactactggagaaaccatctttcgtgggttggtaaaaaaccacaatagtcccgattcaactaaaaaccgggactaaaaatcatttttagtcccgatttaaaagtgcaacgagtctatatgatatttagtcccggttggtgtatctgcctcccatgtcctaactcggccacgatcttatctctctcgagaccaagcgtcttcatcttctctctcgcctctctctctctctctctctgtcctctcctctctcgcaatggggtcggcagtagtgcggggtgggcagcgggagaagaagtggcgggagatgcgacggcagccgggcccgtgccggtggcaggacaagaagccacggtagggtggggttggcggcgcctctctccgtcctctcctctctcgcagtggggttggtggcggccaggcccatgccggtggcgggagaagaagttgcggccgggctgtgtcgacggcgggagaagcagtggcggccgagctggggaggcggcggcctcgccctcccttccgccagatccggcaggaggggaggcggcggcggtggagcgactgcaaccagaccggaagaagattttttttttaggatttgcgatgaatttgtttttgagaattagtgatgtttgatctgtgatgtgaatatgtgatgtatttgtaatgttttttttaaaatttgtgatgtgatttttttgagaatttgtgatgtatttgatctgtgatttggagattatttggggatttcacgatttggggatgtagtgaaatcaatattcaagcagttaaaagcaatgaaaaaaagaaaaagaaactctataccaggactaaattaggagcactagccacctgtctctaccatcttcaccaactagaacttaaaaatagatctttagtcccggttattttaatcgggactaaagatagtcttggattcgtagtaccagtttgcaacttaggactaaaggggttgcaaaccgagaatacagaccacttgttcactggtgtttttttttgcttaatatagagtgaagaagtttgggaatctgtggattgaacgccggccttctcaggtccaggcggttacgtgttgattgatagcacacgaatcggtgcgagattacatgtatatatagcacaccataccagccgtgattatctaacaaattaacaattaactgcatcctaaatcacagccggcatagtatcctatattgttacaatacggactcaacatttcaggtagttcaacactccccctcaatctaaaccataaaggttaagattgtatctaaatacagctagctgtttctcattcaagggttttgtaaatccatctgcaacttgatcttgtgaaggaacatactctatttccaacaatttcctagatactctttcacgaacaaaatgatagtctacttctatatgcttagtacgagcatgaaacacaggattagcagagagatactttgctccaatgttatcacaccatacctttgctgtttttggtacttctatcttgatctctttcaacagagtttgcacccacatgatctcagctgtgacattagccaaagccttatattctgcttctgtacttgatcttgacactgtaggttgtttacgtgcactccaagacacaagattaggccccaaataaacagcaaagccaccagtggatctcctatcatctaagcaacctgcccaatcagcatcagagaaaccactgacaagtaaagaagaagactttcttatcttaagaccaagcccagatgtttgttgcaaatatctcagaatcctcttgactgcagcccaatgaactgtagttggagagtgtaagtactgacagactttattaactgagaaagaaatatctggcctagttagagtcaaatattgcaatgctccaactatgctcctataattggtagcatcattaggtccaagaacatctccctgatgtattgagagtttctcagttggtgacagaggcgtactcacaggtttgcacttatccatattgattcgcttcaatagatcttttacatatttttcttgagataacagaataccatcacataccctttgttgcttctattcctaggaaataatgaagctctcctaagtcctttaaggcaaaagacttattcaggtcctgcaaaagagctgtggtggcatctggcatagagctagcaacaattatatcatcaacatatataagaacaaatataatgacatcacccttgctgtagaagaacagagatgtatcagccttggaaggcatgaatcctagctcttgcagttttgtgcttagccttgagtaccatgcccttggtgcctgcttaagaccatataaagccttgtctaacttacatacatgattaatcaaggatttatcttcatatcttgggggttgtttcatataaacctcctcttccaatatcccatggagaaaagcattactgacatctagctgtcgaaggctccaacctctagagatagcaatagacaaaataattctgattgtaattgcttttaccacaggactaaaggtatcttcataatctattccatacctctgtttaaatccctttgcaaccaatctagctttatatctgtctaagctaccatcagcctttcttttaatcttatagacccacttgcaatctataatattattagctttttctgcaggaactaaatgccaggttttattacccattagtgcctcatattcagcatccatagcatttttccaatttttatcatttaatgcctcatgtaaattttctggttcaccagaagctgtaaagcaagcatatttaactgtaccatctgtgtataccttttctttgcggattccactctgtaagcgggttctaggccgaactatttctggttgatgctgctcagccacaggagagctcgcggcttcttcatgcgatgcagaggattcagagacatcatcattacctgccatcgtcgtggcagacggagactgatcactcggctcgttctcaacacgcgtgcctgaagttgctgcatgcgtgtcactaccagacctgcgcacacacaagggtgtcacagatcccggcgactgcggcgatgatggttgctgctgtgacagctgctgcgtatttgcttcatccacccagtcctctgcacctatatttcctgtatcttctgcatgctcaacagattgatcaggcatttcattaggagaattaaacatctgatcattctcaagttctcccccttgatgagacgtgtgaataatgagatcagagggcaaaagagagatctcatgacgaatacgtgcgccagcattgtcatgcaatttagaaaaaggaaatacactctcatcaaaaatgacatctctggatatatagattctaccagaagcaatgtccagacatttgtatcctttatggcggtggctatgaccaagaaatacacattgctttgaacgaaattggagcttatgtgcattataaggacgaagattaggccaacaagcacaaccaaacactctaaaggatgaatagtctggtgtttgtttgaagagacgttccaggggagactcaaactcaatgactctactaggaacccgatttataatatgagtggcagcaagaaacgcttcatcccaatatttgagcggcatactagcatatgctagaagagataggccaacttctacgatgtgcctatgttttctttcggcagagccattttgttgatgagtatgtgggcaggagacatagtgagatatacctattttctcaaaaaaggaattgagtttctggtactctcccccccagtcagtttgcatggaaataattttacgatcgaacaaacgttcaaccaaattctgaaaatcatgaaatttctgaaaaacttcagatttgttctttaaaagataaatccaagtgaacttgctataatcatcaataaaactgacataatatttcttatttccaacagaaactggagcaggaccccaaacatcagaaaacacaagttccaaaggatgactcgatatactcaaagatttagaataaggtaactgatggctcttggcctttagacatgcatcacaaaccggctctttattggactcatctagacaaggtaatttattcttgctaatgactctggagataatgggtgctgaggaatgacccaagcgactatgccatctctcaaaggatggcgtgacagcacaaactacttttgcagatgatggaggagatgcagatggaactggatagagtcctttttggcgtctccccttaagaaccgttctcctcgtggcctgatccttgatcaaaaaatgttttgagtgaatttcaagaaacacagagttatctgcagcaagcttatatgcggaaataagatttttattggcttgagggacatggagaacattattcagatgcaatgggcgagtaggggtatgaactattgaatgaccaatatgtttaatctccatacctgaaccactcgccgtgtggatttgatcatgtcctttgtagacgtctcgagcggtgagtttctccagttcccaggtgatgtggtcggtggcgccggtgtcaacataccagttggagtcccgtgcatgggtgtggatggcagcagcaactagcttgtcgtcggggacgaaatcttcatcaaatcgatgccaacagtccgctgcaacatgtccgcgtttatagcagacctggcacaatggacgattgtcatagctgcgctgctgctggttgttgccgcgtccacgacctggtgcggcgctgcgcccacgagttgcgccgcgtcctcgcccagggtttgcgccaccaccccgtgagccaccaccaccacgtccacctctgttcgccatgttcgccgtggcctgcgcctgcctcattgctaacctgttttca

SEQ ID NO: 78806 - DNA, 25462 bp, Oryza sativa
atcgatagctgtttcagccgttgaccaaggctagctctctaagcctgaggaaacctcaaccttccactactttcaccaactcattctcctccatctccctcatcttacccctaaaacttaaattgttcaaccactatcgtagtcattagactggtgttggagctccaccaacactataattggaaaattcgcctccccatcatattctttgagctcttacagtctggtctggaggtccaagagtagaagtcgactctttggccattggattgagacccactggccagggagaaggtgacttaaatttcccataatttatgttacctttaactagcaaataccttttttttaatacaagttagaaccaatgtgccgttaattgattttttaaagggtccattaatttaatttgactcgggcaatctacatgtacatgtccctttcaaatcggtttgtgctgcatcattttgcaaagagatgttagttagagctggtacaatagcaggctataagacacctataatcacgtattaagaagaaaagagaagagagagaagaaagcagatactgatcagctgcaaaacacggattccaagacgttatgtgtgataaatggtgtagtatatttttatatttaactgttgtataaatagactattagattagctataaatgatttggagttggctatacttaaacttgctcttagagtcgatcaggcgaaggcacgtacacggccatgtgcaggtcaggcagacttggtgcaagacagatatatatgtgtcccacgcactcatcacttctccagataggtttgtgctgctgcacgacaatcaagacgcatcatattgtagggctaaaattaagcaattaagctgatctgtcgacaataattagtggagctagtggttgcaaatactcctatatgcatatgggaaatttgagaaaatacatggagttattaggattttacactaaaaacctttggtaactcgagatacctaaatacctggagaatttctcccgatatatatttaaaaaacattaaagttaccctatgcatatatacttccagcttgcttgatttgcttcggataaaaggcatgcacatgttctgtgatcgatcgtgcctttgttaatccgttgctttcgtccttccagtgtcattattctgcctaattaaattaccagattcagagtagagtataatatgttgaatcgacgctatcatcggttgagaagttatcaaccccagatgagacaccatataattataagttattcatcgcgagagagaagctctttccgttctcgaacccactattgactacggcagtattactttgaccaatttttttacataatttcgttacgatgaataaaagttgcatagttatatttataagggtatatatttcaataatatatagcatatttcaagtatatataaatttttttttgctgaaaagacaagtattcaaaggttaaattcgaatagcagcggctcggttactcgataacagagggattgagtacatactatactatacatgtccatagggttgtgaatgagttgagctcgagctagctaggctacgtagctcgtcacacgaatgtatactaatttatacctaatatactagctagctcataaataaaagataaaaactacacatatgactaggcttgtgataaagctcgagctcggcacattaaaagtttgagacaagctcgaatcaaatctgagccgagctgaagctagctggagacgctcacaagcctcgagtttttttagcctcacatgtgcaggcgcgtattacactgtagtactttttataaaatcaacatagaggtagtacacatctcttttaaatagagattaaaaatattactcccttcatctacttttaatagtcatatttcatcttggcacatagaccaagaataaataattctacttatcatccatttaaatatgatactagtcattccttgtaaacaagcgattcattaatatttacatttctcaatgcccatgtagccaatcatgtgtgaaagaatggagagtcatgcattaaatccgagaaagtcattaagatgataggttgttgaattaaaatatgcctatcaaaaataaaattttcagatttggaaatatgactatcaaaagtagatggagggagtattagtgaaaaattcatgtggacataattaattggtttgtctgatcgaccaacatgtttttaatatatattttttgatcatgtagatttatttgagctcacatagtactccctttgtcttaaaacaacatccgtctcattcattcaaagtcccttatattttaaaacgggggattagtacattgagattgacaggccactgctttactgtacaccagattatttttgctacaaagtaaaggaaattaagccaaacaatttcaacgtgctaattaattagattgatatgtttcattttcatgagggacaacaggctatgtatgcatggctacacatgattccaccagaatttttattgaaatatacaaaataaagataccatattattgatgcacaccctgctagctatctttgacttttagctatcaacttgtgcacagtaatgacctcttagctaggtaactatatatatatctaaaagtagtcagctattgcagtcctatcctgtgaatcttcatctgttcgtccgtttcttcccgtgtatagcaagggaaaatcattcagcccccttcaaattgaatttcaagtaaactgtcaatgatgacatcattgagtacattattttttaaaaaaatacagatcatataaccccaccaatagttaaattagctatatgcaaccaccgttaacgttggtcatgattaacattttgtgtcttggactgccaattttaattatattaacctgacctagaccacaggtaacatgagtaggtactatgtagtatgtatacctgacctgtttgattatttgtgggagagatatatgactccattaataatgcaatatatgaatgaattattccagaacagccacgtatatatatgcttttgcctaagctagaggtagtataactaattgattatgattggagaagagtcaacttcacataacacatctctacgtcccgatcgcctaatgaagatattttttgagcttatccaagtgaccgacaactttctggctactgatcttgcatcatataaacctttgcaaaaaggcataaaaacattcaaggagaaaaatacaccacatcctaattacttcacatgcagacttgtctcgtagcatcggttgaaactcgaagattaatagtgcatgagaaataaaactacactggttaaacctcctcaattttacatatggtaaaaaataatgaactaattagctatttctctaaaacagtaatttatcctttgatgtaccatattttttttatatagaacttatatataccttcagatgctagctatctcagaataccaaaattttggtgcccacaagtactttctcaaggatcataaaatttctctaaaatttttatatgcatgcatgatgtaattaatttgtagacgttttgaccttttagttctgtttttgtgccacaaaagatctgtctaaataattaattaagcaaaagagaaagatgatcacatcatcacacatactctgactatatatactattgatgcaaaaataaagatatattctgtaggcctataccctccattattaataacaactggacccctgctgggtccaattgtaagatatactctcaccaagcataagcatattccatggaatagaacaatccaatgggattatttcaagtcactcgtagtcgacatatatcgcattctcagtactcgtcaatcgaattaaagctctattatcatataatctacttattttatcatttctttagcagatccggaccctttttcccacaccaatggacggctattacttcaactctaggcaacgaaaattttgtcaaaagatatagccgtatacattgaaatagctgccgcgatcatttcctatttttttttctttttcattttttgggggtggacggcactaattaagatcaactataactaaaattacatagtatataactcatttttgtttctttgacaggaactctcttcagaacgtattttgcagaaaatggatcaacctaattttacacaagtcaactactgcagactatctctgacaacagaaattcttatactgttgtactttaaatactaatataagacatggttaaacttgatacggtcttctaaactaatttttgtcttataatttctcatatattataaggtttgtagtaacaaaattataaccatatgaaagtaaattcaaatgtcaatccaatgatataatttttatcaagtaaaattcaattcatattgtagtagttgttggtcaaatgttttaaaggtggaatcttgaaatacgtggttggcttatattatgggatggagagagtaactttttagtcgtagaagagatgtctgtgatttaccagccatttcttggtttcaaaataaaagaagaaaccgcgtgtggctccaatttataaccaccgaacatacagtgtatgtgattatcccgtgatataaatcattcatgatgtgtccttttactagctagatctaccatactttgttgcatttagctctcgacatatcacttttgatatctctacctggcgatcaacataagccatacacatggtgacatggatatacatctcagcacgcatccatggcacatgcgtactgaattattgcccggccctagcactcaataacacacgttgtactacgagacgagcatatgtctatctggcacgatgctgagagagatggcatatgatggcaaacgatcgattaattggaatacggacgattatttagaaattggaattacatgcatggatgattgtacaattcaacactcacaagaaagaaatatgatgtatgtaggttatatatcttgattgattgttcaacttatatgtaggacatacttgcaatatccttcttgcccgattacacttgtaaaaccataaaattcattgttagtggatatatattaggaataatccgcagtccaaaacatatgagtgtagcaaaatgctacttgaaacttagtgccataatttagagtcgaacgtagctcaactagtcatgttttctttgatggaacaacctatccgagttcaagtcctatacttagatataggtgcacatatttacgactaattattctttcagtggtagacgatgaacttgtcgataacgagacgttcacagggactttgtcaatatcaagatatgtccatttagtcttcttgatgtgcccacaagggataggataagcgcgtgtgtttgtaagaaacactagttcatttgataagcttgtattttgcactcttgcatcctgatagtcccaaacataagaatagggtgttacgcaaatgaacgggccaaatctctgctcatcacaaggtgattcatgtgttccgatccagggtgcgggacatgcgcatgttggagaagatggatatgtttacaataacaaaaaaaaactatctaaccccatgcaggttatcttcatatattccagttagttccattcttagtccttactgatactatatgttgtgaagctacaccgttggaatcagcagggatcttttgttctactttggatggtatagctcctatataatatagttagtatagattatatgtgttttctagttgatatttcagttgggtgttatcaggagggagatgcggtttattccataaacttagggcccctttgtgaagcaaaggtttaagaaaatagaggaatatgaaaaacatgattctgatatgaattctactacaaaacagatgattgtaaaatataggaaaaatatataaatgattgtttgattgaatcacggaaaaaatgtaggaattagatgagagggatagactcataggaaactttccatgaggttagacctcatgttaaaaatccttcaaaacttatatggattaagacatttcttattagaaagttttcaatccatggtttcaaagggctgtatagaaaaaaaaacctacaaaataaaaatgctacaaaattccaataatacttttccttcaaatcaaaggaggtcataagtttcttatttattgtatgcctatggcagagatcgtagagataaacaattttcattattggaaagaaaatgcttaattagttgagctgctaccttcgacttcgcgcggctttatccggtgcggattcgatcctcgttcacgcaaacaaatatcccgtcccggttcatccgcacacgctctatcagcgacttgcactacactactcatctgccgacacaagacaaaaaaacccatgtggggcccacatcaacccaagtagtgtagtggtcggtgggcctgcacaccgtccattgtccgctcgcggcgtacgtgtacgtggatcggtggtactacgtctccatcgatacattttttatttttgcccaatgcccatctctctctctcaggacgaattaatcaataataataatgcagatggccatttcctttcatgattatatatattgttctctccgttctaaaatataagcatttttagtatagtaccaaatcaatcatttttaacattaattattaatagaaaaaaataaaaaaagatcaaccatgtaaaattaatattattagattttatcattaattaaactattataatatgtaactctttttatttaaaacattttatttttatagatatggttagttaaagtagcatcttaaagactacgtgaaaatctaaaaatgattatattttggaacgaagagattattaattaatccaagttaacaccggattagttactactccagtaagctagctttacgcctacggttactttagctctttaacggtggcctccgcctataaaagcaggccagtaggacgccaataagcaagcaagcaaagccacatcttattgtcacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctggtaattaactaattaattaaccactaattaattgatctaacgccgccttaattaatcaattaatttgctaagaaatcatcaagaagtaattaattaagctgattaatcgtggtgtgtagtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaacgtcgccggcggcggcgacgacctcgccgtacgtcgccggccgccgtgtcgtcgatttgtgtgtgtaataatttgtcttcttctgcatgcgtggtgttgctgtttttcacaagagtctccggcctcgaccagtgagaggctgacaggtggggccgtgagttcagcttgtgttgcttgattttctctgcagccttgccctctgtgtgtccaaataagtggtgtgcatggctctctccgtgtcatgtatcaatgtatttttatctgtactttgtacaagtgaagcaatatttatcgaaccttgactttctccattctatttgaaaaaccattaaagttgagtagattttagtgtgttaaattatatcgagaactacagaagtgctataggaatctatcagaaagataaccatctcttggggacaatcaattctccataagaggaggcaagataatcgaacaagaacgcgcatcgaaagatcaggattaattcatgtttaacgaacacaaataaaaatatcacacatatggtattcataattaaagtggttggtagttgaaattttgcactcaaattaaagattttaaagaaaaatcaaattaaagttgatagtgataagtggttgcattggaaaccacatggatccaatgttgacactgatgtaggagaatgcatttcctaaaaaaaattccttggaaaacaaatgttgtcttttttttctaaaaaaaaattgtttgtctgttggagtagtaaaatgccacaaccaaagctattttgctaaccaacaagtattacactcgcaaataaaaaaaaaagactaaggacagcaacatacgacaggtagagattttgctgagtagcaggcacaatgtaaaaaatttagtgaagagataagagcgggtgcgcatgggtaaaaatgttcacatatcaaatgggatcaacttttcttgctgtcatcttcataaacaaatcactaaatttatttttttcttaaggaaaataaagtcgcagctttttttctctactgactcatcctcttctttcccctcctccacacgcgcaatgcttacttcgcatgagtaatcaccagatgcaatgatttattttcaatcaccctcgctagtccaattcggggagcgcaatgcttacttcgcatgggtaatcaccagatgcaatgatttattttcaatcaccctcgctagtccaaatcgggggtggaaataggcgtggggcagttagggcttgagcttaatacctagctccataattctcattataatcttgaaaaatgttatgtaatatatgaaaatatttgaactcccattagctcagctttatgcatgaagattttttctaattctgccactactcctagcacttatccttaattatataaagagtgaagtacatatgtgggtggtccttaaatttgtacggagatttgtacggagtgttatgagatccataaactcccaaaatgcatttttgggactccgaacttgtcatgagtgtcgtatagatccaaacaagctccaacctgctttgtgggatgacgtggcatgccgccatgatgcttaagtgttagtggaatccatatgtcagtcacatagaaaaaataaaatttaaaaagagagggggagagagagagagaggagaaaaagatgtttttaattttgaaaaataaatgaaaaaagagtggagaaaaatatgttcttaaatttttctatatgtgaccgacatatgggttctactgacacgtagatataaccatggcatgccacgtcagcatacggagcgggttggagcccgtttgaacctatatgatagccgagacaagttaaaggaccaaaaatatattttttgagagtttagggatctacgtgacacacccatataaatttagagcccgtctatatacattaatattatataaacctaatacattataacatataagcatatattacctatctttaaaaaggtaccggaaatctatgtggtcacagcccatacgagaggatgctgtgaacgcatgatcgaggccatccaacggttgaacacggaactcggaaggcccagcctatagtagtaacttgtaaggatagacagcatgggcccaatcacctcaagcgacacatgtaaattgggccacaatagaggcccaaaggagatctcggattttgcagtccgaccaagctcgaatccgtgatctcaattttagtgtgcagaattaggccgctaccgtgatcaaagtgggagtgattttgtactagttttaacagatggaggagtgattatatccgattttccaattgagagatataaatcagattcgacctgtattttgttgtaaaccaacacgcctattagcggatcaccagatccgttccctgtccctgccacagcagtagaggcgttagataatgtagaacacccgcgcccatccctttgcgctcaagaacattgcagaagtagacaatgaacacagatatagggtggagctctctcttcattatagatctcatctggagtacaagccaaccattagccatagatgttacaccctacccctgtatatataggggtcttaggaggagatagaccttatctctactccggtttggattggcccacaagaaacttatctcctagttatcttaggagataaacttaacacaacactcccccttgggctaatccgcgactaactcatgcctcatcaaaactcctaccaaaacctagtgggaaaaaggctaggagaaagagtacatagttatcgctcatgcattgcacgttgttgcctcgttaaaaaccttatgtgaggaacaacagctccactcactcaaggaaaaagagtataacactatggactaaccggtccatattgtgggtcatgttctagggtgctctcccgttgaacctagcaaacatcaaagtcttctcatcccaattctccggaaaatcttccgagaactaacagttgggagagactaggtgatcaatcctctagattatcactcaacttgaattgctactcacctcacctcgcctcaggagtatgaggtagcccacttgtattagtggtgttggtttaccaaaccaatctttatatgataggaccttaaaaataggtctaagtgatcatcatcgagtcaatgccccgagcatactctaagacatttcaatgtcttgcaaatgacaatcaacacatagcacatactccccctgatgacaacctttgtcacagaccatgttcccatagcattaaacatctctcagatgtatgcgtaggcaagaatccttcagatcctcaaaccattagtcttaaagacttgtctcatttcaccgctaaaatgagaatagggaacatagagagtaatgcattccatcactatcatataccacaataccatattgttgtgcaacgcaatctgtttcatccttcagaaggattatggggataaataagtcacaacggcacgcacctcctgggcatgactccatcaagaactaggtcttgatcattgcaactttctttgacaatgtcaacaacaattggggatccacaagatcaaccacaagccttccaaagacatgttgtaatgatcagagtaactagctagtctgaaaattcaagcactgtgggggataacacatagccaacaacaccaagtataccttagcaggtattagaggacaccaccgttcctaccatcgggtagaacagatatcacgagtgtacacactccagtgataatcgtgaaatgcacatgtgcctacagaccctgtctgtttgatctcatcaggttcctcattgcaatcttatcgggtcacaattgggtcatcattcctccaagggattacacaattattagtgtgctcagacttactaattattttgtatctcaaaggaaatttcatcaatgaggtctccccctcagagaaaattccatcaatgagattttctcccaacaggagatggtactcttaccggaatacctattggtacgagatttgcatgctgcgatttcactatggagtctattcaagacatccatatggatttcccaaatttgttaactgcatatttaatttcatgccattttgccaatacctttatttagcggaacgttcaactcatgtggaagaggtctcatctaggacctacttgaaccatcgcacatcaccacctcattatctcaataatgacccataaaaatccgaacaacattcgcgacttttacttagcgattcggttcagcctcaattgcatttccatttgacccgatttgagcatcgcatgctcatgccatggactttttccggatccgggttctctctaagagaatcattagcaagaggcgacatagtgtcaacacatttattcccactcacacatttaaccagatcttcatcatttcccaaaacgatcgatccatggttgttccgtattcctagcaccataatatgcgtgcattgctaggaatgtcgtctccatgacgaacatcattatgaggcatatcaccttccaaaggtgaattctccaccaggagaatcagaggagtatactcacatccagtgagaactcttatgctctgactaaggcctacggatcgtgttagcaggcgtccccgcacaacatgatcaaatgccataagtcttatgtggatacgatattattcccgggtctatccacatttaccacaattgggagcattactctttttaacaactatctagttgttcctcatatgattttgttggcaaaaactccgtgcaccaagcaataggagtatgaactaaacatacaagttcagctcatttagtgagttcactcaaagaaatctacaggcattccaaaatgggcaattctctccccctaatgccgagatatcttacaatagcatactaccaatccccatatcgtggcataggattaaggaatttcacctcgatcacaaatgttctcccacgaatgtatgctacggtggtgatatatttgggaaatatttacgcactttaataggagagatttttccattatatgcagtgagcctggacatatactaatacagtgccatgaatactgtattcttccttccttcgaagggttatcctcaacctcctagttaggatatacaggtctgcaaaaaccaccattgctaccaaatgtatatgcaaccaacatgcaaatactttagccaaatgcactctccatggattaatgctcacctagtgccattcaaactcataatcgattccggatcgacgtgcattagacattgcatgttatatgcttaagaaggcaacctatggtggcaaaacgcattccaatgcgctcaacaaggagtacgatagcaaagtgcgcggccactagcctgcgctgccaagcagatttttgtggtgcagagttgtgttaaagtccaactcgtctaatgcccaagtttgactccaattactcataccaaactctagaattgggtcatagttaagcagcatgttttaggtacgatccacgagtgaattatgaaaccacatttactaatgtcccctggacatagccatcaggagataatcaatacctccgacaatggtaatattcacaataaaaccattatattaagacatatccacaaaaatagtggaatgtgtcggtgcaactgtcgttggcataacgagctcaacgcatgcaacacgacaaacctttgcatggcttgcacacgtccacacacgaaaaacgccagtgtgcgactagcatggtcatcaacccgtgggtgatcaaccaacacaaccagggagtagtcatcgactacgagagcgcgataaaacgcaatagtgcatagccaacatttttctgaaatacagttacgttgaactgtgtgagtggttgtaactcctcggatcaaacactaattgttctattaaactaaagcatttttatcaattccagcatgaagataagctttataatagaataggaaagaccaagaactttatctatctaggaaatatcgatttaatgcaaagttccaaactaagcaaaagataaactgcttggcaacattatagccgaccaatgtccttctaggacatgctctaaactagccatacaactcccgttgtcaaagcaacttattagacagacactacaaaccattggtcatcaaccaaaggtcgccatttagcactggatccatccgaggagacgaggacctagaccgggtcaacaccctagtcaagctattggcgttgtagtgaagtgggaatcgtgcctattcacagcatctaccctcgggcttattccgctagatttgcctccaatttttcggcgttctcgcaagacatcaggttccaaataatattgagaagatatgtgcacaccaggggcaaccatatgaacagtgccgttccaccacatggaaaacacttcacatctttcaccggaccgagtgaaaaatatctcaaattattgaacctcgcaactccatgttgctagaaaattgaggtataatcatttatctccaaatcagaaaagcatgctctcaaccattgggaaagcaaaatgacgaccgtagtccgaccatactctgattgagatattaagccactaggggaaaggcacaatgaatcccaaacacattgtctaattccacacatttcaacgactcagaatcccattcttgagtgtgatcatagggatagagtgatctacattaatgcccaaagccatacaatagtcattgaaggcctttacgtgaaatcacccacactatcatccgaatcgtttcatgcggttctcagagaacgcaacacgcaaatggacgatatgtgcagtgaattcggcaaaagcatggatctcgtacaacaagtatacgtgactccatcttgtagacacatcgatattaccatttatgtatggaggagtgtatcagtaaagagtggtcttatccatagccatggatatttaatttcccagaatttccatgcgttatgtgattttttgttatttacttggtcttatttggcattatattcccaatatttatgccacacagaaaaccgtcacacataaatgcaggaaaataaacccatcataatgcttccaggggggattctacactatgtgaacacaatttatggaagcatcataacctagaaaaccatctctagattatgttgttggaattgcatcaattttaaaagcaaagcaatgcttaaaaaacaccattacatagttatttacgagtccggagacccacatgcaaaaccaaactatacagggcctaagcaacaagacatagccacacaaacaaaattaatataatctcttgttaattacaaggttcaaactgtaaaattgcattgaacggtgaactatagcgtaaaaacccaacactccgggggcttaaacacaagttgtcaataaaccgaaattaatccggccgaattaccgttcagagtacgatcttatttgggctatcaagcacagtgtagcccaaaatgcctaataggtcgaatttctgaaactctagacccatgaggatttcggatttccaggtttattatttttattaatttgtttgggctgtctcgttactgttgggctttattcggtcgggcggaggcagaccggtccagccggttcgcctaaatgaccgagaaagaggaaggggaattagggtttcccctttcccattcattgtccgcaacggcgtccaccgctcggcacaccggcccctcgggcacggcggcggcgttggaggccgtcaactgtcgactttgaagggagttagggtggcacacggcgaggaggtcatcgacgacccatccactaccccgattggcaggacggtggcgacgacatcactcccttgttgcaatttggtgtggcgacggctcggtggcacacgatggagctccacgtcgacctgcgcatcctcatgacggcagcgaggcgaactcaacgacggcaactgagaccccaacaacagcaaccaaattgcatctggccatatcgtctcggcggaggttaatctggtagcaggcagccgacgacccatcatcctcccgccacagctcgacgacagcgtcgatgggaggtcaacggcggcggcgcctcgcttcggcattaactccggcggcaatggcgacatgggtttagggctttttctgagacggcggtttcccgcgacggcatcgacgcaaggccgacggcgtacctaacagcgacggcgaacgatggccaacatgtctctaagtccgactacacagactgagaatatgtcaccgcgttcccggcgtggcgtcatcagagaaagagagaaacagatagatgcgagggaggcgggcgagtcagtcaattcggcccagccgaattaggcacgtctccagtccagggtttcccatcaattttaatgatttctcacacggttttctccagttttcatcaaataaaacagatgcatatagatcaaaagtaggaaattaatctaccgctagatcaagagcaggatcaaatctactacaagcaaagcatccataatatgataaaaacgagaaaataatatcaatctataaaaacatatatagaccgcatacctaatagacacatgcctggatgtatctatagattagtaaattagtttagaaaccaatcttactaattaccctggttcgcatgctcacaaaaatctttcacgcgcatgctgcctcctgctgcgtcgcaggtcgcctcaggaacggcgtcgatcggtatatcgcacgcatctgtacgtgcatgtgtatgacaacgatgacgacaggtcgacggctccgatcacggatacgctgcttagcacgcacagcacctgaggctcgtctcgcaaggcgacgcgacgatgactcagatctcgtcgaccggcggcagacatgcatgcaagcaaaacaaccatcaaccattaattaattaatttgtaatcagaaatcaatctactgatgtaagtgcatgtgtcgatgcatgcatgcagcatgcatattggttgatttgccatcaatcttgtgcatggacgccaggagccaggtccatccatgcttgcgtgtggccagcacaggccatcgcgtggaggtgcggcgtccagtgtagccgcagccgcgtggcggatcgcgtggggacgaaccgacgaagaacgggccggtgcactaggagatcgagcaccgacactctctacgggcgcgctcgatcgtgcgagggaggcggggccggcggacatcggacgacaggagtagtgcacgctgctcgcggcgtctccacggtttcccggctacctgctcggtttccctttgcgatgtctccgcagtcgcgtgatctcgcaaagaaaaccaggacaaaccaatagatcaatctgttgaccgaaattaatctaacaaaatcaacacattagaacaacaaaccggtgaacggagagctgctgataacgtgttgtaaaccaacgcgcctattagcggatcaccggatccgttccctgtccctcccacagcagtagaggcgttagaaaatgtagaacacccgcgcctatctctttgtcatcaagaacattgcagaagtagacaatgaacatagatatagggtggagctctctcttcattatagatctcatctggagtacaaaccaaccattagccatagatgttacaccctacccctatatatataggtgtcttaggagaagatagatcttatctctactccggtttggattggcctacaagaaacttatctcccagagatttgtttcacaacatatttaagcgagtaaaagtggactttttccttgttattagctatctaattgggccgcgctttctgttaggcaagctatggtgggccgatcgctttcatcggacgacatagaggaacactacaagcccattccccagtggccgccgcccgccgccggtcgccggagcttgctccgctgctgcaaacacctcgatcgttgtttccgcggcacggccaacttgccgacgtgatggccatggccggaggacgtggtcgcacgcacgcatgatgaggagaaacatgcatgattaattggacactggacagagagcacaaacacagcacgatcaatgccttcccttaatattatacaaacatgtagtagtcaattcgcagtcatggatcaattaaattaacgaagggcctcttcactttcacgtcattttcaaccttaccaaattttagtaaagttgtaaaaaaagtggctacatttagtttgctgttaaattttagtaactatataagaaatgatgccaaaattttgacaatagatttttttttggcatcaaagtgaataggcccgaatagacatgtatcgattcacaacaatctataagtaatttaccaaacaaaaaattaatcaacaagaaataataataatacaagttcatatattgctcaaatattcaactgcaagaattaacgagcgagtttttttttcctcactcgatggatggatggatgcaacagcgtgtgtcaattaatcatcatatcaggatttatggctagcttaaccaatcaaatcaaatcaatttcaatttctccttcttggcatggatacggcgttgccgtcgaagagctcgtcgatgatggcctcgaggtcctcggcggagagcttgatgtacttctccgcctgcctcccggcgctgaagctctgcgagaacctccccaggaacgacctgtacgccggcacgacgacggcggcgatcgacaccctgagctccgactgcagctgctcgtcgctcaccacccacgcgccctgcgtcctctggatctcgtccatggctgcgttgaattgcttgaacctctccttgagcaccggcttctgcaccgaccccttcaccgtgatcaccccgtcgtcgcggagcagcgtcagcacgcggctccacgtctcccgctggtagttcttgtggtactgcctcaggtccgtcgaccgcttcctcgaccacgcctcgccgaccaccgcgttgatctccggcgatccccggatcttctgcagcatgtaccggccgttgttcatcaggaagatgctgcagagcgccgggtccttgtagagtcgggatttggcttctagattgtcgtggaggagctccatcacctccatcagctgcgccgcgaacgggtcgctgccctcgtcgtcggcgtcgatgtcggtgcggtggtgctcatggaagacttgctctagggtgttcttgtactcgcatgcgtacttgaggtagttcattaggtagcgggtgagtgggtgcaccgcgccgcccgggaccggttgcttgccggcgtcggcgcggatggagctctccaggtcgcagaagatggcggcggcggactcgccgaggcgggaacggacggaggcgagctcggtttttatgtcggtgagggcgtcggtggtggtgtcgggttcgtcggcggcggcgtcggtggtggagcaagcggcgatgaaggcgtcgatgacgggggcggcgtcgcggacggcctcgtacatgtcgagcaccttgaagagcttctcgcggcgcgcttcgtcatggcgacggcctcggtgaagttgagcatctggagcatggcgcagcgggcgaggtcgacgaagatggcgcggccgacggcggcgtcgcagccggcgaacacgcgggcgcagaggtcgtgctcggcggagaggccgacgttgatggtgtggtggaacgccttgaatcacgttggcacgtccgactccagcgactcccacgccatcctcaccacgttgtcgatgctcggcttctcgtacccgaagttctggagcaacccgtccagcgcgttccggcgagccaccaggaacacctgggtgcactccgtcatgtaccccacggcgatcatggcgtccgccatggcgcggagccggtccacggtctcgggtgggaacggcgggggggtgtctccaccgccgccgccgccgccgccgccgtccgacgcgggatcgccacccgcatggttgaacgacgggccacgcctcatggacttgccggtggcgctcctcgtgtcgccgttctgcgccgccttggcgacgcgggggtcctcgagcatcgtgtggaactcgtcctcgacgaacgccatggcgcggtggagcacgccggtgacgcggtgcaccccgatggtgaacttgctcccctcggggaccgcggtgagcgccgccgccagcgcggagatgcgcctgatcgcggcgaggagcggcgccgcctcgccattctcgcccaccgcccacttatcgtcgtcgccttccgactgcgccatctcctgctcgacggcggacgcgaacttgtcgagcgtcacctccgagatgctcgtcggcgcgtcgccctccctcccggcgaggaacgcgtccacctccgccgacagcatggctaggtccggctccgcggcctcctcgggcggcgccgcctcctctccggcagcaccctcgccctcgccggcgccggcattgtcgacgccgccgcgaccttcctcggcctcctccttgacgcgcacagcgggggcatgctcgctgatcttgatggcgccgagggagaggttccggccgagcctctcctcccggaacgtcgccggcgagaagctgctcgacttctgcggcgggatcctatccattcttgccgccggagttgatcgatcgatcgatcggtgcaacggtcaatggcgggacgggtcgcgatgcatgcaaagcgagagatcgagaggagagagagagagagaatggagaggttagagagagagtaggggtggggcgcggaagttgagggacgccatgattttgaaggagtcgtcgtcgtcttcttcctcgagctatgcagactttgctaaagaaagcagaggtgttgcatggttgctcacttttggcgccaacgtgagtctcctgacaaaattcttatgaatattttcttctggattgatttgaacattagtaggatgccacatttttagaccgaagtgatatttttttaaaaaagaaatcgttatttattcaaatgctaatgaacgtgtgaccgtgtgtggtgatcatttgtgcttaatttggaggaggtgatgatgattgctgcccacgatgagtccacttcaaggactgtttggagatattgcatgtaattaattagttgtccacagaattttgttcttgtattcaatttaactcggcactgcgaactgaaatggttagttttatgccggcccgattcaattcctaaattgacatgtcagctcgtatttatgtgcaattattctattaacggtaagtgagtactgtttacacctaaatttgacacctctagataaaatagagaaaaattgccaaagtttgaaaagtgctgggtttccttcacatggccggtcagaccgcaggaatgtgggcggtctgaccgcggcctgaactccggtctaaccgcaggtatgtggccggtcagaccgtcagagtttgaactcgagtctgttttcgtcgggtctcgagtttccttgcttgggaaggcatgtttcgggtttcctttggtttctatcccaagttagacgtggaggagaacctgtagagggcaagaccaacccccatttaagggacaaggccggttcaattgtaatcccccaaacacacaatatacttgaatcaccttatattttatctttatttttagccatattttttattttaccctagttttagtccatctttgtcgatttgtgccgtaaatcgtccgccgccgctgcgagagtacgacacctctttgtaggtttgtcctgaaaaccttccgtttgtctacgagacgggtagttatcctcatatcgatctaaatcggtctagatgctgactttaatctctaaatcggctccgctagccggtttagccgttttctacaaaacctatcttgatttggctttttagctagatcgaggtggttggcgactccatatcaccttaagacgtttaggtgttgcgatcgtacttgtcgacttgtcacaaaaagttatcaacaagtacccgtcgatagagagatgtaatttcattagtactaagatatatcagtaaggtctctcaagtaaggtgcgtgcatgttgtgtttaaagcgaaattaaacacctatagtgtcttcgataatcttaagatactcccatccaatctttcagaaacgctcatcgtgatagagtgtgttgtatttattagaaaatgaattaatttggcatttatttgtgaaaagaaatggatccggcgtataacacatgatcatgtagtaattggtagtgaggaaacggcccgaaaatagacggaaattacctccaccatgtttgtttaattttttttgttggaaatggaaaaaaaatctcagatacagaaattataatgaatatagatacaaagtaaataccaacagtaacgaatatgatcatggatagttatatctacaagaatatacttaaactcatgttaaatataatatgtcattgtaaattagactatttattttttaaaaagaaaacttagagttttaaatatgaagtgtatccatattaaaatatcattttcaaattttatttattcaattctaaaattaataattaatgaatgtaattgagatggatttttttttaaaaaaaagaaacaagttactctcccctattcacattataagacattttggaatctctatatctcggttagattttatcacataataatctatcttgttaaagagattttataactattttaagtgagtgacatgtaaataaggaggggttatccccttgaaagtttagaatagtctcctagcctgtcaacatctcgcttgtgttcagtgagattgcactgcatgtatgcatgatcacaacaattgagcagtaggttttctcaggggtggatcccaggattccttgaagatactccctccatcctaaaatataacaattttaaccctcagtatttgttccaaaatataacttctccatcaacattctcttcccaaccaattacaaccctccaccattcattttttccacctacctccactactcatccaatcacaactctcacaatttcaaattttatactaactttacgaaactactaatgtgtaatattcatattggattttatatacatgttagttattaattatttttaatatcaaattttagttatttctaaattatattcctatatggactctagatcgtctttcaatatttcttattttttaattctgaattttcgttatctgtaaattgtatttatatatagactctaggttcttcatccaatattatttatttttaattctgaatttttgttatttctaattgtatttttatgtgaactttaaactcatctttagatattctttaatttttaatttcaaatttcagttacttctaaattgtatttctatattgactttagactcttcttcctctgtttttttaaatttcatcatgttgggtgatcaagccgacaacgtccacgatgaattatctgttaacaaccttttctcaaatagtccagccgtagccgacgttgtacatgagataagtcgtcggccttcgttggtaggttgggtgtgacaactcagcatttttcgagagcgttctcgataatggggtgtacttgaccatatcctactcgagtgctcaattgttcctgaaaaatattttctagaagacaagatatatagcatagaatatcgagtatgtacttaaaaaactgcatgaatcttctagcaatttaatattctagtttttaattccatatttaattttgaatttcagctatttaaaattgtatttctatatggactctattatttctttttctctgattacgtatttcaattagttataaattatataccagtatgaactctagtcttctcttccaatattcattatttttaattacaaattcaactattttaaattgtttttctatatggactttgattaatatgaatttgtagcccatgagagagaatgtggagtctaattttcctattacttaaataagttaatggattagttcttaatccaattacacttgctctgcattggttgaattagaaataaactttgtgtatgtggtttgtttggtcgtttccatctcaaacttttttactccgattcctataccttactttaagcttctgtaaaaaaaagatttctattagttatataactattatattaaatctaaactgttataatctggatctactatgacgcgatggttatttaattttttctctttgtcttgattaacattggaatttctatttttcttgtccgttttcactttttttctatctttctcgtccgtttccatttttttttgtccgtttcaatttttttatccgtttacactacacccaatctaatacccttctttttttgtccgtttacacaaaacctaatcctaatacccttctatttttattttttcttattttctttcgattaacgtgagattttctagaccgtaagagtgaacgtggaggcttctttttctgttactttattaagttaatagattgaaaatgtttctattgaattcttttttattgaattcttttttacatcgctcagtttctgatacgtactatttttcttcggtatatttctatcattttttttgtctatcgcctccgtgatcgagtcggtctcataccctacacggtcgcatgaagatgcacacgctttacgcgtccacctgcctcttcacatattgttcacatgcaggggcggatctagaaaaaaaatagtagtggaggctgaataaactacatcagcataaatcgaacctccagtccccacatcctatggatctatggaaaaaaaatttagtgggggcttagggggtctccactgtcccggagacggtagtggggtctcaagacccccgcccccattgtgaatctgcccctgtccacgtgcccccattgtgaatctgcccctgtccacgtgtcttcattcagttaggcaccgattgtctcgctcgtcatgtctacggggccaccttcgcagcttcgctggatgggactattgccctgaatcatgcaacttcatcatgcgtgtgtgacaaaaaaaaaaatttcacggtatcatctatgatttcgattggatgttctctccacttctttttttttttgtgatttttagcacttatacatatatggatttacgtacccatcacattaattctttcatgcaatgcccgtgtgccaaatctcggccttttacttagcgtaataccagatcctcactgtattggtcaaggttggctttaaacctctatacaataaatagaccaaataaccatagtaaaaatatttttcgtcatacgacccacattattcaatacaagcaaacacatgatgaataaaatttaagtcctccagaactatatgatgtgcttttcccggagaaaacaagcagctagactactcgcatttcatgaatttcctctcagcttacttcctaatttgcctgaaatcaaccaacatttctcaatggcatctaacatctcttaatattttcttaaagactgcgaaaccactcttgagtaattgacttgatatatgggtcaaattacacaatgcatacacataatacaacgaatttgcatgaccacatcttcactagtctgaaacggctgcatgccagggctttacttttaccttgttcactgaaggtttccgtgtgtgtgtgtgtgtgtgtgtgtgtgtgtgtgaaaatatatat

SEQ ID NO: 78807 - DNA, 5029 bp, Oryza sativa
caacggcgccgcccgcacgaccgcctccccactgccgccgccgctggcggccgccgtcgcggcgccgccctcctcctttcccgcctcctcctccgcgcctccgctcgcaagccgcctcgccggccgctgctcagccccgcaaagaggagaggaaaaagaagagaaaaaaaaaagaaagggtaaagagagagggtgacgcggacacctgatatgtgggttccacgtgggtctcttgctgactcagccgccacatagaccaaaaccgaggtcaaaaccaccgaatgacctcgggtgaccggttttgtatagttaagggaccccgaatatctggttttgcatttcgaggacatttttgtatcccgatgacaagttgagggaccttcggtgtactttttccttttggttcccttcaactatacccatagtttgatttttttaagactaaaaaaatgcccgtggatgctattttaatttaattattattatacggtttagttagggtgaaatttattgtgggaattcatttggatatttttttaagaaaatcataagttgtaattaggaggtcgcatttcatctcaagttagcattcgagtttttttaaagagatttcttatatgacttcttttgtatttccaaaagcacacgagcttaaaatgcaactcaaacatggatctatatttccaaaagcaaatgaacttaaaactgactcaaacacggataatgtaccaaaataccggcaaaaacattttcatgttttataatagtagagatagagatataacgggtagaaatccgacctctatatccataattggatttacacagtcaataccctagtttgattgttgtcaagaccagatatgaagactcccctcaacccttaaaaccgtccaattcaacttcccaggaggttttcagagtggttcggtccgatgtgacgcttatatggcattaaattacagtaaaataaaattaataaatgcagtgaactccacacatcagtgaaactcctcgtttccccttcctccctgtattacaatcaaactgtagctatctttgagggaggtaaaataaacattctcccaaccgtaaaccaaaccatccgcgtaatgggccgcgcttgggggcccaacactggaggccataataaaccctcgagaaccccctccaccggcgccgtcgccgccaccgccaccgccttcccctcgatcgccggagcggcgagcccacggcggcgagcgccgcagccatgtcgcgggctctcctcccgcgcggcagcattctactcgtccttcgaccgcgagtcccgtccacaccccaccgatgcttcgcgattggggcggcggcggcagttgacggcggcgagacgtggcgggggcaactccggcagggggagggggaggggaggagcagggcggtgaaggtgtcggtgtggtgggacttccagagctgccacctcccgcagggcgccaacccgtgccgcgtcgccacgcgcgtcacggcggcgctgcgggacgccggcatccgcggccccgtcgacatcaccgccttaggcgacgcctacatgctcccccgcgccgtccaggaggctctcgccgccaccggcgtcgccttctcgcacgtcccttccagtttcgtcttccaaacccatcccaatttcgttactcatcgaagtgccattgtggaattaattaatatctcttgtgttaatggaattaaggagtgatattacttcatgatgtagagagtacatatcatagaagaacactagttttaatgcttttcaatttatgactgacactgattaggctatatatgtcaaaatgatcaccctttttactgattctaattgattgcgttggggttatatccggtgttggattgggtttgtggggtgggattggaagaaacatcctgaattcttcttaatgatactctgctctatatgatttccaatatggtattgagtttgtgctaaatgtgtaagtatttctccaactgttagcaatgaatcataatttttcattttcagacaaatttgcagtgctttggattgttgaaacttgcaaattaaccactggcatgctttaaatgttgtgactttcatgtttaacgaggaaatttagagcagcttatatttcacttatctgatgctgctacttcgttgcatgatattaataaatagtttgatattgtaggtggaaagggcggtcccgaccaattgttcatggctgatctgacctattggattgctcagaatcctccaccggcccatttcttccttatatctggcaacaaaggccttgcaaacattctgcatcgcctccggatgagcaattataatgtactgcttgcctgccccagtgctgactctagtgtattgtgcagtgcagcaacgattatgtggccatgggatgctttagttaaagggttggatttctcaccaaaacattttaaccaaccacctgatggtatatccttttcttggtacggtcactataggggaccccttgatgacttgttcttgaactcagagtcagatgactctatggcagagtcagaggactccctggcagagtcaagggactccaaggcttttcaaccacataccaagtcagtgaaaccacctattttacccaaatctgtggccaatggggttaggcaagtactgtactcctttcctgaaggtatcagtcttccaaatcttcgagcagagcttagaaagaatcatgtgttcatggataaaggattatttggcttcaaaaacttctcttctcttctccaagccatgcctgatgttgtgaagtttatagatcctctaccaggtgaaagaaaccagcctgctgtggttggggtttccaagagatcaatggagcctgctgagcaaatttacaagggaaagagttctgctcaaagcagtggtgagttcaaacgcctcgttcagactcttaatgagaaaccaccatcatcacatgtcccatcttcttcatcagatattttatctgcggaccgcaagaaagttctagcagttgatgccccatcttcccaatctgacttgttatctaggaaccaagagaaagctccccctgttgatttgactacacaacctgaaacacctgcaagctgtatggaagctgatgtggagagtgttgctggagcttctgcctttacaggagagcaaattactgttgacaaaaaggggctatttgaaaggatttgtgtactatggaatgatacagagcctgttaagcctatgctttctccgtctcaagatgatacccattctaaaggctccaatgatttactaactcagtatgccaatagtaacgaacataacagtcttttgacaaggaccttgaagatcttttccacaactgacaattcagatggagacaatgttgacagcacttcagcaattagcagcagtttctcaaatatgactgccaatgaccattcggacaaattaaatgtcaaggagaatgtagggaatacgatcatccattctagtagatcagttgacacgagcaacgctgaacataaagttgggtttatagaaaaaagcaaaggaatatttagctgggctgcaaagtggtgggcgtctggaaaaccagacacagatgacaatttaagttcagtacatatcaatgatggaacaagggaagaatcagaaaaagaatctgcatttgtaaagacagctgctactgcaagtgaacagcaagtaggagttgaactgttcatgaaaccttacttctgggatgcactacagcaatatttgtctacccctcatggatcagatcttgtttcaaaagcaaagacaaggtattctgcttctcaaattacttttatctacatatataaatgtttctactttgcctgcaattctatctttagcagattccaacatgcacagatagtaactgtagttgacattgaacaaaaatgccatatcctaactacaagtccatggttctgattgcaagctgctcttttactatgctaacagcaagcagaaactaatctcttgcagcacaccaagagataatcaaaatggtaagaactgaatatgcaagcatgcggggtgataatggctgctggctgtgatcatattcaataattgtagttcttatattttactttataattgcactttcctcttcaagttcctgattttattctatattttgttaccaatgcaaatcttatcacagaagatacgaaataaatgcagtcttaaaataaatgatgactcaaataatttcatcttttataattcttgttcttaggtggacatggacccaaatgtctcacctcaaatataactagaatcatttctgagtaaagcttcactcaacctagctgcttgtttttgccagggaggagttagcgcatggactacagaagcaaggccattggcctctaaaaagccttggtgggaaacaccaccaccaattagtagatttgcttatctcagaaaagcaatggatcaaagaatcttcatcacaaacgtctccttttcgacttgccctcccccagagaagagctcgttctccactactttcattttttacgaatggaaggccatcaggccagcgtaaacatgtcgatgacagaagcccaactctgtctagaacgtcggtccatgttttacctacaaaaaatgggaagggtcaggccagctgcaagagcaatgagaatcaaagtaagagtgatgactttttggagaaagagcttggtccagtatctgacagtggtaaaccatatcgacaaaatgataaagcagtccggcatcatcctcctacctgttcagatgatgaattttctgatgatgaaaatcatgaggtggtccaagaggctgggagagatgcagcacaaagttcactcttcaaaattattgattcgtggaacactagtaagactatttgttctagcaagaaacagcacggcattggtggtatagtggactgctctagaatcaacagaggtaatggtggtgacaattcgatcacagaaaatgcagaaaaggcta

SEQ ID NO: 78808 - DNA, 6957 bp, Oryza sativa
taggctccattaccccatgattagtttaacactaatgaccttaatgaagcttttggttgtaatgtaatgtaaatgtggtgtggtggtgttgggtggtgtgggaatgaatgaaaagacacacaaatgcaacacaaatgccaaggagaaaaaaggggatctttatgtgcggttgcagcatgggcgattgggcatgcagaagctatgccatcatgctcccaatcctgaccttctgatgagaccatgtgatgtgatcacctgtttctttccttctctgcattttattagccatggattagaggagagtagaaagatcacctgttaattgaatacttctacatttgtggcaagaatgcactaaaatactatttctgaatatttctctccctctctctcttaagttttgtttgactgaatttctgcaatgtcattgtttgcttttcagcttataagccattgtcagaatttgaattttgaaattgactttgtggctttctcattgtagtttctttctagcattttcttttaaaccacgaatagcacagatattgaagttttgcccacaaactattttgtggttgcttatacgctgttctatggtttaacgatcaaacttctgaacatcattctgaatgtgacagttccgaaattcagcaggaagaatgcttgcaatgcaagatgctgttgtgatctcgatggcatgattggtgcaggttgatgtggattagtttggattaatcccagcatccgttcttagcggttactgtgcagtcaaaagagtgcaaattaaagatgtatattagagagagtcaagtaataatgcagtgtagataagatcttcagtttcgcctaaaaagccctgctgctgcactgctcacaatcattagcacttctgtacgtagatttcttctttggaagatcattagcatcgcagattcagaaacggctaatctgtagcatagctttgtcattcatagctagtcttgtcagtctctgcgtgatttggttcggattggcgcacgcgatgatgattggaaagtgatttggaaaaaaatttggaagaaataattccactgtgatacgatcgtcgtgtgcagattttgtggggagagatcccggccgtccacagatcaggaacggacggagaccagcagacatgatccgcgatgcgaggcagcgtcaatcaatctcggccgttcatcacaagaaacagacggtccgcatacttccagcaggttctgcgtcatgcacccctttctggccccacctgtcagcgtcagacgccacggcccttcttgtgacacgtgtcgtgttgacgcacagctgaactcgacggtttttgatgatttgatgttgctagacccacgaacctacttacaggtaaaggatcctattgtttggcttattggtgaaatatgccgaataacatatttacaagcgaaaactaatttatgaataaaacttttatatacgtgttattagtgatctaaaagcaatgcctaaataataaacttcgatgagtgaacctcaaaatcagattcaaatttaagtttgaaaattcaaaatttagctgataagcataagcataaacgaaaatacgaggccgaaaatcagtgggtaacccacgggccacgaattgacatgttgtttacttagaattaattaatctataagtgggttcacgggtcgaaccacttgcatcctcaggtacggcaagctgccacgatatatgggaaccggtgggtcactcacttatctgacctataaatgggttcgcgtgtcggtccatttgcatccctagctgccacatgcacccgtgaattgtatccgttattatatatttattttttatctatgaatttggacattacacttatctagattaataggagtagcttaaaaatattatattttagaatgaaggaagtattattttagaacattgaagacttttaagttgtgatgttttgacgaactaaatagttatatttataataaaagtattctgataatatgacatcttcgacatattgtaacttttctttctaaaaaagtataagctattaaagttggtactctacatgaactgtgtctggtgtaagtaaaaggaacggggagggagtatattgtaatttaatgtataaatgcctttgacaattgacatttttccccttcatgccaactttaatttgagaagagggacaaagtttcaaagaaaaactaaagtttttggcatatgttattcgtcctcctataaagaaaagccactcgctcgcatgtacgcaacaaagaacatttgaacatgcatgagcgcgcgcttccaggttccagcgattagtatacgctaattgcatgttagtatagttcatcacatctgagacccagatcagagaggaactattaatttggaccagatactattcactactagtatagtactccgtagtggttaatcatgcatatacctgggctctgacaatacaaatcatgttgtatttgaacgtgtatgcaataatgcatatactggcaattccacgacgagatacaatcatgctgtatttgaatgtttggagcgcgagaaatctctcttactatttttttttacgaaaactatactattttagtgaaattactgtatttcaaataggatgaaagaacattgagttcatttaaaattatagacaacattgtccaattttattaacgcattaaaaatttatatttgtactgtaaattgccaaagggctggtttggtttgaggcctaaattagacttaccaatatttggcaatttcaatagtgtttagtgtctatttggtttgaagccaaaatttgacatgcctaagaaaataggccatttcaatagtgaactcaaactattttggcttcaatacaaacacaactttgccttaccaaaattagtcatgctaaaacttgctaaaatttggcactgacaaaatttgataaggcctatttaggccacgaaccaaaccaacccaaagtgacaaaaactgttttttatgtacaagtttatgggccttctccaaatccggcccagttatatgtacatgggctggttagttattttgaacattggccaactttgtgggcttcctaattttttgctggtagtctccttccattcacgaatgattttgtagggagtttgtcaacatggatgccatctccaatgttgtgtatatcttgtaaacatcgtatatatgtttcttgatgaaagcagtaatgttttcaatggcgtgtatatattgtaatcatcgtatgttgcttgatgaaagtagtagttctttttattcaagtctgaataattgagctaattaccaaaagagaaagaaatatgaaaaataccatcacatataatagagatactacatgagttacacaatacgaatcatatgtcgatgacacattatacaatggtattttagactctgttttttgcgatggtattcggagtattgagcaaaagagatgccatcagattcaggcattcagctagccaccttggtcaacgagcacgctccagaaatgagccgcacatcgatatcgaatgggttaattgcatttagatatccagccactagcgactgtagctaggagccatgattaagcatatgatacatgcacgcaatgcaaagtaattaatggaagagagccacacatgacaagaacaaagcagaagcacatgcggatgtgtcgaccgatcttatggtgacagagacatgagaatttaatcagcattattgctcgacacacatatatcatcatttcaagacgattgtcaattctgaatgttttaaaagcctaatgtaaatttacatcaatgttcagatcatcatttaaatcattttatttacaaatgccctagctaaattaataatggttcgtgggtacttaccatctatggatcaatggctcatacacatgaacaaggtattcagaagattgggaggtagatcgttcaaaaaaaaagaatattgggaggttatttggcaatactaggactaggaagttcaaaagcatagtagttctagggtataagaaccacgttcaagtcgtttgttggtagtgtcagccaccatctagtgaagctctgatgactcctgtggtgtcatgaaaaccgtagacttatcctcctccacgtgtctaacaaaagtgtctcagaataaatgtgttgtaatataattaatatctagataaaaactacgactacctctgcttttaaataaagggtgatgctccggtgcactctacttgcagtattctactacaagtagaattaatctcgaccgtttatttaaaagggcaggtaagtaatctcctaatatagtttaggggtaattttggcatgggatgttttgttcggttcgcatcacatcaggttcggtggatgggcacggcaggcaccacaggcgattgctgcagcatggtgtcgtcgtctctcgccggcaagggccacagcgcggtgtacaccaccgacggggcacggttcgagggtgccattggtgtacctttgcacggtggttttcggcgagctcctcgccatgtctcaagaggaatttggcttcgccggcgatgatggcaggatcacgttgacgtgcgatgcatcagtgatagagtacgtcatgtgcttgattagcagagatgcctctgaagaggttgagagggcgttcttgagctccatggcaagttcttgccatagtgtcgaaggaatcagccattagttttccactgtgtcggagaatggcgagctgctcgggatcggatgccacggccggccgaggtaggtctccacactgctgccggcgggggcaccgcggaggaggtcggtgtcagcgtagatgctgcagtcctggaacgagaagcctgtggcgcgggactgggcggtgatggtgttctgctggccgcggagggggaagcgtgcgacgatgtcgcagtgctggaagacggcggtggcgtcgccgaagatgagttagatattgataaattatgataatacccctgcacgaattattatccctgaacgaatatacctttgtacatttctactaccactaactctggtgggagtagaaatagatcacaaccctacaattaaatataatgaacggctcagattgctttctactccaagtagaaagcaccggagcaggactcttaaatatatgatgtgtttgactcctgatgataataaattaatttgattattcatcttattaaaaatactactatatccatcctgaaatatataatataacttagctatatgtatttgcataaaagtatgtccgtatatatagctagaattgctatattttaagatgaagggagtatgtaaatatcacttattttatcattaaatatacttcaaatatgacttattcatatttatattaactttttaataagatgaatagtcaaaagtcaacaatttgtattttaaaacatatgtagtagtccctccatcacacaaagactttattgttacctttttcatttgtcccataatgccttcatttttaagacagttaatacatcaaagtttggaaaagtgaaacacaaatacattagagatttaaaaaagcgaggaacaaatgtattggagttcgaaaaaaatggagagcattttagtcttttgactttatattggtatgtgtgagataggaaaataatgaagtttttttttacagaggtagtagcaccatattactatagtatagccatattaatataaggccgatcgatatacacataatcatttaaaaggcgatctcacggtcagtcaaggtgcaatggccctttcatcaatcaggcccatatggccatatgcataatgcataatgctggttagcccaaaagtgatgaattcaacataagctagctagccagccagctctgccttcacgtactcaagccagctgaaagactcctgccatctctctctctagatcgatctcaacatgtgtaatgatcatgccaaaattgaaattaaaggaaacttgcaaatatacctattacacaacagttgatctatcatctgtgaacgtccttttgatgagatggtccgaaagatagagaaattggggcacctctatgcatatgcatggtcccggcagattcagagatgaaaaagtctcagaaataaaggtagctaggccaccatgagatcgagggcggccatgatgagagagattaagcttaagggtaccattatattatattgcacctttagtttctttagtaaccaacagctaactgcagctccaaaggtaatcatgagatcacacagagttggaagctaccaagcaagtaagctcagttgattgattattcttcactccgttccaaaatatagcaacgtaatacaggatgggatacatctcgatactaagaaatccctattcagatttatattactagaatatgtctcattttatattaggtcgttatatatttttaaacggatggagtaacgttcatgtatgaagcataggtcgtttgtgcaatatatatgtatgcacatatatgaagccaattacacaccggcctagctagctattcggtagacattgttgtttcccccttttttctgattgctgattataatatatattccaataattaagttagcttggcagtttggtgcaagtcaaaaaagttggctgatcttcatgaataggctagaaatattccagacattagttaggttggcactctcaacacattgcaacttcattttcattctactgtgtgttgggctggcctttttatagtttttgatatactcgatttgtaattcacttggttaatcagtctcctaagaatagtagaatcgtagagctatttttagatctttattattattaaatatcattcaatgtagaaatatatacgtagcaattactccctccattataaaatataaagatttctaggttgttta

SEQ ID NO: 78809 - DNA, 17990 bp, Oryza sativa
aaataatacttcctccgtttcacaatgtaagactttctagcattatccatattcatttagatggtaatgaatctagacatatgtatgtgtttaaattcattaacatctatatgtatatggacaatgctagaaagtcttacattatgaaacggagggaatactaaataagagacactttggtgtttttcttcactagtaaattttcttagattgcttagagaaatcaagtctttttagacgtatagggagtattaattcctgtctgagtaatgaccaaattactgtagatattacaatactcccttatttcataatactttactaattttgattggctttgttttattttgtccaccgctgacttataaataaattcaagagtattcaaaacctaccatattattgaagtatgttagacaataaatatatccgttcatcataacaaacgatttgaaagttcgtcaaactaattaaaagtaaaacagtgacaatcaaaattatattgataggtatagtgaaacagagaaatggagtattagccgttccgtattataattagtcgtttaaggttcaagtttgacgaagatcatagaaaacgcagtaacatttataacatcgaataagtttcattaaatccaatatttccgttgtatatttgtcttgtgttgagaatgctgctatatttttctatataaacttgttaaaaattaatgaaacttaatttaggataaatcgaaaacttctttttcttacacaatctaaaacgtcttacaatattcataaaagagggagtatcgaaaaactaattaagtgcgtatttttcgtgttaattaactaattaaggatagaagtggcctctgtgcgcatgcatatcttttgcaatcaatcgagatgatggccgatcagtgtaactagctgtcgtgttgagatcttctatatatcgtcggccaatgataaggggacatccgtgttaggaaacgatagacgaacaaacgataaaaaacaatagatcaattacaaaagacatgagatttaacgtggaaaaccctctcaaaacaggagaaaaaaaaccacgggcgctagccagcaaaatatttcactatatctgaggtgaggttacatcgccgcacggcggcttacaagaggtatatatatagtggaaccctaaaagggatgatgatccgtacggcagaagctggcctttattaagtgtaaatgaatttggatcacaactcaacaatccggacatgcatggatcgttgatcattggccaactttgcatgcatgggccacgtctcctagtactaagctccaaccgcatcgatcgatctggctagctatctgctatagagatcaccaaggccggccctggggcagtacgaacggtgcgaccgtaatgggcctctaaaaattaggggcctccaaaatatgtatactatggtattaggcttgaaattcgttaatgacaatgagtttttaaatattatcttgtttttttatggtgaatgggggcctttattttttttccgcaccgggccaccaaaaagtcagggccggccctggagatcacagcaatatatattatcagaaatgattattcagaagatatacatacataatctgtacttccatgtctttgacgactctctgtctcactgcctagccaagccatgcagtagtagattcagagagatatagcaaagatctaaataaactagacaaaactctaaccctttttatatatatgtatgacaaaaagttttagtgagatctttataagagctctcataattctggtaccagtagtggagactcgagcccttgccgtccttatattagatcatcccctggagccatgcatgcagagataatatatacactaaactccgatcttttcatacatgaatatattagtagaaaatcatagctcgtagtactaagaacatgtaatattccatattatgtttatttattttggagcacaatgaacaatcagaatatttatatatacaatagatctctcctacgtatctaaacctaattggtacttgctaaaaactggtcgtacgtacgttaaaaaatatctgaccattttagatggatcatattaacatgatctatatgcatttaacttttcaggtcatgttaaaaacttatctattctacatctacatattgtgggagtttatacttcatgatgaatgtttttttttataatgggaatttataaaacccggcttcaaactggatacaacggggtttttattgattccaaattctagactaagcaaaatgtcggtaagctacaactaagattacaaactgagtacaactcaatatttattaattcagaattatgaaaccattcagttttgctatataattgtcgataaattttcttctagaaatttaacatatataattatagtactatcatgatataattacattgtaatttacatataactataatataacttgtacgcaactttcacaaaaaatttgaattggtagatttgtttcaagattcttaccggcaaggaaggaaaaaaaatcaaattgtgcgtacatgtgagaggattcggttgacctccatttcacgaaaatagcatgctacgaagagatttttaaaagttacatacaagtgacattgtagttacaatgtaattacaactcgattgtaccataattacatctgtcaaatttctagaagaaaagttgtcgacaaatgtatatgtgacctcaaaaaattaaaaaaaaaatatttcaaatgtcaataacaatagctgtgcgacacacggttttacgactatgaaatacaagaaagaagagatcgggaatacaaataagctcagatatatgtgtagttgttatcacttgtttatatcagtggcatggccgctcgtgtgctgctagctgcatgccccatccatatattgcatacatacacacatgctagctactctcatcactctaaattctaaaatacacacgacaagacagtacaaatcgacgagcgtcttctttataaatcaatagccagcctgcaccacagcctgtgcccatccaattaactacaagaccccagttcatccagtggatcgatcgatcagagctagctagatcgagagatcacaattcagaagcaaatcaatcaagcatcgatcgatcgatcgacatggcgtcggagaaggtggagacgatcgtggcgggcaactacgtcgagatggagcgtgaaggcgccgccaccgccggcgaaggcgtcggcggagccgcggcggcgtcgggcaggcggcgcggcaagctcgccgtctccagcctcttctggcacggcggctccgtctacgacgcctggttcagctgcgcctccaaccaggttcaatccgtcgtcatatgacatgacatgacactctcatggcgatcactacgatcgatcttgacgtcatcaatggcgtgattctgtgcaggtggcgcaggtgctgctgacgctgccctactccttctcgcagctgggcatggcgtccggggtggcgttccaggtgttctacgggctgatggggtcgtggacggcctacctcatcagcgtgctctacgtcgagtaccggacgcggcgggagcgcgacaaggtggacttccgcaaccatgtcatccagtggttcgaggtgctcgacggcctcctcggccgccattggcgcaacgccggcctcctcttcaactgcaccttcctcctcttcggctccgtcatccagctcatcgcctgcgccagcaacatctactacatcaacgaccgcctcgacaagcggacatggacctacatcttcggggcttgctgcgccaccacggtgttcgtcccgtccttccacaactaccgcgtctggtccttcctcggcctcctcatgacgtcctacaccgcgtggtacctcaccgtcgccgccgtcgtgcacggcaaggtggatggggcggcgccgcgcgccgggccgagcaagacgatggtgctctacttcaccggcgccaccaacatcctctacacgttcggcggccacgccgtgacggtggagatcatgcacgccatgtggaggccgcggcggttcaagatgatctacctccccgcgacggcgtacgtgctgacgctgacgctgccgtcggcggcggcgatgtactgggcgttcggggacgcgctgctggaccactccaacgccttcgcgctgctgccgcggacgccgtggcgcgacgccgcggtggtgctcatgctcatccaccagttcatcaccttcggcttcgcctgcacgccgctctacttcgtgtgggagaaggccatcggcgtcacggcggcgccggcgtgctcccccgcgcggcggcgaggctccccgtcgtgctccccatctggttcctcgccgtcatcttccccttctttggccccatcaactccaccgtcggatccttcctcgtcagcttcaccgtctacatcatcccggcgatggcgcacatggcgacgttcgcgccggcggccgccagggagaacgccgtcgagccgccgccgcgcgcgctcggcggctggccggggacgttcgccaacaactgcttcgtcgtcgcgtgggtgctcgtcgtcggcttcggcttcggcggatgggcgagcacggtcaacttcgttcgccaagttacaacctttggcctcttcacaaagtgctacaagtgccctccaagacactagaattttaatttttttgaccatggttaatttcttgatgagaagttaattaatcctgctacctactgttgcataattgcattaatgcacagagagagaagaaaaaaaaagttgagagattgcatgcgagcttcatcatctatcttaatcttccatggcgatcgagctcatggcattgttgattatgattagtgtctgtgaggagagagattaattcctgtatgtatgtatgtatgtatgtgtgtatgtgtgtatgattgatgatgatatatgatggatcgaattgaactatatgtatctctctgaatcataggtgtgatgcatgttcagttaggtttttttttgttggcgtttcatttctttcctaattaatttgatagaaatggatatagcttctgtgatgcaatgttgtgcatgcctctgtcttttaaacaagtattggagattcagattcctactagtaagtgaacaagtattattgcaagcaagttttcaacttttcatgccgtggcagtactcaatttagaagtgcacatatgtttgggtgtatcaaatcaaatggtcctaccaatacaccaatgctaatggcctcctttgatcctttacaatgcagagacatccaatggtgctgatgatgctgttaactgatgatcatacccacatccctcaaggacaatcacacttgaagaatcacatgactgacagagagggcaaaaagcttaatctgcatgcagtctgcaagctttgcagatcagaggaagaacctgcatgcaggcctgcatttgcatccatgcatgcaatggtccaccttttgtcccagaaaaggtgatactgaattctaattacaaaagggtaaaggaagataagtatacatcaactgaagctgatgctacaaagctgtggtccatgtccttactgtgatgtgaagaaaggactagcttggagaccatatgtgtgcatctagtcccataaagtcatatatgatatatgatatatgcatgcatggatgcagccacaggacaaaggaggtccaggactgaataaacaaagtagtaattctcagcttctcatatggttgcatcatgagggctctgtagtttggatctgtggtaagattttaggataagttaataagaatcctaatgcattgagccagctaactgggcagttaaagatgttgcaaggtcagaaatttccagtttttcagacgtgttaaaaatgttgcagttaaaaatgttgcaacaattattccaaaaaaaaatgttgcaacatctgaaatctgcaatgcaatgcaatgtattggatcatgcaccatcagcaatgtgttaaattttttttaacatttttaacacattgcattgaaaatttcaggtttatgttaactgctcccaagatttcaggaaatttgcaggtggggaacatgagatgacatgaaacacattgcattgcatagaaacggtataatatctcaaactctactgttctaatagaagaaaaaaaatatccacaatgaaacaaagcaagaggcattattgagttaagtagcttcaagtgtctgaattgttcttcggtcagagcatggacagcttccatgggcacttgtcagacaaacacctctctctctctctgcagaaacgctaacagctagatgacaacggattgtgggaggaagacgaacaccaaacaggaaaacactccacggcatgagctgccttccatcaccacaactgtttcgatcggatgggttctgaactctgaacatttctgaagaaaaacgaacaaggagttgctgccaaattaatcacccctagcttagctcgtctctaccttgagctcaactgtttgttcagctagactccagatgccttggatcatgtgccgtggcggtacgttccggcctcggtagccgcgccgtctcctcggcgtctgtagcggccgtcgtcgcccgccttcttctccgtctccggtgggccgtccggggacagtgatcatattcagcaagctggatgcatgcaatgccagtgcagtgcaaaacagcaaaagttcagagatgcagcaagagcctacaattttcagacttcacctccttgtcctgatgcctgaacacactgtcaacaggaaaattcctttctggtgatggtgatcagtgttctgttgcttgtgcagtgcaggatgattgagttgcagtagccatggataagatgtggggtttagctctgaaaactctgaagttatgtgttaaccgtttcagattagtataggctgctatatgatcctagtaataattagggaaatctttagtctttaccatcctttaaaaaaaaagtatcggaagatattatatttttctaatgaaaaacttggtacctatagatactaggtatcttgaggtataaaaatttttagtgtaaaatttctctactaattaacaaagactttttcaagtaaggtaaaatttctccactaattaaccttgccagagagaatgctactgctgcaagactaagaaattagtagaagaattatcatcagttgattcttatctcaatcaaaatgacaatcagaaagcttgttagaccaaataacttggtaatctgctaaataacctttttctctctctttctgtttgagaaagaacatcatgttagctgacagaaggagacattgcaagaaccaaaagaatggaaaagaacagaatgcatcaacgaaatcacaggatacatagcccagttgcagagaacgccaacaggaggcagcaagagcaagatgctttataaattgcaagaaataaacactgcagcaggaacaagcagacatccctgcatgcatcttcagtgcatccatccacgagcactgattatttagatcctgacatgtctgccgttccatggacacacaaagaacaggttaaatattttgattagcccagcactaactaaccacagctgttgagcttaagcctggcaggtacagtacatgccaagcaatgctacaagcactagcattttcaggccagagactgcagggtgattaagcaacactcccagtgtctctacaagtctaatgtcagaattcagatctaggagaagctcccttttttctcaagtacgtgtcagtgtgtgtgtgatcatcttttttcttttctgtgacaataattgagaagggtccaatctgcaatatgtgaaccccaagattcctcaggtaaatggcaaataggaaagcttaatggtagaagtggttcaaagttcaaaccaacatgcatacagacttgtcatttccaaccatgccactaacatccaaagacacacatattgaacaataccactgtaaagcatatattaaacaatattactgatacagctcaggataacaaaatgtaacacaaaggaatttgttttgtcccgttattcttggaatactgggccagaactatttatggattattcgcgccacactttcaaaagtattacttaggctacttattctaagatatacttgttaggtttataaaatataattatttgattcatttcctataaacaaatcgatcatccatcatcctacatccgcatttcatctagaaagaattggcatcgcgccaccccaatgttgactaagtagagctcaagttttatttgatggcttgcatatccatgtttcttaggttcaaaggaacaagaatgttcaacaaaattggagcccttttgatctaccatgaatgaacttcaaatgcatcactatatccaagctgaaagccatcacaaacctccttaagctgcatggctcaccaataatgccactgaaaagctgaacttctccatgtccctcgagcattggaagatcacatctgacagacaaatcaaaaccactgaccaattctgatatggcaacttctattgttgcctccactcctctacaaacaattccaaaagacatttatgtatcttggattatgaaagctgccattaatgttttaccagaaaatgtagcctactaaaaagaaaggccaattacacacattatgatatgtttattttttttctggaacataacaaactattcctaattttatttgcctttttttgggggttgtgatattactcacaagtcacaacatagtgcatgtacacttcagttcactgaactgagtaatgatgttctttcagttacaatgctgtacctaatttgacagttctcctgaccagtgaacaccaaagattttcgaatcaacagcaaacaatttacatagattaaatttacatatggcttctgaacggaagagcagctacttctaggagcaagagaacttaagacagaattacaccttgttttgagtgtttactgtgtagtcagcagggtcacttcatatttgacttcacttgcaaatacagtgactgatccaaagcagtagactccagcttttgagcaaagcatgaatgaatgtccagaagatgattctcaaaagtcattgttttcaatggctgtcctacaaaagacgaactgtatcgctgcattcagttgcgattaaaaatctgaagagcttatgaattgaattgcctatgcttgctgttggtatcatcaccaagatacaatctttagagtttcagtatctgaactgccacgtttggagaaagaacttccggagaaatgatctggatcattcttaagatgtccaaggcagatgcattggtgttaactggactgagcttctcaacaattaagcttgagactaactaaagctggatgagcccaacatcaactcaaacatgtcatctggggtaagaagggttgttccccaagaataagctccacatcaggtctgctgctgtctgatattgccttcatgacttcccggaccttgcatagaaaagatcatttaatttgttaaagatttactttttcacactgcgatatatactttgccaacacataagcacaaattgcacagagaaaaggaacaatcatagatgggaaaagttgcagatagtccaaatactctctccatcccaaattgatcgtataatgtttgtgtaccaagacctaggataatttaaaccgcattgattaagacgccatgcacaatatgcacatattctcccacagtgcatgcattgattaaaacataatgcacaaatatacacattctcccatgttgtattaattgcactccgatgaaatccgtgtccatgcggttataagatgatcaatttgagaaattttagtttctattatatgatgatcaatttggggagggagtaacaagcactggataatcagttaaaaaatattggataatccacacccaacggatattgatataccaatacaaccatccatatccctttccatatctcctccaatatagaaaggttccttaccattctaacaaatgttttggcggcagattggatcagacattatatgtaccttctttacaaagagaactttttgcaagttccttttagttctattgtggtttgtaatctcttatttggatgagtgcaattttatgcgcttttcaaagtgcactaactaaaacctcatgttttctacatgggaatgtaacctgatattttgaagataggaatcgtgtaccaactgatggttctgaaagtgccacactaccagtacactagcaaaacatagaaaatataggtcaaatttgaggattcttactgtagttttaaacaaaataaacaaatatttatatttaaacaccaaacagtataatagaaacacagcttcaataatgccatactggtatgattgaatacttgaaaccaaagaatatggaccatacctcaagggcattgatgcctcccacaacaaaaacgatgagaatgctttggtcgccaaagcttggtttagactgcagatagtattgagtgtgagaaaggatagctacagagtggtggcaaaggaaccaaggaagtacaaactaataactcacctgtcctagcccaaacctccccagtccacttttaaataaacgtccaacagctgatgagtgatattcaaggccaggaatgtcataccttgccaagacagctaatagcaacttatagagcaagccttttcttgagtatatgtcagtctcaaatctgctcagtgctgctaggccttctccaagagtttggttccttaacctcatactggacaaattgtgaaagaacttaaaaagctggtcaactctgtctcgtacttccaacttaagttgcatgtccccataagcttcatccttctgatcatcagtattatcatcatcatcaccccagctatcccattggtcatcaaaatcatcagtactcttagaagcttcgatggagtcattacttttgtcaccatctttaggtctagctttagcttcaagctcattctccaagccaacaagaaatctgagcttcacagatgatggcctgtcaaggatagagtccaccacaatatctttcaaagaccgctcgtcttcccaagagaatggaccaccagcaatcgatgtaggaaaattttcaccagccaagatatacccgataattgttagaagcaaaacatcctggaaacttagaaggccctgagaggactcagttttattagcttgcttgtgagattcaactgaagtgctagtgttgataaaatcacgaagctcactggcaagactttgagttgtctctgcagatgttacacttaatattctctctgcacttgtaaaggcatcccagcgagaactttgaggctcctggagagccatttcagcagccagtgccaattggataacccctctgtttcttactaaggataactggtctcgagagagcatttgaaccatagaatgaagctctgaaacagaggcagctccttgccgacctttggatgggaaggataacttctcatgttgtaaagcttccataagccatttcttaatcaacattaacccatcttttgctcctctgtcgagtaatgattccaagtagcacactccagcataattggataggaatgaaccatttaaactaccatgttgactgctgagtttgtcatcatgagctttatccgcgtaatcaggtagccaggttacttcagattcaacttcagcagagttccatccagacacaaatgacatgatactttcgggtaacatactggtcctactcttaggttcttccttgctgaagaccttttcaaaagggacctttatatctagtgggatacgtttaacagtagcttcagaatgcttgcttggagtttgtggatttttggacacaaaataggatgaagtcccttccttgcgtgtcaaggaggacagcatcctatcaagaaatgagtcaccgtggaaacaaggagtaaggagatcaagtgtacgatctacgatcagcaggccagcagatctcttattacgaccaacatcatatagacttgacatatccatcatcagcttcccgatgacctttgatgtatctccaagtgaaaatatatcgagctttaggtccatctacacatgttttgtaatacggatcactaagtggttatatgaatgaaaaataagaagccactagtaagaaatatgttcttatgataaatctttaccttactggccagatggtaaaggaactgggcagtcaatgtcactccggggggaatctcatcaccatcaaaagatctaccagtagatatgggaggtagccctggactaagggaatcttcatgatggtttgataaacatgattcagccattgtgccttcagatggcaaaacaaaagtcctagaggaaataggagagaaaatcatcggaaagtgagtcacagttacagataatctttttcctttagtttctagctggcttgactcatcagcaaacaaatccttttttgttgggctagattcagaattagagccataatgcaccccagattcccaattggagtatctaccaccatccgatgtgaaatcttttcctgtgtaaaaagtggtatctttgtgctcatctgacttttcatacttcttcagaagttcctcatggtcctgagtaagtaatgtctcatactcccggaaggcatctggtccaaatggggaatcaacatatgctgagtgaccaacctgcaatatatcacaaatgattcaaatcctgcttgcagaacttaagatgattttgctttcaataaaaaaactcttaagttttgcaaaaagaaaaaaaaatcttataatatgggttgaagcaagattgctgtttatcaacatttggttgagcaccacagaagttaccacaggttgcaaacaaaacaaagtccacaaattagctcatactaatacactcatatgtgttcagctatactatgtacaacaaataattcaagaggacattaagattattcatacaataaataatggtttagataagcttccaaatggacaacatgcaacaatacaaactacatacatgagtgttgagaccatcccctggagaaaggataaatcaaacaatccagatatagtatatgataccttcatgataatatggaaactaacatggactatgtacctttttcaaaggaaattaaataggaacttaagccccaggcaaaaaataaaataaaataaaatctaaagccattttgatgtgaacagaagataattgtaggaaaataatggctggatgttcaagcatttcagaagcaatacaggcatcaaagtaacaaattcttgcaggaatgaagtacctcggaaatagctgtcaacacagtacaatgtgaaatagttccatggtttcccaggcagcgcaaaatataccgatgtgcatcactaagcaggcgtgatgtaatcactactatcttccttgctggatgtgcaaaacttgagtgccattcagcagcctgccaaacacaagttacggcattttgatcatgtaaagaacaggatggcacatttgtcattaaaaaaaagcataattttttcttactttttgtacatgaacaaagaaaattatggttttatataagaaaatatgagtttgacactaaggttaacatgaaggctgttaggtgcactgcttctcatctataagaagttcagaatgaaaaagaaatatgaagtacagaaattcaagatgtcataggaccaaaaaggtagtccctccataccataatataaattgaattttatttgctaatagtatcattggattgacatttgaatacactttcaaatggctataattttgttcctacaaactttatagtatatgagaaattatgagtcaaagattagttttggagaccgtgacgagtttgaccatgccttatattttgggatagagggagtagtccttagctctaagttgacacaaatcaagaaacaaatgccacttgcaactatggtttcttcctaaactttgccactcatgtgccagacacacactaaaaatgcttgagctttggtgcactcaacatgctgcattcagtttgacacataaattactactgagcagacaacattgcaacttttgggaggcattgctattagcttactggctaactaccttgggaggtagtatgcattattaccatatctattctttattactagtataattaattgacttttatggcaagggatttaagtaatctcacagcatcaagcggagatgcattctccaagctgcaaattgcacgagcaccaagctcaagaagcaaggggaaagctccaataaactgaaacgcctccagagtgcctgcatcaaggtacactagtgcatctgcaatctcatctccaatctgcaaagcagcaacagaccaaaaaaagaacataaatttctatagtgaaagccacgaagataaagtccattagttttacatgcaaatcatcaaataggaatttgttttctcaaagttatccacagcttaagttaatcacgaacgaataacagcgacttgtcagctcagaagctaaaaggataaatctttaccaagttaagcagctcctgtaatttatcgttttggaacgagaaagaaatacggtcaggaagctgtaaagatgggtttttttttaaagaacaatttcatcgctccaatagtccaattaaacgcagtagtctcatattcatctccaaagtgcaaaattcagataattagaaactgaaaattctgggaatcttcttacacattcagtttaacccggacaaaattaatctcttacatgataataaaaagaaatcgaacaaacaatgaggaatccgagcaggcaaggtaagagagagaagtcgcgaagagatccgacctggcggatggagtcgaggcaggcggcgatcagatccaccgaccccatagtccactatcccctgagatcccaggaatcttttcgccgccacgcccccaccctccccgtgcgccggcgacgcggtagcgaggatgggaggggagacaccagccgtaaagaactcggtggggttgggggtgttcggcgctgccgctcgccggagatgccgccggtggtgtcggatgaatcgcggcggcggaggagacgagacgagacgacggcgagagagagaagagaagacgaaaggattagtaggcccgtttggagtatccggcccgacccatctgatttgggcccagtaagcaaacgctcatgggtgtcgaccaattgaaaaggaactttctactgcatatccgtttcatattaaaagacacttttaatttttttccagtaaaactcttttttgagtttgatcgaagcttattaaaaatatatagtaatatccacaacgctaaataaatttgtttcattaaattttacattgaatatattttgataatatgttttgttttgtgttactatatgtttttaggcaaacttagtgaaactttaaaatgtatgactaaaaaaatatacaaaacgttatgaaaggaaactagtacgtacctccgtcgcataatataaggtaatgtttggtttggggacaaggtgggatgggttagctccatctctatttttgaatgggatgattatgtttttttgtttggttacagggatggaacgaaccctgttttttaatttggtttgaggaatataatgggatggaatgatcctatacattgtttggatggagggatgaaggtgggatgcctgatagggctacctattgatattagttggtgaagttacccccaactagtcatgaacaccatacagtgcaaaataatacttagtcatgaacaccacactatttaaaaatgaccattgtgaattccaatttcgtttgttcacaaacaatatagctccataagttattaaaaaaatttaataaaacttcatgtatgcccaaaataattgctgcagcagcagcagaagcttcacagtgcacatataatacaagccacacataataatagcaaattttagtcttacatatattagcaacttaaggtcttcacatttaattcttgcacatgatagcaattttaagtcttactcgtactagtaagttctctgcctcaaacatattggcagtttaaagtcttacataataggtaaataagccaaccaacaacacataacaccaaaagaactatccaactcatccaagaagcctatgttgatccagggaacttttcactaatgaacatagcaaaccaatgcatcttgttttcaaatggaagtccatcgaaagctctagcaatgtgagggtgagcagccaaatgagcatagtaaaatgatctatggacctcctcaaaaccaggaagggttcccaatatgtcaaataaaccttttggaagcttattgtccgggtcggctacctttagtatagcagaggcaagcttgtcaccaacactagtgaatgcaccaatcagcccgtcatcttcattctcttgtgtttttgctttctttggcttacttgcagatgatgcctccgcacgatcatcagtaggggcaggaccatcattttcttcatcattgtcatcttgaacatcctctgttcctaggactgaacttgagtcctttgcatactttcctgtagccatggtgctaccaaatattgtaagcatctcaccatagtgtgcaagaggtttgttaaaataatctgcattagccttgtgatccttcatgaaacaaaagttattgtataagaaaatgcaataaaaagttataaaaataaaacaaagaacccacaaggtaagacatatacctcaatataaccattatagtgctcatcatcaagagtaataatgaaaattttctcatcccaactagccagcactcactttcctaagcctatttatctttgaaaactttctttgccgtgtcttcaaatggttcttaatttgctcacccgtgaaagtactattgaacctttcattgaccgccctagcacatgcattgagatggactgccttgaagccagatgaggtccttgtgccaccagcaacaacattaactaggtgagaaaacatgaaagaggacatagctgaggtccatgaagcatgggtgcttcctcccttgccaaaatgaaacaaaaatgtccattcagtaatatatatatatatgtatatatatatatatatatatatatatatatatatatatatatatatatatatatatatatatattaataaaatatgcatgcaacaatatatcaactcagaaaataaccattcagcaatatatctaataaaaaaattcagaattcagcaacatatcaacccagaaaatgaccattcagcaatatatcaccccaaaaatttcccattccccaacatatcaacccaatatatgagcattcggcaatatatctccttaaaaatttcccattccccaacatatcaaaccaaaatatgagcattcaacaatatatcaacccaaaaaattaccattcaccaacatatcaaaccagaatggaaaaagtacgaattacccccccgaactatcgcggtcatccgaattacccccccgaaccataaaaccggacattcttcacccccaactataaataccggacgaattaccccctcgacccaatccgcggtagttttggtctacgtggcgtacacgtggcagtccagtcaacattctctttataaaaaaatgtgggacccacttgtcttacactactctctcctctctctactctctctctctctctctcacttctctctctcacttctccaggcgatggcggatgcggagaggccagcacggcggctaggcagcggcgagcgcggcggagaggcgagagcggtgaagaggcgagcgcgacggcgaggcaaaggcgagcgcggcggagagacgaggc

SEQ ID NO: 78810 - DNA, 14407 bp, Oryza sativa
  unsure (1)..(14407): unsure at all n locations
cgaggaggcggcgcgagatgagaaggcggcaatgtcgtccccccaccaaccgcctcaccgccgctgccgcctcgcttcctccgccgtcgcgctcgcctactccgcacacatagncgctgctcgcctnctcctcttctggcgacgccgcacgctcgcctcggctcgcctcctcgggcgtccattgccggccctcgcgtgccgaccgcccgcgtcgccgcccgtcgccagacctcgcgagccgaccacccgcgccgcggtccgtcgccgggcctcacgagccgaccggccgcacccgcgcccgtcggggtcgacgccgtggccgtcttctccttcgtcggctccacgtccgctgcagatcgatcgaacgacgacgacgtcgcctctgcctgggccctgacgacgagcgcgacagcacaccggcgaggcgggaagccaaccgcggcgcggccagcagcacgcgctcgccgccgctccccccgcccccgcccccgcccccgggccggcgaccgacacgatgttcttgattaggttcggccgccgcgccgacacgacaagagggctcgccgccggctattccgccgccgccgactgttccgccgccaccggcgcctattctgtcgcctgcctcagtgcgccagggagcgagagaaagagagaggggaaggggtgaagagaaaggggataagaagagggattgggctgacaagtgggtcccatattttattttatctgttttggctgactagactgccacatatgcgtccacgtaggaccaaaaccaccctgaatcgatctagggggtaattcatccgatttacaaagtatagggtcaaaaataactggtactgaagtttagggtggtaaatcggacaaccgcaattgttcaggggggtaattcgtactttttctaaccagaatatgagcattcagtaatatatcaacccaaaaaattaccattcaccaacatatcaaaccaaaatatgagtattcagcaatatatcaacccaaaaaattaccattcaccaacatatcaacccagaatatgagcatccaggaacatattaacctagaaattcaacattcatcaattcatcaaactagaaattcagcatacaacaatacatttatccatacaactgacatttggcaaatggactacaacaagctgtccacgcgaattaaataaataaaaaagttcataatacaaatgaaatgtagcaaataaggtagaaatacaagttgcatggctacatattacactccatgatggttattacagtcagcccacatctgatcagttaaacgatgcctgaactgaaccatcaatgcatggtcattcgcttggccggttgacgattcatcaatgtcctcacttgtccaatcagacgggatgagtgtctaaggttgaacaactccttctcattttgcaccggattattctcccactctttcaagtggtaccgcacagcacgaaaaggaggcaagaatccttgtttggctccatatccagcatcaactagatagaattttcctatcatatgatcgataagttggtcacattcctaaatatcaacatttgtcatggagaatttgataaactatagtaatatattaccttgtgggacatgaaggccattttcacgttccaaagcatctcttaaaactacagcatcatgtgttgtcccctccgaaccagccaagacataagtaaaccgaagatcaaaatctacggccgccattacattttgagtggcatgggacttcctaccacgaaaagaagactccacattcttacgaacagaggctctaatatgtgtgccattaatagctcaaatacaatcctattttgtgttcaacaacattaaaaattagggacaatatatcaatgttcacataaatataaaatgagatagggatgaatctcacaccttaaagtaaggatcccatctaggatttcctgctattttagttggagtgtccaatgagggggggtctgataagttcatctcgtagctcaccaattgcatgaaggactttgttgaaataacgacttactgtttctccagacctatcataattagtgcggactaacctatttctaaggttatgccccaccgtatgcagaaacatagcaacttgttcctcaatacacatgtggatggtatcttcaagtaaaccacgatccttaaacagcttacaaaaacgaaaaaaactttctcttctaagtctaagcatatcgatacaagttgtatcattcctcctctagggactcaattcttatcctatccctttcaaccattgggccatatctaataccttctccttaacctcttgttctttttctagaccgaataatcatggccatcattgataacaataaatttatagcagcaatacaaactaaaagcttggtcctcttatccttctagatccaccaccaaaaataacacatgaccatcatctactgtcaataaatttacccaaaaaaataacattgttgaactaattatactacaacattcttgaacaaaaacagacatgcacagatctataaatgaaatccccattcagtgtagggatggagaggatgaagattttttaccttgaacaatggaaaccgagctctgcagtttgtgggtagggatggagaggatgagggagagcagcaaccggcaatggaggaggcacgcgcgccgtcggctcgccccaacttccgcagccgcctcgcccttctcgcgccaccgccactaatcctaaccctagaggctatcgtgaggaggagaaaagagcaaagggaaaaaagaaaagtggtgaaaatatgtggtgggacgcgagcgttaccgcgctgaggcacgtaaaatcacgagcgaggaagtgggatggcacggtccgccaaattttcgcggatgaagcggtaccgaatattgaaggaatattcccttttggaaccatcccatcccttctagcctctcaaccaaacacatctaaaaataggatgatcccatcccatcccgggatatccctccaaacaaacactacctaagagattgtgggtgaatgtgcctcatcctagtacaatgaataccgtacgtatgtccagattcattgtaataggatgtgtgtcacatccacccaaaatctcttatattataggacggagggagtataaatttataatcgtagggggaactacactatatggagccaattgaaagtacacttgtagcttttttttagaacaattgtaatttatacaaacttcaaatttcattatatatatatatttgactacttttatagcggtatgcttatgtagaaataagatatctactgcgcattataatatactagaccaaccaaacaacgatttttttatatatatgttaaaaactcaacctagacaggatgtgacccatacggccatgtaacgaatctggacaaccatctgtccatattcgttatactaggaggccacatcactttctagaccgccaaatagttagaagtgggtatcatcagggatcaatgggctagctcatgataaactatttaatccatgtattttttttgttttcgttcaattggcttactgtcaattgacgaatgacgacatacgaatggaaggagaattgacataacaactacttcttccgttttatattataagactttctagcattacccacatgggtgcctagattcattaacatatatatgaatgtgggcaatactgtaaagccttataacctgaaacggaggtagtagattacaatttaaattaatacggaaaatatcactttgtgcatatgggaaattttaatttccctatcattggtgcactacacatatatagataacggcaagcatatataggataatcatatcagttgcagagaataaccaaatgtttactccggttcactaataagaatgctaattaatgagcaaattaacactaaagaacagctcttgttcttatgcttacatatcctatcttactataaagttatcccccattaactccttaagcttaacatacaaagatgtcacatcatcatccactaacaagatgccacatcatcatccactaattaacaagatgccacatcatcatccactaacaatcatcacatttaaacatcatgcaaacatgctatatctttatagtttttataatttaagagcttttcaaatacaaacatgttaaattatcatccaacataattcacataatgtttcaatgtatatctttattatgttttatgatatcctatatacttatatagttcatcctcacttagttagtgcttaaatgattaatctatggtccaaattatctttttccttttttcctctaattaagtcatatcacatcaattgtttttagcctttagatgattaatctacggtctaaactatctccctacttttcttcttccataaaatcataccaccttacttttacgcttgaatcactattctacatactatttaaatttaaattatcataaaccacattaatttacttaatctaatgttatctagctatcttacacgctgtttttttattgttatcatactaaattcccgcagcaatgcgcggggtttcacctagtatatagctacatgtgcatgttcctattccactattattacatacattacacaacagttctgcaagtacttgattttgtactacaaaagacatgagtattcaaataagtaatgaacaccttagcatgtgtttggtatggggataaggtgggatgggttaggtccatccctgttttattgggttgagatgattctattttttatttggttggaggaatagaacgaaccatattttttttgtttggtttgagggaaaaatatgtttggtttgagggatataatgggtagaatgatcatattccttctttggatgaatggatggagccaggctccgtggatatagacacctttggtgagattacttctcacacaatatacatataacaaagaaataatttttgagtaaacatgagtttagcaaacatatatactactatttgaaaacgatatatttgcggcagcaacaaaaatctaccgtgtcatgctcattgcggcgctggcggagtgggtcggcgcggtacgaccatttttcatggatcgactggtcccagatattagtggaatattctcttttggagccaacccatcccacctagtcccacaactaaacacctatgaaagtgggtgttgggtttagtgctacatcggtaattgatgatgggggagcacggcttaaaagatgggggtggtcctcactagggctgaaaacggtacgaaaactttccggattccggacctattttcaaaaacggaatctgtcggttttttcggaaacgaattcgaaaatattttctcggaaacagaatcaaaaatgataaaggcagtttccgtcggaacttggaatcggtcggaaactttccggaaattttctcggaatttccggaattttttttggaatttccagaaattttgtaactaaaatatactgggttctttttttaagcacttaatagtgaataccatggtattttgctgttattttcttgaaaatatttttttatgcaaatctaaaattacataagaatattttttccttcattgggattttccaacatcattactctcttaaacatagataatttatttcatagattgtgttttgtgatgtactgttaatacttaataattggacttatatgattgtgttttatgatgaatcgttgaccgttgagacttgagaattggatttatcagtttgaggggttttttattccgataaattttcgttaccgtatttacgccggttcgttttcgctccgttttcggtttcgataatattcagttccgttttcgtatccggggtttccgattccgatttcgaaaaaaaatatgaaaacgaaaacgataaagatggtttccgtccgtttccgtaccgttttcacccctagtcctcatacataagactagtcttttgggttgtgtaggctcaggacctaaagttgtggctccggttggacttgtgtggagcaggcccaatgtgacctgggtggcccacggttggtgggccgagttgcgtactctaacaagtggtattagagcccaggtttagaacctggaacgatttctatgggtcacatggtggggaggccaggtaataagtcttcagggtcacatgggttgatgtgacggggagattgttgagcccgatgtcttcggggtcacatgggttgatgtgacgggggagattttgttgagcccaatgtcttcaggatcacatgggttgatgtgatggggagattgtttgtgtttgtcttcagggtcacatggattgatgtgacagggaaggttgttgggcccgatgttcggggtcatatgggttgatgtgacggggagattgtttgtgtttagtcccatatcggtaattgatgatggggggacgagggagcacgacttaaaaggtgggtgcggtcctcatccataagactagtcttttgagttgtaggcacaggatttaaagttgtggctatggttgggcttgtgtggagcaggcctaatgtgatctgggtgacctacggttggtggaccgggctatgcactacagtgggttcgacccaacccacccacgaaatccctccaaccagacagtacaaaacagatcatgcatcaagccatcatcaataatatcactgtcatatatatgtacccgtccattgatccatatggcgtccactatatatatgatgcctcctaaacaaacagcacagcaggtgctacctatgtagcagcagcacatatgtagtgcaggtatatcaaggaagaaagaaaagtaattaaagaaagagctggggatcgaacaagctagttatgtggagccatgggagttggaggcaagagggaagaactgctcgtcctgcccaaagcaatacgcgcgtactctacatattcgtagagtacgcattaggttgctctctcggcatcatattctacatattcgtagtgctgtgctatgggaaatctatggagttccgcgttctgcggaaaaactgagatagactcctggctccatgcatcttcgagtactgtcgcaactctagcctatgtgttgtgctagttgaatccgtgtattagatgaatacatacttcaggtagtatagaattgtacaataattaaggtgcaagcaaagatcgtagtaaaacttgtcttctgttatataggcatagactattactacttgtcttctgttatataggcatagactgtatactacaacagaatgtatggggcagctcaaattaatcaaaagttttagtcaccaccacagtatgcttgagacaataagatccaccgacgattgcataactttgttactaggactgccagtaggtatccattgctcacatacatacccattgggtatggtattggtagaaattatatgtttaaaacttggtaaatatacatggggagggtacttaattattgcacacttcaactataatcattagaagttaaactccaactaaaaagttgtaaaactcgcattcgcattatgacaaacttgttgactcaaatttgatttgatgacgtctccaaaaaaaaagagcgacgaaaaacatcaccgctgtcgtccgttaaggtctcaaagagagacgaatctgggttttcacctgacagccccactggaggagatgggacggcatgacaatgccctcaagagggaagagggaagagacgcttgaaaacgtcatcgttgtcggcccggactaggtcgggctaggtttttacctgtcggccgctggctacgaacccacaattgatgcacccaagctccaccgctgtcaaacctccgtcgacatgtgggaaccgctgcaccgacgccccctgccgaccaggcttcgtgtgccggcattccgcactgccgtccgcgccttctcgcgccgggccgggtttcctttgtcgtgccggccactagccccgccagccaggcgcctgctgcgggcaagcgcccgcgcctccgtagccgtcacgcctactgcggcctcctgcgcctccgccgccgacgccgcgcccacattgcaccaaacaaaatctggcggcggcgacaccggatccagccgcaatggggctagatccaatggtggcggcgccgaatccgcagccacgtgcctcgccgctgcgctgcgccgccccttcgtgccaaagacgggacgcaccgcaggggattggagcctcaccactaccatcccggcggcccgcgcggtttcctgtgacacgcttcggcggtggcaaggcggggaaaagaagggaagggtggcgccgcccaggggctagggttcgcccccgatcgcttttgcaagggcgacagggagtgcgtcattgagaagggatacatttcttgcgttgaattttcccttaataatctttttaatggtttttactatagtagaatccatctaggccgttgattttttttttctaattcaatgaatcatatctaagttataaatcaatgattgagatcgcacctttaaggataatattgaccgtagaatacacccgtagagaccgctgtaaaattactcttaaaaaattatattcatcacccgaaagtgtgcataacaccgtcaagaaagatcatctagttctctacccacctttatgagataaacatatagttgcgatgttcagacaatcagagtgcataaatatcaagagatgcacagattttcgatgttcagtcagccaatcgaagtgcataagtgttgagttcatctacacagattttccatattcaggcagccaatctaagtgcataaatgtgagttcatgtacgcattgtgaaatcattgtcatgattaatattttgtgatgaacaattggctttgcaaatagtttgttcaatgaaaattggtttggaattatatgtggatattggtgtgagcgtgtgtgactaatgtgggtcatgttgtgatatttgtgtccagaaatagttgttttgtctgattgtgtgcaagtgacttaaagtcggccttagtcaatggtaaggattaggactatactcacggaagagcatagatctagcacggtcgtaataccatgtgaaaagtgactagagtcagaattcttagagatcaactttggtcaacggtaagatcgagactaggctcagggaggaattaaggtccaaatgataaatgatactaagggataaagttggatacgagatgccacacacggttgatagacaccgtgttaaagagatcttcgcaacgggcttcacgagatgtccgtgcaagcgtcggttttcgcggaggaggttggaggttggagagagaaattgttggagtatatggtcgggtactgtagcggtggtgctgtgccatgcagtgtgctggttttgtgtaggcccgggcagcaggaggctcagctggcccatgcggcaggaaggaagcagcaggcagtagcgcaagggaaacgtacaagggcgacgtgtcgtcaccggattggcgaggagtcctgttcggattcattgtggctggctgtgtccgcggtgttttgagagaacacaattttggtaaattgtatatttggtttggaatatgagggattgagtactactgtaagcatgtagcagcagccggtataacatagactgatcgacgaagtaaagagcaagtaaagggaaagtttgggtgttcaatcgattatcgtggagacatgcatgggaatcggaggcaaagagcaaggaatttttcgctctccccagtctctactgcccagcaaaaatcagtacatgcaaaaatagtggttgcaatgttcagacaaccagagtgtgtaaatattgagataaacacatatttgtgatgtgcaggcaatcgaagcccataaatattgagatcatgtacggctataccttgtttggtcatttctagatgtaaataatgagccaaatttccactatatatcgttggcatatcaataccagtatcatactgtacataattttctatcggagaaaccagtgccactagcctacactagcagagcacaaaactagctaaaatacatggtacttcgctagcaattatggagcaagaaactagagaaagaagtgaaaatctttaggaatttggtattgagatcggctatgggaacaggaggcaaaagggaatgaaccaagagttcatcaaacctcatgcattcttgcagcggcggatccgaaagactaaaagaaagggctaagcaaactagatgaaactataatcccttcttttgatggatgtatgatagatagaggggcttaatgggagctcccatggttacgacactggtagtgtgtgttcgagatcccgtagcctctatggtggatccaccatgcattcttgggcaccaaacttcctgatgcaaaataagaacatgagtacttgatttctatactgaagttgtggcaagaaaattgatgcttccctttttcttttttagttaggtggatggatatgagagtcctacattttcgatgttggaaatgggagatgatctcctctctgttccataaggagagaaaaaaccgtagtatatagtagtactagatcgatcatcagctactcaccaataatgagtaattgatcggtatttttcttgtttctttttgggaaatcggcttagtgacaattaattaatgagtgaggtgtaaggaagagaattggcatggaagtatgcaactactaaacaacactcaaagtatgccaaagtatgaaaaagagtaaagtgcattggtggttcttaaacttataggattgtgtcatagggttgtgtcatataggtccctaaattctcaaaatgcatattcaggtcatagaacttgacaaagtgtattatctaggtcccaaattaacacgttccttttagggatgtggcaatgccacatggacgtgacgtgtccttttctttttttttcttcttttctttttctttttcgttttcttctcattcttctttttttccttttttttgcacgggtcgcatagaaaggtgaagaaaggggaaaaagagaaaaaaaggaaaaaaataaatggatcctatttgtcagtcaaaataatatcatgtcatgtccgtatggtatgccacatcaacgtcacgtaagatcctgaaggggttgtggtgatttgagacctagatgacacactatggcaagttttgagacttggatatgcattttgaaagtttagggacctagatgacatactcctacaagtttaagtaccgcccgtacactttactctatgaaaaagaagaacattctgctattcgattttaattgtttagatgaggccgtatggattttaattatattgacacgtattatagcagaccagtgcatgttccaattcactaagtaaaaacatactaagacttttggtcatccacgtgataagtcaggattttagttgaactaatagtatggtataaaaaaacataatatcattttagacaaacgtggtagttgagggataatatatatgaacttatcattatatacaattattaatacaattgatccatatacactacagggaattctatttcccgcaacaaaaatttccattgcaataaactttaatttggtgcaatataggcatactgcaaattctgagctgttgctttgaaatgtagtaatattgtaacgatttcaccatgctattgtaacagctaataatgttacaaaaaatatgtatcgcaacaatttcaccgtgcgcccctcctgcggccatccggaggccggatctgccgctcgcgccactcctgcgactgaatcctccatccgcgccgctccagcgaccaaatctaccgcccaagcagttgggttgctgttgtagtcaccaccgcggagtcgctatcgctgtcgtcactgtggccgccgtcgcctttagggacgtgggggtgggagggggtggggtgggtgggtggagaagaatggagtcgatcggtgcagttggtgtggatttataatacagtgatacttatttttgcagttagtactccttagcagccgccaattttcgttggttgtcacttaagaggtccgcttgtacaatgacctttatttttttttcaagcggttctcttaagtgtcaggcaataaaaattggtttccgctggtggttggtgaccggaatcactctcaagtatttttacaagcatgtgttcattaaacccgccagtaaatataaaaggatagtgctatgaaaaatgattttgtactagtggttgtatttctcgggtggacgattgtcggagtttatctctaacacctacatagatcggctgcgtgttcttaaaaaaagtccaattgctgtaagatttcaaagaaaaaaattccaattattgtagaaccataggaattggagacaactggaaaaaactcatcgcccgccccgctcatccccacgctctttcgtccagagaaactcagtacatgcattaggtttctctctctgcataattttgtagctgtgccttgtgtttttttcgcgaacgctagctgtgccttgtgttgcagcatatatatatgatttaaaagaagctgctgcatctggacaaaagttaattaacatgaagggggactggaatatgaagcttgtaccacaactaaaattttttttgatgaagatgaagttgtcctgataatatatcaagataaggtagcagaattcaaggtgatagttagtgaggatcatttcaacctggatgaaaaaacaacttcctgttcttgaattcgtgcctaatttgaacaattgaagaaatggtctgacatatgatccaactgtattaatggtatagttgattaattggtatgttatcaattccgttgttactagcacgaactacctcttgctatgtgaatgatttctaaaatcaaaggtgttatgttacaaatgtgaaatgtccacatgtatatatgtatggggtttttcaaattttagtcaaacaagttaaacggatgacaaaatccgcacaatatttatacattattgcaatgctgcaagctattcgctacccatgtatacatcagcttttcatcaccaagttacaaacattaccatacaacgataggcattggcatgtttgcccttcaacattcatactcaccatggtttataattaattcccaattccaaagtatgatcttgcatcataatcagcccaaactagacagaaaatctaaccggaagtttgattgaacttcacatggctacagctatctaaagcatttcaatctatgtgctctcaatcaggtttagatcttgttgagcatctcaaccacttcttccatggatggccggtgcttagggctctcctccgtgcaacgccgtgccacatccaaatacgctatcatttcatcttggtcagcctctctcccttcccattggatccccatctgacggtccaggatctccaatgcctggcccttgtctaccttatccctagcccatttcagcatctctacctctttccctttcatgttgatcttcaccggccagcttggtcgccggccggtaaccatttccatcagtagcacgccgaagctatacacatctgcctttacgctcgtgcctacgccagcacgtaactctggtgccatgtacctacaatccatttgatcaaatattggtcaacagggccaaatatttgtaaaaagaataagcatatatgaaaaaccatattctaaaagggtacttcattgcaaggtattgaaatgcgacggcaacagctcaattatcatggttatcaaccttatcaagccaataaatatttacaaacggctcgataaatcggtcaagttcaataaaaaatcaaaccaaaatcgagatcaatgtgaaaaaaaattatctgaattcaactggttatcatcgataactgttgcacggttatcgaccaaaccactagggatcggttttcgatgacgaaccacatttgcaaaccatagtttctaataagtcaaaattatttttctagcaccgaaagtttataactacatagaatcataagatcctgattcattttgatagcacccaaagtttccaacgttctcaaaatagcattatgttaacactatcgttatcgaagtgctatatatacttctctgaaacactaaaaaaatagtggtggtgaatagtgagccacagtgacacgaacaataataaaacgaattctataaggagcatttatactgttggaattcttggattaatatttgagacaataatggtactatgattctttcttttaaattcgttggaaggcacaggcattcaactagtatatgaactattggccatagaagcaattttg

SEQ ID NO: 78811 - DNA, 5977 bp, Oryza sativa
  unsure (1)..(5977): unsure at all n locations
agggggtgaggtgacgtgacgttctcgttgggttgggatggggaaggaggtggagtgagtcgtcgatggagtcaacggtgttcggcatgctgcggttgactatttcttcggctgtcactgccacactgtacagtgtacacccctgtcgagggagaccttgacctgtgactaggctgggctcttcagttaattttccaattttccaaacctcttatctctttccgcagtcactttttccaaactataatagatggtatgattttttaaaaaatcttctatagcaaagttgcttaaaaatatatattaatctatttttagctaatacttaattaattatacggtaattcggtatttggtttttcgtgtctggaggcaaaggttgtgaaccttacctcccaaactcaatctaagactctgtttggatgagaaggggactaaaattagtctctcccattcaaacagccctaagtgactacaagtctcacgtgccagctaagctactacaatctatagaaaatctggaatccaagggagaaaaaaaaagagatgagctaacctttggaccgtagttattttacatgatttttttaatatataaaagtaatttaatttatgcaagatccttttacaatttctaacttcaaagcgaagtgagcatagttttactgcttaggttacttgtggttgaaccagcccgctctgattcaaatcccagacttaacacaaatacccgtatttatggctaattattttttaacggtaagtgatgtatccgtcaacagcgagatgttcgtggtgactttgttagttttaagatatgctggtcgggtcagtgtgagctctttttgagcatctatgtttatactgtgtttctaaaaaaaattctacatacatcagtatgaaaattttgccacttcgcgaaccataaaattctatattttgagttgagacgcaaaaggtacacacttttatagcccaaaaggtttgcttttattttctttttctgatgttgctaagaatcgacgggaagtttctaaggccttcaaagaagaaaagcccacccccgtcccaactagcgagcccacgacgtccagcgacaacaccggcgacccaaatcggacgccggctgatctcctctagagtttgaaattttgcgtaccatatttttatgatggctttgttggggggaaatttgtgcatgccttggtatttgtagaatgtttgtgccctgggaagttaggatttcgatattttgttgcttcatgtcaaaaatgtggatttctaatgatgtttcgaatgagaaatactaccttataggaaaacaaatccaatagatggtctaattttcaattaagatatgtttatctcaatccgaagaatgggtccattaaagatcctctgtatttgcaacagctcagtggaaaataaattttagccagtttgtttgcttgtctgaactgacatccaaatggtctgtaattagttcccataatctcaaaagttatggatctgtttgtggtgtttttagatgtgatatgttccaaatgttctttctttctttacatactccctttgtcgtaaaatatagcaacctagattcaaatttggagtactaggttatgtatctgtttgcatctttgtctctcatgtcatgtgactaatgtgaatgcatttctattctacatgtgcggcaaaacaatggtttaaggtcatcagttagatatcagagatactatccctgtgcactaaagtgccttgtcagttagctgatgattcttatttgcctttaagtaccatctacacacatgtcaaattagagttttgctacaggtttatcggcatagatttaaagataatgacatgtcaagacctgacaaggaaaataaaagggattcaaaagcacaggctggtgatctgatggatgatggtggaattcttgtccttagatttcttctgctgcctccttgtcttcgtgatacaatcaaaaactgcgggatcgtctatgtactagtgtgttaggtcgttttcaaaaggtagtgcataatattcgccttaattattgggaagtgtttttctcaagaagaaatcagagtcaggaaagtagtgatgtatagtcgtattggttgccctaacttaatttttaagattttaaattttaaatttttaaacttaatttttttaagattttaagttactttcaacatagttttcttttcagctttaacttttaagtcacaacaaaaaacatatatatatatatataattttatccataaattaatttttattttctaacaaaccatttttggcttattaggaaatatgggcaaccaagagtctaaaccgtgccaagaataatactctgtttttctatcaggcgtgttgattccagaatgtcaaacatcgaaaattataaccaattcttagttaacttgccggtacatcaagctcataaatactataccgatatactcattcaaatttgacttacctttacaaaatattgatttttatatctattaagaatatattgcctccgtcttaacaagagtttctgcagtactactttttttttcctcttcaaccattcctcattcaaatttgtcactcctacctaccgtgaaccactcttccactcccaactagtttgtcttttaaatgaaacaattacactgttttttagatgaagtatctgataagaaattgacagtcgaagtgtaatcttttctaaaatagagttctcagggagaacgtcaatcgtatcaaagtccactcatttctacgactgtcgaaaagggggggaaacccccccaaaaaaaaccccccgggtttttggggagaaaaaaaacccccccaatttttttnncccccccccccccccttgggggggttttttttttcccccccccgggtgggggccacctgccaagttcctcgggtttcaatcggttcttaaagaaaaagttggtagcagttttgtttttttattaaaaaaaaagttgccagctggttcattcattcaggaatcaggacaggaaagggaacaaatagctgaaccaaaaactgtgagagaaacgaagtggaggcataatgtgcattcagactgacaaaaagaccccatttgttcgtttgatggggtttcttgtcagattccttcattccttattccgaattccgattcccctcctttcgccgtttttactctcaacttttgatgacaaaaagcccatgttccatgtcggcaaactccacaatacctttatcctacacatagagtttcagagtttcagctaataaactcagggaatattagtttcaaatgtattgcaattattgtaaccatgttaattaacagaggttatctaatcatctaacaaggcatgctaggcaaaagagattcctgaggtgatctgcacctgccgaatgtcaaccacagcctgcaaaagtcacaatgaaagcagccttgaacccttgattagccttgtcatgtaaacctatccttttgagacacgtgcgtaaatagaggaatctaaaatagatatagctcaaggagcaaaatgtaaaagttgcaggaacatgaagtaagtaacaagcatctactgataaaaaaaaaagcaaccaatcaagaaggaattaggtcaaacccaacttaattgtacagtcaaaccgccgtaatataagctagtgtgaaagtctcactgccagcatttcattgtttaaaggagacaaatttgctctcaaattctcctccagttcataaatattttctctttaaaaacaaatcctccagtctcaggttgtcagtcctcttcacactgtttctactctgtttcacactaactgttctagatcatgaccaagacgaagcgaattcgcatcaaaactggccgataattacgcaacaaaaaataagcaaaaacaattaaactaattattcagtacgaacggaagtagacgatgatgagataaagaacaaacaaaaaaagaaaagaaaaaagcgaaattaattagcagattcgttgcacctcgccgtcggcgaactcactgtgcaaaaaacggcgaaattctccgaaccaatacgagagagcgagagagggggtaacgaggacggctgggattgcgccacgtggcagccttccccgccgcccgccgccctatataaactcgttgcagattgcatggtggacgacgactctagctgtcacgtagctcggtcgccggcgacgtacggacggcggcggcggccgtgatttcatgtgcggtggtggcaaggtggcgagcccgccgggaccacgactgccgcggctcgccggcgccggcggcgaggaagaagaggagaaggcggcggctggaatgctgtcgaggcatggacaggcgagggagatgtctgtgatggtgtccgcgctggcgagggtggtccccgccggcggcggcggcgaggcggaggagtggtgcccgccggcgtacggcgcggcgccgctgccaccgtctacttcccctgcatctcacggtaaggaattgaagtgtgccatttagcttggatagataattagatcttttcgtggcagtattattatgtgttaattttgagtttaattagcatcattgcgtgtaaaaagttaattgcatgtgcttagcagtttagcccaagtagtgtgtgtgtgtttttttttactagtctcatccagaacagagcaacttcatctggtagtttcggatttccagtactcatttctaacttgcattcctcgtttcaatttgaaaactatttcttttgttttatatatagtcttttgctgacttactaatagttttttaagtactccatttctgccttgatgtttttttttcagctattgtctgcttctcctcgtgtttatcaatctagttcttcacatttgtcacgtggagagggtagagagtaattagatggatatataatggatggacgtggtggttagcaaagcaagaaacaattagagaatggataatgattccaaatgtgcctaatgattatcattagaacgcatagttgcatcatagtcggtgaggtacacacgtttttcagattaagtaacagtggaatatgatcacgtcaccttgcaagagtagaacacgtgtgtgtgttccttttgtcactgtcccattgggtccatttggtcacctgcatgtacaccaaactacctttgtttttcaaaagaaaaaaaacacgaatattagaaaatgacctgatatcaaataaatagaaagggtgagaattcaaacccagactagctaacccatcaccttatggagttagccggaaaatccctaggtgtttctcaagaaaaggtaaaacattgtagtaaaattttattgaacactatgttgaagatcttggaaaaaaaaagagggagcagagctaaaggaaacatttgttggttgtttatatagagtagtacatggtaattattctgcttattcgtcagattatcgttgcagattatttactccgatccatgtccttttagaatacgatttttcaaaatacttttttactttattgtttagaccacctattctaatttatttgttaagtttataatgtataacattagctttcatcctcgaacaatgttgaaaacaccacctaagctagagatacgacaaaatttcaacataaatttagaaatatctaaaaaatgactatttttaaaatgaatcataatatatctctaatttcgtttaccatagccttcagtactctgtttcggttggattttgcagagcacgcagcagccatggcggcagggcagtacgcgccggcgacgtcgtcggcgatggcgtcaccgggcgagcaggcctcctcgccgtcgtccggcgacgccgccggcggcggcggcggcggcggcaggaagcggtaccgcggcgtgcggcagcggccgtgggggaagtgggcggcggagatccgcgacccggtgaaggcggcgcgcgtgtg

SEQ ID NO: 78812 - DNA, 1962 bp, Oryza sativa
gaaaagaaaacagttgtagcccatcaaacaattttaagtcatcttattttctcgaaatatccagtaggattaagcaataagcatcgttagtgagaattgtatttattgattttatttcctttatttgaaaacaagtcaaacgacctatctaggtttagcagacgtttttcactgttcatactctatcactaatcagagtatcagagaatgaattcctttctttgaatacaagtcaaacgacccatctagttttagcagaggtttttcgctgttcatactctattactaattagccaatgagagaaatggaggtatgaatccaagcttgtcacatcaatggtgcggccgccggcgccgccgctgccgttttccccgtgcaaatctcctctccggtcaagcgattacacataaaaaaccactcgaatcgttgtcatttttcttcgtcttccgatcaaaatcaaacacgcattcaatccgagagtcgcaactcgcggactccatgataaaagcagtgtgtgcttcttgttttctggtcgtcatctgaagacagcgatcgacatgcgtgtatgaaatctggacttcagtcagccagaaaagaaaaaagaaaaactaaatgcaacattagcatttaaaactaaatcaggttatagaatgtattattacaactctataaaatttatattacaactaaattggagtatttcggtgagaaaggctatgcatctggtgtatgaacccgtttgccgtctgacaccgacagacgaaggtgaacgagttttcggccgtagtatcgtaagcaacgacgatgttaagagcaagacggtcaagttcgcatttggagtcgtgacgaacgcctgtttagctggtgaaatgaaaacttttgaatgtcacatcgaaactggatgtcggaagggtttttcggacacgaatgaaaaaactaatttcataacttgcttggaaaccgtgagatgaatttttttagcctaactaaaccgtcattaacacatatggattactgtagcacttatacctaatcatggattaattatgctcaaaagattcgtctcgtgatttacatgcaaactaagcaattagtttttctttttatctatatttaactagcaaaagtgcctgtgcgtttcaccgggtgatcacggagtgtgtacagtgataaaaagtgttgtttggtttaatcaactaatctgctcaaaaaaaatttttgtttttagataaataatctgctctatatttgtggaatatatatgatgtttagttgggatgatttgtagcatgggagaaaatggatgaacgaacaatgcgattttctttgcccaaaaggcgacggataaaaatttgtatcacaaatggaaatatttatttttttatgtaggtaagtctaataaaatatgagtggaatttttgtactaaatgtactttgagttgcgagaatatatacttttttagaaacacgagcaataagattgacgaagttaccacaaacgccttgagcacccgtcttaaatcaaagatttgaatctaggttgattggttcctccacaagaaacctatccagttaaattatacccactttgcaattgtgggaatatacctgtgtattggtacctaaataaaatgtgttgagtttaacaaatcgtaaaaatcaatcttattatttttgtgagagtaagtattgtttttttatttacaaattgtatttgaggtcaaatattaataagtagatataaaaaaatgaaagaagattataaagggagggaaaaaaataaaaaaagagcggatatggacaaagaaaaaaaaaagagcagagggaacaggtcaagatatttttaaatgttaaacatttttaataatgagatgcccgtgcattgcagcggatgaactaaaaatataataaatataaaaatattataggattaggatttagattttatgatatgagccccg

SEQ ID NO: 78813 - DNA, 15057 bp, Oryza sativa
  unsure (1)..(15057): unsure at all n locations
tttggttgtctagttgattgattgatttaaagatctagcttggggatgtttttttgaagatagactcggactcaaatgaacgaacctaaattttgggagggacggatcacatggtcgtatggatgaaaattaggtgacgaaaggaaaataggcgacgaaaggaaaattatgaataattagttaagataatgggtttattttatatacggatgacgacggaaaattttttaattttttaattagttagagattagagatagagatagagattagagattagatcttttctttttgtgattaggaatttagattgtttatttattttttagaaataaaaagaaaaaaaagaaatagggaggggagctctttttttttctacctcgattcgctattttcttacagttgccgcgttttttttttcatgatcgcgcgatgacgcggcattgcaggcatgatgacgcgagcgacgattttatgtgacgtgagcaacggacgaaacggacaaaacaaaattacagcttgtatttgatacgtactcaaggccattaatcaatcggaaaaaaaaacatacgaaaattctaatgcattagttaagatgtgtctaaagatttgacgttatgtttttgcgaaaagttttcggaactaaacaggcccggaggacaattagtcaactgtaccacccacgtgtggccactgcgcacgtgccaatctgctgccgccacgtcagctccagcatgtggccttcgaccttgactccagcgtgtacaaacatgtacacgtcagcatccaatatgacttgcctggttaggcaggggctcagggctggctggaatcatcagcaacaggaagaatggacgaaacagaattcatggcattcagagcacacgcaggaaggaaacctaggttgttgataaataaacagcagcacagggtgtttggttgtttggtggtgcttttgctgacaggacaggcctagctacaaaaccaagatccagccacaaaatttgcccaatcagtcacaccgccacgggaagtaaaaacatactgatggggcatacggattcatgtcgaaacccccatacagaacagcattatcagataatttaagcacacgagttctcaagcttcaagggcacctcctcctgatttcatcttagaatcgaccacgcccacggccgcgaccacggaatggtcccggtcctccgccccttctttccctgccacgtcctgtgaagccgaccgaggatgagaggagccatgagaagtgagatggcgaaacctggaaacattgttggttatgttagactgagcttaccacggcctggaggggggtagtcctctggttcttcaaagtattcgccctgatcttcataatagtcccccctgccgccataaccgtaatcatagccatatccaccacgtcgaccacctccgtagtagccaccacggcctcttccacgtcctcgtcctctaaatcggcctctccctctgcctctgtagttgtaataatctccttcctcttcccactcctcgccataatcataagcggggggaccattgctcatggctgcacatttgctatgaaagaattagcaaacataatattatctagtcggcaagacattcaacaaataacatacactttttttagacttgcagatggaaaaagacgcataattgaatctacaaatgcagctagcacatttttaaacaaggcacaatgtaggaagtgttagaaactagatcttttatttatttatttaagaacaacaggatggtagaagctgcaaagccagttcataagattgaaagcagtatggcatgctacctacaatggtaacagatactggtaataaccatgtgtgttgtagtctggtagttttgtgctcatagaagacataagaaagaggatacctctgcccctgcctcttctgccaccaccacggcctcttccacgattagtggggaaagattctaaatttccatgaaggaatttgtcatcaaatggttgtgctagtcatatttaaagcaggaagtcagaatcatgcgagaacaataccttcgtgttcatagtcaaaagcgggtctcacttcttcagctgggataggtggctggtacctaaggatttaatcaacagacaatgatcagacatattcactatcagtttcaaattaatatacagcaccaaataagtgaataataagtggataaaacatattagctctggacagggttcaacttaccctggagataacgtatccagtgctttcttggataatgttatggcgatcattgatacatgccgggtggtctctaggctgtggtaagcagtacactagtgtcatggctcacgataagtctttccttttcttttttcttctgaaaaaatacttacgggagaaggccttcttccaaaggttcccaagtgtccgtgatgtcaattgattcagtagatgtaatctgatgaagaccaccgatccttctctgaacaaaaaatttagagtaagttgaaaaaacaaagaataactttggtattagatattactaggtggaagtgatacttagcactaaccttgatcaattcaacaaccatgactgtcttattgatggctcttcccatagctttgatgacaatctcatcatgcccattttcctgaaaaagaagatatggggatgaacatattgaacatatagtcacattatccaggattaaataaaaaacatgagactgcataaggatccacaagaggaaatatagcattgttgaccactgacgacccaataaactttttggcataaggggacatatgcaaacattttgacgatggcatcttatagaataaggaacactgtacataacaagctgaagaaatagcatatgaaaacggcaaaggtatcttctacacaatcaagtgaatgggacgaatgtttgcacatttgtcaggctgacaaactacacatatttcaggagtcaggatcaaatgctacgtaatggatacaacgacaagcgataatattcagaaagttcaggagcagtaacagacattaagaagcacaaggaaatactggaaggaccaggaggtcctctgcggtactacagtggcaactgacgatgtactatgccaacctaaatcataagcagaggcagattcacctccgggcagcacaggtggctgcccagacttcatggtaacatccctggaggtcgacgctaatttttccctgaaatagagtagttcccgggcaatgtgtaaatgccaaaggtgggtgtccagcaaacagcgatcctgcaggctgcagctagcaggttgttgccatcctcggcttcctatatggcctgtctcacagtcacagtcccaacttaacgcctcattctcgtatcatatgcatgaacttgtacatcgaactcccaatctcccatgcatctctaggcatcattttagatgtacagtcaaggcatcaaacaatataaaaaacactgaccaactaaatttcaattctttaccacggtcttgaattagactgaataatcagtgctatagtttcagggacaagctataatacttcctccgtttcatattataagactttctagcattgcctacattcatatatatgttaatgaatctagacatatatgtataccaagattcattaacatctatatgaatgtgggcaatgataaaaagtcttataacctgaaacggagggagtaatacttagttcatatataagacaagtcttgaaatttttcgatgtataaatttagcatgaccgaccaaggttcaccaccacatgtagaaaatgcattcgccttgtaggatgtattagcaaaatgcttcactctaaatatgaatatgtattattttcttatatgttgcatggatataattatttttttgtttcgtgaggtgcttgggtgtgttagcgaattgttgaggcagcagtaatattgaatttagcaccttgaattgattatactgattatcattttttttcatctataaatatttacatgcattttgggcatgtttctatataaaaaaaattgggatgccaattttgatggcgacatatgagaatatggatatgctttagttaggttttcccaggcttcatagaattcctggcacagccactaatcataagagcagatttcgaacttaaaaatccaaagatacctctgattgagctgtgcagaggtgtgaataagacaagcttacaaaatgcagataacagagattttggggccttttgagccatgtacttttttagacttatgcagcaataaaaactgggtacaagcagatgcagaatttaagataaccgaacagcttactattggtaggaaacacttagtgataaataaaggcatatgcatgagtgcagtacatacagggtatccctaaaaatatcttcactgtccacaatgtcaatttgcaagcgcgtcctgttaattgttaaaacatggcacaaaaaaggttgctgcatgttctacctcaaataacaacatagccaaaggaaagtaatagtagtagggtcacctcaagcaacgacatcccatagctgatatagttcctcatcctcccctgtgcagtgatcctgatctcattctcactaattggtgtctcattgcgaggcttctccaccctttggtatctatccatgcctatgaattgatacattgatatttcagtacgacaatatatacaagccacaatgtagaattacttcaagataggatcataaattatgcagaaataagatagggagagagcaaaccgtatacgaatataagatagcatcataattaattttcactcgatcatatatagactgagtgagattccaacgaccggtgaaatttatacaaaacctaagagtaagttaaaaatgaaaaccatcaaagtccccaaccaagatgaatatcttttgaaactagagattaaatctattactgcaatctgacaggtaagaccaccccttcatcgacttgcaagaaaatgattaattttcgctaggaaaatgcaataagattctctttttcactcatcactctttttgattctgtaacaaagcacggacattctgctagtaccatgaaatacacacaaaggagatgaaacgtggacaaactgaggcactaagtacagaaatctggcaggtcaagatgaagctccctctcacacattagtgaatctacttaggaccttagtgacaaatcacagtcacagtgatgtttgcaagtgacactcaaacactgaggacctaaaacacagcaaagttcattagagcagaacgttagtgtgataattcagaaacccaacacgtagcacgtacagaaccattttgcgcctccgaaatcgacaaccaaccgttcagagtagtcaatcacaagagtgcgaacaccggctactaccggtacacctagaactaaaaatataactcgactgctactcccaagccttagtcgtttgatttaatcctaagacagagtgattccaacacaagggaacagaactccaaccgcgccgccgaaccaatccccacccccacgaagagcagcacccaaacacagctacatgccgcggcaacgcgcagagcaaccgaaaacccacccaaaccccccccccccctacacctcgcagtcccgccaccaccgaccaaagcaccggcgagtccagcaccgccgacgcgcacgaaaccacgggaagggggaccacaaccacaaaaccaccaaatcgagccctaaaccgtcaactccccccacctcccaaatccaccaccaccacctccaccgccgccgccgccgagtcagcgacgcgagcccaaccaaatcgaggaggagaggaacgaatcgcaccttccgattgggctcgcctcgcctcgctgcctcctcctccgcttcgtctatgcaactcctccgctgcgactctgcgaggcggagagagaagagaaaaaaaaagaaaaaaaggagaggagttttcaggtggttgcaatgcagaggagaccggggcgcgttcccgtatcccgtacgtggcgtggggttacggctctccgcgtggggctcccacctgggcgcggcgcacgtgggccgcgccacgtggggagatcctgcgcgttggtttggggggatgggtggtgcggattggggttggtccatggaccgggcgcggggagggttttggtggcagcgggtgggatagggcgcctggttcgaggataaggggccccggtttttcactgccgccgtgggtagactgtgggccacagttgtcagtgagcctggttgtgttgtcttgtactcttgtgccgtgctactgcgcgacacgtgtcgaggtaattttgccacttggagtgttccactgtgcagtggtcacatcagatttttcactgtttttacttggagtgagattaaaaattctaaggtttagatttaaattttacagttaactttaagatattttatttttataaaattgtcttctaaatcgctaagaattttgaatataaattatttttattttccaatatcacaaaatatgggaaccgatgaaacctgatgactgagggtgcgtttagttcccgtcattagaagtttagttgaaattggaacgttgtgataaaaaagtcagaagtttgtgtgtaagaaaattttgatgtgataaaaaagttgaaagtttggttgaaattgaaacattgtgatgaaaaaatcaaaagtttgtgtaagaaaattttaatgtgatgtaaaaattaaaagtttgaaactaaactcggcagaaatacggtttttagaggcacatctgacggtgcgcaaatttccttacgcaaaaatacacacctactgacctacataacattaagtacagtgctttcttggaacaaaacagcaatgacgccaaaatcgacaacaagcaactagcaaaaccgcattacgagatttaatccatagggttcaacagagttaaggtagggacagcagaagggagcacaaattcatagatcaacaggtcctgaaacatctgctacaaaacttaataccccagaaaatatcaagagaagagaaccaagtatagagtagtgatgatcgttttgacaaattctgactttgctgaggaaccgcacaaactaagccttgagcttgccgaagaacctctgtttctcgtcggtggtctggaagcgaccgtgcccgaacttggacgaggtgtcgatgaacttgagcttgatctcctcgagcgccaaacgagaggtctgcttgagcagggactggcggagggtgacgaccctcttcttggggccaacacagcaacccttgatcatgaggtagtcgcccttcacaacaccgtagtgagggaagccacccatgggagtgatgtccttctcagtcctgagcgcaagagcaagcacaatatcgtttaagtttcgctcgcaaacagatgcaatagcatatcaaacagaagacagatttgcaatcatggagtgctggtgtaatatctggtagacgaattggtacctgtcaaattcagtgcaggcagcatggctttcctggccagacttgccgatcttgtaaaccttcttattcatctcagtgcggtggtggtacccattctgaccagcgcgagcaacagtataggaaaccctagcaggatgccaggcaccgatacaggcgaccttgcggagacccctgtgggtcttgcggggaaggcgagtgacaccccaacgcgtgacaacaccttcataacccttacccttggtgacaccaatgatgtcaatcatctcgtccttctggaacacagcatcaactgggatctccttctcaaagaacttgtatccatagtccaccttatcggcaatggtaccaccattgatctggatctccatgaggtgagccttcttctgcttcaagcccttcattttcctaatctgaagcacataaagatttagaatgagaatgaacaaacaatttacagcacatggttaccatccaattaactgaatagaagggctcaaaatacaagatagtaaaataacagtaggttactgacctgagtgtgcacgatcacacggacaacagaagcatacttcttcatcttctcaagctgcatttggatttccttcttgccggcatcgctatcatacttgagagcatacttggtgaaagccttcttcttgctcttgcaccagttcttgtagaaccttctccttacttcttcactaagatgctgagcccagacagagttgagactgcgtaagccacgtggagtcttcacataggccacaagtccaacaacgacaataggaggtgtctcaataatggtaacagcctcacaggtctccttcttgtggagttctgaaaagcattagaaaaatgacaaggttaaatctcttcagtagtatgcatattcagatgaatactaaagtcttagtattaaagtcttggctaaaggccagtactcaactatgttaggacttgttgccattaattcagaatattatgttcttccaagtaaaattaagaacaacagatgaaactaatgtagttgcttcttccgcatagtcacaatacatggtcatctatttccaggttgaacaaaatagcattggcaaaaggcaaaaggattagacacatactggaaccaggcttctcgacctcacgcacaatgtgggtcattccagccttgtaaccgacaaaggaggtgaggtggcatggtttgttgacgtcatccttggggaatgacttcactgcaataacagagaacaaaatatcagattggtagtgtaatcacacataaacaactggcagtgcaaaatggcaccgagaagacgactggaacaagaaaaaactaaaagttgaagctaagccttagagactgctagaaagaattcccaaacttggatattattggcaagaaaaacaataaatttcagcattttgaaaaataggcagagtacactcatgtcagatatgcagatatatggggaaatgcatcaccgcaggggtatgctcttagtaggaattcaacaatcaatgatggaagcacatggattgatcagatcaacatagaattattacctcatttttactattttcccccattacactaacaaaaagaaattatgtggaccattacactaacaaaaagaaattatggggacaaatagagcataggctttcaggtcatatatacagagcaccagaatcaaagtccattttgctaagaacactggggcgcacaacaatctagccaggcacacagaactaggcctatagatccatacagcaacagcatctcgtccacgactacatcctattttctaccaagaggatccaacaagtttctactctaccatacaaggcgcaagctctacaaatacagcaccgcacaagcaaaagagagagagagagagagtaggtgagtgagcatacccttgccgcggtggcgggaggagcgcttcctcgggaggaagccgagggatccgtgcctcgggtgctcgaacttcctgtgcgacatcttcttactcctcctcccttacctacaaaatcccgcgagaaaacgcaaactccatcagatccacgacaaaagcaaacgcggcaaagcacccaccggtgaacccgcangccgacgccggcaacgaaatggcctagccgcgccgccgccgcaaggcgagcagcgaatcgaggggaggcgaaggatgagatggttacctggttgcggggtgcggcnnccgagtgcggttgggtngtgtgtgnagncgnagcagggtaacccctaggacagcgcttataaaggngggcgccacgacgagggttttgatgggtcggacgnaaatgcccctccgcgatgaatgcttctagggctttcttgcttctctgggctgggctgggatgggatgggctctggcccacaatacctccacttgacctcttcgtttgctaatcattttctctgttttttttattattcttctaagaaatatcttttttcttttcttcttcacttcctttttttctcccatgctcatatatggggttaaatcaaatagcacttgcaaaatgttgctctctgtttcaaattttcttgtgttaatttatgtgcttttcacttcattcaagcggaaagatgtcaatgatatgtaggataactttttgacatggtctttgaccactcgttgtattccaaaataaataaataaaatattaagtatggcttatacttaagatgtttacgctgattcttttcgaataaaatgaataatcatgagttattccaaaagccaatggtatcatctattaaaaaaatagaggtagtacatttttttctgcctcttgagtctcgaatcacttgtggcagaagagatggaaatgccggggaaaagaatgatatatcacttggcagagccaatttcagaaggaacaaactaccgacacaattacatgcaatgtacttaagctgtctgctctatgcacccgataagaatacacaatgactcaaaactctgcactctcgtatagttctgaacacaacaagaatgttaactcacaccaaatttctcaagtcaagaacaccaaaacgaaaagaatgatgaaaagaaccaccaagaatgctatcatcataatctggcctttcaagctggccttcttcaggaccatggccacccttttctgcacgaaatcaaaagaggggaagaattttcaggctgttggaatctggagtcaaaacagactaggtggaaaatatgatactccctccgtttcagaatgtaagtcattctagcatttctcatattcatattgatattaatgaatatagatagatatatgtctagattcattaatatcaatatgaatgtgggaaatgctagaatgacttatattgtgaaacagaggaagtattccttttgtattgggatagagagagatataacgcatgcctgcacaaagtcgagcctattggtcgtagtttccatgtcaaggcttagctcccccaaaagtctttcctgcgcaagatagacgagaaaacaaacattggcatcacaaaggacaatagcatttcaataacacaatatacagtagtcaaattaagtactgtacaacatttatacaaggaaagagagtacacaaaaaactatttgtacgaaagcaagtaaggaaattagattatcataactttacctgtccaacaagttcatcatgtatggtgagaccaacacctccaattcgctggacactagcactaagctcatccaattcctcatcctgtcgcctacagaagaagtgcaatgcatttatcagtgatcgtttggtccacagttcatacgagagaggaaaaaaaatagaacaaacttatggaaggcaatttcaaatctcttgtttaggaaattatatgattccatggagcagaactttgattctttgtttctttgagctacaagttctaatttgatattcgaacaacatgaatctcaggaaattagatcattttggtaagcgcttacttaatcaggagcatctgctgatctgattctgaagcaatgaagtcatcgttatcttgagcaatgtgctgcttggacctcactaattcagaaggattgactgaatggccaaaggcactcttttgctttccagcttcaacacaccgccttatggagaccacctaggttatttcaaatattgttatttgccacatcaaactcattttatagcagaaaatcaggttgtagactatcatactgcaagactacctggttacgagcagtgctagtccagttcctcctttttcctatttcaacctcgttaagtccatagtaagctggatctctctcagcaactgaaatagctttctccagttcaaccacctggatgaaaggtcgaaggcatatataagtcagagatgaagtaagaacatgaaaaagaaatggagggttaacgacagtttataaatacgtcaaaccattctgaaccttatgggttgtgagtggttgcattggccaaaatatttataaaaaaagtaaaagtacaaaagagtcctgaggcagaataactacaggcatcatgagcctaaaattagtatgacactaaaaatatggtggcaatcccatatacctgccactggatactttcgcagcttgctattatttctttggtcagatgcacatgttctccagtgttttccggtgtttgcttccactgatgcaaagtatcttgaattttttctatctggacaacaatgggacaacagaagagaagttgttatatgcatcatgaaagtaaagaaatgcactacttatagtatcatttgcggtgttattatttgcatcgaaataatcgttggaaagaatataacacaattgtcttcagaccttgtagtaacagaatacatcattaaagggaaaatccttcggtaaaaaaaaagacggtataatgccaaattgtaaatgaggaaaccagatatcatatatactcacaagagaaaaaaaaagatatcacattcacatatactaacagatggcataacaactctgcacaacatcacacatagtagctacattcatctaccacacacccaagagggagcagctctatcaatctctcagatccatgaattggtgagactcactaagacgcattaatttcctgcaattctcctacagggagttaaccgaaaccgaagagcccaggaaacggatccagagctgcaattgtgtgcaacccagagaagatcaaaccgcttgaatgagaatctacacagcgaagaacacggcaaatcaagaccgaccacacaccagtgagtgaccaccagaaatcactggttcaccgcgatggagtctagcgcccgagattcgcatttacacgccacgacacaagagaccccgctgctttgtagggcatggacaacccgggaaacggatcgagcgagcaagtgaacgaatgaacgacggggagaggaactcaccgactcctgaatctcgtccttgacaatgtagaaaggatcctgcgcggaagccatcctgttcccccaagctcgcgaagggaacctggagagggagagctcggccggatcggcggagcggggagtgacgcgggcaccttcttccggtccggccactccgatgtggcgtcgcggacgaaaagggcgggagacgaagatcggggagatgtctacacacacccaattgtggggctgggctccgatcctccttgctgggctttaggcccatgtgatctattgggccgtaaataatccttttattgcgcattattttgagtaaatttgtatttcgctgggtaaataatactccctctattccaaaatatagggcacaactatttttaaaagtggtttcataatataaggcgtgcatgcatgcatgcaattaattagcacattctctcccctaaatcattattattttaaatcctatactcacaagatcttcaattctattggttgcatgtattgtattaattggggtgattcataataacgatgagatattaattatttcttggtctttgggataagggtggttatgctttatattttggaatggagggagtaaatacgtactaggttataagcagagactttactctataccccctctgtactcgtaaagaaagtcgtttaggacaatgtttaagtcaagccttgggaatacaaatcataaataactctcaagttgttgagtttgaaaatataaaaaatatatgaatagatttatcttgaaaaatactttcataaaagtatacatatatcacttttcaataaatatttttatagaaataagaagtcaaaattatgttttggagaccgtgtcgctgtccaaaacgacttcctttacgagtatggagggagtactagtttgcaccaaaaataagtttacaatgtgtttttcctatacgtgtgggttggtgtgtagtaaaactagatgtgtaccccgcgcgttgctgcggaagaattatgtaataatatagtagatatgagttctaaaattttctttcaaaccaactatatgatttcttttcatgtgtttatatattttttacctttattaattatccaaatgtcataaataattgggttgtatggtgtatcttttggtggaaagagatgcaatttacacttttgatgaatcatccaaagtcttaaaagaattgagttgatgtggcttcacgacagaagagagaattagcattaactacacgtagtggggatgaacttgatagatatatatagatataggatttgttttcgtttgccataatatgaagagaaaataatactatttgtttattaagcctgtaagaaactctgtaatatagtaattttgtgcggtaaggatatattatcagtcgctgcagaaacgctatagggcagcattttgctgggtaaataggattgaagcaaaataggtgaggaagccaaactgattactttgcaatagtttgaagcaaaataccaaaaattttatttttgccattgacacactaggtgagcaattttgttaccacgtccatgtgctgatttaaagttttttttttaaaaaagaaacttattttttttctttgccacaatataaagctaaaatatttgtcattaactgatcctgttgcaaacaatgaattttaccccaccatagctaattaactcatataataataagcctgtaagttacagaactgaagaaactctgtaataataataattgatcactaagaatatgatcagtcgccgccattgatcactaagctagtgcagtgtaatggcaatggacgccactaccatcaacaatggcagcgatcccatcccctttccctttctcgcgccctatataaccacagctcgccggcgatcgatcactgcaccatcagcttccacaaacccagctaaccaagtttaattgccaccaagctcaccaatggcgctcgccgtgaagctcgccgtccttctactacttgccgcggcagcagctggaggaaagcagcacgacgaccgtgcccccgctagaggagaggctgggcgcggcgttcgacgggatggcagccgccgccgaagg

SEQ ID NO: 78814 - DNA, 1449 bp, Oryza sativa
aaatgatttatatgaaaaacgatccaatgtcttcctttctttgcgtgacatgtttcaaaaaaaatgtttttctaaagaaatgcttgtcaaattgcatgattgaaatctgaattgactatcttaagttgttctgataagaagctttagtcgagaaaaaaaagaagattgctccatgagctggtgactattgagacttgagaattctggggactaaagctactagtcgagactattgagacttgagaattctggggactaaagctactagtcggaatgggtatcctaacaagtgataacaaatttgagtctttgtatatgctttagcctgaaatgttgaatgtgtagtcccaatgaattcagtcaatcaagcacattggccctaattttagttagacttgcacatgtcttggaaagttggaatttcactggtctttcttctcgtatttatgttcatgatatgatttagtatcatattgcctaacttatctttgtgctctgcagtgaggtacgacaagatgttggaacattcggagagtgcaacagaaaaaattatgagcagcatcatggataccattgctgagaaccttcctaagcagaaatctgggaaatttgacgtaggcgctgcctctgacaaaatgaaggagaagctgtttggtcgtcagaagaccattcatcgagttctgggtggtggaaagcgtatgtaatcttcttatatttttataatgtttcctttgtgtagccatgtgtgatgctctgtctgtgcttgtagctgctgatgtgtagccatgtgtgatgctctgtctgtgcttgtagctgctgatgtgttgctatggaggaacaagaagatatcctccagtgtcctggctcttgcaacagcaatttgggtattctttgagtggctcgactaccacttcctaacaattgtttcatttgcccttgtccttggaatggttgtccagttcgtgtggtccaatttctcaagtgctctaagcgggtatggaatttacaaagcatctgaatagtgtgtcccctaataattcttcatgttgtcataaaaaatgtcttttgccactttttagatctccttctaaagtaccccgtgttgagctgccagaagagctgtttgtgaacattgcagttgcagttggtacccaagtaaataagttcttgagttttcttcaggatgtgtcttgtgaaagaaacctgaagcactttgtactggtatgtggaccttctttaggttcttatgtactccataaacatcatgaatagattaaactggtaaagactaaagaatcaaaccctgaatatgcaaacaaaattgttctgtttgtttatcactgacctttatgcctgtgtcaaactatggttcctttcaggcaatcgttggactgcgggctgcggctgttattgggggctggtgcaatttcttaactgtcatttacattg

SEQ ID NO: 78815 - DNA, 5121 bp, Oryza sativa
cctcgcagtacatagtggcccgaggggacctcagggtgacctcggatgggagaactgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttctgcgttggcgcgttccacttggccattgcttctggggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgatagcgacatacagatactcgaacccgcccggggcccgtataaacggacgcaggatatcgagcccccagtcagcaaacggccatgacagaggtatggtctgcagggcctgggccggctgatgggtttgcttggcgtggaactggcacgccctgcactgccggaccaggtcgaccgcatcgttgagagccgtcggccaatagaaaccctggcgaaaggccttgccaaccaaggtgcgtgaggcagagtgggctccgcactcgccttcatggatagcggcaagaagctcgacgccttgttcccgaggaatgcactccaggaggactccgttagccgcgtgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgctcccctagggtcccgaggcctggactccgacgggcctcaggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgaccaactgagagtcgcctaacaccaggaggcggcggatccccagtccagccgccactctgagtcccgcaaggagtccctcgtactctgccatattgttggttgcccgaaagtcgaggcggaccaggtatttgaggacatctccgctcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgtctggaaataatggcgcaacttcctcgaagccatcagaatagcgtaaagcatcttctgggcctgagggtatcgggtcttggcgtcccggagggcctcactaacaaagtagacgggccgctgcaccttttggcggggccgatcctcttcgccaggggccgcatctccagggcgcttttcgtccgagaggccgcgcggggcgcactcggcttctgtgtcgacgacctcggggtcggaaggcgacaggcgtggccttcccgcagtggccccggggccatcctgggggtcgggggctcctggcaccgtcggacaagcgggcagagggccagctccggtcgtcgggggcctcgggccaccgttcggctcgggggcctctcctccctgctctctcccgggtcgagtcgacatagggtggggatgcgcggagcgagggtcgtcctcgtcgcgctccacgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccgtagcgtttgaggagcttaaataggggtagcgccttctctcccagcctcgatatgaaccgacttagggcggccatacagccagtgacgcattgcacatccctaagcttgctggggggcgcatccgctctatagctcgtatcttctcggggttggcctcaatgcctcgggcagagatcaagaacccgagaagcttgcccacaggcacgccgaacacgcacttgtcggggttcagctttatgcgggcggtgcggagactttcgaaagtttccgctagatccgagagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgtgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccagtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcacacgtgatcatccgctgcctcggggcggctgggacggaggtgctgagcctctcgtcgccacccgcgggcttggatgccgcggcgaggtggtccgcgcgctgctccatgcaagcaagcgcgactttgaggtcaccatggacggtgatggggccaccggggcccgacatcttcatctggagataggcgtagtggaccgccaccatgtacttcaccaacgcaggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcggaggaaaggatgttgagggctgcacccccgtcaatgaggacacgccccaacttcacattgcaaacggtgggggaaaccaccatcgcgatctgtcctccccgggcaacgcacggtgggtggtcggtctggtcgaaggtgagggcaacctccgaccaccgcgcccgccgcgtcgcctcatgggtaggggccacggccagaagctctcgcttcatggccttgaggctccggcgagaagcgtgagcacacgctcccccatcaacggtggcgacggtggcctcaggctcctggaaccctaggtcatcgtcgccatcgttgatgtcctcggcgggggccttctgcttggcctcacctcgccggttgccggcgggagccgccggggtattgccctcacggcgctcctgcctcctctcctcctcccacttcctcgtccgctcagccaaacttttgaccgcgcggcagtccacgaggtcgtggagggaggtgttgtgcacggtgcaccacttgccggtcgggcgctccctactgggagcgccggcctccttttttttgtcgctcgcaggcctcccctttcgggtggcccgcgaagcgccctcgacggcgaggacgtgaccctcgtcgtcggaatgggccgacctcttcttcctcctcctgtcccgccgccctgaccgagcagtgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgcccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctatcctttcagggccatggggaagaaattcgccgtagacgaggagacgacgctccctgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccatcgtcaccgctagcgctcggagagagattgtgcgccattgcctgttcggccatggggctgagcgggagaagcttggcgcacacgaaagaggacgagggctagaaagacacacgcgccccctacctggcgcgcca

SEQ ID NO: 78816 - DNA, 10673 bp, Oryza sativa
ctgcagcccttgaatctcgacaaatatatgatgcccctatgctattgtgcattttctgtcaaggaattatcaaaagctatttctatctgattcagtaatgtcgtaacattgcctggttcaggaattcatttattttgttgtttcttatgtgtgcgttaatgaaaagtttggtaagagttgccagtctagagttaagattttactgctaatgtctttatcttcttgcaggtcatggggatttgattgcgatgttgtcccaacactgctagctgttcttccatttggtcattgggaatttggtgatgatttaattgagaaccattatatcattatcatacaaacttttgtttgtgaccaaatgatcttcttatgcagcttattcaatatcttcatctgaaaaagtggtgggttgacttacattgctcgtacattaattgcttcaagagtgtagggttcatctaactgactaagtaactatgtcaatcaaccttctccttgttgttcagggctgttcatatcatgacaattaaaatcttctgcgtttcaaccttctccttgttgttcaggagggttcatataataccaaatttaaaatcttctgcatgattcaaatgttttttgtgtaccaacatggttagccttattctcttacggtactcaatctgccaatcatgagaatttcagttttgctggtttagtgtatgtgcctttcaatctttcaattttttacagtaactgagcagtgaactgtgccaaactagatctgagaaatatctatatgatacctagaatcagtacaaaatccaaaataagtgcagctacacctaggcttggttgaatttatagaagcttcttgatgtgagccccttaatgatttctgtaggtgttatcctgcataaataaatccagaagcatattgccttgtcttatttgtgaaaagttgttccattttgccactggcgtgagttttttttttcatgacatttcttggttaaattatgtgtgttcttgttccatcaaggccctactatccaacctttatctcgtgtgtaatctaagtgaacatcaggctgcaggatgagagggtcatgaaaacaacatcggcgtcaaagcttggcaagttaatgcaccatcgtttcctagaaagtatttcattgaataaggcttgagttgtattatatggtgctaataataatttggaactttcacatcaatgaagtccagcttttgaactgatcaaaaggtaattttatcggttttacccatatcaatcgtacaatttagcatgatagttagttatatgtgttggtttatgttacagggctttgcacatgaacagagggctccttgattgctaacttggagatatctagtaagtttgctcagattttgaaaaggaaatattcgtcagttaatgatataaatcaaaagatccttatgttgactttattattatataggatcctgtattcatgaaaaacatggtactatattatattatatatacaagagatttctgtatttctgttgtttctgaatagtaacctcacaatggttgatttcaaggccatgtttttcccccttgcatagctgtcacttggtaccaatgtttcataaacatttcatgtaaagagcaacagtacttgaagtacatacatatgaagttggccgatgttctgatccataatctggatcataacaatagcatcacaaactcaagttaagaatagtacagggtcactttatactacacaaaccgtcacgtttcttttgattcatgtattcctgtttaagagacttttaactcatatgtcgtcgtccaaaattttcagatcttttggaagcttctcacgctgtatgcgtgcaaggctctgaggatttctgattgcatccagcatcctgtccaagaattcaatgaactggcgatcttcatgagcaacctgaggatctgaaaacctatcgaagcgatactgatcctgcacgttccattacaaccataaagcttcaaaaaacagaggaactccagcactaagcaatagatacatcgtggggatatcatatactacataagtacgtcttaaatcacaggtatgtgcaaacagaaggtcagtaaacttgtagatatatatttacctcaagtttagttttatgatgattatgattactagtttaccacaatcttggaatttatttgacactgtacatgaaaagctgaacaacaacacatctacttgtctaagcacaaaccttttatttaaacggaataaccaaaccacaaacattcaacttcgatgtagaaaaaaaaaaaggcaaattttggatagaggtcgaaccttgatcgtcgtgtcgacttgcccacacgcgctgctgcagaaggattgatagctcgccggagaaagacgacggagcccctccccatggaacagctgcagctggcgatggccggagaggcggcagatcgcctgaattctcccgaggaccaactccgatgccatgtttgcccaagcaagcggttatcctttgttcccctcttctaattttcccctacttcaatctacaagcttctccagggatcgagcagtagttgtagttgtagtactatcggagtattacgcaaggtatcggcagtcatggaaagcttcgttggcctcgtttggaccggccgggtcagagattgactgagattagcagtcatcctttgacggaacgttctttggtctcgtcactgatgactagataatcgcaagtcacaacgtgtctcctgatctcatctttgatttctcctcctgtagctatcttgttgattactactaggtttgtctccgcacacctgggatgctcccagtttagttattatccctctcaggctctgccacgtagagcagaattaccatggctgtagaccccaaggcgccgtttgggcgcgtaactgaattttttagagatgtttcgttacgatccttgattgccaatttggctggaaagatatggcatctgtagcaataattttgatcgagaaaacgtgtacgcgtttcagcggaagcctggaaagatgcttcgagaagaatattttgccaattggtcatacatattacatggtcgctggccaactttcttttatgactcggctcaaacttttaatccatggtctctgaaaacttaatatagacgtgattcacaaaaaaaaaaacagaaaaattcacacgattcttcacagtaactgtagatctcgggttgtaaaattctccggtcgtgtggtggttgtcataaaccgaacgacaacaatgtcgtatggtgaaaaaaaatactgccacacgattaactcactggcatttttcagcctatctgcaatagattcttctgtaaaacttggtgaatttgtattttcggtgctatggtatcaccgatgacttctcatccaagacctgcacttccccgttcaatgcaactacgacatatgatctgcagataaggattgcaatgtcttagaatatgtagagcactgcatagctgcattactgtgcactcaagtagtaagtgtagcattgatagaaatcttgggcatcaatgattactaaatatcataaaggaaaggctgcttctcctaggtctaactatctatatctttgaaacaccttggtctagtactagattaaactatatatagtcatgttagtttgagaaatttacggaatgctggaaactatcccatggtccacgacaccggcaattttctccaagctttctgctaccttacctgtaaccgaaacaagtcaaaccagctaaaaatcaatcgaagaaatggtcactaaatcatcgagttaacttagcataccaagatccgggatgggagttgtgaagataacatcaagtacatgatggccctccttggtaaccaatgggaagtcacctcctaatggaccagcggttccaatcgatggccgcctccataccttcatcaggttatcatgtaacgatgaccaatgatggaaagtactcagattcacatcaccacaaatccagtagttgctcagacttcagagtaaacattagaattacataataaatatatgagtgcacctctgcgtctcctaggaacaagtcatcaatctcttcagcagtgtcgatccaatttgcctgaaatgacccgttcttctattaatgatgattattgcaattgcagaaaactgatcactccagtaccagaaggtggcttacacttttcaccaagactggaattgaaccttcgatgcctttcacatatttttcatggccaatgatgaaggcaagtttatcagctgatttaacaataccctatggaggcattttcacatgacaatgtggaaaagaagagaacagattacaccaaggttgtctcgatgagcaactaaatgaatctcatttctgatgagctttttgaataccttctccaccatgaaagaaggctctccgctctccgttttccgacggccaatgacagcggtcattgtgtcctcttcaattatatcagcatcagtgaaagcaaagtcaatctatatgtcagtaaacaccgtttcagcagttcacccactttctcccattgtcagcaagatttacaatggtgaaagaaatcaacatacttgggtgccttcctcgtagctgctgacctgtatccctgctttcactgcctcacttgcactgatcgtggacctggctgatcaaccccaagaatggattaaatgcaactgacaaagcatgtcatccaaggaaattcaggtcaggagctcatgcgtccactcttgaaacaatgagtgatccaaaaagaagttagcttcagcaaccagaacttacgagggtattccaaggatgccagtgagagaccctcgccggaggcgagtgccgaggtactggatggcgaggccggacgccgggccggagccgagcccgaccaccatgccgctctccacaaacctgtccacctgaggccaggccaggccagccaccgagctcgtcagaataatatacacatgatccaagcgtcaacgagctgatggaacagtggagaatcccctcaccgtgagcttggcggcgtcgaagaggccgacgacgtcggcgtccgcggcggccgcgcaggtcacagcacgtctccggctacggcggcgcacggtggccggtgcgacgttgccgatgcggcgggggcgtgggcacgggcggagccgcgccgaagaggagctcacgcttgccccggcaacggcgtccatggttgggctggtgcctcagcttgctggcctagcgagcttgacagttgcatacattggatggatggcacattgacgaagcggataaggggtgcgaagcaggtgcaacaccagcctattgtccttgttctcctcaggcctcatatgctcggttgtggagtcaccgatagctctttgcggtataaatacgttcactaatcgatttgtactcaatttacatattcatatgttttatacaatggtagtttgtactcaattcacatattcatatgcttatacaatggtaggctagcatttgaatattgggttttcgttgcaattgtacagtgggattttagcatcaataaaatgatttaggctgcgtttcccaacacagctgctgcacacgtccagagcgatcgattagcacgtgattaattaagtactccatccatcccataatataagacgcacccgtatttgaagattaacctttcaaacatttgaccaacacttagttaatataaaatattttttatttattaaaagttatattattggattgagatttaaatttactttcatacggtaataattttgttgctacaaaccttatagtatgtgagaaattataaactaaatattaattttggatggagtattagctttttttttcagaaatatatcaatataatttttttaagcaactttcatataaaaactttttttaaaaaatacaccgcagtttgaaatcatgacagacaaacagcatttgaatattaggttttcgttgcattcgtacattgggtttgaagcatcacagaatgatttagcaacatttgcatattggataacatggcatgtaaattatgtaagtttgaacgactgaacaactttccatgtaaattggataacatggcatgtaaattgtaagtttgtaagctgcaaaccactaattattcacaaagcagatttgataacgaaatccggcaggcagataaaagcacagatcaggcaaaaacctcttaagctccatattcaagcaaataaaacactcggcaaaaatatgaacgattcttcaatacataatcagtatcttgcagagcaaaaaaaaagagacattttccaaaccacgttaccacatatcaatgctgcattgttcaatactttaatccaatatcaggcaagagcaagaaagcatttcaaaaacacaaagcagatacaacacatctaacaaagatcaaaaggacaggtaaaggtacttcaaatctcataaactttcataaagcgaattatggtcatcacattacataatactccagtctaggaacataaccagagacatttcaacagctagaattaaccaaaaccagaaaaggtttcacattcctacaccaataactggaacatcaagaatccgaaggcaccatcaatccaaatgcaccggtcaacatgatgtaagaagacatccacactactgataacgactacttggatctctgcctcatctttcggcgcttcctcttgagcctcctcattctcttcttcttccactgcagattagcaaaggctcagaacaaagcatcgacggtatccataattaagtgtagtagttgaataaattaacatgcaagcaatctatctcgtgtggatagaagtaatctatctcatgaggataaaagttttggaatcagaagtatgagtgcttcattgtagtttcatcacgagatgatcagaaacacggaccaatggttcttcatcatgttccataaaacgattaattttgtggtagtcatacagcatagagccttgactgaatcatgttcatgatttagcaagcagaacactaacgtactgactaacgtacatatgaaaagaaagaaacaaatgtacaggatttggcattcagaatgagtaggaggaatttatcatcaaatagatcagataaacgtaaggtttcctcatcatgccaatacagtatcataaagaagaatcacatacagaacaaaggaaaatcggcaagaaaataaataaaatgttctctcagacaaatgcctcgattgtccccatggtttaatggaatggattagatcggactcgtcatctgtgtgttcatcaaggagaaccgcatccagaaatataacaatttagaacacctactcctatagtacacacgaagattgctagcgaaagaaacatttttacagctatatagcagtagtagcagaagaagaaagttaaatcgcgcaagcgcgacacgcaatgcaattctctcagacaaatgcctcgattgtccccatggtttaatggaatggattagatcggactcgtcatctgtgttcgtcatcacggagaatcgcaagccacaaaataaaccaacaacaatttgcacatcccaaaacctcaaatcgaacgcacaaagtacaacaatttgcacataccacaacctcaaatcgaacgcacaaagtaaccctaccaccaacgctacatcgtaacatctagataaccgaatcagcacaggtaacaaagcgaaacgaggcatgcgaacagatcaaaagggaaaggatgaacgcggtaacgaaccttggccctcatcgcggcggcggggacggcgaagcactcgctctctgtcccttctctctcgacgtcggcggcggcggatttgtggaggcggcgaaccgggtgagatggtggcggcgaggtctctctcgtcttatttatagagctaagggaacagcggaagggagaaaccctaaccaggcgtgagcgatggacggctcagatcttccgcccaacccgggttctactccgattagggctttatttaatgggcccagaaaaaaggctttaccatcttattaggcccggcccatgaaaactatcaacaaaagtgagaaaagcttttgagtcaaattcaacgcgaattcataaaaacgatagatttgtgcctcgttttacaggacatatggaaattttaaaagggtgtagttatatttatggcaccatatttttcatcaaaaaatagtcggcatgtatttatattgtaagtccctaaattacatatgtaattttagtgtatttacaatgtaagtctcaaaattacatatgtaagtactaaaattatatatgtaaatttgaaaattatatatgtaattagtatgtaaattcgtaaatgaggtgtaactactgtataaatggctgaaaaaaaatcgactgtatagcatatagcgtcatatttatagtaactccgttttaaaaactcaaggattcatttcgtgtagaactagaactacgtggtgtgccacgtcatcgatattggctcagttgatgacttggctggcggcgctcgggtccgcgtcgccgtcggcgccggcgccggcggggggatccggcgcgtactggccgggcgccgccggcgagccccagccgatgggcttgaatgggatgccggggagaggcatgccgaggccgggcatcccggggaacagcgggaacgacgggatcgtcgacggcggcagccaccacttcatgctgtcgctgccggcggcgctccccgcctcggccgccggcccaggagccggcaccgccgcgtccgcatcccccgcggcgtacggcgtcgacccggcgtcgaccggctcgaactccaggtggctgatctcgttcttgtagtcgtccagcaacgggtccagcggctccgtctcgtcggcggcggcggccttggagccgaaggcgaagccctggccgaagtcgccgtcgacgtcgtggaggatgcgcaggccatggccggagacggcgagcaggaggaggcagacgaggatggacagcttcttctccatggcgttcctcctctttggctttcttggcctcctgcaaatgaggagacgcgtgatgaaaccatcaaatccatcgaagaaattatagcttggcagcaatggagttaggttggatcatggtgacctgcattctcatttcagtatgataatctgatagctccaggaattgagaaatggcatgtcgaaggtgtgcattgccacctaaactgcatccgcatcgttgagtatttggtaatctagtatgatatgcaaatagatttcactgcacataggcttgaatcaacaaccttgatggatccgcatctgttcagcattgcagccttggagcggattttgaacacagcctgactgcctgagataaattcagaacagcaacacaacatactgatccaaagttttgtacgttccattgtctctattctttattcttataccctgttcttttctccaactaaagttggattaaattttggatactcatggcacgctttttaaactactaaacggtgcgtttcgtgtgaaaactctctgtatgaaagttgctctaaaatatcatattaatctatttttcaagtttagaataattaaaactcaattaatcacatattattacaacctcgttttgcgtgaaacacttaatctccatcttcattttcatcttcaggacattcaaacaccatcattaatgttcctcttccttttctcatttgcccttgttcatgcaactttgtaacttatcatttctatcaatgaaatggctacaaggtagagctgtctctacattcttatgtcaaaaaaaaaaagatccagagttcagaattcaatgctatcatattattcagcagtcaatgtccatgaagcccctgatatcagtagtatcatgatggtgatctcactattttctaatttctgcaaacgaattatggtgatctcactaattcattgttttgctgagctccactagtgaaaagaaggaaattaattgagccacttgaataacactacataacagaagaaatgcagggcagagcagttgaaatattaattcagattgcagcaaatgagcgccccattcaggaaagcacacagctctcagatgacaactgacaaccaatgtctgcaatacgcaactgagcatggtacaaattcttgattcattccactgatgaaaacccagctaatctatgatttcagttcttaaaacccagacaatctactcgctcttcttgaacttcatgttccccttcggtatcttgctcaagacaccttgatcaagtttctgatactggtcacgcaggaggccaagaatattgtataggaaatcatcaacttgatcttcatacttctcgtagagcacgggcagcgtgtgagcgctaacaaatcctgttccagttaatcaaatgtgaaatatcagtgacatctgtcactaatacagtggactgcgtacattcagaaaatagtgacaacatgaaatttctaaatttcagagggagagaaagatcttgtcatggaagaaagtttgaagtagcagtctcttaccaatgtaaatgacagttaagaaattgcaccagcccccaataacagccgcagcccacagtccaacgattgcctgaaaggaaccata

SEQ ID NO: 78817 - DNA, 610 bp, Oryza sativa
ttgtgttccttgagtggctttgtgcatatatgaagagaggagagctactcgcaatgtattaggttctctctattttatttgatcaatgtaatgtaataataggaagtgttgtacaactgtattgtaatcccaatggtatgtgatactgctttgttttgtatttattgaatagccagtgtggccaattgatctagtactacatgccaagagagctagagaaaaaaaaagctagcgaatgcacacaactgttacggctggaaggctagacgagttctttgcctccagcttcactgctacctctcctgaagcgtgcacatgccatctcttcctcaatcccctctggtatgaattggttaggactagtaagtaatgggttcatatcctcttccataatgtcactaccgttatcaagatggaccataatggcactaccattaccatggtggaaataaggtatgtctccataccctatgtccacaatgttcaaggcaagaaaggcaagaatatatgttaagtgggtcccacatttatgtaaacaaattctacttcaaggtaggtcccaccataccataatctattctcatcctctttaatgtgtatctgtgtttta

SEQ ID NO: 78818 - DNA, 1259 bp, Oryza sativa
atagtacaccctccactatattcgagcatcactatgtcaccctccactgtcatggcatgtgagtgcaaatcaacataattttacatgagaaacgttttgtttgtttttattacgaacagagcccaaatattttgatgtgaaaagtacgatagacaaggaaattacatttctgtcttgtgtactagctttttactctatatcatttattgaaaagttatagccgactatcaatgcttatatatttagcggcgctggcaagatataccacaccatcactaaaggcattgtgagtttgtgactaggataccactcaaacattgatataagatcaaaagctttgagatgcttcttctgctgtcttctttcctttccttggtctattcttttcttctttccctagcctacccatatgctgctgttattctgttgaaattcttggtgatgcttcaatgcttaagatcaccttttgtagctcgccttctctttctttctttttttctttctttctttctttctttctttccggcagatttgatgatttgtcagtctccattggacatgaaatgctacactatgctactactggatagagttcctttccatttcaatcaaaactgcaagtacatttcagaattatgataagaaaaaaaagagaatagtacaaaaggtgatggaaagtttgagttcctcctacgtaccagctgatgttaaagtagggttcacaatctcaatgaatttcgatccaatttcatgaattttgatcatctcgagatggttctagatgcgcatcttgttcgaaatttgtcccaatttatatgaaatgcttcaaaattagcgaaaattgatgccttggtggggctcgggtttcacttgccaatcaagatcgtaacccctgtgttagcatgttggcgccaactaaggggtcctggctccttgtgttaggcatcctgcatggcgaatattcatattatagtgtttttcatcttttgttttggttctcttttcatgatcgctaaagaggacaattaaaatccccgcaaaaaaaagaggacaattaaaatattgttttgatttcttttaaaatcaaactttgaaattcattttaaactttaaaaacacttcagtttacagtgtgcagtatgctatagcagaatcaaactctccaatgacaatcgagtacagtacggggttctgattaaaaaaattaggatacaagtatgtttacgggagacttgatttcgctggttgtctgggctgga

SEQ ID NO: 78819 - DNA, 1215 bp, Oryza sativa
atccaggcacgccctagtccctatagtttccgcattcttctgcaaaaaagagcgtcgaaacatgtaaaataactacattatcgactcatcaaagacattttcgagaagcatgcctaagaatagatgaactatcatcacaaaaagcgcgcaggtgcgacctcacgaccagctggggagatggacacgctccacgggctattgtgaagcggtcctctccgccataaatgaaacagatttatggggagccccagccagcatggagttgaaaggatgtagacaagacaccagtgttgagtcattggtgccggtggcaccttggatgcgtgtcgaacatgccctgcaccacctgattaagccaaacgggcagaagcgaggctgtggcattgtttcagacagcccgggttccaccaagcccaccactcgccatgtgttgggatagctggcgcgacccagctgtctcggacagaagcccgggtacacggggtaatgcagatttcaaatctcaatagggttttcttgaagatgtgttaggaaaccagccgacaacgacaagatagctgataagacaagacaaggagtatatttgtaataatgtgagcccctacttggactataaaatgaaggggacaagctacagatggagggctggactctttagatcggtataattcattttgcagcctgaaaaagcctcctttgtaagcagctgatctagggaagacaacgaaaccaacacatgagtagggtattacacctccggatagcctgaacctgtataattcatgtgtcttttgcatggcggggagcttgggccccacagatccgatcttgcttgaatctttttctaagtattgcaccacaaaccccttggttgaatcttcccacttgggggggaggggtctccactcctcgttgtccaaggaatcactcccttgacacctacataccccttaaaagttgcccaagtccttttatgctgctgagttttattcattctcttgcataccctagactttttgcttcgatcccttccataccttttctgttggttgattgttagttgatcattaaattcttataaaaaagtctattttgccatttagtacgaagaaacatgtaattatttatattattggagtatagaaatttactgtatgaaacttttatatttatgagtttgtcatgcgagatattatttacgacaaaatttattta

SEQ ID NO: 78820 - DNA, 807 bp, Oryza sativa
tatgtcaactttttatattaccaaaagaacttgtaaggatatgatcaagatgaaaaataataacaaaaggaaatatcaacatgatatttcaaatatttcaaataacaaaagaacttgtaattccataccctacttgcaacaaaatatttcaaataaatgctcaaacgtcataaataccttagggggctctaataattgtgtcctcaactttgctatttttgctttcagttgtccaagatggtattctgtatgacaaccagaaataaaaattattcccagataacaatatgcaagacatttctcacacagtattgagtatgggtgggaatgtaagagatcagagataatcgttcattagctaaatacaacattgttaatagcaagttcacgttcagatacataaattgcatatatgcaaacagagatactcaattactcagttatgcctgttcttctagcaacaaatttggcatctgactgttgatactggacgagtatagtgtgtgtcaatcagaaaatggataaagcagggtatgcagtaaacataaatcaggcaataaaagacgaattccctgagtccactcgtcataacatggatgaatttgtgccaagcaaagaacatgtggcaacaaatcaacaatttcggatctgaacattgactagtggatgcacaaataaatggcccactggccatcattgatccaaatgtccataacactgaataccaacatgaagagaaattttagcaacaaaataaactggaaggttgagaatcgtcagtggccagtataactaattaagcagcaa

SEQ ID NO: 78821 - DNA, 10725 bp, Oryza sativa
acccccaatcacacaatctaaaaaaccaaaccacgccctttcccccaatcttccgaacctatattaaaaaaacaaatctaccttttcgttcagtggagtccccaagattctcccttccaacaaaaggctagccaaaaaagaaaagaaaaagattccacctccacatcgccacacatagcgaccatcagagctcgaaacaaccaagaacaaggtctcaaacagatcatacccaggggagacacagcagcagatgaacgaagagacggagaagccctcggctctcgagcttcttggagacgaacgaggcgaagagcaagagcaggtattcaaagtaggagtagtagtagtagtagatggggaagtgttcttcaaggggactagtagcaattttattccagtggtgtgggtgcgcggcgtgtgatctgatttgcagcctgtgcagtgctgcactgcgggtcccacgagcaggttatctgctacgtgtacgcgtgaccgctacgggttgtttcacttacaggtgggccatagcgggggatattcatggtggggcccacgtgcaagagaatgtcacgatctcgagtaggaaaggaaaagaaaagtggttgcatggagcacgagggaagtgtggtccattccgaggatatttttcgaatttattattgggcttgtttgtgttgagcaaatcgccatgttgcctgttgctgattcgaaaataattgctgaattgttcgctggggccaaaatatatatgagtttaagcaaaatttacactccacgtgggtgccattgttcaaaaaaaaattgaagaaaaaagagttgaatgattgagtcggcaactgcctagatatatagagcacgtgggcaactaaaagtaaccacaacctgctttgtaagtcgttttgattttcttaaatcaattaagtttatacaaaagtatagtattctcttcatcttaaaatataagaacataaaattagatgggatattttgatacttttctagtactacatatctaaatagactatgtgtagattaatttgtgcttttccttaaacacgttcacgtcattgtattgtactatgatctgaaaaatgtgtttttgtggtttgctaaaaatgccttttgatatgattatctaaagatatttatcctaatactatgacgcactaaaaatggtactattgtggactaggttctctcaaacatattcttttttatgtgtgctctagtccaaagtgcaaactagtgtaagcacgtgtggtgttaagtgagcacttaggtttagcccttgtacattataaaattatgctcgaaatatatgcccaatgtaaaatttactcttataaatttgataaacttcacaatccatgacaaaaacaatggcccttgaggccttacctccttgcatcattaattggcgcacaatcaaaacaccatggctctctttctatgaaagattctggattttcaaactcatgaacagtgcatttcatgtaaaaaaatctatataaaggtatctcctctgatcttcatagaacaaaatttcaactttataatagttgatttagtcatttatataccctagaatagtgagctgtcacaaaaccagataatccactcaattagacaattagaagataaaaaaagctaaaaaaatatgggtggctagtttggtaaacatagaatggcattttgccagactcttttggcaagagaaaggtttggcaacttccgcttgaactggccgaagttgtaagcaattgaagcctcccaacaagatcatcctatcaaaactccattggaaagcctgcaactgttttttttatattaaaaaaaaactccattggaaagagtcagaaaaaggcctggctacaaagcacccaaaggctggatcattgggccgggtcactggctgcggttggacggacagtgggcctctgttgccgtgtggggtgggccggaccgtgggcccatgcagtcactccatacccggacggacgacgcctccgccgcccgccgcctcgcctgcgtcgatcgatctccatcgccgccgcgctaccatcgtttccggcgtctgctgcttccgccgcatatcctcgctcgatcgctggctggtgagtatccatgcatcccctctttctcgaatttgcattagtcctagctagggttcacaaactatgtgtgtcgcttgacatatctaggggtggtactcatcctgacatatcacatatgctctttgatttgtgctagaatcgtgtgccaggctagcttagattgtttcagatctgtgttgaaattgagaacaatgctacatgttaaattgagggataagttttttttttctgatgaagttgcgtgcttgtacaaattagtcttgattttcaccgcacctgaatttcatttctcaaacggaaaaaaaaactctgtacaaacgacgggcaaggctataaattattctcgattgattataccctctctagtcattgctcgttccttgctgttattgattaatagctcaaaaataatccagatttttcacccttctccactgaatgtctagttacttctccttttcagtgtcagtcaggctacggtaccaacgaattaagagatttaatttaagtcgctcatctgttctgttgacatgtgcaatgaattattctctttccttgattggacagaccttcaggtcaacgaagtgtgagtgttgaagatgagttgtcagaagttcagccgtcagtctctgcacttggcgttgaacgaggggcgcggcttgtactcgctaaggcacatggacgtatcaaagctcttctacccatcaatggcagaagcactggaagcagaggctaaagcgaagaagaagaagaatggcgccaacaaaatccggagcatcggccgtttgccaacaccgagcatacactaccaaccacatgtgtcggctacgtctaatccatacaatttcactaatgtgtttgctctctttggtgagaacaagaacaagatcctcttctcagacatggaaggccactccagcacctacaacaccgagttgcattccttcatgatcatgcctgatctgaattcacccaagggacccaattgtttggctgctcatatcacccgcactgctgcccacgcaaggtatgactttgatatccggcctgatgtggactacgatttctttgcctataatccccatggtgagcacactgacagcctctacttgatggacatggaccaaggcaaaccaagctcctttgaactgcttgcatactatcctgtgggggaatggcaatggtgctcactcccattgccgccgttctttgatgacccggagcacaaggcctgcagcaacatatcctacgcagtcatcgatggtacccgaatctgcatatcatctgccactgcgacctactcttttgacacagtggccctcgagtggagcaagattggtgattgggtgtttcccttccacgccaaagccgagtacattcctgagctcaaactatggcttggcctgtcagctagcagtccctctgacctgtgtgctttggacctctccactgctgccatggattcttgtgatgtgctacccatggtgcatcatgttgggcttgatgctgaccttcctgagggttgatcgctgaaaaatcgtaccctggtgaacctgggcatgggccggttttgcattaccatgttcttccatactgcagatgacggtcctcaggtgatcgtcttcaccggtgtggatgtcgtgccctgtggtgacaatcaacaaggggggcaggccctccacaggatcaagcacaagtccaaatgccttgtcacagacaggatcgagcatgtgctatgaattgtgatcgtcgatgctctcatctagagatggcaatggggacccataacccgagactcgacgggtttttattttattaggagctaattgtgttctaactcttataccaaatgttttaccgttcatcttattcaaaaacttttgtgaaatatgtaaaactatatatatacatataaatatatttaacaatgaatcaaatgataggaaaagaattaataattacttaaattttttgaataagacgaacggttaaacatatttaaaaaagtcaacggcttcaaatatttagaaacggggggagtattaatagcactgttgctagagaaaatagtgatggtttataactctaatatggccaattatagtacaaaacttaggctgtgtttagtttctgaaattggggagaagtttggagaaagttattagttttgaaaaaaaagttaggagtttatgtgtgtaggaaagttttggatgtgatgtgatgtgatgaaaagttgagagttgaggggaaatttagtgtgaactaaacacacccttagcccgaatgatcaagcacaagtccaaacgtttcatcactcacatcaagttcgtactctgaggtcatcgattgatcctcatttatccatgtttaacctactgggagaagtaggttcagagccagtaggaggacaaatactgcacgcagtgattttgctttaatgtgccatctactcactccgtcccaaaaaagacaaacactggatttccgtgttcaacatttaaccgtccgtcttatatgaaatttttttataattagtattttcattgttgttagatgataaaacatgattaatactttactagtaatatgcccgtgctaacgctacgatgctattattgttattttataaaaatattagaacttcatgttagggcaaataattttcgcacaatcctctcagattcaatgtcgtatatgaatttaaagtaggcagataacaataatatgatttgcttgaaaataataatccataaccatcgattacttcaatatacaatatacgtgagcaatatatgtggacactatatgtccacataaaaaagacaaaaaatggtagagaattattccattaatttgcatacaaacatgattaatactttatatgtgacttgtctttttaatttttttcataattttttcaaataagacggacggtcaaacgtccttgtttctctgccgataaaacttaatatatgtgccatctatatttatgttactgttgtactagtttttattttttttggtcgtaagaactatgtatatcttagcccttgtttctctgccaataaaactaaagctatagatcaagtgtggcgtctgctcagagattggctgtgaatggcattcccgcttccagaagaagggcctatggagtttggggattggtggctgaaatctattagccgatttcggacgtgctacagggggcttttgattccctttgtctcatggtgtattggttcatttggaaagaacgcaacacaaggatttttgagcatacatcttgcacaacagcttagctctaccgggatattagagaggaaatcctaatttggagagaagcagagatctttaaacgagtagattatcagtgctcagttttgtgagagttcttaggtggtgtttgaatcttctaaagataaagatgaagatgaagattaagtgtttcatgtaaaacgagatggtaataatgtgtgattaattgagttttaattattacgaacttgaaaaatgaatcaatcttatactttagaacaactttcatatagaaagttttagcatgaaacgcaccatttatcggtttgaaaaacgtgacatgagtatccaaaatttaatccaacttttgttagaggcgtcacccgaaggtgatcgctcctgtcgtttcttcaacaatcaacacagcttctacggattataggtgcggttgcagcactgcatgcgagcacaacttgacagcgatcgattaatgaagctgaagttaccacgaaatctgaggctgcatatctttagactaatgaagctgaagttaccgattactaatgtttgagggagttccttcttgcttcgttagtggaatttggcccggcacaaagtgataaaattaaacgcaaatgaagattggcccggcgcaaagtgacaaaatgaaacaggaattggagatgcggggtatcgatccccgtacctctcgcatgctaagcgagcgctctaccatctgagctacatccccgtgatgagcattagttttttttatcttgattgatactgtgttcataactgatggactgtaaatcgccaaaatgcatatgcaacactgcagctagcagtacatcgatatgcaagtgtttttttttaaaggaaccagcacaagaatgtgcttattcattaaatatagcaggagaaaaatacaacccctagaggcaaagaaaaagcaaaaaacaaggaaagctgtacactatacaaactgcgggatgatctctccaagacgcttggcgcctgccaaggcccacatgccagcctcttcttttatctttgaaagtagatacgaggttgcggtttccttatgatcaaatatcctcctatttcgctccttctagacttcccatacgatgagtagaatcagggtgcggagtcccttcttggggacgccagacacagaggctagcattttcaaccaatctttgattgattgcgccaccccccagcgtcggggttctaactggtggaaccctacccatgtcgcaacgagattccaaatccgtctcttatacctgcactcggcgatgaggtgcaaagccgtttcatcttctcttctgcaaagagggcacctgccattattttgccaacccttggtcgcaagccggtcagaggtccaaaccctattctgtatgataagccaagcgtggagtttgcattttccgggcgcctagaccttccagatcaaggagtcaaaagttgtgtcaggcgcgccaacacactgcgctttgtaggccgatgaagccgagtactgcccatgaggagtgaacttccaggcgatttggtctgactcttcttcttctaactgcatgttgcgaactgcagtccatagggccaccagctgctccacaagggccactgtaattactgggtttgtttccagtgccaaatcacctacccaggcatcattctcctttccttggcgcagggtctttttcctcttcttagaaattgcgtatactaggggcatgaggtcctttggtcttctcccatcaatccacgcagagtcccagaatcgcactatattctcgtcaccaatggttatcttagtggatgcggcaaacaagctcttgtctacttcatcgcaggggatctcgagaccaacccatggcttgtttgggtccttccattcatgccacagccagcgtagacgcagggctctcatgaatttttctaggttcaggatcctcaggcctccttgcctagttggcagacatgtctttgtccaattgactttgcattttccacccgtgatgtcccccatgccagcccagagaaaacgtcgccgctgcttgtctaggcactctaaagcttcctttgaagttttcagagcggtcagtaagtagattggctgcgccatcagcactgatttgacaagtgtggacctcccggcaagtcccatgtttttgcctctccatcccgttatacgccctgtgatcttatcaaagatgtgctgcatgtccgcctttcgcatccgcccgaggatcagggggagtcccaggtatttgatcgggaagcatgctctcactgctgggactccctctaggacatcgtccaaatcaatgttattgcatttgatgaccgcgacttgagatttttggaagttggtaacgagtccagtagccgtgccgaaacgttgcaggatttccgtgagcgcttggacatcccctcttgtgggattgacgaaaatgacagcgtcatctgcatacatagatgttctcaggcgaggcattctgcctcgaagcttagagagcgaacctaggtctgttgcctttgtaaggagatgttggagagggtcgattgctaggacaaaaaggagcggagacagcgggtctccctgccaaagtcctctcccatgcgtgattttttgaccagggatgccgttgagaagaacttgcgaggtagatgtgcagaggagggcacctagccagtctctccattttacagggaagcctaggcattgcaaaagggccatcaagtagtcccaacgaatggaatcaaatgctttcgtgatgtcgagcttgaagaggagcatcggccgattcgtacggtgaaatcttctggtcatgttcctcacaaagagaaagttgtcatgaatgcttcttcccttgattaaggcactttggttgatggagaccaaggagcgcatgtggggcctcagccgcaacgccagcagcttggagaagattttggctatgatatggattagactaatcggcctgtagtccgaaacactctccgccccttccttcttcgggatcaacacaatattcgctgagttcaggaggcccaagctggcgcagcggaggttgaagatggaattgaagacaagggaaacatcctccttgacgatatcccaacagcttttaaagaagataccagtgtaaccatccggccctggcgctttgtcaactggcatctctttgatagcccggtggatctcctgctccgagaaagactcttccaaggtagagaggtcgaaaggctggatgtctagagcttcccagttgagctcattcggcctcggccccggccgccccattaaatgggcgaagtggtcaaggatggtcatttctttctcatcgtgagtgactacccagccattttccttgcagagtctttgaatgctattcttcctcctacgcgcattcaccctgaggtgaaaaaacattgtgtttgcctccccttcacggatatgagtcaacctggaagcctgtcttttccttgccctctctatcgtggcgagagtcagagttttgcgctttagggcagctctcagccgcaattccgggccagagagatctctgtgttcctgggccacatcaagccgctgaatgacatcgagtgccatgtgaaactgaattttcacctctgtgaatagacttttagcccaggttttaatgcaagaagctgtgcgctgtagcttgtgatttatgtggcgcattggctctgtgtgcggggatggttgggtccaactagccttgaccatgtccttgaaacccgaaatgcgtgtccaaaagttctcaaatctaaaggggcgcggcttgcacggggcagcgggatttgaaagaacgagagggcagtggtctgatggccctgttgggagggcatgcaggacatggtgatggaaggcgagatcccagttctcattgcagaaacaatgatcaagcttcactagagtgggcctttgacgctcattactccaggtgaatctcttgttttgcaaggggatctcgcggagttcacatcgatcgattgttgctcgaaagcgcctcatgcgagctagattaaggttgccattgtttttgtcccttgctcggtagatcatgttgaaatccccgaataggagccacccttcgccagcattgggctttagccgccttatgtgcctaaggaaggcatccttaagccggtgtctcgtgggcccgtacaccccggtcataaggaaggtagcccctgtgagtgggaccatcacttgtgctgagatcaaaaagcggccgattcgaatatcttgtaggatgagggcagcattgttccaaaggatgataattccccctctcgtgcccgtggccggtttgaaggcaaagctatccaatttgtagccacccaggaagcgggtgaggccgtcgtcgatgttctgaagtttcgtctcttggaggcatgctaggttgcatttcgtatccaacatcatctcgtggaccgtgttgcagcgtgctggcgaattgagcaccctcacattccaactaatgaaatctaggctgtgcgacatctgcaaaccaaaggtggactcttgattgggagagtaggcccagccggggttggagcacggcctgcttggcgcgaaggaggggaaggggacttgggccgagaagatccctcgcggccataattgcgtcggcctcgagtgtcgttgcacgcgcagcccaacgaggcccaagatggaggacggccttagaaggcgcgtggaggcccaagcgagagcgcgaaggcccaagcgaggcctagcgagaggtaaggcccatggctggggagccgctagcgtcgtcgtcatcatttctgccttcgtcgcggcggcgcacatacacacagacgccggcggcagacgaggcgcaacgcaagcggggaaaaagacagcgcaggcggggtgaagcaaagcgaagttctgaccgacatgtgctccaagagctgaggttccatagaaatgctggggaggcggcacgcaggccaccggcgacacaccagctgcaaaagaaaagacgacgacgatacatggaacgatgacagctccgaatccgacgatacatggagcgacgacagctccgaatccgcgcgcacaggcgctgctcaagcgaacgtttcttccactttatcggccacatcagtgatcccttcgtccacaagagggagcagagcggcatccatggcgcactcatcatcgtcgtcgaggccgaagatcgccgtcaaggcggcgatggcgtgcggcggcaggggcccatcaaacatggccatatactggctgagaatgcgctccacggaggcatcttcttcgtcatggaggatgcccaacctcctgaacagg

SEQ ID NO: 78822 - DNA, 1153 bp, Oryza sativa
ggtgtatatgtggcaagtttgttactttgtaaatgcatataatttatagttaaaaatatcactaattgaataatcaaaatttcaatctttgatcgatgaggtatagcaaaatacaagtgtgccaatttatggaataaccacccgatcaatttataaggctatgaaaagatgtatataagggattattcatgtgatgatgtatgaaacaaatgcaacaatcgtgttcaatgctatatacgatttccgactttgttttaccattgttttttttgtcttgttttagtttgtcgtttaatttagcaaggatttgatcaaacgtgaaaattgtattgtaatacacatgcattttttttgctagttagaaaaaagaaaatcaagacaactgagcgagtatctaacaattgacaaaagtatcaaaattgctttttacaaagaaaatttccaactgtcaataatgcatcgatgagtgatacttttcttcatggctgcatcacaacactctcctttctctccttcctttccccttttgtcgccctccaccctctcaaatcaaagcaaaaaaaacacaagagcatttcccatctctcccactccttccgccatggccgactaccaccgcccctaccggagcgacctcgacctccgcccaccgccgccgccgccgtcctccgcctccttcccgcactccaacggctactacctcccctcctcctcctcctcctcccccaccgccaacggctacttctcctccaagggcaccggcggctttgcggccaacggcgaccggcggatcgagatctacaccacggcgccgcccccgccgctgccccctccgccgcgcctcgcgctcccgccgccgcccgggaggcgggacggctacctgggaggtggcggagcggggggtggcggtggaggaggcggaagcggtggcatgtggtgcttcagcgacccggagatgaagcggcggcggcgggtggcgagctacaaggcgtactcggtggagggcaagatgaaggcgtcgctgcggagggggctccgctggttcaagggcaagtgctccgagatcttccacggatggtaaaaaccctctgtgatccgctctcctcacgccatggctaatgatggctcctcctccacttctcggaatgaaagg

SEQ ID NO: 78823 - DNA, 2917 bp, Oryza sativa
aatatcatctcatgtgtgtggctggatcaataacgattaagacggacggaaaaattgatggaagtgctaaaaatgggaacaaggtgaactttggatgctattaaagtgaaccggtaactttcggtgctataaaaccaaaaacgtgaactttcgatgctatataaccaacttagcctttttttaaatgttgcacgatgttccaccaggtatatcgaaattgtctcactaagtacatcgaaaatgtttcactcgtttaaatcgggtgttgtttcaccttatataaaaacaatgtttcagcaaatagcgaaagaatgttttagtttactgcaacatttgatccatacatagtgaaacattataagtacactaggtgaaacatttttcgatggaacaaaaaataaaacgaattcccttaatagggggtttccaaaatatgtgggtttttttgttgcaatggaatatctcagtttactgcaacattagatctatacatagtgaaacattgtgagtgcactaggttaaatatttttggtggaaaaaaataaaccaaattttcttaatagagagtttccaaaatatatggttaatttgttgcaggggcaggcactgtggtgggccagacacatggtgggccagcggcatgcaggcgcatggccgcgcgcggggagcggggccggggggagcacccgattttgctcccccgtccagtcacccagatagcagcatttccccggtatttttataaaggaaaaatataatactggaattgatcatgcgtaaataatatgtctcgtttttttcctcagactgatttgtctgtctacacggtatgatgtgttggatggattgaactttcaagtttaggccgtgttcagttagttggccaattttttttatgtatactgacacatatttgaagtattaaacgtagattaatgacaaaacaaattatagattccgcctgtaaactgcgatacaaatttattaagcttgattaatctgccattagtaaatgtttactatagcaccacattgtcaaatcaggacacaattaggctcaaaatatttgtctcgcaatttacatacaaactgtatagttggtttttttcgtccacatttaatgatccatgcatgtgtctaaatatttgatgcgatgttttttgccaaatttttttaaaatctaaacacagccttgttgttgttttggaattcaaattcgtatgattagcgagcctcatgttgatttgggagtagtagaacagctttcacctggcactccgtacaaccgctcatcctagccgaacgtgtatgacctcgaatgctttcgacaaggacaatcattaaccatgtttgtttcagggccctggcaaatggatcacaacgatttcacatcacttcgtaaaccgtttactccgtcctaaaaaatccaacctaatactctatccgtctcagaatatagtaacctaggagcggatgacgtatcctctctccgtctcagaatatactaacctaggagcggatgacgtatcctagtactggatacgatacaacctaattctataaatttctattcagatttgtttcgttgtgttagaatatgtcatatttcttcattattttttttacgaagagagtagtagatctcacatctcggtagtctattcaaatcaaccttggccgccgtcctatccacggcgagccccacggcccccaaacccgccggccgccggtgggccaccgctccccccacaacaattaattactaactcctcattactaaatgatctctttattaatcccttgtacacctgtaaccactccacagtccaccccaacccagcgtaacgtccactcatcgcgagccgctcaatccaaatccaacggcatcccgcaacccacgtgtccctcaccgcgcgcgagtttgaatttcccaacggctctctcgaccgttgctgccacgctcctgaaaaaaaccaaaaaaaaaaataaaaaaaacacgcatctgtttttattctctcccatctctcccgatctctcgcccatttgcctctgatcccgaaacaaacagttggcggcggcggcggcgcgaggcgatggcggcgacggcgttcacggaggaggagaaggcggtggatgactcgctcggctaccccaaggcctacgcgcgcctctgccgcggcggcggcggtggcggcggtggactcccgtacggccacggcccgccgcacggcttcctcccctacgtcctccacccgcacgaggtaatgggtgctcgtcgaggtgatggtcgcggctgctggtgcggtggtgagctgattggggtggttgtgttgggtggtggtgcaggcgatgcgggcgaaggatctgaacgagatgttcccggtggccgacgcggaggcggcgccgacggcgaacccgcgggggttcgcgaacctgctgtggaagcagctcgaccacctcggcaacgccgggttcgacccggcgctgttccgcgtcgacgcctacggcaacgtgctctacctccacgccgactccgcctcgcctctcgcgtgggacatcgaccactggttcccctgcgcccgtaagaaacgcagatcgaacgaactcatcccaacatccgcttccacatcattccttcgatctctaacgagattgttttttttgtatttgctcgcaggaggtgggaggacggtgccgagcaacctgaggatcgtgcaggcgcaggtgtgcaggaagaagcacaacaagctggagttcctcgtcccgtggtgggatctgcagctcggcatctccgtcaaccagttcctctccatcttcgcctccaagaacgccgacttcaggttcgcccatccgcatcgaacagcttaatgtgtctctgcgggtttttttttaccgatgcatcatggatcgaatcctt

SEQ ID NO: 78824 - DNA, 2631 bp, Oryza sativa
tggcgagtggcgacaaatgcgtcacgctctgtatacgtactgtacaaaagcttaacgtgttgcttaaattatacgtgtcatgttaacaaatatatatttctatcaccgctttaattgtgtatatctttgttggcaaattaccacgcatgcaatcttagtaaaagtgccccttaacaatattgtttgggatgacatatgcgccacttatttcaaaatttacatataatcatgtgagaaatgaaagcccatatatacttggacttagtggcggacgtagctatagaaaaaaagaatgtgtttgatgctcattctataaggataatcgaacacaacatttatattataatcacataaaaaagtataatataatcaataaattaaacaaacatgaatatttaagatggtacctaatctttgagccgtaaatagtaaaaaactactcaaatcttaaataaaaaaatcgaaggaaataaccaactgatcacttgttgctcatccgtcaatcaaattcgaagttccactatacaatcctacgataccttggttctgaacttattaccaatgacacttttcccatcaggcatgcattcggactcaatagcctttctcgccctcagccagcggcagtgattcagattgtccctccatctccatagattgcacccatagtttcgctcttgttaaaagctcctcttcagagaccatgcatgcgaggaatgaatgaagaaagtgaaaaaaacaagtcacaaacaaagtctcatgcgattcgattggaactttatgggctgacctttgtcgatcgaccgagcctacctaatgggtaaatctgcccctgcttggcctgtgaaatatcttgcacaatatgttaaatcgagggataagttattttctgatgagattgtaatattgtatgcttgtataaattattcttgatcatatattgatatatagtatgccattaattagctaaccagttgaaaatttagcttattgctagaatgctcgtttctggcctatgttgcattgtctcttatgtttggatggtcatgcatcattaattcctgagtatatattgttcaactgatggactgtaattctttccaccacaaaatgcgtgcgatgatctgcaactgcaaaatgcaagcgatgaagcaacatgcgtaatgcattgcatgcccggcttccctcttctgcaaactccttatatatagccctccaaactccacacagctagtataccagtaaccaaatcaaaccctagctagctagctagctaagctagcacgcacccatggcgtcgtcttccacctcgagctcgctcgccgcggcagcgatggtggccggcgtcctcctcctcctgggtgccaccgccacgtccacccaggcggcgcgcctcctcgacgaagaactccccaccgccgccatcccggcgatccccggcgtccccggagtgccggcggtcggccccgggatcccggtgatcccccgcgtgcccggagtgccggaggttggccccgggatcccgttcgtgccggtgatccccggcgtgccggtgatcgtgccgatcatccccggcgtgccgatgatcgccggcatgacaaccctgccagtgccgccatttgtgccgccgattgatcccggcgccggcgccggattccccggcgtgccgccggcgtcgtcgaccaccgtgcaggaagacccacagccgccgatgccgtccgtcgttccacccgtgccataggtgttaatcaactccggcgagccaccatgccgtagttaagttataccgttgctcacgccgccgcgatgtgtgtactccggcggcttaatataacgtgcctccttactgtgtgttaattaagtactcctcctgtctaaaaaaaattaacttctctatgaatttatagacgtagttagaagttgattttttcttggatggtaagagtacatgtgttaccgtgtgttgttacgttaagttggtaatttgtgtactgatgaatcgtgtgtgtatgatgtgcactgtgcagtgcagaccaggtacgtacgtgtgggtcgcgtcacccaatctctgagtgctcgcaaaatttaatgtgcttaatgcacgaattaattatacgtcgaatattataggttttaatttaatcttgtgtaacccactattttatcactgtttgaactttgaatcatacgtgtctatttttgttgggatattagtcttgctaaggtgcataggaatgaaaatcatattagtcatgttttagttagtaaaggccgagttgaggaactactcatttctggccggacaatagctgtactgctatcgcacaactttgtttgtgtcgatgctttgattgaataaagtggtccctgtttcctccaaaaaaaaaaaagaaaatcatgcgtgcttatatgtgactgttaattttgggggcctagagcattccgggcaaaccggcctgaaatttacagcccaaaacaaatgttgggctttgcctatgcagcaatttttcgggccaaaacaaacaaccatgcatatgctgattttttttaattttttattaaaatatttacaaaactaattccatgtttcaaaaatttacaatagtagttgcccaccaccctctgatctgg

SEQ ID NO: 78825 - DNA, 4105 bp, Oryza sativa
ccttaatttatgctaaactaacaaaaaaaaacaattattttgggatgaagggagtataacctaacggagatcctctgcagggtagtgctactcactgggcacaagggtttatgccttatagatccacgtgtcagtgaacagtactgcagagaatcctctttcaatataaccttattctactaagataagcatattatactgctgatgttggtcatcggagatgatcagcaaacatttactaaagtttcaaagaaggaaaagaataataaagctttaatactactactacacatttggtcctggatgaatggggaaattagggcttatttgaattaaaggatttttatgatgaggaaaaaaatggaggaatccaattcaaaagaaattctcctactatatgagcagtttagtttggatcatacgattgtttcaaagggatttcaagggataggaaaagtctctccacatcttcgaggaattctagcatggggtctaacctcgttgtttcgaattcttttgtgatttttaaggcatgttctctcctcctctctctagcaaattaaacatgtaatctcaattttctctcacccgttcgatatatccaaacacttgtgtttgaatgattcctgtagtttgattgcttggaggatttttcatgtcgtgacatttcaatcctaagttttcctcttcctgtattttgagtcatgttccaaaggaacccttaaagtggacttataactttcatcaatacatatttggtaactcatggtaaggagattggaaatttagagtaataagctaatgaagggattgatcctgtaagtttcatttttaatctctgtcgtttgataggagatatgagaattatgatgaatttgagtgagaaatgaattttaagtgatgatatactaacttatttttttctctcagttacctgcctctacccaaatattgaaaagacgagagttcgctcttaaaactcctcacccctcaaacttccatcatcttcaaacattccccctccctcctaaccaaacactccctcagcgttctgaatgcaacgtgctattcaattaatcacagaatataactttgactgacttacaaacttagtaccagaaggggataagaagtgaaatccgagtagaaatagggagattcaaaatcacatataggaaagtaagaataaccaacaccttcactcttggataaacgttgtcacaaaatacgtaccgtcaaattttaaaaccttaaatggccaattaataaaaacatcaaagttttacacaatgatgaaatatgtctgttatacctattgatagtgagacatctacatgattttctttattaaagatatgttggtgcaatctctgaaggtgctctatgcacaagtgtacatataagtgcatgcatctgtcatgtgttaaaaaaaagctcagagatgatgagatatgttcattacattaccaaaacaaagcataacaatgaattaagtaccagataaatcttggcaattgggctcttgaaaacctggtgcacagtctcatcatctctactgttctacagaatcacctcccttatcttacctgcatgacaaatgcctcgagaaaaaaaatatagccacgatggcagtagcgaaatatcgtgcaaaaggaggggcagtttcgaccgaggagctacagtgagccgcaagtacgcttttttctgcaggctcatcaatccatgcacactcattattagccctagaactgtagcatcatttcacatttattttctttctctctctctcggccttaatcgcatataacgataattgatatggataattggattggattatatgcagctgtatcacaaattcacaatcccacaatctcattttcttttttactcggtgaaccactaaaacagtgtgaaatgggcagctgtttggcgttttcaagaaagaaaatattgttaaactgaccttttttgacagtcatcttcagttttttttttttgtttaagcccttcctctcctcactcacactgccctgttcatctctttcttttttattcgattcctctattccattccacacgcattgccgctggtagtagaagtatagtatctctccgcgaccgaagattttaaaaaggaagcaatttgcctcttttttttttttggcgcacctcgattagtagtagattttagaggcgaatgtgagcggtcaaatccttcttttttagcttgtgcgcgttgtgttttgtgctctccttttgtcagttcctgaggcgctctctcctgtgcctttgtgtttagcgtgcgtgaccgcgagcgaggtcgaggagtgagagggagtgaggcggcggcggcggcggccatggcgcagcagcagcagcagcagagtgcgtgggaagcggagaagatgtgagctttctcctatctctcttctgttcttcgttgcttcatcattccttagtttgttattgcgatcagattggtttgatgttcttcgcacattcttttttcccttttttttatgttggtgaaatgttctccgttttgtcttgagatttttttgtcattccatttggttctcttggtgtccgcatggttatctttccccaagattagtttcttgttttcctctgggaggggtttcggattcgtttcttggcggtttagatcgtctttttttctggtgatttttgcaagaatcttgtccttcatcttcccttgttgttgtatttcagagggctgcagacgcttgagattctgtttgagttccctgaaatttctgcattttccgttctgcattttggtttctccttttgcaaaagccatgcctcttttttttttcttgttcctcttgttccttttatttttctcggatacagtactagtttggtttattgcttgctagcttttcaactgccttttccttttaccttgcattgcaactgccttttcatttctcgaaatttatttgctctttcacactttaatctgcattttacctttttattttctcatgaaaactttcgatcccctccttcctgttgctgctgtgcttgcatgcaaacccccatgtttccttttttacttattatatatccccgcactgaacttatccatgtctgttcttggaagcaggttggacgtgtacatccatgattatcttttgaagaggaacctgcagagcactgccaaggcattccaagcagaaggcagcgtgtcttccgatcctgttggtcagtgcatcaatttctgaattttgtcatactactgtagtttgcaatctttgctctttctgcattaggaccagatagtttgttcctcagactgccattgttcttgggccaataggatggttacaaattgatcatttgattagcttgattagtactacacttacatttgtgcatgtgcgagacacgagtattattagctactcgtaccgggcagatacaaaggaacaatactacagccacattgttttgtctgatttatgcatgccagtctctgatgtttctgcattgtaatgaatgcgattttaatcttcttgtactgaaagatgtcagcttttgttttgcaaaaaaagcaattgatgccccagggggtttcctcttggagtggtggtctgtcttctgggacatcttcattgcaaggacgaacgagaagcactctgatgttgctgcttcgtacattgaggttcttgtagcacatgcatcttggttattacttgtccttgttgtttgcttgcactcacttggtacagtggtttactgcttatcttacaataaacatgtgtaaatgcttgaattgtgtcagtcatagagatcatgttcactgtaaaaggatttagttttttgcctaaagcaaatggatttaaattccacacaaacattgaaaaccaaattcaagaactttccatgtcactcttgaaaaaaaagaagaaaatgcctaattcatctatgtaggaaaaacttgttatggtggatatttttttttaaaaaaaaaatcaaatgtttccccatatttccaaacaaaacatgctgcatcatatcacacaattatagaagaacatgtgtcttaatcattttagaaggtacagaatgcaaa

SEQ ID NO: 78826 - DNA, 5092 bp, Oryza sativa
  unsure (1)..(5092): unsure at all n locations
aaaatggcagccccctacagccggccgctaggcatgagccaacggccatctgccacaacacgaaaatcgctatttgggagggctatttctaaaaatcgtcctctcaaagagcggcgggtgactaattttgtaaatttttgaaacacaaaattagttttgtaaatattttaataaaaaattttaaaaaaattctgcatatgcttacgtcgtcgataaaactgacgaaaatactcctttagaaaaagctgacacgaacaaaacggttcaacagattgaagctgcacctaaacaaagaaatttcgatccacggatggtacggagtatgcactaacaaataatcaaaacaaaaacaacctcgtcgacaatatatttggccgatcgctacaactaaatctcctgccttggccacacaatttcagaatttatccttttgttattattccttttgggatcgatcgatgaacatcctagcaagcagccaagcatatatgagttctgattaccaaacatgggcgattaaagaacaaatttgttgcagctgcaacgacacaccgttctggccaaccaccgatctaaccggatatatattcacttaattagccttataaattgcgcacagattggctcgtgttcttcgcactcactgcaagaacagattaagaaaaaaaaacacacacacacacacacaagctagtcttgctgcaatggcttctagtgtgagcttcatggccacggccatggcgatggcgtgcgttctgctcgccgccagcagcagcagaacgtgctacgccgcccgcatgttggccgacacgccggcgacggcggcggcggcggccgcgcctcccgccgccctccctgtcctccccgccgtgccggcgctgcccaccactctgccgcccatgccggccatcccggccgtgccacaggcggcgctgccgccgatgcccgccgtgcccaccgtgcccgcggtcgtccctaacgcggcggcgctgccgccgatgcccgctgtcccggccatcccggcggtgccgaaaggtgtcgttgccaccgatgcccgccgtgccggcggtgaccctgccgccgatgcccgccggcatccccgccgtgccggcggtgacgctgccgccgatgccgtccatcccgaccgtgaacgtgcccatgccgttccaggcgccgcctccatcggaataggcagngnggcgaaccagccgtgccagtnnactgcggnggcggngnnngnnnnnnggnnncagtaggtaaantaagatttttcatgtgaaatttctcaatgtttgtgtgagtgtgttatttatttcatacttagtttgaattcttcttgaaattggggtccaaantagggttagnaattgaaactactagtgtgcttggcttaattgaagtgtacattatattttgggtacgcacggtctcaacgcatgtgttgaggtcgtgccattgtgttttacgtgtacgtgtacgtacggtttatgtatttgtttttactttcatactttcagagattatatatatgttactttactacatttcatttttaaagttcacaattgtactttcatgtttgaacattttggaactttgatgtaatctcgtgggcggcagctacgcagagaatatgacatggaaaaaaaaagtactccacttttcagttcctgacgcaggtcacataatccggtgcagcaaaatgcagcgctgcagccttgacggtctaaggaactgaaacgactaaaaaaaacaaatttaactaaaaagcttgcggcgttcttgtgtagttggattgtttttttttctattcgcgtagtcgaatttgactatgaaagcctgtttggtacagctccaactcctaaatattgctccgggagttgagtctgaagtggagttggagctgccttaaccagctccacaactctagtacattttgtgagagagctccacccaactccactctcagttttggtggagctgaaactgtttggctgagctcccgctccaggaggggtggagctggagttgaagttgtgccaaacagaccctgaatttagtcccggtagtatagtttgagaatttgatgaaaatagaggcttgcctagaaaagttcatgtgaaaatgagaaattttagaggtgtacatagagacatatcggtatgtatatatgtttataggggtgagtatgtctccgtgtatattaacgtctgcttgtgttacaaattgtttttacttctaaaaaaatatttttaactgttagaagtacttccagaagacactctttttgtctgtgagaaaagttgggctgccgccgaaggccgttttccatttcccggcccattaacgaaaggaaactgatattatagcccaacaactggatcgcactgctagttggccttggtccccttctaaaagaaaggaagataatctaccggtttgactgctttaaacacataaattggcataaactaatactgtgaaaacggtaatggaaatacctgactgcctgaagttcatttctgttttttatggaccgagccatgtagaaatgattataccgataaaattgaataaaaatgataaaaaaatggaaatagaaacggaaacgatattgatattatgtgattatgtcaaccgtttccaaaatctaccctgttctaacggaaaataccatttttatattatagtaattatcatatctactccaatatatatgatccatttctttatttgacccatagtttgagcatcatcaactcctcaaccaaatcagtataaattgagtgtatggttaaatgggagataaattgtaatatgattacttagtgtgacatttgaatttatttccaatattatatagtaaaactagagccaaatcttaataaaataaaatttgcaagcaaaattttctttggaccttagtgaccacatcctatggatgagatgttgctgtcagcaaagagcttaagctatcttagttctttgtcttcacaagaatggggacaccctgcagatcttctctgaagatgagaaggcactgccctgtaatctacatctgagctcccattggctcaaactcacctggctcaagatcacaacagcacagcctgcatcccaagaagaaaaagaaaacttctttttttttctcatcacaagatcacaaaactgcagaaaggaacagggaatggaaaacgtcagaatggaatgatccagaggggctagactagtagtagtagctagataaccccaagccgagctagcaatgatccaaatcccacagttgctttcctatggctttggatgttgggggcacatttcgttttcagattatgcccagatgcaagtagagcacatgtcgtttcaaattattccgaaatattactgtcttgaaagagatgctaacttcgcattgctccaaaggaatcgtatgctcctgtgtttcgtttcagaaataaagaaattttggttttttggcgcaccgttttcagattctttgaactggtatgattggaatgattttgcagccgattccaagggaacaaaactaaccacttcttgtcaaattaaaacttgcacttaaccaatacaatcatgagagtgatgacatgtttttttttgggtgatttcagaaacagaaccgtcagggtcactgttggtgagtttggtctcatatgatgaagtaagctgaattgaagaagggagaatcatttctggtcattgccctgccccccatagaaagaattttatgcgtatctccaatgctagtggtgggcaatacttggcatggtatccatcaaggcatcaagcaccattgctcatcaattttcataaaaacatatttatcaactacatactacctttctaaaacaaacactaaaaatatgctttgactctcaaaaaggtttcaaagaacattttatctaaggatcgttcctatgcttcaccgaaactatatagctagacaacatacaaaattagctaaggtggagctggtatacaaggcctgcgtagaggtcggatttaatccattgtcttaaaaaaagtatacaatgccttgttattaaaaagtaaaaagacatgggagatcctaatatataatgttttgtaaatatttcttcaagatttgtttatggtttagtaaaactcctcgggaaattccaacaatattttgggaagataccttgactaagaaaaaaaatccccaaagaacaaaaaaacactctacctcaggctgtcaaaaacatgccaggatgggcaatgtgatgaatagtcctattgaggtctctttctgtagagaaactatcgaaaaactaaatttatggcttggagcaaactcagttcagagtcatcaattatatgtttatcgcaacagtgagatgggaccaacatcagaaaggagagaagatttcctgtccaatctgtttacatggcattgatgcacaacaatgttcccaaataaaccagactctatggcatcaacaaatacctccaaaaattacttactagcatttttccaatgcttcctgtgtaggggtctgaatttgaccaaagataaccaatggaatcaacaggctggtgcagataattagctacctgtttaatagatcatcttgatcatttttttgcaaagaattaactaccccagctagatccacatcagtcaaattataatccagtatgaataaagtatattactacgacatcaacatgcatatgatgcattgatgcatacagtgatacaggcttacaacatcagttacatactcttaggctgtgtttagtttctaaaattggggagaagtttggagaaagttggtagtttgaaaaaaaagttaggagtttatgtgagtagaaaagttttggatacgatgaaaagttggtagtttggggaagtttggtgtgaagttaaacaggcctagataggagaagaaagtacagaagcagaaaccattagtttacagagccctaagcttgcagcagcagcagcagcagaagtagcagagaagtgggagagcgatgtatccattcctgcaaatccaagttggcaattccgagggccgacatatatcccactccaaggagatccgac

SEQ ID NO: 78827 - DNA, 17221 bp, Oryza sativa
tgttcccttctcaccacctccaagtacgctttgcgggacactcgcggcagcaagagttcgtatactcgcctctgctgctgctgcactgccgcgcctaaagctgagcaagaagaggagactttgcagcaagagttgctactgtttggtttggttcaggtgagagaggtcaacaatagctgttggcgtggctagttgcttgtgcagaaaaggattctcttttggttttgccctttctgagaagctgatgatgatgtggtggtgggctatggttgtgcaggttggggagctactagaagaaggaggaatagctaggttgggtagctcagctttgctctccttttattttttatttttttttctgtttgttccaaggtttcttgcatcactttgcggcttatcttgttggttttccttctattttaaggtgtaaagtttgtctccttgtcttggttgtgcttgctgttcttgtttgtttcaaccaacttgtgcagttatacttgatgcttaatgcttctttttttttctttttctatgtggtttatgcaggttgtgaatttcttggggggacacaagaatcgtgggatggatggcaatgcgagatcggcggcgaatcagacgaagcaaatcgtgtagagatttcatctgaaacccaagaacggattcgtcttgtgttgttgccgaatggtagtgacctgacctgactctgtgtgcatttgctccaatggcgatttgcagcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgcggtgatcttttttttttcgttggctgtaacctgcaacttgctatgcttgagatgaattcttgaatgaaactgatgagaaatttcaggatgctgaatgcgaggcaaccgaagagaccaaatcgtcgtcgcggcgatatggatcaaagaggagaactcgtgcagctgaagttcataacctgtcagagagggtgagatcatcaaatacagctactgatcttaagagataaatttttagtagtcatcctaaaagatgatactgatgtagagaagaagggatcggatcaacgagaagatgcgcgcattgcaagaactcatacctcattgcaacaaggtaagaaacattattatatatgcatcttttttctgatcaggtgcaagtccatggactgatacagctatgttggtgagtggtggcatatctgatctatcctttgttgatatgattctcttttttattcaaaccttttgggtttactttactaactgcagttatctatatatttttcaattagaccgacaaggcatctatattagatgaagcaatcgagtatctgaagtcactccaaatgcaagttcaggtttgaactactgtttcttgtatctgaacttacatggtcctacatgaggccaattactagcacagattgagattgtcgaatctgtgcctcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtacaaaaataccatactgacaaagggaattttcaggcctctttgattgttcacctagattaggcattggtcatttgcaggtatcaggaccatatgcttctgggcctcaagtagcacagcaaaaccagataccgaaagcgtcagctagcactgttctgccaaattctggggctgaacaaccaccaacctctgatggaatttagaatgaccagaaacatgtaagcacttgcaccaatcagtacatctgcctatttacttcaaatgatgttgagataactagagctgcgtatcgctacttgtatgtattactattgttttcagccaatatatctgtattgaacacgatcggcaatttgtgccgtcactttttgtcagcttaagctttcagagcaactaggtaacatgaggacctatggacttacccatatcatctgtagtctgtttgttgagctcgaaatgcatgactagatgcatagaatatgaagccatcatcgtccagcttaaactttcacagtaacctgttagttcatgcaagctaaccagttgttttcatctgacctgtcatatgatggactagtcggtggctccaatctttttggtttttgacatcttctagcactgtccatgaaaattaacggttgtatgtctatttcagcgtcacgctgttgcatcaaatagaccacatgatagcaaagagttgctggtggataacttcagaactattatttatgatcttcattttcttgatattacaggataaggaattcaatgtaggctttgcacaaagggtcgtctttctggagatagctgaaaatattgacatgatgaacagattgcatccatattgctgttatgtatctcaatcagtatctgtctgacataaatgctacaagtgtctgtaaatgcacatagcatttccccccttccctaagatgctaattcccagtgtatgtactaataatccttataatatgaagtgccagtggcaatctttgcccttctttatcatcctctctaaattcttagaaatgtctttccttttctgggaggaaagaggaaatgttgaaatacttgttaaatgacaaccatgcaagcaacaggaaggcacaaaagaagccaggtcctacatgaactcattggataacaaactgacactgttcctgttctttaaatccaaagtacagctcaatcagagctcgtcttttcggccagtgctactgctggtgggcaaccagcatatgatacatatcttatctatgctttagcctaacacgactttctgtttgtggaaagatttggtgaacactgattgtctgattgtgtctgactgttgcacaaacgagccgacacacttattgccaaaatcttcagcattctggttctttgtgactcatgcagcagcagcaggaacaacaactgggagagcctgaggattatgtctgggaaccctaccaccattgcaaattgccatcatcccagcagaaacctgaaggtatacaggagttgccaatttctttttttgcctgatgttacagcactcaagtgcaggttattacatggtcctacctgcacatgctatggggggtccctgcacattgcaactggttcataggatcatatctactatctcctgagctttttttttcctgtctaccacaatgggatcccctggcactccttgctccacgcctcgccgctgttgctttcgcctttccgttattcttcgggattgaacagattgtcgcctgcgtcattgcagcgtaagaggaggaggaggaggatgatgcagccgggggcacttgctgagcctggacagtgatgtccatgtaaatgcaacctctggcttgtattgccggaacatgtacagtagaggtggtgtaaaacactttgctgtggcgttttactgctgtagttacttcttttcacctagttggcaaagccaatatatggccagcttatggaagtcctatttcgcaatcagctgcgagataaacagtttgcgatcactgctttgagccgttggatcaaccgtacattgacttcgaagtggaaggggggaaacaactcaggctcagtttaaaatagatttttaaaatagattattgaacggattgttgctgtagattatctactttattatagggataattaatcattttgatataacagataacttaaaacaagtggttaagcaatcttgtagatttttttttgataaaacatatttttcaaagcatggtgcaaataatccggtgaatagtctgaaaggaattaagtgtgccgtgtaatatgcgctcccaaaaggccatattgccgtaagcttcccttaagaacattgatgttttgttccataataacatgaatatctcctacatcattttagatgaaaaaagtagactcgttgatgttcatgtcagcatcttgtgtttattagggttctacttcagtcaccatctacgagcactagaatctgggatcgtatcctgtttcacatttataggtggagatttggagttcatgtccaagttggttgcatctattatctcttgttgacccagtcctctcaagttgtgttagtactgttgttccatgctaatagtgcagactgcagagcaagagaactgattgatatttcttttgttgtgataaatatagggctaactgcttgctgaattatacgagcttgggcattttaaaggaaaaacgagtggatctatatacaattcttattttctactacctctattccataatgtaaggtatggtcaaactcggcacagtatacaaaactattttttgacttataatttcttatatactataaaatttgtagcaacaaaattataaccatatcaaagtatattgaaatatcaatccaataatattattttcaacaaataaaattcaatttatattatactaatcgttagtgagatattttgaaagttaaatcttgaaatatgtgtgtgctttacattatggaatggagggagtacttctataaaaaaaatgcaattatgatttctatataaaactagaaatagagtcagatttcatatacaactcttgaaatagaaaatagaattggatgtcatatacaacttttaatttcttttctgttacctgtagtttgtatacaccatacttttaaaagtggaattagatatacatctcttaacttctcgttttatagataccaccaaccaatttacaccgctatattttaaacccattatgacaatggtcatttttttttctaaaattaatgtgagaatttctaagcaaacttggtgactcttatttgagttaccttaataataaatccaacgatcaacgttaattttagttatttatattttatttttttccttggatagagaacacattatttatttgattgagaaaatatggaagaactataaactcgtagatgtcaaaggacacagtaggaacaacaatatagatgtcacgatcagcgttcattttaattcctttttctttggataacgattaacgaacacgttatttatttgatagagaaaatatggatgaacatagtatatacaaaaagaaaaaaaaatgatttgatagagaaaatatggatgaacacagtatttgatagaaaaaaaattggcttcgcccggactcgaaccggagaccttcagtgtgttagactgacgtgataaccaactacaccacaaaaccaagctgctggtaagtccaaattactttaaataaattatccctatgggccagtacaacacatgctttagatgtaataaaatagattagctcgacataactactctatttcttatttagttttatcattgcaaatgtacactattacttgaaggtttaattaattaaatccatgcaattgtaaattttatggtttttaaaatctaccactatattcatgtaattggaaccatatcaccatgacaagcctaaaatcgaatccatatcacactattagcttgagacctgtgttaaatattttttctaccatactttttatggaacagaatgcccttctgtctccctgttttaacgaattttttagagacaatactattttaatagaaaattataaaaataggggtcagatggttgaaatcacaactttggtgccctgtcaaacaaccaaaatttgacaaggcacatatcaaacagccgcctattgaaatgtgattgttcgtcagggtagaagaaatacaagtgtaaacagaatatttcaggtagtaagaatatgccatttgacctccatcaatttttaaatatgttatttttagtaataatataaatagctacatcagttatggggtgcatggctgtaatgacatgttcgagaagtatcagatgtcaacgtataaattcaaacttgtgagtcagaaagtacataaagacgcagttttcatcaaagtgtaagttcaaacttgtgaacgacaaagtaaaaatgttcgagaagtatcagatgtcaacgtataaattcaaacttgtgagtcagaaagtacataaagacgcagttttcatcaaagtgtaagttcaaacttgtgaacgacaaagtaaaaatggaaaaaattaaaaagatttggctttgcccggactcgaaccggagaccttcagtgtgttagattgacgtgataaccaactacaccacgaaaccaagttgcagccaagcccaaattaactataataaacggatcattttgtgcctatgagtatgacagtgcaacacatgatttggatatatagaataaaataagatcagctggagttaattactctgttgactgttgcttatttagttttatagttttagataacccactaaaattaggtggacatgggtttaattaaaattatgccattataatttttacggttttaaaatctaccactgttattcatgtacttgaaattatgccatgacaacaatgctaaaattggatcatgtcacagtacacgcttgaaatacattttgaatctcctttttctaccgtattttgttatggaacataatgcccttgtcttcctgcttttaatagcctgtgggtagtcatatggatggcgccggtagtgaggactgagaagaaagtgaggagttcatcctgctcaagcccaagtgccgacctcttattgtccttctctaagggtttgttcgttttggaggaaataataatttaaggatttggacttttagggattaatgtctatgagtgtcatttgttttgtaggattagaagtagaggaaaaccaaaggaaaattttctttcctacatgtgaaaataactcgggaaaaaaagttgaaatatgacatcaaccatgagacaaaacgaaatgaggttcattaccatgagacatcgtaaaagtggatttttttttatccgagcgttacgcataaaatctgagtattatgaaataaaatatttctgaaagcaatttaaaaataaattgaaacgaccattacgccaaaaaaaaaactgagtattatgaaaaatttttctgaaacgaatttaaaaaaattggcttcgcccggactcgaaccggagaccttcagtgtgttagactgacgtgataaccaactacaccacgaaaccatgatgctcgcgattttaccgtaagaactccatatataacaaattccccatttgaacgaaatttacatataaacataagaccaattttgcatgtttataagactatataaatcctccgaagagaaagaaattaaggatctgttgatagaaaaatgaaacgaaattaggatgtggcctctcttggatgggtcggccaggccgaagaaacacgccaagctctctgcattgtacaagtgattcttgcctctcctctgcttcctcttccaccttcccgacgcatttcggccttgcagaaaagtatatgatactacaactgttatttctgatgtttcccatctgaatatttcagatgggctcaaaatacgtgtacggatcctaatttcctgtcatttgttcaaagattctagagatagcaaaaaaaaaaaaaaagacagcttaacctttttcaagaaaaatgtttttagcaggagcttcattcattcgagacgatacaacaaggttaagctgtaatacaaacttttacttatgaaatcatacacatctgtagtacctgaaccagaataccaaagaatctgtgccctcgcaaaaaaaggaaaaaaagaagaagaaaaaaacacctgcgaatggcgtcctaatccaaacttatgagcgtccgtgcatgtgcatgggcatggcggggtgatgccgactacctgttcacagtgatgcatccctcagagagctttcatttttcatctttctgcagggacggagggaattgcttcgatggccctctataacacaacactctgatcactgatcagtacagaatggactaacattccacaaaactgataaaaaaaatcattctgattcaccatcactgccagtgccaaatcccagtatagaagcagaatcatagtcttttttctttttgtgagaactaagcagaataatagtcacgatctgctttcttggatagagtaacttgtttgctgccttgctgagtgctcacaggcataagcataactgacacatggatcagttgttagtgaccagcaaacactgtgcaaaatcttgcaacaggaacatagagatagaactgctgcgcagcacatcacctgcaattagaagaaactgggtctgagattaaccatgcctacacgttatgaacttatgatgtacacctaacaataaaattcattggtttccctgatccttgtgggaaaaaaggggtacatatgctatggcatggaattacaggtgataagatcataaaaggagataaaaaaaattgataacagatattacctaaccaatttctggttcttggaagaaaatgatcaccaacgcgattttcataaaaaatatccagccatctgtacttggtgaatactgagaactgagagcactggttgctccttttctgattccagataactcctgactcgttcttctgaattgcctgtgcaatttctctccacttgctgctccctctagtaacattctgaccctttgtgtccaaaagaaatatcactatcaccctttctgaaataagctgcggcctgacctcataatagtgtcaaatactccatcatgttacaacttacgacagcacaacattgaaaactttgtttcaagcataattgtgctccatcaaccccatccatgggccaacatcgtgaacaatcccctgagaattcaaataagaaatcaaccttgtgacaggttgaagactagcagaagtggaaagagaggccatgagctcattgattatattctggaaacttgagctgaagttactcctgatcgattttatgtgctcaatggccaaatctacttccccaacatctattagacacttcaacaaaatgacgtgtgaattcacactctcaacattagatggaatacaagataaaacactcagtgctcctttgaaattacctgaaatatatcatggatgatattttaaaggagatatttaacaattaaaacatcactaatattattgaagaatcataccttgtttacagagtgcaaggataaacacagttaaatactgaactagccacttcagtatcctgcaccacacatttggtaaagatctccacagcctgttcatatttcttttcttggcacagcatattgatgactgaagtgtatgttgtgacatcaggggacactcctttctggaacatgcgatcaaacagttgttgggcttgttcactttcattgatttctgcaaattttgttatgagtatattgtaagtctgcagatttggactacagccactggtaaacatttcatcccacagcttcttggctggcctaaggaggttttttctgcagagtgactccatgagagaattgtatgatgaaatgtcaggctcaagtctctttcttttcacctcctttagtacatcatatgcctctcgcaccttcccagccttgcctaagaatgatactaccaaatggtaatccctcacatctgtacaataccccttatctaagagcaccctaaaaaattcccacatatcatcgcccttcccattcgtgcagaggctttcgcaaaggtgtataagcatatcgctgcttggaaatctctccttccctatcatgaacttgcagaacataacagcagcatcgacatcaatctcagacactgaacaaatcagtgcattcaacacgtcatcattgatagggaaatcccctaaaacaattgcctctgctatttcctttgcctcgccaatctgcctgctggacaacaatgcaaacataaactccctgtagtcctccttcctaggcgcaaccccgagcttcctcttctgcttcaagatcctaccttcctcttctgtcctccctgcttccctaaacgcctctgatacaactctataagctacaaaatctggcttccacccttgaaacctcatatcctccaaagcttgccaagcatcctcaatcctcccctcccgacacaaaccatcagcaaccattactgcaacaactgacctatcaactcggtccccttgatggcgcactgcctgcaccaaccgcagaacctcggccaatccatgcctcctccccacatttttgacgaacaccccgaaaccaaccgtgtcaagctcgacggccctcccgatcattctgtcgaacaccttgcgcgcggaaacgagtgacccggaggacgcgagcgccgcgagcagcgagttgcaaagcggcgcggggagggcggcggagtcggggacgaggccgaagtgcgcgagggcgtcgggaaggcggccatgtcggagcagcgcggaggcagcgaggacgcgggttgccgggaggagcgggagccccgcggcgcgggcgcgggagagcgcggcgaggatggagcggagggtggccgggtgggcggcgcgggaaggcgccgcgagcgacgcgaggtgcgcgtggaaggcctgcggtgtagaggtgggcgcggcggcgtggggagacggcggcggctggccggagatgccgcgcgcggcggcgagtcgcggcgggaggaggaggaagcgcgaggtcgctggcggtggggccatggtgtcagcgagagagaagggggcccgcaatgcccaccaagtagtcctcaagcggaaacacagaatacgccaaccctacaagaaggcgtaaaattaaattacgtaaatgatatatcgcttgtgttttctgggtcgcggccgcttcgagatcccacgcgcttgtctctttcttcttcttcttcttcttcttcttcttcttcttcctcgcgcagcctccaaattctccaaaaccctcgcgttttcccgcggcttcgcttccggggagaggagattttcaaaaataaattcctcatccacatcctcctcttcccctagctcctaggcagggtctcgtctcgactccgaatcttagggtttctcctccccgctccccgccgcgggcgccatggaggcggtggtcgtcgacgcggggtcgaagctgctcaaggccggcatcgccttgcccgaccagtccccatcgctggtgagcggccagatctcccgctcctcttgagattccgttggttatttgagaattatctgaggttttttgggtttggtttggttttggttggttggttaggtgatgccgtcgaagatgaagttggaggtagaggacggtcagatgggcgacggcgcggtggtggaggaggtggtgcagccggtggtgcgtggcttcgtcaaggactgggacgccatggaggacctgctcaactacgtcctgtacagcaacattgggtgggagattggggatgagggccagatcctcttcacagagccgctcttcacacccaaggtgataggcttcgtggttcatttgaacgtgttcattgttctacgctgtaaacctgttgatttggctgataactggtccaaattgatactcactcattactttacatgccgaaatgttaagctccgaatttttagggtcatttggtatgtctatgaggtgcccatagcgagtttaaacactttgcgtctaacttgctagctatagtctctaggctaactgccattatatggtcggattttgtcctaaatttatgtttcagtcaaactcttgtgctattttttggttatttgttgaatagctcaattgtaaagaaaattctagttttggaccaaatcggtatatgctctgcgttataaagtttaaatctaactcgattttaacgtgctatgtgcattataaaatatttaaaatttaaacatgtaatatttaaacatgtcctattgaccattgttcatgcttctgctcaagcaatgtttgttagctaagctgcagttgttcctgcatatcatttcaaaattacgatttactgatagatatgctacctgaatatcttgcattccttctagtgaatattttccagacattgatattgcacgaacgggaatgggtcctttgctccttttactagcatatttagacatttcatgattgtgtgtgattgcagtgctgtatcttgtgttgctctatgtaatcttgatggttgcatgaatccatagaccaaataaatgtcagtagtttcgaaaagccaagctgtgctaaagggaccctaagtatgcttcgccgttttgaacttcaattcaaattctttgttactactttacgaagattgtttcatttgacttcgctcattatttttattgtgaatgcgttgatttaactattattctgttgtttcaaattttgacagcatgtttcctcatcttttgttatgctctctccaggcacttcgggagcaactggcgcaacttatgttcgaaaaattcaatgtttcaggcttttatgactctgagcaggctgtattgtcactttatgcagttggacgcatttcgggctgtacagtggacattgggcatgggaaaatcggtaatataaccctacttttgtttgagccaatatagtagtatgtttttccttttaaattttgtgcttatttttatttggctaaagatcatgctttgctctgcattttacttccttatgcatgaactcttgccatataagcaaaactaaatttctctgtgacccaaccttttgttttaggaaaaatgaattgaaaaaacaacatatgttgtttgttgttctgtttgtatgcttctctctctatatattgtgtatttgtgtgtgttgagaggatggaggggggggggcataattccatactgacagaaataaaaggtacaacagaatcaaattcacctaatgaatgcttctaagtacagagaagacaactttacaagtgtagcatatcttatgttccttgtgtaatgcttgcatcccttttgcttctttctacattactccctccattccactatacaaggctttggatgcaaaaaccaaggaagctcctataactgccacagaattagggggctttaaaacaaccaaagcaagccaacgaatagcgttcactgcatgcatgtgcatggatgagaattacatgattcaaagaggtgccgctgcagctgccttcaatgcatgcatgcgcatgaacgagaataacggagtcaaggaggtgccgctgcatctgccgccctatattctggaacttctgaaaaacacagttaagccttgtataatggaatggagggagtatttatctactttagagtaaagctgcacatatcgaaggcttgctgggaaaaaagaatgatttccttttgagctcaaaaaatgtgcaacaacaagtgccgcccagtgattaatgatgtttgtgcatacacagaacatcatacaagggtgacagaaatcttgtgtaattgaaatgcttaggttactcttcttccattattattgttctactcattaaggtagtatacttaccatgattttgtttcagatttttttaaaatattcatttttatcttgctattttctggcagactattttatcttactattatttttctggcacactaacttaatgggaataactgtggagtaactccaacctcttttgttgcaggcatagataaacatttattttatttgttaaaagattccatttaattaactagattctgtaacacatcagagcaggacacagcaatacaaagctggccccaacggatgtatataaataattcaattccatctgtaaactgtatttatgttgttcagcattggctgtgtggtgtgttttgataaacaccgtttagtttcataatggtggggaagcagcagtcgttttggagcttaacgttgtattgacatcctttctattttaacagatattgctccagtttgtgaaggtgctgttcagcacatagcatcaaagagatttgatattggaggaactgacttgacaaacctatttgcggaagaactcaaaaaatctaactcatcggtaaacattgatatttctgatgttgagcggctgaaagagcagtatgcatgctgtgcagaagatcaaatggcctttgaagctataggaagctcatgccgaccagaaaggcacacacttccagatgggcaggttggttattgacttgctctatattggtcttttctatgtataatatagggcccagtattgactttgtttctgttaactgtatgtgttatgtgcaatctgtctcttcatgaaatgcatgatagctgtatgtcttaatctgttttggttgatcacatatcttgttggctacttattgctatgaatctgtgcaaacctatatttctgaacacttcttcccccaggttataacaattgaaaaagaacggtacattgttggtgaagctttatttcaaccccacattttgggcttagaagattatggaattgttcatcagctggttacaagcgtctcgaatgtcacaccagagtaccatcgtcagctgcttgaaaacactatgttatgtggtggcactgcatcaatgactggttagttaatgctactttacgctgtcggattcatcagtcttttacctcacaaataaaaggcatatacatcaactattatttgagcatttttagtcttgctattttgacattgataatatatatacatgtgaagagcattatcattcggtatgaaaatttgcattctgtatgagacttgtggagatgcaattatctgagccagtattgtaatgctattggtttatgatccatgtgagaattactattgtttgtttccttgctatgttccagagcaaagaaatgggaccactatggtagtttgtccatttgagaactcttgctgttggaccttgaacttttatttggagggagagaaactgggatcttttattatattaggaaacctcttgttctgttgttgtcattttgaattttgtcagctgtcaatattacactgaatatgtggtggaaaatttgtgtttggttagagtcaagagtcttacgatactgcagtctggtcacagcagtgcatataatcaatattttagtgaatacttgcttaaaatatgttttggtctgtatacgatttggtttggtggcactactgtagctttgcattcattagtgctttcttatgcttggttgcagattgatttaaatggcttttcatttcatgtcaccaaaaccatttgaaaccaattatttagttaagagccttataacttagtttcaatttcaaggtatataacctcatgctttcactttcaaggttttgaagacaggttccagagagaagcaaatctgtctgcttcagcaatctgcccatctcttgtaaaggtaaccacctccctctcccttcatcccaattccccaggtccaactctgtttgaccttcattaaccaaacactcgttcctccagcctccagaatatatgcccgagaacctagctaggtactcggcctggctgggcggtgcaatattggccaaggtcgttttcccgcaaaaccagcacgtcaccaagggagactacgacgagactggtccatccatcgttcacaagaagtgcttctgaataacagctcgccttggaggcatgaacaccttgcacgggtaggtgcgccctttactgttgctgtcaagtcttagtgctttcaccaccccgtgattggtacggttgtacgtgcgtgaccctaactcaaagccggatttgcctttcagggcgtggatgcacgaatctacagtttactggcatgtaggggcctgcctgccctgtgcttcaactcgctgtactaacttcctctgaagctgcggttctgagcaattcattagattcggttgtgcccgcggctgccaggtccagtttagatggtgtttgttacacttgttactagccattcaggatgcagtagaatctaacattggcatctatttattacaagttgtagaggattgtacctggcaacgctcgtaggctgcattcgtttgattgtccgttcaccgagcgtacggaaatcagttcattctgtgattctcccttccaattgctctctgaattctgtgtagctgtagtgctgtgtagcaaactacaagaaaacaaagcttagctagaagcggtattgttcttccaagttgattggcaatttgagctgtgctatgagtaattcctgtctgccttgtcggatgtcttctttttttaaaacttttctgaaggacaagatgcagcttaaaggttggctacgaatcttgcgcacctatccttttggggccttggcgccatgcaaaccatgaaaagaacaactgtagtctgagattgattgctgggaaaataaaagttaaaagtgatctacacaacctttcaatccaatgtcgtgatgtaatggcacaacaatgcagtacatcatatagctgcattatttagcttggattgtactaatgctgcaatttgcaggcatggt

SEQ ID NO: 78828 - DNA, 998 bp, Oryza sativa
ttggtgaattgtttgttatgtgatatctgtatgctagttatttgtaattagaatagttgcctatgtcctggatttagatctatatagttgtattttctctgttctgtattcccatgatggcaaatagatgaatgcgttgaccatctttactaatccgggttttctacaatttataggagtggagggaggtttcactgatcaagaacccgaatacgatgaggcttttgaaattgttatcttgcctgaatttacttctctcccttttccatcaattgacttgccagagaaggtaactgtgcttgacataagagattgtacttacttactacatagtagttacttactactctacaactccacaggttaggattgcagttgacaaagttatacttgccgaaagtgctgatcgaaaacaacaattggcttcttgggttgctgacaagaaaaaagtcagtgcacatgctatggatctgaagcagctagacaatggtgtcattgtgccacctacaggatggaagtgcagcaagtgtgataaaactgagaatctctggttaaatttaactgatggcatgatcctatgtgggaggcggctttgggatggaagtggggggaataatcatgctattgaacactacgaacagactaaatatcctcttgcggtaaagcttggaacaattactgctgatttagaagcagcaggtaatgctactcgtggaccttttacatatttaggcttcctcttctattatcgaatacaacttacggtgacattgggttgtcgcctgtgaaaaattgaactaaaccccttttaacctctcacaaactgtatcctttgtaatatctaaattaaaagtgtcatatatatgatgctcaacttggaatgcacttttagaatactatactccctctagttttaaatatacaaaacggtggaccttttaaattcgtttgactatttgtcttctctagaaatatttgtgcaaataaacaaacatata

SEQ ID NO: 78829 - DNA, 1214 bp, Oryza sativa
aaaagaacaattgtagtctgagattgattgctgggaaaataaaagttaaaaggaatctacacaacctttcaatccaatgtcgtgatgtaatggcacaacaatgcagtacatcatatagctgcattatttagcttggattgtactaatgctgcaatttgcaggcatggtcgttgcatcaccggatttgttttggattggtaacagtagcaaacgtggcctccaacaaaggctgcctacggtccaacaaaggtggtactggtaataattcttgcagattagggtggccgcttgtgattgcgggtaagaggccaatgaaagtggtcgatcttgtctctaatggaagctagcgttccctttgccattaagctgctctcccgtgtcattcttccgcgattaagacccgcctcgtcatgtgggttttgtcctatcaacaagatgcgtcttaagtcgctgtcgggctatcgagccattaggacggtgctgatcgatggtacaaaacatttgctaagcaaatttcagaggtcgtacgaaggaagaaaaaaggaaaaatagaaaaaggccgtgtgacaaactggctcgtgacccgtttgacattgctgtctagctagtccctactccctccgtctcaaaaaaagacaaaccctgaattttcgtgtccaactttgaccgtccgtcttatatgaaatttttttataattcgtattttcattgttgttagatgataaaacatgattaatattttatgcgtgatttgtctttttaatttttttatatttttttcaaataagacggacggtcaaacattggacacggaaactagggtttgtctttttttgggacggagggagtacgtcttaatttcacgtgaaaaaaaataatgcgggattcatgatatatcaatcgatcaactaagctagatctgtttggcaaataatgtaatggttaatcagcgagtaacaataattaactaatattctttctcttcattccacaatatatttatctttagggcttttcagtggagaggtgaaattaaatgaggaataattgtgatcgattgagattaaaagtaggtagagaaatagatataattcaaaacaaaatgcaaatggtaggagaaattgtattttgtaatggaggaagtacacccattaggaatgtggattttaaataatgggcagccggtcattcgcttttaacagacaaccagttat

SEQ ID NO: 78830 - DNA, 2679 bp, Oryza sativa
taattcagaagcctcaaaaacgggctgatcacaagtacatgcatatatacagccggcagggttgttgagcttatctcctaatacagagggataacagcaaactctatctagagctaacaaccctatccaaaccatatgaaacaatatttcacgtaaatcctaacactccccctcaatctcaacctaccaggttcagattgtttctaaacatctccatctgccttactgtcaaggttttggtaaagccatctgcaacttgatctttagatgagacatactctacctcaatgtcacaccccaatccggcaccgccgtacaacggcacctgataggagcgtgtcgcaggaaaaacggcgcgaaccgcttcctacgaaaccgcgatcacagtaccagtcccaggacatagtgctggtacccacggtgacaaatatgattcattgcaaaatccttaaaataaatagaggacttatttaccttaacttaggttgcagctcaggacagcctgagaatacaaccgaagacactgacgagaaaacaccagcaacagcagcagcagcggaaccaacgaactaacacccaacaccacaggcgatggctgggaaccaggacgaaaccctaatcttcacttcacttcatcttcagcttcagggcggaggaactatatatatatttatatagagcaaggatgagtactttcgtactcagcaagtcacgggaacttaggtgtttaatgcaagcttggaagagaggcaaggttgttttgcaaatcctttgtttgaaaacattttggaatcactaagtgatttatttctttttaagtttgggtcgagaggagacttgcgtctcgattcgacttaagagatgcttttcaacaactcaaatggtaatgtactgacccccgggtcagatcattacttatcggctcccagagccatttcacttgattaagcggctcccagagcctttttcatttttgcggactcccaaagttcagctgcccagcagcaaagcaatccgcttccactcgggaagcctagtctatgatgcccgcagacatcccgaatcacacagattcgtttctgaccactcaggtcatccatctgccacttaggctgattctggttacgattcccaattcacaacaacttttcacaaagcacaggcaaacaaatctacgcatcgggaaccacctcacatccgcccatgaccgtgggcacggctgttcgaacagttagttaacctctgcagaggggtacactttacccacaagacacgaacttactccagacactggccggtgttagaggtttgcgacaaagcctttccaaagctaactttgggtcacctcatgccacatagagggtctccttgaccaacatcgggccaactccggctttccttttaggactcccggatgccttcctctgtttcggactcccaggatgcctctacccccacatcccggctttccgcctctattgacatacaagattttccaaaagcagctaattacttagccagggtgtcccataccaccatgtggttgcacttgttatgcttgatgagtttcccaaaggaatcggttcttatatgcgaatacgggacagtgccacccaggcacagcacctgcatcgcgagttttcacaattcattttattttcaaacacgccgacaccacaggtcgggttttaaaggcttctcaaacccatttcccatattatcgacaaacaatggtgtatgtggaatatttggtatacgcgcttagagagaacgaataccgaggtaccacaagggtggagcgacaaggaatcagggtagtacgacctacaggaattagtgcgactactaggtaggtccgacggtttggcacgcaaaccgaggccaagcaagttgagtgtatgattctaataatgcaagttgcaaacaaaatagtaatgatttttcaattataggagcaattggtcaaagggtgacttgccttgctcaaggtcttcacgaagcttcacgaatcttcgagaaaacccgcgatcgacgaaaatccggtaaccgcaactatacgcaaacaataaaaaacctaaacaaaagaccaaaagaaagatcctatttagactaaataatagttccattagatagatctcaattttacggaattattggaagtggaacggggtcaatcggtgttacggatcgggagatatgaattttggaagtttaattggaatttgtggacaaaggaagatatttgtggaacaaggggaaattgatttatgaaatttatagaaataatattctcaagaatattattgacagtcacggacgtgcgggaccaagggaaatgattcatggaattttggaataaagaattgatttatggaaaaggaaatggacgagggatgtatattagacttttttgggcggcaagggcgcggcccgagggttgaaggaggctcggccgagccatttgggccggcgcaggcacgggaaaggcggcccattagggcgcgcggaagggggggagcggttcggtggaccgagtgcacctcgcgggttccaggtggggcccgcttgtcggtgacacggcccacggtgggatgggcgcatgcgaggtgcggcgctagggtttcgggtgcacgtggcttaggagcggtgcaccgggtggacggatggcggcgggcccac

SEQ ID NO: 78831 - DNA, 4591 bp, Oryza sativa
tagtcgtcgccggacttgggccagaggcggcggagctcggagcggagggaggaaggggagaaggtgtagccctcggaccacatgagcttggagaagaaggaggagatgggcggcgagccgtagccgcagggctcgccggggccgcggacggcgcgcatcttctccgacgccggcagggagaacacgcgggcgacgcgctcctcgacgcgcgacagcagcgccgccggcacgccgtgcccgaccagaaggaacgcgccccactgctccgccgcccgcgccacccgcgccgccgcgtcgcccgccccgacgtccaccaccggcaccgcgtcctcgccgccgccgccgccgccgtccaccaccgggtggtcgtccagccccggccacgcgtgcgtctccggcacccgcctcgccgcccggaagtcgaagcagagcgggttcttcaagtgcgacggcgtcggcatcgcgacgacgacgacgatgaccagagagcaacacactcgcgcgctcgctcgtctcgtctggcagaaagccagtaacaataacaacactaattttttctctctatataaattttttctatgactttacaatagtggaatgagtagtaaagtgagacgagtgtaagaactggacaagtacaagggagaggtatatatagggagagaagttttggagcgtagtggaagaaaaaaaaagagagaattaattggtgaataaatcagtgatgaagaattgaaatggatcattaattaatagatttggagaggaaaaaatgtggtgattgggacagagggtttggagtgatgtggagcacacaaggccaccagcttagctacacaacacaaatctagctagtatgctcatcaccaccccctggctggctagtggcactgccacccaattaataacacacatattcatacaaattaagttatgttatagtaaagtaaaatcacaatgtgaaataagcaccagagtaatttttaattatcacattacataaaacagattaggtaattaaacataggaatttcacaggaacagtagcgtcctccgttgccgtggtgtttttttttaattcgtctgtctgctttagaaccaaacattctcacatgcagccacttctaattaattatgattaccgtataattctcatacacgtcgaatttcattcgatattttactttcagtagcaagatcttcatgctagttcccatatacagtactacatccgtttcaggttataagacgtcttgactttagtcaaaatcaaactgctttaagtttgactaattttatagaaaaagtagtaatatttttaactcaagacaaatttattatgaaaatatatttaattaactaatttagtattataaatattattatatttgtctataaaattagtcaaacttgaaacaacatgactttgactaaagtcaaatcattttataatctgaaacgataggattacgtcctaatttgtcgagcacagtacaattaccaagattcaaaccgtgttatctacttcttcttttttcaatatatttactaagaagactaaccttatattacaactacaaaaataaacaaaacaaaacaaatataaacagtaaattgtttagaaaacagcacacagattctagaacagcaaacaagagaaaagacagcactagtctgcagccacgagtaaaaacagaggacagaggccatgatcatcatcatccatccatccatgaatggttgctaatacattacaaaattaacacagagacagagagagagagagagagagagagagagagagaggatgcattgggtctggaggtaggcggcgatggaatggccggccgtgcgtggaagggaagggacagggggatgatcgagagatggcggcgactaggggcggcggacgatcggcggcgaggtgtcgccggcgccttctggatgcgttgtcgggatcgatggagcagagggcgcgtcgccattgggtgggatccgtgcagccccgccgccgcccgccgcttcccacgcgctctccaccaatttctcccttttctctctttaggctacgtacggcgccgccctggaaccattcttatttcttatttaaatataaacaaataataatgcggtagtatataaaaatttgtatataaggattcgagtccactctagttcctgaatatatgtctaatcctcatcatgattttttctgcactatatttcttttattttagtaacaataataatgcaatggtctaggttttaccttttctttgcaaaataatgttgattattatgctaaatattaagaaatgattacaaccatattttttttagataattgattttcattagtccggcctctatatctacgagggatatacaaaatcaaaatgatacaagaacaattagactcacatctcaacaaagagaacacaaaaccaaaaaaaaagggaaaaaaaaacactacgacctctatacatccctgcttccccacatcctctcttgaagtggccaaattcaacgagtggaagtcatctaattgccatcacccctagtgcgttgtcgctacgaaattccgctggtgctatcttcatccgcttcaagtgagctgacgccacgtgacgccggttaaaccccactcatccatcgtcatacagtcagaactagccgaccagatgtgagccaaaaggatcagcttctgcttcattggattcctagacctccatcgacatcagaatcctcctccgcctctcagacccctagcccgttgccgccgctattggagtcctcaacagctgtcaccgaggatatcctctttcgtcctgactccgaggcctttgccgcccctagctagggccactgccaccgccgggatcggcctcctcctcactaagatccttgtaccggcacttaggccaccgccgcccctagggccgcagttaccgaagctgaggaggtcttctacccggactcgcaggccgctatcgcccctagggtcgctactgcctacgaaaccacctttaccggattcgccttcttcttgccgaggactattcgtcgacgcttaggacgccgccatcctccgccgcacccttcgctgtcgtgctccgcagcacctgccacccaaagagacatcgtcgccaacgtcttgctgctacctgccgcagcgccgccctcctgaccttctccgctgcaacgcgtggcccaccgccgcccatggccccgctgactacaaccatatgttattacatggggaaaattcagacatgctagtcatacgcacacagataccccgtatcttagaatgccacgagagatgtattttgtttcgaacgtaaagggggccatttgccggtacatttcccatatttcacaatcaatggagctccggcgaaaagtcccgttgggcctttctcctatggggaatggaaagttgtaaaccaaatatcttttacaagtcatatacagctcaaggcaggagtgtggaattggtgaggaaaaggccaaaagaatgggagtcttgcacctttttcttgttttggtaaatacattgcataactaacacgtattgtgctcttatatgctaaacgcgccaaatgatcaaacaattacgtcaagggcagtccaatatccctattttattgttagggttaaaatagatgtacatctccttatgcatgttgggaattctatgggaacatcttccaaaattaatgtgcaaaatgattaacccaatcggcttgacgaatagctttcggggccactctattttttcccctacaattttgctcatttcaacaatttatttatcataaaacctatactaaatgtttaaccctcctaagctccataactaatcacttctgcacggaaaacggagtggtctattaacgtgtgattaattaagtattagtagtttttttttcaaaaatagatcaatatgagtttttaaagcaactttcatataaaaatctttaaaaaatacaccgtttagcaatttgaaaagcatacgtatgaaaaagagaggtacgagttgggagctatgggtactgaactcagcctaattgtatttatacacacatgccttttccctccttttaattgagtattcccactaacaatttatccattattggttcatattcgctgaaaggagcccaacaaatcgtgtgatagctcagcggctaattacaacaatttccatagataccatggatgatcttatttttctttacctaaacatgtactctctccatcccataatataagggattttgaaattttgcttgcactgtttgaccactcatattatttaaaaaatttatgtaaatataaaaagtaaaaagttgtgcttaaaatactttagataataaagtaagtaaaaaagtaaataataattctaaaagttttttataagacgaatggtaaaacagtacaagtaaaatgtttaaatccttatattaggggacggagggagcataacaccctgaaattatctattaattgtgagtgagaggtgacaagctgctagttgctgctatccaactcacaaaactcttctgaaacaacgaggagaagaaagaca

SEQ ID NO: 78832 - DNA, 2158 bp, Oryza sativa
gccaaggacatgccgttttcttgtagcgtattgactctcagaatatatctaacaaaactgccgttcgtgcacatgtatttaattacgttgtaaattgacaatccattctctcttctctctaatcgtaaactaaaaacatgtgtgttaattagactatgattttaaaaaacaactcaatacttagaaaattattttcacagctccctttatttttacaaatgggctaaaagaagattcacttgtgaaaatatataggactctcacagtcaacaccgggccggcgctgtattttagacgaccaagacgcaccaacacatacgttatattaaaataaaggagcacgaacaccaacaacaccttgcttctcacattttccttaaactctccacacttccctctcctcttcgttttttctttccacagcacagaggacactgccttggctcctccttcccctcttgtagatggcggccggcctcaagagcaacgacgaaaatgacaacaaccttaggagcggcggcggccttgggagcgcgcgatggatccatcgccactggcctcggttggggcagatccccagcgtgcatgggagcgacgttgatgatgaccgcgctagccttgggagaggcatatccaacgacgggagtccagggatggcatcaacaaagtcggtggcggccattatggggatggttgcggcgatgatgacgaattgcaatggcggcgatttcgattggggattggggctatggtttctgtaactttttggattttttatatttttcgccaaaaaactttttgtagtcagggttgaaaatccgttccgtcatacggttatgatgcccgcaatagaaaatcttgacttttgcataaattgtcttaggtgggtgctccatctatctaggaaaggtggttttggtcggctgaaaaaggccggtctgtagtggggatttactgttagtttctatcagtatatttcagatacccctcaatattacaattaatactgggaaagcagaggcacttttcgcagcaaatatcaacatatacatgtgtcgacgtttgatgtcgcgattccggtatttgcatagtatgagaatcgttggtactagaatatatgcgagattgtaataaaagagatgtggacgaggatttttatacaggtttgggccccctgaattgtcaggtaataaccctactcctgttggccgaagccggtcgttactcttattcaccataatcacaccagcataatatttagggtaacctatctaactgttgtcgacttgacggtctgaagtgttgactcgtagtcgacaacagggtagccttcctcctcaaatccgtatccggcgagattaaagacagcgttatgtctctcctgagagtatccgtagacatcgtaggggactaaccatgcttatctctgaagttgatatccgacgtcttgtcttggcacatgttggcttgtatgttgatcttgtgtcttgatctattgttccgtgtcccctctcctcctaggggccttgtatttatacccataggtgtccccttgtccaagtagaactaggaaaaccattatggataaatccgagtagttcttgtcgtttccatgtagaactctattcatccttcattatgcataactcctcgtatatccgaaggttgtttccgtataagacatggtatgtggtgggtcctaccgagatttagtcaactactattaggtatgtgatattcataaccctaacaacatgtgtgcactgtgcaagtgcaccagacattgacacaaaacaattcgtcgatagacaagaaaattcacacgcagagacatgcacacaccacatgctctttcttcgaaggaaagaaatacacatgactcgatctgcaggtgctgccaaggcatcacacgcaagcagagacgcaccacatacgtacatctaaggtgcttacttccaagatgcgtgaaaaggcatctctctctcaatgtggtcttcaagaaaaaaacaaaccaaggtaatatttctctcggatttttacaggtatattatgcgtgtatattaccgaattgtcgttagttcactacacgagaaagtgactgaattgtcctaagtaatataaaatatgtagggaacgaggaaaaacagctgcaggaatt

SEQ ID NO: 78833 - DNA, 18716 bp, Oryza sativa
cggcttggcccggtcaaagccgaggtggcgccgacgtggcgcctacgtggcagccatgcaggccggcgggagaaggaagaaggggaggccgagatggacggcggacggcgggcgtgttcactggagcaagcgcgacggatttggtcttcggggagcacaccggagtgacgagggcatcgagaaggagcgagccaacggctcagattcgccggagggagttcgacgttgacgaattgcggcggcggccgccggcggtggtaaaagaggggatttgtcgacaggcaacgggagtccgattcaaagcggtgggagtatctatggtggtcgggaagcccatttctggcatcggatggggcagagcgacgccatggaggtccggcgacgagcggtggcctccgacaagagcgggcggcgacggcggcaagcctacggcgagcagcggcggcagtcggggcggcgccagctagctactggaaggctactcgcactaatgcccgaagctaagggcaggagatggagcgaggaaggggaacggaaggctaccgtgtcggaacgtgcgatgggagatgcccgacggcgcggggcgagctttcggcctcaggccggggaaggggaggaaggagggtgcccgcactcgtgcgtcacacgcccacgcacgcaaaggttccctcggtgtttggcgacggacggcgacggcaagaacagtgggacggcggcaatggcgtggtcgaggcgaggagcaaaacgcgattgattgggatggggagggatctcagtcttgggtatttatagcggtggggagagggcggtttgggggaggaaccgacatagggcggttgagggtgcaaggatggcgagctggcgcggtcaagaacgctgctggcgctcacgggcggtagaggaggtccagctcgggagggaaaaaggaaaagggcagggtggaaaggaggggttcgaccatgccattttggggagggagagaaggatgggagcgcgagctctggctccacgttttggacgcaagcgcacagaggtgggggcaagcggcagggcggcatgggcggctgcgtggcgcaggctgccagggctgacgcggcggcgaccgggcagtcggccacgcgcgggcgagcgcgcgcgcgacgcgagggtgcggccggatttcgaacggcggcggcgggaaatcggcgccggtgagagggagttcgacgagggagagagagcgagcgccctcgctcagagcggcgcacgcgcgaggcacgcgagggaggaaggagcggctgagggagagagatgggccgagggaaaaaaaaaacggcccacaacaaccgagggaggtaaattagactttttccgaggaaatcgattcggagggatatgagatttggaaattgaatttggatttcgaacttgaggcttggtctgacaaagcagggaggagtcaaggggaagcacccaagcgagaattcggtgtttctttggagcaaagttatactcggcggtccgagggattagatgagagggattcaagtgagacctatctttggagttgggacaatggtatgggataggttccaaaggtagatgggtagagggacggatagattgatagatagatagacagctggttagttagatagataggtagatcgatacatagacagatagatcggctgatgggtagataaacgaataggaagatcgatagacagatcgatggatagatagtaggtaggcagattgattagagagagggagagagagatagggacgaaagaatcgacgattgatttcaggatgttgatttcagagacttgaatcggaattggaatcttgaggtggtggattttgatggcgacgaaagggaacaacgatggagattgaattgagatccatggcacaacttagactcgcacacaaagaacgaaattttcgcaattaggattttgccgaattagtttttaatgtcacgcaaaaagcggagcgttacacctcaagtaacttgtgagcaactcgttctctaacaaaatgataatccacctctatatgctttgttctggcatgaaaaactggatttgctgttaagtatttagctcaaatattatcacaccataccttagcggctctaggcccttttacaccaagttcctgaagtaatgtttgtatccacataatttctgctgttgcatttgccaatgccttgtattcagcttcagtacttgatctagaaactgtagcttgttttcgtgcactccaagatacaaggttgggtcctacaaaaacatcaaatcctctagtggatcttctgtcatcaagacagcctgcccaatctgcatcagtaaatgcactaacaagcaaagaactagacttgttaatctgtagaccaagtttcacagtatgttttatatacctcaatatcctttttaccgctgcccaatgatctgtagttggagcatgtaaatactgacataccttgtttactgaaaatgatatatccggtcttgtcaatgtcaaatactgcaatgctccaactatgctgcggtactgagtgctatcattgggaccaaggagagctcccccttgacttgacaacttttcagagatggacagaggtgtattaactggtttacagtcactcatacctacccttctcaggacatctgaggcatacttttcctgtgttagcactagcccatcatttacctttttaacctcaattcctaggaagaagtgaagatctcccaaatccttcagtgcaaactcctgattcaaatcctgcagaagagctgaggtggccttttcggaagagctagacacaatgatgtcatcaacatatacaagcataaacatagtaactccattcttatcatagaaaaacagagatgtatctgattttgatgacacaaaccccagctcattcaactttgtacttagcctcgagtaccaggccctaggtgcctgtttcaatccatacaatgccttatctagtttgcacacatagttaagtgccttagattttacatatcctggtggctgtctaatatacacctcttcttctagaactccatgcaagaaggcattttgaacatctaactgacgaagactctaacctttagaagctactaaggatagaacagttcttatggttgcagctttaacaactgggctaaaggtatcttcataatctatgccatacctctgcttgaaaccctttgcaaccaatctacccttgtatctatctaaactcccatcagcctttcttttaattttatagacccacttacagtctataatattaattccctttttaggaggaactaaatgccatgtttcatttttcattaatgcataatattctttgtccatggcctctttccagttcctatctcctagagcctcagctaggttctgtggttccccagatgatgtaaaacaaccatatttgactgtgccatcagtataaattttcttttttctaatcccactttggagtctagtttttggtctagcattaatatcaccttgctctgttgcagcgataacctccggagccgcagacgatcctgccgcatcatgatgaggccctggcgatgtgtcacctccgagctggtggtggcttgcgatggagcgggaactcgcgcgggagctctgtacagccgacgacgtggcggctgctggttcggtgacggtcgcaggttgctcaggggcctgcacggcgcgccgctgatcagtacgagacggcgattctgccgccacttctgtttctgctgtgtgtaccccggtagatgcaccaggatgaattccatcaggttgctctgcattaatttctgcattgctgtcgctagcatctgtgtcatctgcagcatcattctcaaaagaggaatcagtaacaacaggtaggatattatgcatatgatcattgctatgtgctactcccccttgatcagatgcatgcgatgtaagatcagcaggaagaagggaaatttcagcacgtagacgcgctccagcatttggctgaagcttggagaaaggaaactcctgttcatcaaaggtgacatcacgggaaatatagacttgaccggttgccacttctaagcacttaaaccccttatgtaaattgctaaaaccgagaaagacacattgtttggaccggaattgtaatttgtgagtattgtagggacgaagattaggccaacaagcacaaccaaaagttcgaagagatttataatcaggttgttggtgaaaaaggcgtgcaagaggtgtgtcaaagtcaattacttttctaggcaagcgattaatgagataagtggctgcaagaaaagcttcgtcccaaaatttcaaaggcatagatgcatgagcaaggagagatagcccaatctcaacaatatgacggtgtttccgttcaacggcaccattttgttgatgggtatgagggcacgacacttgatgtgctatgccaatttgcttaaagaaggaattcaatttttgatactctcctccccaatctgtttgcatgcctagaatcttacgattaaattgtctctcaaccatgctttggaactctttaaatttctcaaaaacttcagacttaaatttaagaaagtagatccacacaaatttactataatcatcaataaaactcacataatagcgcttggctccaacggagtcagaggcaggaccccatacatctgaatgaataagttccaaaggattactagaaacactaaaaaacttaggaaatggcaactgatgagactttccctgttgacaagcatcacaaacagactcactaggagactcattgctacaaggcaatttattttgattaataaccctaagaacaatgggctttgaggcatgccctagacgaccatgccatcgctcgaacgatggcatcacagcaaagacttgttttattggatctccggcaggcaaagggtagagatcgcgccgacatggtccttcaagaattgtcctcctcgtgaccttgtccttaatcaaaaaatacttttgatgaatctcaaggaatgcataattatcagcaacaagtctatgaactgaaataagattttttgatgccttaggaacatgcaaaatatttttaagatggaggggacggctagatgtaggtacataggaatgaccaatatgctgtatatccataccttcaccactagctgtgtggatttggtcggtgcccttgtacttctcccgtgtggtcagcttgtccagctgcccggtgatgtggtcggttgcctcggtgtcaacataccaattggtgtcaacaccgtaagcgtgcgtcgcagcgcctcctagcttctcatcggggacgtagttctcgtcgtagcggtgccagcagtccgccaccacatgccctttcttgtgacagacttggcaggtaggtctgttgtcagtgccgccgcgtccattgccacggccgtgcccgccacctcggccaccgctgccgccgccgccgcgtccagtgccgcggccgcgagggttgccgccaccacgtccctgatttccgctgccacggtttccactcgtagcagcgcacgctgttcggatcttcaccctgttttcaaagccaagaagctgtgagtagacctctgcaacagtgacagatgcattcttggcgatgagtgcttccaccactggatcaaactctgaatcaagaccattaataatgtaagcaacaagttcttcatcatctattggctttcctgttgcagcaatttcgtcaccgagagcacgcatcttgctgacgtactcggtgacagtcgattggcccttctgagtggtggtgagagccaatctaacgttgatcgcgcctgcgtgagatcgtgtcgagaacgtgttctcgatcgtcttccatgccgcggctgccgtcggtgcgcctgcgacttgcgaccgaatctccctggtcagagaggagaacagaaaaccaaggacctgttggtccgtggcaaaccattcgccatacgccgggtttgggactctgacggtcttctctcctttttctccttccttctgctcaagctcggcttctggtggaacggatgttccgaggacatggccctccagtcgcgcgccccttagggctgtgagaacttgtgccgaccagagggagtgattttgcttggtgagtttctcagaaacttggacgccgaacaaaggatttgcaaaagcggtggaggaggaggaactcgccatgagatctaatatagatcgagtttttgctctgataccatgtaaagaacagagatgcaagcgtggagaacacctcagtgggtggtttcgtgttaattcagaagcctcaaaaacgggctgatcacaagtacatgcatatatacagccggcagggttgttgagctcatctcctaatacggagggataacagcaaactctatttagagctaacaaccctatccaaaccatatgaaacaatatttcacgtaaatcctaacaggacggcgtttcttccgccatcccggcgaaaaataaagagagaacacgtgtatgttttggctgtgtatatcttttatgtatacagaggttggactaatgaaaatccataattaaaacattgttagctgtcagagatggaagaagagtgtaagcagacttgatagcaaatgatggaaaaaatttcagaaacagcaaatgtagcaaagctgagattttctttatctttaattgtattgacacaaccccctgatttgtatcccaactcgtgcaagtttatatgcagtacattcgcattaattccatatttcaatttcaccatccgatcgagcaagaagaccaataactgataaactaccgcagaagcacatgcatcgaaggcccctgcaactgcaaacgtgagtctttgccaaatttccagtgtggttaagccaatgagtttactttcttgcacgccactgatcacaattcacaaccccatcagctagcatgtaccgagcccgagtgcttcgtgcgtgtgtgttcgcttgtccatagccgatagaaatcggaggcaactccggctttccgattctggatttcttctgaaactgaaacggacatcgacacagctgacagcgccgagttcgaatcctacccccgtataattccacccctatatacgcagcgcgtctcgccgcctcgaacctcacagcgaattctgatcaccaccccaccaaccagagttcaccacgatcggttcgatactttgatctacgcacgagcgccgccgccgagaacctcacgcacgcagcagccgccgccgaggaggaggaggagagcgccacgccgtccatggaggactgggtcgtcctcagcggcagcgacggcggcgacagcgtggagctccacgacggcagcgacgttggtggctccgacaccgagagcagcttcgcggtcgtgcaggtccgcggtcgtgccgctgacacgccggcgatcgccgtggaggccgtgccgtcgcaaccttcgccttcgccgccggggttctttaagaccgtctcatacggccaggcgttctcgggaatagcttccgagcacgtcgcagcttcttctcacgctccggtgctcgacgcggcagaggaggacattgccgaggtgtctccggtgatcgtcggaggtgagcacgagaacgccgagatatctgacgtggtagagagcaacaatgaccacgtcgactccaacatcgacgccgccaccgaggtcacgaccttctccggcgaggaggacttggatgatgagaccgacggtgacattgaatgttttgatgaggaggacggaatctgcgaggagaaccccgatgatgaaatcttcgacgacgaagaggaggagagcgatcccgaggaggaggacatcggaagctctgacttggagactgattccgatgagtatatagaaagcaccgacgaggagagcgattacgaggaggaggataccactgacttggaaagcgattctgacgaagatactgaaagcactgaatcttcccatgacgaggacgacctagatgatgatgatgaaagcctcgacgacgatggctctgaatgctttgatgaagaggacaaaatcggcacggagaacccggacgatgaatccgtggacaccggaagctctgacgaggaggagagcgacgacgaggaggacagctattctgatgaggagattgacgacgaggaggagagcgattgtgacgaggagatcgatgaggaggaggaggaggagcatggtggtaataagtacgacgccattgacaacgaaagcttcggtgaggaggagagctgcatggagcagagtgatgctgaagaggagtggccggagttcaccggtgtccctgtcaggtacaaagacatcgacaccgactctgacatggagatcgacggcggcaagtcggggtcattggcagtgagagcttgtatgaggaggagagcgtctccgacgagcagagtgatgatgaggaggagcccgaggagttcgccggtggcggctacgatggcatcgactacgaaagccttaacggcgacgacttcgaggagtacctgcaggttctcgccgatggtggcattgacaatgaaagctttggtgaggaggaaagcgtcttggacgatgaggtcctggatttcttccatggcttgaacgatgagttcctggatttcttctatggcgacacgctctacgactatgaaactgaaagctcctgcgacgaggagtgcgagcacgtgtgcgtctgtggcgctgcatggagctcatcgacggcgaggagttctatcagctgatcaccggagacgagttcgatggcacgcagctcggagaggagatcggtggagacgcaagcggcgccgacgaggaggagccctctgacgccggtgagagcgaccacgacactgctcccgacgccggcgatggcgaggcgcacggcgacagcgccgacatggcaggcgggaatagcgcggcggcggcggccgagccggcgtccacgtcgtcgcagttccagcaggcgatgcaacaagcggcggctcggaaccaggctgcagcggcgatggtgagggcggccgacgcgatcgattcgtacatgcaggccgccgccggcgggctggcggcgcaggacgtggaggcgctgtcgcagggagccacgggcctgcgcgccatggcggccgcgcccagcttcgccgttggcgttgacgttagcgcgagcaacacggcggcggcggccttcctccctgatacgctcgcactccaagacggggtggtttcgcttgcagtcttctacctgctctttggtgtcgtgtaccttcttctgcgaatctgcgcattgaattagaattaaggatttattagggagtgatgctgataaagtttgtggtttagtactgcaaatatcatgttcttttattatatatatggtaattcctccgtccttaaatatttgacgtcgttgatttctttaaatatgtttaactgttcgtcttataactattgtgaatattattcaaaaacttaaattacttaaatttaaaaatgaatcaaaagataataattacttaaattttttgaacaagacgaacggttaaacatgtttataaaagtcaatgacatcaaatatttagggacagagagagtatatatgatatgaatcatatgatcgatcgtgatagtattgttatgaaacgatagacaaataaacgataaagaataatagatcaatcaagacacgagatttaacgtgaaaaaccctcccaagacaggaaagaaaaaccacgggcaccagtcagcaaaatatcttcactatatctggggtgaggttacaacgccgcacggcggcttacaagaggtatatatatggtagaaaccctaaaagggatgacgatccgtacgctccggcccaaatctaccggcgacgggcctatgctccactacggtagaagctagtctttattaagtgcaaatgaatttggatcacaactcaacaggtatatgtcactcctaatttggctgttttttcttgaaatttctcaagttgtatatatgtagtaagtacaaacaaaatccttgaattgggtttagtcggaataaatttggtcgagattcaatcgaagaaaacaggggttgatattccattatatttactagtcttattttggcaatgaaagtttctaaaaagcaaaaaaaaatcaggcaatgtaatactactattaatataacgtttaaaaagaaagaaaaatagtttacatatggtgatatcaacgaggcaatactgccccattgtaaaaacccaactcactgaaactgggcccaaccaaacgtggtccacatccccatcagagttatgcactactccgtgttcaagttacaaaattttaaatgcgcgatttgtaggggatttggtacataagatggcaacttacaataactaaacgcatgaaccaagtaacgtaacaagagaggactcgtgaggcctatacatgttctccttatcatcagcagcaaagagagccggcaacgaaccccaaaacacaaacacaaacaggttacaagtccttaatactcaaggaaagtagatgtcggtctcggtcacggtcacagcctcaaacgcggtcccaactccgactcacgtctcatgtcgtagcggtgttcccaacgacgaatttccgtctcaactcggattcttgcttctgaaactgaaacggacatcgccgagttcgaatcctacccccccgtaacgtatccacccctatatatgcagcgcgcctcgccgctttgaacctcatagcgaaatctgatcaccaccccaccaaccagacttcaccacgatcgcttcgatacttcgatctacgcacgcagcagcagcagccgccgaggaggaggaggagagcgccacgccggccatggaggactgggtcgtcctcagcggcagcgacggcggcgacagcgtggagctccacgacggcagcgagagcagcttcgcggtcgtgcacgagaacgcagagatatctgacgcgacagagagcaactatgaccacgtcgactccaagatcgccgccgccaaggacacgaccttctccggcgaggaggacttggatgatgagaccgacgatgacattgatcaatgctttgatgaggaggacggaatctgtgaggagaaccccgatgacgaaatcttcgacgacgatgaggaaatcgactgcgaggaagaattggatgatgatgatgatgagagcctcgacgctgatgacgttgaatgctttgatgcagaggacataatctgcaaggagaacccggacgatgaaatcatgtcccacttattattaacctagctagtaccaatttagccacgtacatcgatcccatgtacagccgcatctaattatcgaattattctgcatttttacccctactttcggtcgttagctgtcagaccttttatgttttgcccccataatttcgattgcgtctcgacacaatgttgatcgtggttgtgcatctatcagttattcaactaattcacaggctctccattacttatctagcacctgcctagttgtctttggactctatatacatattatttctgctcaccacttgcaacttaatttgtctcttcgttgtacgcactcgcactaagcttttgcatgaatagaacaatatggttaagaaaatgatagagagctatgcatgggttcttagggatggaaggcatctgcaggagcattcttgtgagaaatgtacgtgataattgctattggatagagagaagtgggcgtgaaaagcacaactcatgcggaaaaaaatgtgtagccattaaaatgttaagggtgtgagagatcttaattaaagagaaatgtttttgtttgacaccttaaacaagagatagggtgtgcatacaagaaagagcccgccattcatttgcaaaatagaaaacaaatattccctccgttttaggttatgcgacgttttgactttaatcaaagtcaaactgctttaagttatcgagtttgtagaaaaaagtaataatattttttctataatcaattatatttaatttattatgaaaatatattcaacttaagtttgaccaagtttgtagaaatttattatgaaaatttattcaattattgatttaatgaaattagtattataaatattattatatttatctataaacttagtcaaacttaaaatagtctaactttgactaaagtcaaaatatcttataacctaaaacggagggctacttgattgcacactccgcaggaacaaacaacgacaaatatctgttttttttcccttcacgttatcaactaaatgtccctgcgcagttcagttacctgcaccggcgtgtcatcatctctcaaacagtttactgtttacagacttagcagcagcattctccttccatgttactggctgactggtgaccgactttagaaggtcatctgtggaaccatcatttcggttgaaaagttggaacatatctgcttcgaaataatggaactttttaacgtgatgttcttagtctgccgatccattactccctccggggatatattaattaaagttttagacaagattgaggttaaacttttataactttaacaatcaataactttaaaaatatttagttcaaagaaactagaacaacatatatagatttgtctttcaaaacactataataaaagtaaacatgcatttatttattgtatatattataatagaaaaataaggtcaaaggtatgtctcgtagagcatgtcattgtccaaagcgtcaattaaaataaaaccggagggagtataatgtgatgtttttttccggcaaggcctgtaaataacaccttactttgtttgtttttctcctgctttatcaatacatacgagacaaagattttaacttctttttgaaaaaaacaaatctatatttgttttttttacatgggatttgcatcattgggttgctcgatcgaacatctccaaaagaccaaaatagtcaagaacgattcgatttttactgtagttttgtcccccatcaagtagcgttgcgcattatcccgggaaactattctaatccctcgaggggatgttccctcgtttgctcaaaaatcatttaaacggttatgaaaaattctggaaaaatttgacaacattcatacaacacatatatacaacttcacaaaatcttaagtccaaactcaactcacacttcgagatataaaaaagacaaattcagcgtatgaatagtagcgtactgtttatatctaaatttgtctttttttttctcgatgtgtagatcgaattggaacatgaattttggtggactagtaggtatcattatactctacattgtcaattttttttagaatttttcacaactatttgtatcaaatttgaaagaaaaaggtatacgaggggatgtcccctcgagggattagaatccactccccattatcccctttcttgacatatgtcggccagtctaatccttctctccttaatcacacaaatatattgcttgctcagacagtcaatgatatgtaatattcataactataataaaaagaattgcatgcatcctctaaactttggatgaatgtccatatagaatcttaagttttaaaactgaatattgacaacccctacacgcacagcgtaccccgaagtcccgaacgtcacaattcgtccattgtgtctccaactcacaaacataaataaggtttcaacagcattcatgtgcgtcgctctcccccaggggcgactcgggaggcgaacccggccgccccctcctcccctcccccaccttcctcctccgcctcgccgccgcccgagtggccgccgagccacgtagccgcaaggacggcggcggcggttgggcttcacgcctctccctgcgcgggcggccaggggagcctctagtgcagcggcgatggtgactgccagatcctggtagggtggcagctggcggcggggacagcgatggcggtgggagtggagacgacgacggtaggggcgaggggatgtgggcgatggcggccggaatggtgacgatacaagaaagagagcccgccattcatttgcaaagcagaaaaaataattgattggcaattcagcatactgcagcaaaacatgaataattaatcaaattagttatttttttagtaatgttctgtgcagcgtgaaaaataaacagtaaaccgtgcatacacagatacacgtaaactacttcagtgaaagtgaagataatatcacacttggtaaactattataaattttcgagaggacatttactcgttgtttgcatgtcatctaaataattataaatttttttaaaagaaaatcaacaagacatattaatatgtgaaaatcactctacaaacatgcaagatctaatttaacttctataggttacaacgtaaaaataaatttaactgtgaatatacgttaactagccatagccatagtttacagctagcttgctagttacccaaccatttaacttgacacgtacaaccccatgaaagacaacgagaatagcgccctagcatgccctcccccccttttttttatagataatgcgccctagcatgttctgatgtagttttgcctttccttttccttttttttcttttcttcaccctgggtggttatataaagtttttcccctacttataatataatataaaaaataaattttactgtccttagcaggtatatacctcctcaataactgtaaaattgctctaatataaaactagcaacgcttggcatcgtacagtcctattggttgcctaagtgacattgaatgctatgatgtagatgatagaatctgctaggagaatccggatgatgaaatcttcgatgacgaggcggaaatcgactgcgaggatgagatgagagcctcgacgacaatgacttgaatactttgatgtagaggacataatctacgaggagaacccggacgatgaaatcatgtcccacttattaacatagctagtaccaatatagccacgtacatcccatgtgcagctcctgcaaaaagagacaaaaatagtgatgttatatctccaatcaagtagtttacaggcataccgagttagtgaaattctttttcaaaaaaaaaggaacccagttagtaaattatcacgaagaaaatagaggatagactatatataattattcgtggtgcttctcattgtctgagaaagctagaatctttgatgacagtagttttatgtgtggtttggtggtacttgatttttcagtagagaacgattgatcaagcacctttctcagaaattatccggatgccttccactcctagtaggaggccaatgcaatgctcaaacatttctcacccagctacactcaagcacagctgttctatcagtgtacaatatgacagcgtcttcttctgtcacttctcagttatcaggcattagacaaggtatttgatggatcagattcagaggatgaggtgagaagcagccatgaatgaggccatgtatatataaagaagatggctggcctgttggctgcacgttagttgtcagagatccaagaagagtttaagcagagttggtaggatcgaattgatggaaaaagtttcagaaaagagctagcattgttgaaattacagcaacctttgttccttttatgttgtgctcgttttctttttgggcctggcttttttttatatatataatgggcagcgtccggcctttgcattataagatgaatatacatggccaattttgggcctggctaattggtcatttttatgctatttaatttctcaaatacttgaatagctgcatatgaatacgctgccaaaataactgcaaatcttttctttttccaggaattgtacatccttctcttcgtatttgagacgaactctactcctaaaagcattcgttaatgctagctttatctatgcaatcaaccacaaatgtttactcatctggctacaagttttgcaacgacgagatcatcctgctcaaccgtagtttcttccaataatgccaaaatggccgagtctaatccagcaaatccccaatcctgatcaactcgtctagttatgaaaaaacttataatctaaaacgtttgttccagagtctagcttggattcaagaactgagtctgatcgtcagtgtggactgtatcatgccatcgactagtccagcatcaatctatatcgcgctggtgtctggttagtgccacaaattaagcattttgtacctcatctagagagacgactggtgccgcggtcctgcataacatgacctaggaaactgaaaacacctagtactgacatgaactgtcggtaaccaaattcctaaactccatcaaccatcctacccttgtgtaagggattgtcacgccccgaactagtcccgaccggaactagcccgtgacgctccaaattaacctgttaatcgataccagtcccaggaaacaatgctggtatcacagggagacagagtatcacagcaacagaggtctctttattatagagtagaagtacagtcatgttgggctgcggactgatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccgcttcatcttcttcagcaactgggggggggatatttatatagaacaagggtgagtacgggagtactcagcaagccaggggaaggctgttgtttttgcaatttggttttatttgaactctttttctaaaacgactaggtgagtgcttctcaaacgacacggatgggacagtgcgtctcgtccggtcggagtatgtgcaatgtatcagtctttagatcttgaaacagggttggcattcggccaacagcttttcaaacggcctcccgggccaacaacttttcaaacggccacccgggccaacaacttttcaaacggccacccgggcctagctgatcccatcagctacagatttttcaaacatcgaaccccttttcacaacagcaatttcacaagcagtagtcaaacaaaactacgctaggaatcacctcacatccgcccttgaccgtgggcacggctgttcgaacagttcaatgacctctgcagagggggtacactttacccacacgacattactaacccgggtcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggttgtacttgtcttatgtttggatgaaattccaaggaatcggtccttaagtgcgagagcgggaaaccgtacaccccgtacgttccccggtccgcggttttggaaattcatttagttcgcaagcaccgacccgggtgtcgggttttccaagtcttttgtaaaactccagttttacccaagttgttactcagattttaagttcgaaggcgaccgtcgatactcgcacagagtgcacgaatatcgaggtgcaactgggtggttacaaggggacatggtataacaattaacaaaggaaggatcaaatgtaacaaattaggtaggtctgccaatctgccttgcagacgggacaacagattaagtgtgatcctatcaatgaataatatttcgcaagcaatataattaaatttcaaatataggctcaagatgttcaaaggtggcttgccttgctcgagatccggagcttgatcctcgaaatcctcgcactgcggatcttcgggctccgaaactacacgcgaaacaggacaactcaacaaacggcgaaaataaagccctattaatgacctctaagcgtgtcattagatagatctcgagatttgaggaattttggaagttgaacggagtcaatcggatttacggttgggaagatattgaatttctaagattattggatttttggtctaaaggaaaaaggatttatttaaatcctttttgaaaaagaaaaaagaaaagaagggagggagggaatatagacttttctcggacggctagggcgcggcccaagagaaatggagcggtccggccgagctaaatgggccggctggcccaaggcggcccaaactcgcgcgcgcgcgggagggaggagatagagagccggtggaccgggctcaccacgcgcggtcccgggtgggacccgcttgtcagcggctcggctcaccgtgcggagggagcatgcgacgcacgcgcgcgggcggggacgggacgcggtgcatgcgcgcggtccgcggtggacgcaggtgcggcgggcccacgcgcagcctcacggctcgcggtggatcgcgcgcacgcggagggaccgaccggggtcggcccgacccggtctggctgagctggcgccgacgtggcgcctacgtggctgccacgcgggccggcgggaggtagacgacgacccggcctcgaatggacggcgggcggcggcggcgagcggcgaagcgaaccacggcgatacgggcaaaagcgtgcacaccgggcggttgcacgtg

SEQ ID NO: 78834 - DNA, 2321 bp, Oryza sativa
ttagtgtcggaaataatgcttagattttttgtaaatttaatcatactttaaaaagctgacttaggaaaaacttatttaaaaaccttattatatgaaactgatgtagtaatggtcaaagtcacctattcttagtcgaaaggatatttccgctcacttggtttatcaattaagcttttgcaaagtcaaggtaaatacacatacaacatatatgcatgacaccatgtacaaccatatatagatgaacaggagtatacatacctacgttgcttaggtagcaccttgatttaatcaaatgctagctagttgatgccaggtggcacactgcggacggatttgtttgtcagtttccctgcattacacattgtacaggagtgtactacatccacatacaatgaacagtagtagtagcagcagctatatactccagttgcctagtcgtacacaaagtataattaatcacaaaattttcattttatcatggaaaataagtaggcattcataatgcacgtacactccgcacccatacaatgaacagtagtagtagctactagatagttgcctagttgtacacgcagcataattaatcacaagattttcatttttcctaaaaaaaaacaagcagacgtataatgcgcgcacactcatcctacctttaatgagtatcttcagaagattgagcctgttgtcgtcgagaggtacagggtatgtcatctatcactcaaagaataactagtcgtaaatacgagtaccgggttgctgtcaaggggtataggttacgttggctatctcttaaagaataatttgccgtaaatgcgaataccatcaagcctaagacttgcatccatataggctagttacaccacaaaacctaacgtgttaagctacgctccctccacacaaaattttcatttttacccagcaaaaataaatgaatactgaagcatgcagcgctgtacacgagcttcttgtttatcattgcgtatttgtcatcatctaaaaaaaattgcgtatttgtacgcgtacatgcacgtttccatccacaatttcacatccatacgcgggtgacatatattatgcagctctcgtgggcatagctcgccagccaagaacgagctgaagctctcgtgcgcggcgcggccatgaaggcgtcgtcgtcgtcgcaggggcagagcccgaggacgccgtcgccgcgcgccacctccgccaccgccgagcacacgcggtcctcctcggagccgtggctcgtggcggcggcggtggcgagcacctgcgacgactcgtgcgtcaacgacgtcgagaacttcgcgcgcaccgtcgccgccgccaagtctaggcagctggtgggctcgtcggcggcgtcgcgccccgacatgctcgcgtccgtgctgtcccactacgccgccaagtggctccccgacgtggtggccgcgtcgtcgtcgtcctcgtcgccggcgacgtcggcgtcggggcggttcctgcccccggagagccccaccgccacgtggctcaagaagcggctcctcctggagtccctcgtcgccgcgctcccgcctgacccgccggctcccgccggcggcggaggagcggccgacgacggcatcacgtgcgacttcctgctcaagctgctccgggcggggagcatggtgggcgccgacgcggcgctgctgcaggagctggagtccagggcggcgcggcggctggaccaggcgacgctgggcgccgtgatgataccggcgttcgggcacgggtacgcgtgcgggacgctgctcgacgtgccgctggtgctgcgcctggtgcgcggcttcctcaaggacgccggcgccggcgggggcggcgccgccaaggcaggcggtggcggaggcgccgccgccgcgagggtggcgaggctggtcgacgcctacctcgccgaggcggcgctcgaggccgggctgcggccggccgagttcgaggagctcgcgcgcgccgtgcccgcgcacgcgcgccccgccgacgacgcgctctaccgcgccgtcgatacctacctcaaggtcacccacacgtactcctccttccatctccactaattttacgtttccgtttactactaaaaaaaaaagctaccaatgtagctttgcatattgtgtctcgatataccgataaggtcttttttacaccttatggacaaatttgatgtcgcaatcttttcggtttcaaaaaattgatatcaccatcttctacatatcgtcaaaacaattgtgaattattttgggaccagctagctacattttaatattcatggcgttacaatttaagaaaaaattgtcaaaattttattacactgt

SEQ ID NO: 78835 - DNA, 3095 bp, Oryza sativa
tggtgtttactgtagtgtccaaactataaagttactaatatctgaagattgttcagccaaatcacttgtagtttttttttctgaaaaaaaaataaatcgtaactcggagtacttctatgaagtagggtaagaacaaagcgtagggaagagatcacgtgagctccaaactgctaaagaacaaaggtttacctgtatttacacatgggaataggtgctttgtggatatcaaatccttcttgtcccttagcttgctgcctgctgttctcatcaacacttgtgctttgtcctggtgcgagtgactaacaagcagttttactgtagctgcgcgtttcaacaaacaaaaaaaaccacatttgtacttaattatttttagttgtttcattcaattttatcaaccgagcaaacgagtgtccaaagagtactaagagagaagatcatactcctaggcctggtttagattcaaagtttgaacccaaatatgtcacatcgaacttttctacacacacaaactttcaactttttttcgtcacatcgtttcaatttcaatgaaacttccgattttgacgtgtaactaaacacaccttagtactctaaaaacgtgtggatgattgaaattgccagataaacatgcaagtatcagagatcttgcaggcatgaacagtcatgcaggtggtacttattaacagtctttaacaaccatcgtaccagactactgtataacagagccaggagattcatctttcaatttcatggctctacatgtcaggacttgacagtgctgagagtttcagatccaaatgacaccaaacaaaaatcatgtggaattctgtttctgctgttctctgcgcttttacagatcccctgttcatcagaaatgccagcaactcagcattgttgctgctgtctgcaaatgaaagattctcaatgtcaaaaccaatcatatgttaggcagttaggccatgcaagttcatgccaatggcactatgccaaatatcaagatgccatcttttgttcagttctgttcttcaaaattttttgtctagaataaatttacactttgttgagcaaaaagtgctgtgaaatcatgggagaaatgatttttcaagtgcaaaaaatattttttaaaaagaaaaaaaggccgtttgtggttcgctgttggcgccacttgttttgggggccttttgggagtataggattttaaacccctcaacctccctagcgataggagtttttccctcttagtagctagtactccctccgtattttaatgtataacgctgttgactttttgaccaacgtttgaccactcgtcttattcaaaatttttatgcaaatataaaaatacttatgtcttgcttaaagaatatttgatgataaatcaagtcacaataaaataaattataattacataaattttttgaataaaacgaaaggtcaaacgtttataaaaaagacaacgacgtcatacattaaaatacggaaggagtaacatttttgtttgttacttgttttcggttcttctatccttgtccactgacaacagccttctgctgcttgtgttgtgtaattaaactttacttttcttcttcttctattttacttttcttcttcttctattatattgatatgtaatcattttgcgcattagtgaaaaaagaaaaataatctatctattatattattaaaacagtcttgaaaggaggcaccacgttcgctgtggaagctagaaattctcacattaatcggagaaaaagaaaaggagagtccaagtagaaatacaattcaaaaatagctgaaattcggaattaaaaataagcgatattgaaagatgtgtccatataagaacccaatacaaaattaatcaaaattcgaaataaaaataaaataaaatccgaaattagaaaataaaataaaagttcaagtaggaatacaatttaaaattaactgaaattcggaattaaaaataaggaacattgagagaagagtacatataagaacccaatacgagattagttaatattcggaataaaaataaaaataaaatccgaaattagcaaaaagaaaataagagttcaagtaggaatacaatttaaaattaactgaaattcggaattaaaaataagcaatattaaaagaaggatccatataataacccaatacgagattaattaaaattcagaataaagaaataaaataatatccaaaattagaaaaactaaaagagagttcaagtaagaatacaattttgaaacaactaaaattcaaaaataaaaaataaaaatattaaaagaatgctatatggtattaaataatttttttaaaaaataaattctaaaataagaaaaataaaaaatatttcaattaggaatacaatttataaataactaaaattggtgataaaaataaagactattgaaaaaaaagaccatataaaacatacgatgagataaattaagtaacaagcctataaaagagtagagtggtggcggttgatacgacatataaaaactattagtaaaacaccaaatagaatcttaataatgattaaaaggagggatgataggcaggccatgaagcaaacgtgtaagatggttgccggacttctagaaagtgaaaaaaaaaccccattgataatcatattcgattttcaaaatctcaatgacaataaaaaagagaagcagcgggcatgatgtataggattatagttccagagccaccgatggttggcgggacttctagaaaataaaaaatgaattgaaacgatagttatgttcgaatttcagaatcccaataacaataaagagtaggcggcgaatgggtcgtagaggagtatagtggcatcatttgacgtcacttctaaaaattataattaaaaaatgaaacccaacaagacaataaattgtaaaaactacaaggtccaatttttaaaggttcggaacttctaaaaagtaaaaaaaaaaacccaatgataatcatgtataattttaaaatctcaatgagaataaagaagggagacaccgggtgagccataaaggagtacaatggcaaagccactgacggtttggcgggacttatagaaagtaaaaaaataaact

SEQ ID NO: 78836 - DNA, 3591 bp, Oryza sativa
aagagatgggccgagcggaattcggcccatcgaacccgggggaggcaaactagacttttgcggagggattcgatttggaaggaattggattcggaattgaactcgacgatagatcggggattgagatcttgagatggcacggacactagacaacaagcaaagaaacaaatttcgcaattagggtttttaagagataattttcccgctaggcgccacgacggaacgggtgctacagggatttagttggtcctgcataaaagaaaaatgatgtaattacatcttcaatcaagcagttcatacgcaaaaaacttcggtaaaatcatcagacatgaacataaaataaactttttttttgaatggaaacataagataaactagaatcttggtgcttaggtcgctccagttttttttttgacgatttacttactattacgcactcatggaaaataagattcttttttcttttcgcttgctttcaatgtgattgaaaattacgaatgcccttgaagacgatggtgtacaccaatacaccatacaaaaaccaaattactttctccccaaaaggtgccaacttgaagtctctgttataaaaccggcccccaaatcacatcggaaaccaaacgcggaagaaacgccatagaagatccaaatacgatgacgacactgaggcacgatatttgataacgaagttctgccgaggcctacatctctgggtcactgattgcgggcgttcctccccgatctagcatattacagcgtatcagagttacaacgactcacggctggtcactgccggcagccgctccctctcgctgtgctaagtcgccatgcggttacaagaggcacgcccctctatttatgagagatcctaggatatagtccgactcatactctattcctatacctagtacaactctaagtcctaaactgtaaccgattttgtacacatgttcgacacaaactctaacactaatgctagtttcagcctctatatatacggagtagtacattctttctgctcaattgctgcatccttgccccttcatttgcacacactcacactaacatagaaaatgaagctgcatgaatagaacaatatagcgaaggaaatgatagagagctttgtgttaatttttgggactggaaggcatcaggagcattcctatgagaaatgtacgtgataattactctaaaaaactgctatcgcatcgactctttcacgagtgcgcatggtacatatataccatgtgggaagaatgtacctctattaaaatcagtggcggaggatggaaaaaaatctagatatggcggtgtgacccatggactagcgcgaagccccagatcagacataatggctgtgtttagttggatccaaagtttgaattttggttgaaattggagatcatgtgactgaaaagttgtgtgtgtatgacaggttgatgtaatggaaaaggactgaagtttggatccaaactttggatctaaacacagccaatgtaatctgggttgaacttagttataccttcaaaattctcttcaacacgttcttccccaagctcttggacaacatgctcctccatctgcccctcctccttctccatctatactgcaacattttggcttccatgagtacttgggcatgcactacaagagccccaggtccaataactcttcaaatatgcaaaacaaatgaaacaaatgctaaaatgttctaaaattgtcagcatttgaagaatatgtacctctttgtgaagacaatgcttttccttttctctttctatccatttgaacttttgaagaatatgtatcctctctcggtctctcctctgcctgcctcactggctctgtggctcactgcttgttgccggctgccctgctgcgctggccgcctgcctcccgcggccgcgccgcagcacgcccacgccgccgcgccgctgcctggccctggccggctagctgctgcctgcctcccagcgtggccgcgcacccgcctaccccgccagctgccgagcccccaccggccatcgcagctccctgtcgcagagtcacagtgtagtcgtcggccgtcggcgcttgcctcctcagtcggatgcccggattggattggggaatgggggatggggaattttggagttagggtttcatgttcaacaggtgaaaaggcccatttacaccaaaaaaaagcctaattggttggcctgttcgcacgtgggctgtgggcaggattggcttcggcaatcggcagttggatgcctcgccgccggctcggagcgatgccgccatcgccatgtgagtcaccgccctgggacctgggattcgctgcaggaggggggggggtccggcgggagatcaaggtatggcgagcgccataccgactcctccgcccctgattaaaatgttagaccatgagatctaagcacttaagagaaattcgttagtttgacactaattaatcagttgaaaggatgtggatccgaagcagaccatcatgcattttctgactaggaaaaattatcaattgattaagagttttgcagcaaaatataaatatttaatcagatttgttcttttttaccaatgttctgtgaatacaaatttcaaaattttcatccaggcaaactactgatcatctaattaatattgttttctccgcaggaagaacgaaatatctcatggacttgcacaggtgcatcagtcaatagcacaacttgtggagtaggccggacagaacgcatcctggtccacatcagggtggtgtggttggccggtggaagagacagcagccgtcgaggacgcgatcgcaaattacacgtttttttatacccgatagcaaattcacaggaaataataaaataacgtccgagtgtctaggagctaattacacgttttttttatgcccgatagcaaattctcatttttgcggtgtccatgagctaattacacgttttttcgatgcactgtagcaaattttgctaaaaaaatttaaatttgatgaaaattcaagcgttattatcgaaataactttttttttctgtaaggccttgtttgatcatggtagaattgcccgttgtgttgctcgatgatcgcgtgcaaccacgtcaccctgctgtccaggggcaaagctatgtagtccccaggtgttcctaggaacccgactaggaaagtaaaattagtgattaataccccctaatgactatgtgggcacccccttggctcacgtatgtgtacccccagaccgagaattaagccacgaagacgtaaagtccagtgcgtgcattgcagatcaccaggccgaacaggtgctactaggaaggcttcaatgcactaatgtgttcataacaaggctcctgatggattagatcatactcccgaaaattgcggactatttgtcaatgctgtataggtgattttttgggatttttttttataaaagaagtggccgatagaacaagccaacagtgtgaaaggaatatatataaatatccaggtttgccttagtgtttaacaagcattaaaaaaattaaatgtagagtcataaatagtagaagataatgtatgatgtatctatttgacgtgaatagttcataacct

SEQ ID NO: 78837 - DNA, 3661 bp, Oryza sativa
tacggagggtagtagttagttatctaatcagcatagccaaatttgaagtttacagtagaacctagttttaaagttgattttgagtccttttaatgttggattttaaaccgtttaaaaatatatatatatatataaaagttttacatatggattactcattttctagggtttattagtctcaaatcaaacaatcggaggcatgttttccggcacgagctttcaaacaatcagagccaagtttgtaatttgctttttctactgcttatcggctgaagctgggtcttgtctcagttttcatcattttactactggctcaaacttgcaaatactcgtatttctttgactctgaaagtatatatccaggagtattcccgtgtgagtgcgtgacaggaaaagttcagacctgttttctgcctgcagaaaacaatacaaaaaccaaaaccatcgcctcgcccgtgtagtactagtaaatgttcaggcttcagagttcacaagcgatgaaaatgtcttcttggcaatgtgaatgtgtgatggaacgaccagaaaaggacggtgatcctgttcttcttcgtttgatacacgcacctgaacttctctgaactgatgataggatacgagaagaaaagaagcacatcaaaagctcagagtttcagtccccgcaaaaaaaaaaaaaaggaaggaaaaagttcagagtttcagagaagcccattaattcgcaaatggtctcggactaacatggccgctctgttcaggcccaccgtttcttgcaggaaacatcttgggctgggctaacatgttaagcctatttagcgtatttaagcctatagagtacctaggccttagtaccttttctcatctccaaactttaactttctcgcttttcgaactactaaatagtgtgcttttactaaaagtttctatgtagaaattgtttaaaagaatcacataaatctatgtttcaattttataatagttaatacttaattaattatgtgctactgagttttcttgtttcgagtgcgctgaaaatatacctgcatagtgcataccattgaatcaagaggagcctaaggccctgtttgggggagcttatcccagctgcagcttttcccaaaagctgcttctgctagaagctgccccaaacagttcacagcttctgagaatctgtagttacatattctgaaaaatgaattaagaagccagaagctggagaaacggggtttcagagcttttccagattctcagaagctggctaccaaacaactgcttctcagaatctaaagctccccaaacaagccctaagctgtgtttgaggaaaatggaaaagagatacgtaaaacgaggtaagttattggtatatgattaattaagtattaattattttaaagttaaaaatggattgatatgattttttaaaacaacttttctatagaaaagttttccaaaaaaatataccatttagtagttcggaaagcgtctgcgcgaaaaagatgtgttttctctctcaatctcccagcaacgaaagcagcctaagtgtttcatataagtcgttttttttttttttcatattttttaagtttgaataagtttatagaaaaatataaaaaattccacacaaaatattaaatattaggtttagtaaaattaatttggtgttgtatgcgttgtcatttttttaatttaaagaagtttgattagaaaaaaaataaaagtagaaggcttaagaatccattatttttccaaaaaaaaaacctaacttttcctcaggccggcggcggggagccggccggcgaagcgagggttcctgccgcagtccgcgtggcggcgtcgatccatggagctagccgacgactctctctctctctctctccattgcgattctgacgaagcagacgtcatggcgccgacgcctttcgcggcgttccaagcaggaggaggaaggctgcggcgccgagaatttcctcccgcccaatcatcaccaccaagaacagccacgagaatgagattgattggatcgatttggactgagacgccggatgaactgcagctcacagacagtcatcagatcagatgctgcaagcctggagactggagtagctgtaaaattctcttctcttcccccgggagcagagtaaattcctgcgtaatcccaggaaacctaggtgcaggtggagcaggaggaggaaaggagaatcaaatcaaccgggagttcagggacaagcagttgggaatgtgctttgtttttttcctgacatgatttggtgtgtgtgtgtgtgtgtgtgtgtgagagagagagagagagagagagagagacttcctctgaacttctgaagagaaaagtagaaaagagaacaatttctgattacatttcaggcttttaccatctttcattttttgagtcgtgatgttttgttcctgcatatatgttcgtttgctcctgcttacaagttaaaaattgccaaatggttctctcattcgcaggaattcagagcaatttcgaaatcccgaagtgaaacgtggcgattttggcggtataccggattactggttcgatcttgtagtaactggagtgcatatagttgttgttactcctagtactgcagtattaaggctatacgcaaagagaccgtgtaatttatcattacagtgctgtgcagttcagtagcaaatcaactcagatttttttttcctggcgagctgatcagctgaagagatattttctgtcaaatggcagcacggtaagtgatgaatttctctatcatgttcagcaggggtgggctaagagagcaatgtgcatgccatgaacatgatgaagatcgatggcatgagcatctgacactctgactaaccaaagttacagtacttagtactactattactgcagggtagaaacctcctatgtgcagtgaatacatgaaggttcttcgtgcagtaaactgtaattctgtataacactgaaagctaggtgagctaaactgaagtttggattggcccaggaaaaatgcagcagccagagcgtgtctgaacttctgaagcagcatggtgtggtaatctccttttttactttatatccttgtcctgctatgtttgtctttacctcttcacagcagcatatgtggttaaatcccatcgaagaaccctctcatctaccaacacacactagcagatcataagtacattgtgcaatgtactatatagccttattcacaaaccaaaaaaacaatctaaaaattcagagatggccatttgcctctcacatatacgtggggtgaaaaactgctaaataattcagtaaatacagctagggatcatgctgaactttgctcaaattaaatacttgtctgcctagtcataggcttccttgataattttgcttacccgtgtttatatcctttcatctacctggtgttggctggtgctctcagttggcatgcatgcatgcacaattgcacatcatagttcaaccaaaccagtgtgagtgtggcacacctgaaccgtgacccccaaaatgtaagcaagcatgcgtgagaattttatagattctaatgcacatgtctcatgagcaatcaaaatctggtggttcttgctccccttttgaccacccaactaatcaatgacactaggggaaactgttttaaacactcgggtggatgtccacccg

SEQ ID NO: 78838 - DNA, 893 bp, Oryza sativa
gtcggggaggacccctgggcttcctggcacaagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgacccgggttagtaatgtcgtgtgggtaaagtgtaccccctctgcagaggtcattgaactgttcgaacagccgtgcccacggtcaagcgcggatgtgaggtgattcctagcgtagttttgtttgactactgcttgtgaaattgctgttgtaaaaggggttcgatgtttgaaaaatctgtagctgatgggatcagctaggcccgggtggccgtttgaaaagttgttggcccgggtggccgtttgaaaagttgttggcccgggaggccgtttgaaaagctgttggccggatgccagctgttggccgtttgtaaaactccagttgcacctcgatattcatgcactctgtgcgagtatcgacggtcgccttcgaacttaaaatctgagtaacaacttgggtaaaactggagttttacaaaagacttggaaaacccgacacccgggtcggtgcttgcgaactaaatgaatttccaaaaccgcggaccggggaacgtaccgggtgtacggtttcccgctctcgcacttaaggaccgattccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctggg

SEQ ID NO: 78839 - DNA, 697 bp, Oryza sativa
ttcctgcgccccaaagtcggagggctcgccgggatttcctacgtcctgaacggggaagtgtgcaaagcatgcagcaatcgaaatttgcaaacctcggtgtgaagctcctgctggcgggaaggcagagagatctctgccaggtgtggctcagggtggacagggtcggtgacgttgtccacgtcagttgcaccagcgtgatgacgccggccgccatggcgactgtgccctcccctgtcgcactggcgcggggagcgtgtgcgttcacggcggtaatcttgatcaatcgcacgttgttcgccgcggccacgcccgaagtctcgtccccgttcgtcccgatcgtcgtcatctcgatccctgctccgccagttttgattagccctggggtggtcgttgttgtgcccccggcggcctcttctcccgccgcgggcacggtcgtcatggtcggccggggcgtcacgatcatcatcgccgcggccgtcttcttcttcatcttggtcttgctcgatgcacgccgcgcatccgcggcgagaccgatcacgcacccgcgcacgaccgccgtgatgtgcgccgtcgtcacccctgtttccccgctctccgcgctcagggcgacgcgatccacggagctcgtcctcccgatcgtggtcgcccaggcggtcgtgaacagagcgcggcggctgtaggtggtgtgggaagtcct

SEQ ID NO: 78840 - DNA, 4069 bp, Oryza sativa
gtcagcgtcttggggtagcggagcacgaggaggatgttgccgtccttggtgatcggcggctggaacctgtcgcggtcggagtgcttggcccagccccacgggttggcggcgtcgccgccgcgcgccggcaggacggcgtcgccgaccatgcacagcacgctctcgccgtcgtcgttctcggtgtacaccccctcgagcagcaccttcagctcggtgttcccgggccacaccttgaactccggcgacacgtacggccccatctccggcccggtgccgttgcgggagatggcgacgccgagcacgccgctcacgttcagcgccgtcctcccgcgccgcgccgcgtcgacgtgcgtgagcgagaacgacgcgagcggcagcgggtcgcgcgccgccccggcggcggcgtcctccgccacgtcggtgccgtcgaatggcagcagcggcgcgccgccgccgccgtcgccgtcgccgtcgtgcttccagtcacccttgacgaaggacagctccggcatgaggccgttggcgcggttggcgtcgaacgtgagctccgccgcggaggagagcacggacttgcactgccgcttcacgtcggcgaagcggacgtactcgtgggggatgaaggggccctgcccggcgccgccgcccatggggttcgcatcacggtggaacggatcaaacgacgacacgacggcgagcagcggcagcagcaacgcgccgacaagctgcagacttcttgacaccattgctgcgcaaaaccaaacccaatgtcacaaactcgcaatctgaactcagatgaatttagcaacgctgctttggatcaaatttgaccaagtgagtgattgacatcaaaatcttcacacttcttggcaacttggatgaacacaacaatgcagtaaaactaatccttttcagcttgcatgatcagatcagtatcaacttggatgaacacaactatgcagtaacacttgcagaagaatgcaaaaaatctaataaaatttctgcagcatatctaactaatcctgttcagcttgcatgatcagatgatcagatcactgacctcaacatagaaatttcttcagtgctcctcaagctgggagacctcgatgagagtgaggtgagtgtcgaagaactgttcaccaaggacggctctagtacagactagagcagcatggatctctgaatttgaccagaatgtggtgtcagatctagaaaaaattcccggaccagattggatcagctggaatctaatctaccaccactgaacaacactgatggatggatgcttcccccgcattatctttttccacaccttaattccccttctgcatcatcgaatcaatcaagggttctagtatagtattgggggttgactttgcgacgaagtgacccagaaacagagggttacacccttgatcaccgagaatgcccctgatcagagtgacttatcacaggattgccactgtgagaggatcgtctcggtacaaacgagcagtggcatttcggagattatctcgcaactgtgagggttacagcgaggtgaggatgggggagttgacgaagcgacgcaggtggcgcgcgcggccgccgcggcgggcatcgcggccggccggccgctcgccgcacggggaagcccgtgccatgtcagggcggctgaggccacgagagggacgtcgcgccgtcacatggccgcacgtggccgtggagagagatatttaattacttctagagttatgtgtgttgcagtgttgctatccacctcgatcttggccggcgccggaggagacggccgcgccgcgtctggagcgggacggcggctcgccggagtacggagaccgttgggttgcagcgacgaatctagtttgtttgagaggagaggatgtgagaagatcgtaaatgatgagtagttagcgtattcaaattttaaaagatatattaatatagttttttaattttttaataaaaacgtactgttaaatcatttgaaaaacgtacccgcgaaaaatgttagttttcctctcaatctttcggtgccgaatataaagcgttgttatttgatcggacaggtgggatgagggcatcatgctcaactcgtttcggcccagaaatagtagtatatgcatgtgtttttcttgggaaataaattatattctctctctcatttcttgattcttattgaatcgtctccctcaattgtaacaacgggtataatgtcttctccgacttaaaaaaaattagtgcaaatcgactcatttaatagtttgggaagcaatttcacctagcacggtaggttgaccacggatgactcgttgattgagcgcttgggacccacatgtcaataacttacctcatttgctaacccacctttctccccttttcttcctctccgacctttcaacagcaagaggacggtggtggtggcgaactggactccggagagggctttggtggtggcaagtcggactgacgagccgaggaaggtggtaccctctctcgtcatagacggtagcagagacgagacatgttggaggatgcaattggaacccttgcgtcgccaccctcttctcatctcctacctcgtcaccatcactgcacctttctaggtttggctcgccaccatagtcgcttggatgattccttcgatgtgggaggagagcctcttgttgatcaactacaccgccttggggctattatggccgtcgtacacgccgacaaggccaccacctgcgcctggtcctcgagtgcctcgttgacctgggccatggcgacaaagtagtctcccaatgcaggaagagaagagggtggggacaaagcagtctcccactgtagggagagaaggaggggaataaaggagagccctgacacgtgggctctacctgttgatgctgccaacataccacgtcagtagaaaccgtttctaaaaccaacaaagaagtcaatttgaaccggttttcgaagatggtagatgtattatacctggttttacggttgagggaagcaattcaatcaggagcgagagtgaggaagtcatgataaacttattccttttctgagacggctgttaaatacggcctggcccataatggtccatcactagtatagctaaaactgtattcatgggcctgcagttgattgcaggctaaaaccgctgtaatactgcgtaatcatcaaagttcatttttaaaagtgtaataatcaaagttcttgcaaataaaagagtcaaccgagttgatatgtttgtctccaaaaatattctcctatagtcaaaatatggtgaaaagggtgttatttatgcgaagaattaataaagaactaaattaactttgaccagtagacttttataaaacatcaagaatctgaatagccatcgcaaaaattcctgaaaatcgatgcggctgttgcttttcaaagtgtcaggattgcttctacagcggtaaagctgcaatatattccctggacgataatactatatgacgtttcggacaaacaaaataacttgcgcttaatggattttagctgtcggaaatatcaagtaatctttgccggatggagtacttaggctgcgttcagaaccctatgttcccagcacaagctgtgcacacgaaaaacggaacggtccattagcgcatgattaattaagtatttactattttttttaaaaaaatgattaatatgattttttaagcaatttcgtatagaaattttttgaaaaaatacacctattaacagtttagaaaaacgtgggcgcgaaaaacgagaagagaagttggaacaaaggttctgaacacagccttggtaccaccaagcatatcattatcccattggaaaatttaatgtcatatgctatatttgtgcataccaaaacataacaactactattaattagaaccattcacatataatcacattaattgcagaagcaaaccctgcattatgcattattggtggctcttcacaattctcaacttaacaacaacaacaaacataatctcccaaacaattacatctagctcatatttaatctctccaccatcacataaatttgatattactactaggactaccggattat

SEQ ID NO: 78841 - DNA, 1137 bp, Oryza sativa
gcttcggaagatccgctcttcgtggaagttgaagccggcgtttgggaaagcgagcaaggcaagtcacgtcacccttgagcatattgaatcccagtttataaaattattttgatttaaattattgcattatcgctttgtttaaattcccgcgttatcactgttttatttagccatgcctatttacctttgttatgaccttattattattgttattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaac

SEQ ID NO: 78842 - DNA, 1179 bp, Oryza sativa
tgtgagcatttttagaagtcaaatcgagtcaaggtttcatgtagtaggtaccatttcacccattatgaatagcaaaagggaaaagcagagatgattgtccatatgtagaattcgaaagtaaaacatctttattcaccttccttcctctttttttttcctggtaaatacaccagcacgttctgatatgttgtaagttttacctgaaactcattttttgtccaactatgttctttattacttgtgttgtgtattcctgcaccaatctttcttgaactgatatactccttgatgataaccttatctctgcatggtcacagatgctcgcaaggtctcgtgctcttttcatcaaggagtacaacaacaaactattcaattggctggtgacgttctccttgtcatgattgtgattgcgcgctttgtgatcaagttctttttactcgaagttgctgcatgggtgatattcatcttcttagagacatacacgagattattctggtcgtcagaattgttgtactacaatcccatctggcacatgatcgtctcttcatgggaaaccattgtgtataacccagttcttgatattgacaggcaagtttcttctctctgtgaagtgcacaacatgaatgtaatctctattttgccttccttactgttacgatgcttgtcttgtgcagatgggtgatcccaattgttgttgtgctatcatttttagctgtttactggcgttgcctcggtgtcaggaaacgaataggaagatcattgcttcctttgtacagaggttcttacggaagctccagtcgcccaagaacagattaatccaggtctagaaatggtgatgaatgatgcaaatcgctgggaaaatccatgaaaatatccttttgccgtgtgatggatagtggacggcaaaaggatgttggctctatgcacacgctgcaagaagcttctcttgcaatccaagaagggaatatttaggctcagctcacggctcttagtcttactgacccaccaagcaaagcaaacgctaacgtatgaatgataatcaatctttgttctatatcgaaatgcttatagtaacaaagaaatataaccatactttatttcaatgtaaagatcattctttgtatattatggcacactagataataacaaagaagatctggtagtgtacaggccagagca

SEQ ID NO: 78843 - DNA, 3500 bp, Oryza sativa
agaatcaaaagaacttacttttgccaccaagtattcccaaccattctttgctcaatatgctgcttgcttatggaagcagaacctgtcgtactggagaaatcctcaatacactgcggtccgattcttctacaccgtcatcatttccttgatgttcgggacaatctgctggaaatttgggtctcgaaggtatgtccactgatgattctgtctccacttttcttcctgtacttggctggccttatagcgaacatgtggctttgtttgacagggagacccaacatgacatattcaatgccatgggtgccatgtacgcagcagtactcttcataggaatcactaacgccacctctgttcaacctgtgatttccatcgaaagatttgtctcgtacagagagagggcagctgggatgtactcggcactgccttttgcattctccctggtaattttccctgtcaaaaactcctgtcatctcatcatgttttgatgctcgtagtagtaccataataaggctaacaatcgaactgttcttcggcatgcaggttacagtggagttcccttacattcttgtgcagtcacttatctacggcacgattttctacagcttgggctcgttcgagtggacagcagtgaagttcttgtggtacctgttcttcatgtacttcaccttgctgtacttcactttctatggcatgatgacaacggcgatcactcccaaccacactgttgcgcctattattgctgctccattctacacgctgtggaatctcttctgtgggttcatgatcccaagaaaggtacggaaggaacaggaaccccatgcataatttgcacctaacgtcctctaattgtactggacccatgatctgttttccccataatccatattccagtgcacattatccatatctttattttttttgtcacattagcatatatagctatggaaatagtgtttccaatccataaggccacttccagtgcacattatccatatctttatttttttttgtcacattaacatatatagctatggaaatagtgtttccaatgcatattatttattactggggccaaaaatgaattatctcccttcgcaaatttcatcagaaattcttagaggagatatctattttcctggtttgaatatatatgcaatgtctcatccgagacactcttttttctttataattccttagcacatcatctaaaatgctgctatgttgcatagtagtttttagtttctattaacattgtactataatggagcatgagtgccctgatataccagtgcccctaataatttcaccaaacccaccagtaactttttttgtcctacagtgaccacttgtcatgtactagaaccactttagcaattgggaagcaataatggtttgtttaaattaggacgtgattaaagtggctaatgattaatgggcttaaacataatgcagaggattcctgcgtggtggaggtggtattactgggccaacccggtgtcatggaccctgtacggcctgctaacctcccagttcggcgacctggatcagccgctgctgctcgccgacggcatcaccaccaccaccgccgtcgacttcctccgggaccacttcggcttccgccacgacttcctcggcgtcgtcgccggcatggtcgccggcttctgcgtgctcttcgccgtcgtcttcgccctggccatcaagtacctcaacttccagagaagatgagacgacgacgagcgagaagcgagctatagggagcacgacgtacaccaccattaattctctggccagctatagcgctcaaatgtgtactgcaactactatgcatgcatcaatccatttcgtttcttcagaactgcacgcgtctcttctctctgtcgtcacgatgaattcctcccggtcacgggagatgctggagctagcagagatcagagaccagcagaaaaaaggagacaagtgtatagctaagctacctgttgcaagcctgtttggcagatctccaacaactagatctaactcggagctaaagtgaagctgtggaacagccgaaacctcgcctcattctaatttttttcagattattttagcctgtttgagctgaaactgtttggttggatagagttggagcgggagctctatcaaacaggcaagtgctccttgattggcttgatcgttatactgcgtacgtagtggctggtgcggcagcagtgcaatattcggcgagcattttgcagcagccacggtgagccaatgggaggtcgacacctgcaagccttttgactgctgcaaccggcgtccctccatgggggtactcttttggaagtagcagcagcagcagcagctagctatagcagattctgcgtcccctggcctctgctgctgctgcctccgaggactgcaaaacaacaacctagctagagcagcaactactactaacaagaaagaaagaaaaaaaaaagaaaaggaaaaggaaaggtatgaggagtactgtactgagtactaaccatttggtgatcgatcgatggtgcgtggcgatgagagatggagaagaaacgggattgattgatggattgaagatctaacaccttcaaaaggggggcagtaggagcatcttctacctgcatcgcaggtacgcaacaacacatgcatggatcgatccactcgtcccagctttttattactaccatctttccttcctttttttttccctttagagcaagataataatagagcacactttctattattagctcatcttaaagccaacatatataatagattagctataagattgactataattttcttctcatctctctatctctcacttatatatttaatgcatttgtcttagagctagtgataagctagctcttgcatgagagccaacattcttaatttttcgctacctctctcctccatctaagcttatagtaggcttatagctcactattatacttgctcttagtgagtgtttggcaaatgggaaagggaaatgatttcccacccatctttaaatactaaccattcattctccctcttccatttaatcctaaccctttattcattttccaatcccaatcccaccccctattttccattatccaaacacatccttatatcttctacttctcgagaggaatatatatgcagctactagctatagctagacattcgtgtccggacgtataggaaggtattcccagcatcattcatccgtgccgtgtgcagcatactgttttcttaagcccaaaccaccaatagcgtttcacgatgatcgatcaatttttttatatattgatgacagtttgtaataaagaaagaagcaacgaatcgatcaaattttacatatgttaatggcagttcgtaaatggtaatggtcgagctgtctccaccagtgtgtatacatatacatacgtacagtggtggaggcagcttgatctgctgctaatgtatatacaaatatatttggtttgttctctctatatacatacgtatat

SEQ ID NO: 78844 - DNA, 5306 bp, Oryza sativa
  unsure (1)..(5306): unsure at all n locations
attaagcaaagtatttaataaaattttatctggccccattttatattggaatttattaattaaaattagatcttctcttctaggcttttaaaataaattctaataattccaattaaacaacaatttatatatttttggatttttaggatgtgacagcggtcctcggctcaccctaggtcgacggcgacgacgaaaaaggctgtcggagcggaggaaggcggcggcgcggctcgggtcgtcggggtcgacggcggtccggcggtccgcgggctcagcgaggggttggacggggtcgacggcagtgcggcgaagccggaggaggcgacgccggggcgggagacggtccggcgagcggagaaggccggccggaggtcgtatgcgactgatgaaagagagagcgacggcgcgagctcgattccggcagggagacggtgcggcaagggccgaaaccggcgaaggaagccccgggagggtttatatagggttgaaaggggagaaggccgcccgaagggaaagaaaccggcgcggcgctctcgggctccatcaatggcgccggcgggattaggggagggtttccaaacgaatccaagggagagagggggggaaaattgggggaaaagggagagggaatcacggggaataattcccccttattgattgcacgcggggaggacggaatgcggcgtattcggcgncgncgncgcggcggcgcttggcgcgggcggagaggcgggagcggcgggaggaaggggatgacgggtgggccccacccgtcagcgagggtggtgggcgggcccgcccgtcagcggcgcgcgcgcaggaagaggctggatgggccgcgggggagaggagaaagggggagggagatgggccggattcggcccaagagagggaagagggatttttagggtttttcttttttaaaaccttttcaactttgtttatttcttaataattattatttgtgctctgaaaattccactaaaatttatttacgcattttaagcttttaggaaatttacaaaaatcctctaagccttatttggcttttaactttgcacattttaattgttggtggggttgggttggtactcttgtttatggctaggatgggttggaaactatgtcatgtcttccgtccggataccgtggtggtatgtggccgcgccctcggttatgggcaagccgagcaatgtacccaagttagtgtttttaattcttaacacctgcttaacaactaaaatgtggaatggttggcctgggttggcttgggacgagctgggacccagggtcgggttgccagttcggtctgaatcatcgtaggccttgggttaaggcaggttcgtgtgagttcacggccttgattaataatcttgtatagctctaggaccgtgtttacaaaatagctttgagcaactaagtgtcttttagtgctgtttactgcaaaccctaacccccctatattatggctcccttgtactcccttgcatttattctgcacttgtgggtgtgtcttgttgagtacggtggttgtactcagtcttgctcaatttttcccaaacccagaagagaagcccctggatgatgaaggctttggtgtctagctcgtgcctcccgtcaagcgcctgtggtcgtcgccatagtctcccgctgtttcccgtttgtctttgtgtgtgctgggccttcgccgcccatgtaataaagtaaccatttacgcctccgcttgataaactctgaaatgtatcaacttttggtgtaccttgcctcctgggacaaggaataatacacacatgtaaggaacgcccgttgggttatttccggtcgtgacatatttctccgtatttagccccggttgtatggttatgacgggctgtcgtaaagaactcggcagtcaggggtggctcctcgaagtaccaggagggcatcggaaagagggtattagctagtatgttggttaactagaatgtatgtatactatgtatattagaagtatagtaatagattatctttctattttcttcctacctagcttagataatatattataagaatgagtagcttatgcttgtgtgttactctacccttggattatcttaacccatgcttagaatatgattatcacaaataatatataaattgttagtcaagttctctctatatgatcttcccacgggataaaataaatacaatacccttggaatactctcgggtgaaatgctacaatggtatatccgtgcgcttgcggatgaactctgtaaccataatataccagaagtatttgtgtgccattggtgggaattatatttctagtaatgtcgttaagaaataccaacagaggggagaattatacccgaacgagtaagctctccgcagccgcgcaccctacgccgaactcattatgctcggtgatggaactanggccaccagatacagaaataatctggcagaccccttcaacaaaggaaccgatctcgggtcggaaggtaaagtcgncagagacaacttggggcgcggtgagtgtcatatcagacactgtcatttagatcgccactgcctggccctctcgctggcgactcgccgaagcaaatgtcacagccccaccagcgccagaggctttcgccgtcgccagttgcaatgcttggtccgaagcaacagcgttggccgaagtgctgcccccggttggcgcgtccgcatcactagcaggcagtggagacaggagcctcttttgtggaggtgggtgtcgtggccccgacgaagttggcatcccatccgaagatgtttcgctgtccgagaagccaccggccacctgcaccacccctttcttcttcctttgggcggcggcaccggccttcgacgacgagccagtgatggttagcaacgcattagcactagcgatgttttgaggacgcgtgggcgaagcgctagagccggccccagccttcgcccgaacagggcttggggtatagccgtgtgacccagcatcgtcgtccgacccgtcttccctctcatcgtcgttgtcgtcgtctgcgttggtctccacggcgtccttgcccactcgccgagttcaaacctggcttctcttggccacgtcgcgcttccacttttttgacgtcccaacgtcgtgatcgactctcgcagggttcgcccggctggctagcgtcccgtcgtagacgcgattcgcctgtccattggactgttactgaagcaggcgagcgtactcggcggtaattaaacccccgatcattttcgccgactcagctttggcatcctccagcaaacgaactaattaaaaaggggaaagatgacaaaaattatataagcccaaacaagccccaagatgtgagatatcgaaggaggggagggaagcttatgattgatgccaggaggaagcacgaggcgggaaagaccgagcacttcttcaccctctgcggtagtaatcccccaatctcgcgcgaggggagaaatctgtagcatgcaaaatttttcgcagaggtcgcgggtgctcaaccgatgcgcaaccttgcgaagaaggatgagccgtgcctcaagcacgccatcaacatccacgttcggcttgatgatcatggcgatagaaagacgccggaagcgaagccacttcgccttgtcatcttcggcggaatcgtctttggagaagtaggggttggcgatgtagaaccatttttgcatcgaattgcggtcccactttgccatcgacacaaggacaggccatgcatccgagcgctttggccgaagcatgaagttacactgccaaaaacagtcttctttggccccgccagagtgttgtcgtccttggtccccacgcacaccatgaacagggtggcgaagagctccgcggtaggagtaaatccacacgtccggcacatccagacgaacacgaccaagttgagaaatgccgatgggctgagctaggggagcttgatttcgtacaactccagcactgatggcagaaagttgtcacatggaaggcggagcccggcggtgaaaaagccggcgaacaccaccgttcgcccgtccccggtcgaagggacaacgtcttcgcccgcacaggacacctggcgctccgcaaggacgctggagaggacaagctcggccaggtcggcctccttgacaagaaacttgccaaggtagcacgaccaaccatcgctgaggctgccagggtcttcgccagacgatccggccttagtaggcttgcgaggagccatcgaatccgcgatgaaagaggtggcgaagacaggaggcgaaaagctagagcaggaatgatagggctgaaggcacgagagtctgacagcggtaaaaacgagaagtggggaggagtgatagcgacctgggatgagggttgtatagcccgatcgcacgacggttcgactcccacccaaccacagcctgacacatgtcaaatggtagacggaacggtaaattcccatcgagccgggccacacagtggcaggctagaaccaaggaaaaccaagaggcccacggagcccgatactgttcactttcaatttcaaaccacctatccatttcgccataacttgggcgaaataagaaaagattactaacacaggaactaagctctttgtaggtgcaaaaggataggtttcagtaggaacatcggccgaaagggggcgcctcatgccataccacacaatttgcatttgcacggtatcggtggaagctccctacttacccttggccgtgaggggcttgttggaggtataccacgagggccttcggccagacctgcagaaaccgttgtcacaccctgattttcgtcttaggatttataaatcatttaataaattattaatagaatttatattaaatgttcattaatttacaagtgaagttaattgtgggaaataaaatttcctaaatataaagcatggatggatttaattttttattaaattctccatggttaattatactctctggaattttctcggattttttcggagctcaattcctaaatgatacaaagaacagttcagtaattatttgatcaataatgatctaattataattgttaagtgcttttcttgcttaaaatccttaaattataaattgttgtttaaaaggaattattagaaatgattttaaaagcttaaaagagaagatctaattttaatttgctaaatctcaatataaaattgggttagataaaattttattaaatactttgcttgttcctctattttctagaattttctgggaattgtttgagcaagggaagtatttttaataaatgaaacatcatttcacgaattattttaattggaaaagtt

SEQ ID NO: 78845 - DNA, 1707 bp, Oryza sativa
ccaccaccccaaatggtgaacccaccagtacaactgtacaagccatgaagcaagcaaagcaagcagcgatcgagatgagagagagtaccctccacatggcgacggtggcgaggtcctcgtccagcttccgcttcagcatcgcgttgtactccacggggtccatcgccgcgctcgccggcgccgccggaagcgcggccgcgggcatgggcatcacccccaccgcctcacgatcgccgtagcccctactccagcgcgccgccgcctccgccgccgccgccggcatcgggctagggtaaatcgccgcgccgtccgggctcgccgccggtgcagggacgccgtcgagctcctccagaaacctctcgaggttccaccccgacgggcaccgctccagcaacccgccgccgctcaccgcgccgacgtcatctactccggcggccgccgccggctgcaccggcggcggcggagcccacagcgggtcggggatctcgtcgacggcgaacacgtgctccattgcgctctcggacgagtttgaaatgaattcgcgaggggttttcgaaccgaaatcggggcgaaattgaaaacgctggaaaagtttgggagaaattcgatcaaatgctttggaatttggtttcgcgggaggaagcggagaggaggaggcttcggagagaaggaaatggtgggaaagctacggctacgcaacccatgggtttttttttcttctctttttttttcttttttttttcaattttgaactgagttgagagggtgctctcctctcctatttatataggtttgtcccctctttagaagcttcaagaaacgtaaaaagcaaaacaacccgcacgatcttgagtgataataccgatataaataatttggacgtgttaacagaggtttcaacggatataaagtgaaacccacacgatcaaagcgataacaacgatacggacgaatacgtttttattaggaaaaagggttaacagaaagcgtgcaagtaagctacgatggtatggtgttcctagcacaggtgtagcataattttgacaaggttctataaaggcatggatttatttgtttttatcttatcaaagtttttgagtgagggtgtagattacgcatccttaatttgacaatgataatataaggacaaatggctttctacagaaaaagaggaaaagtataacagaaagggtagcaaagacattcgtgaataagagtagtgatgctacttaagaaatgatccatctctatttactatgacaagtgtctatagtaatccaaactgattatatcaaactgacctaacaatgatatttcagtttgtaactttataccattgtcctaagaaacgtgccctacacttatggttatgctagcagcttattgacatgtatcatccatgttttctgctaactttttctccccctcctctttacttggttgctttcgagtttaatttcagaaatcacaagaatgcataggtataatgtggttgattccatgtgataatcaaaatggggacatgaaatttaaaagggggaataagatcagctgaaagtgcaatatgtgtcgcttaagcgcccattttgccacgtcaagtttttaagtttcttatgttctctagcatatttaatacatactacttagtcttttagatattattagtaacacaagcacatatgtattttatctttaaacgttaggacc

SEQ ID NO: 78846 - DNA, 1929 bp, Oryza sativa
tgtaggataaatcaaatcctcagtaatattttagaacaaaaataataatagtaggatggtatatcatggtttggccccgttggttagattcctaaattaatttattttgaagcggaagaaatagtagctcaataattgcaatggtcgattcataccattcctagctacctatgtatacacgttgattctgatcgattgggcgacgatggattacacatgcagctagtgtgtgtcgtatatacttatagtatactatatgtactatcttcgttttcaatagatgatgttattgactttaatatattgtttgatcactcattttattgaaaaaaaatataaagatattattttttatgacttgttttcgttattaaagaagtacttttgcatgtatgcatcaattttaaaatctgacaagtggtacaccaaatttaaggatatcatctatttaaaaaaggagagggtatatacgtatatgcaacttggggtgggctgaggaagatcaacatcgagaccgaaaagaccgtagttttttctgtttatgtttatgtttagcgtttgaccgtccgctttatttgaaattcttttatgattagtatttttattattattagataataaaacataaataatactttatgtgtgactaattgttttctaaattttttcataaattttttaaataagacgtacggtcaaatgttagacacaaaaacctactacacatgagacggaggtagtgctacgtactttttctttttaaacaacatatacttatatatgaacgtacttgctcagttattggacgtatctggcaggcaggatgcaggtatacatatactatactactagtagtaacaaataattaacacatcgaagttgtctcatcacgtcaaatatatgaagaggggggtcgtcacgccaggcgatgctagagtccacgggagttgaatttgtctgtccgattcctggagctttccagattgaatcgggtgttgtttaacctgcagtctaggccgggtcaatctaggtctctggtgcaatcctttatacaagaacttagggtttggtcttgacctcggtgtagatcgattcgctttggtgtctgctgcgtcgtctgcagtcggggaagtccagcatatagatcaaattggttcttggcaatatggcatcccatgaagatccgcgcgatcgtcatcgtgatgaaggtggtgcaacaaccgatgaggaaccgattgaagatctgggcggggcttcggaggaggaagacgatgaagatgcaattgtggtagactttgatgaggctaaaaagcatattgatacacagtatgtggccattgggaagttcttctcaaggaggactttcagcgcaaagggactgtttgaagccatgcaaaaggcatggggcttgagacaaggcatggagtacaaacgcctgcatgataaccgatttctactggaattccaatctgcaggggatttcaggtttgcgactggaggcggtccttggatctatcaaggggatgctttcctgatcacggagtatgatggcaagtctagaccttcggatgtgaaactgaactcgctaccagtttgggtgagaatttacgatctacccctgtctatgatgactgaaacaatgggtaaattgattggtgcaaggctgggtgaggttcgtaaggtggcggtggatgatcagggaagagcatgggatgattttatgagagttcgggcggagcaccctgtggataaaccactgacgtgttggctgaaactgaaagacaaggagtcatcttcggtggttcagaggtatgatgtcaagtatgagaggatccctcggttttgcttttactgtggccacattggtcacatggagagggaatgtgatttaccctcggataagcaaacggtgaggtttggccttaatct

SEQ ID NO: 78847 - DNA, 541 bp, Oryza sativa
ggtcagggaggagaagcaaatgatatgatggaggggtgccggaagctgtccaactacatgatgtacctcttggtgaaccacccttccatgctgccgctcaacgtcagctccgaggctacgctggctgaggctgcgcagctgatgaaggtggtgagagggcgagcactggaggagatggtggatccagcgacgaaacgttgagggagatggtggacatgtggacgaggctcctcatctacaccgccggcaagtcccgggggccgatgcacgcggcggagctggcctgtggaggggagctcatcaccttcgtctggctgctcatggtcaaggccggcctcggggattccgaggcgaaaggatcctcattgcaaattctgcttgcgccgacactaatacgaaggaagcctatgccttttatttcgcttcgtgacgtgtatctatgtaataaccatgagccgccggtcagaccgaccaaacacctacggtgtcagaccggctccgtgaaggaataacagttatttcaaaattttagtaatgtttt

SEQ ID NO: 78848 - DNA, 2330 bp, Oryza sativa
taattattatttgtgctctgaaaattccactaaaatttgagggctccttttaggccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacaaatccaccccccttacaggaatctcgtccccgagattcgaggatgggttgggcggtcttctcttcttgtctgacttcttccgtcgcgtcttttataacaaacttgcctagcaaaacttctccactctggactgcttggctcgatctcctattgcagatggaatcttctcttcacctgacttatccctggttgcaccttttggctgactcagactaggttgcggtagttcagtgatgcttccgttccagaacttctcatgattcatatcttcggagtcaacctcggacaagttatcaacttcatgtcatgcgtcgtaacctgcttgtcattactaggataccatgcttgttatttgcttctaactcgccaccaactgcctcatattagcttccctggtctccgggtgatagctacttctgctatttgatgcaagggtcgataactttacctttgaattatgcttcccaagagagccaacttatcctacttgttatactttgacgtcttcccaaatggctttactgctggatttgttattgtctaatcattaccctgtcaaatctgaggcttcgttgtgagaggtgattttaacctgacctctatagactatcttcgaacatatcactggttctataactgggaatggctctcacgaacaagcagctcggattcactttctttacattcagtttacttcccattattatcttcaggttgtcctcagttagcattcaacgtattcctttacacttttaaccttgatgtgttctttcccattggatcatctcccaagacttggcattacctggtaaccggtgcttgcacttttcacttcgtgtagcatctgataccgagttgaagatttcactccttgccttcatagaaacacttttacctaggtcatcttgcttacttaatgacaaggtgactgttgcggggcaattacaatcaggggtcttccttgagcgatgcagagcatgtttctgtttatcaatcacctttcggcctacttcttttatgctagagaacatctttgccaatctcttttatcaatcatctttcggcttatctctaacaggtggtattcttgaatgtggattgcggacgcttctggggatgatgaggtcctttggcttgctgcctttcggtgaaaccttgatgtggttcgtcaaaagctgcactgactaccttcagggaaatacattgtctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttatctgttggcaggtatatccgatcttatcaatgtagaggtatggcgggtacccttcggggtttcctccaacaatccttatcttgatctgtaaaaggcgtatccgaactcctatcctcaactactgtctcgttagctttttaacccaacacagtttaattgtttttcttttccatccacaggttggctattaactcgaggttagaatatagttcctctgacacgagaccctaggtctcctttgtcagtaaacaattatacacatgatcacatatccgcatctttcaaacgaatcctcatggaacttgtctgtattacacatttctccctcattacatgaatacgaggcactgccttaaacaaaaagggacggtgcttaacatcggtacattgtattctcaatatgaatcatccataagcatagcaagctcactgtttatagacatgaatatatttatgtattacatgattgctgcaaactttcgattacaccatgataagtagcggactgaaaaccacaaacatggctgctcattttgattctggagagatatagctggcattgttccagtgactgcatcctcgattggttctgtgatgatgtgataggactgcataatgctatcattcacaggagaagcttccttctgattgctggttgaagcggatgacggtcttctgcttggtatcgccctccggaggttgattgcccttggctaggcctggagtag

SEQ ID NO: 78849 - DNA, 3015 bp, Oryza sativa
atataagctcatctgatttcaccatgtaaaaggatctgagctaaagttggagcggcccagggcctgtctaaagtatgggtccgctcccaaccatataaattcttgttgaagaattcgaaatattcagcaagaaagaaaaatggaagtacaagacgatgaacataaaaattgcgtagttctaagcacgcatccaaaaactgtttctgaaagtggaaaccatgtgtttttttaaaaaaaaataatttaaattgatagtgttgacactaggaaactggtggaaagcctgccgccggctagtaacctaatggactttggacgatcacttatgattgtttttcttcttggtcattgatctcataaagtttgtttcaatcaatgagatcagaatagtttgtttcaatcaatgagatcagaatattaatttccaatcagatatttcctttaccaaatttgtccatagaatagtttgtcatgttcgcgtaattgtaaacacgcatcaatttcggtcagcaattttaaataggtcggttcaccaaagaggcttgtgcaattaggattgtatatatcataccattacatatagatgcttgaagatctgactttaaaggtatatactagaaaatagatgctttaaacccatacactcaatcaagcggctactctcggggcattgattccaggggtgccaaggtgcaagatcgacggatccggagatggctaccaaactccagcatctgccatggtaaaggtggaagcatggaggtctcggcatagccgtcacgtctgaccagcgagatggttgcggtggtgtgagcttggcaagcagggcgttccccgccattgaggagtccattgatcaacaagtcttcgatagcactccaatattcacggaagagccatttagtgcgagtgccatcgcttatacaatcaagtattgcagtcactgccaccaccattgctcctatttaatctcattgcgtagctcaattcttctttcgatggtcaactccttatttgatttaatcaggtaaatgattcccctataaatgttgtttgaaactttttttccttcattagtttgactacaatattgtcttgtttagtgctaaatcatttgaaatgagaccagaatggaaaatactggagtctaaaatggtgtggaaatagttctttctaattacttactctaggtctctgggggaaggaaagagagacacgtgtcaacatataattgtgcttcatcttaaccaatcagcgagcagcaaccttgccggcttgagatatataaagatattgctgaaactgcccgtgatatagtataactacctagaatatataaaaaatgtgacttttatcccaacacttcccaattctcatgctacctctatcatctactaacccttaaaccgcaccacaccatccattaatgagggcattgcagatcttttaccctaatcgttaatttctccaaaacatagaaagctatattttaggacagaccaagtatctaaagcatattgtgattttctctagtcaggagtgatgtacgtgtgcccttgaaggtactgctaggatcgttcaacagttcttcacaattcaggaataccaagaaaacatcacaacaggcagatatacgaggataattttcagaagcactttccagtttcctttgtacaatggccatatatcagtttaagacaaacgcaacacctcctgctacataagaaggcctattttggaacacgggaattccatggatccctacagggaaatatacagctaaagcaaaactccaactgaaattcccatgttccaaactaagactatcatccccaaagagcattcactaaactgtataatgtaccaatagtgatgccattagctttaagttttcagtcttctgccatggtttaactacggcttctcacgcagcgaatccacaaaaaccatcatctgtgttggaaaatattcgtcattatcatgtggtcaacctgctgtagtacatgaatcaacacaaagataagatgttgagatttaagtgtgctcaataccaatttgatatatggaagttacccttacattttttgccatgcctgcttcgataggactgcgctggttggcgagaacttgattgcctcacctgaacagagtgaaatacaaatggtcaagttatatgttggattgtaacaacaaaattaaatatcagaaatcaggaaacatttaacaagttagaggtgtatccacaggttcacccaggtttaagggtgggaggaagatctagagaatttgccataggaaatcatacctgactactgattggtgttcctgttagtccataataaaaagctgaaaatgcgtgatacattacatatattatagtccatatggaggagtcctttattaattgttagcaccagacacactgtataacatacctaggtgtggaggatatctattgctgtcatgataatgtggcagagaagattcagcagtagcagggggcagcgcaccatagctgacataagaggatgcaaaatgattaagtgagaaagaatccgctactctattctgataaataatatgacatatggggatagtttagaatttcagatcaccttgatgctgctgtagtataggtgctaccctcatgacgacgacaagaatgacctctcaatggataataaggatcaccctggattaaaatcaaaactacgagattaaaagatcagtatgcagtttttcaagacgatatggtttaacctaccagtgttgaaaagggacgcttctctccagaataaatgtgggtataatcttgaacagggtatcttactgtttagaggacgaaaactcagctgatagggattttaaagagaaaacaatatggcaaaacttcaaaaatatattgtattggacgacatgttaattgtaggaggggagcaaacacaatataataggagcgcacatagccagagtggcagcatgaaacagctagcagattttgcagcctagtgaaaa

SEQ ID NO: 78850 - DNA, 1207 bp, Oryza sativa
cggccgctgaggaaattttgtgtatccaatgccacatagccctgaagaggacttcattgcttggcactatgataaggtgggtatgttcactgttttttctgcttacaaattagccctacaggcccagatcagagctgacgaagaggttgcacaatgctcaaatggcgatggtgataggaagttgtggaagaacatttggaatgtgcaagtgccgcagaaaataaggatttttgcctggagagtatcaagagattgtctagccacacaacataataaacatcgacgacagattgtacaaaagccaaactgtgagatatgtggggcagaagtggaagatgcgtttcatgctacggttgcatgcacgaaagcagctgcgctgagggcagagatgcggcagaatcggtggctaccgggggaacaggagttctctcagttaggacctgactggctgctacatcttataaaccgtgccgacgatcagacgagggcgttaatattcctgctgttatggtgagcctggtttttacgaaacaatatagtgcataatgacggccatgcttcagtcactagttctgtggtgtttcttcggagttatgctgaatcattgtttctcaaccggcaaccaagagctgacagaaaagggaaggctttgtgtcgccctgaacaggggaaggagtcaggtccaactcgggcctttccatagcaacgtgtttgttggcttatgtctgtgaatggctgggctaaaatcaatgtcgatggagctttcaatcctgaaaatggtaatggggcacttggacttgtaatcaggaattcgaggggcgaagttctgttgtcttcttggaagtttctcaggcgatgtgtgtcagcggaggaagcagagctgcttgcgtgctatgaagggctgaagctagctgctgaatggattcccatgccagttatgcttgaatatgactgtgccacagcgattgcgaggttgttgtccactactgaagagagatcaagatggtcttttctgctgcgagcagcaagatcagttatagggttaattaaggaagtgcgtttgatgcactgtaatagagagtgtaatagggtcgcacatgaacttgctcagattgctatccgttcggggcaaagcgcggtttggcgtaataatgcaccgaattgtgttatgcaatgtctgcagcatgactgtaatcctgttacgtaa

SEQ ID NO: 78851 - DNA, 4087 bp, Oryza sativa
gcctatggccgccgtcggcgaccataggggcgcgggcgcgccgctcccgtggctgtgccggcgtggccggcttggggcgcgttccgcggctgccatgtggggcccggccgtcagccgcccgcgccctcgggtgcggctgacgcgtgggacccacggcgccggccgccgtaagccgcgtgcacccagtccaccgtggaccgtggggctgccgcgtgggccccactcccgtggacccggtccgcgcgcccctcccctcggctgacgcaataaatccgattttaaattaaaatttaaatgaagaaattcgcaaatatccatttaaagagcatataaacttcaaagggccatatcttggccatttgaactcggaattggaccgttcaagtctctaatttttccttaagaagtcaagaacccatttttgtgctttgttcctgcttgttatttggagtttattagtgtgtaagccttttcttttccgttggtcgtgtagacgctgcagcttcggaagatccgcttttcgtggaagtcgaagccggcgtttgggaaagcgagcaaggcaagtcacatcatccttgagcatattgaatcccagtttataaaattattttgatttaaattaatgcattatcgctttatttaaattcccgcgttatcactgttttatttagccatgcctatttacccttgttatgaccttattattattgctattgttattatttccttgttcaccctagagtaaacaaaaccccaactagtggacactctactcatggcaccactagtttaattttaggtagatgcttcgcaatttaattaggcaacattaggtggttttataactttagactttgggaattctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttccgcctgcctgtcccgggtatcccggccgtaggtgggattgggtcggtactcttgtctaaggctaggatgggttggaaactatgtcacgtcttccgtccgtataccgtggtggtatgtggcgcgtggttacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaacaactaaaatgtggaatggttggcctgggttggcttgggacgagctgggacccaggtcgggttgccagttcggtccgaaccatcgtaggccttgggttaaggcaggttcgtgagggttcacggccttgtttaataatactgtgtagctctaggatcgtctttataaaatggctttgggcaactaagtgacttttaaaggctgttactgcaaaacttaacccctatattattatccccttgtactcctttgcattaattatgcatctccggtgtggcttgctgagtactgtggttgtactcattcttgctctatctttctccccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatgtaataaagatgtgtcttctatatcatgtttgtgtggtgtaccccggcctttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaaggtttactcttttcttccttcttcaaatttcaattagtactagatggtcagctttgcgaagaagaagatgtcgtcagttgtttgccgaagctccggaagactgcaggatccgcttgagaagtgcaggaagcagtgaagccagctgtgaaggagtgaagatcttgggaacccgtcgcagaacctaagccaccctatagggtagtgttgttagtcgtgtgttccttgcttgtgtgtgtagcgcgtggtttgcatcagtgggttgtgatgtaaccatgctaggttgtttgcttaatcaacctgcagaataagcaaaacaaacaacacatcaacaaaaagagttagttcctgtaaggtcttgtccctagttctggtctattctttccttgtatgctttccctctcaacctctaccttgtgacagatggataatactggtaacaaaggctatgggaatgatggatccgatgactcaagaacccaagccaatgggaatgagagaagcatcaacgaaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaggcatcacggccagaaggacataccatcacctggaacgagttttcctctgtattcaggagatcacatgttcccgcgggaatgatcacactaagaaaacgagagtttcgctacctgaagcaaggggatttgaccgtcacagagtacctgcacgagttctatcgtttggctcactatgcaccagaagatgtggaaacggatgaagacaaacaagagaagtttctccaggggttaaaagatgaacttgcagtgcaactactcctagaggattatgaagattttgagaaacttgtggacaaagccatgcaactcgagagtgagcataatcgaatgacgaactgcaagagaaggattgtcaacatcccagtaattccatgtggtaaccaaaggcagcgcactgagccacttcagatcaccgggtcttctgttgtgcatcaagagttcctgctccaagaagacggacgcgatgcagacaacaacactagcaatactaatgatgatgataccaccaacaaccatggttcttgccccattagtgaccactcgaataaagcgtgcaatgtcagtagcattcaccaagatgtcaatgatagtatcaatgttggaacccagaatgacaaccttagcaattttgacactgagaaagactccaatggtgatagcaactatggtaccactgatgccaatgttagcaaggattggcaaccaccgattccaactccaagtcagaatgatcgccctcagacggatagctcagcaaagaagaacgttgatttgctacaattgcaaagaaccagggcattactcgagggactgcctgcaaccaaggcaaaatcgacctccacattaccggcaatttacaagaatcagacatcccaatcctattgggggcactggagcaaacaccgtacccgtgaggccttgtggtaatcaaaaaccatagcagaaacaatgtaccgaagttaagcaccttccctttttgtttaaagcagcgcctttgattcatgtaataaggagagaaatgtgt

SEQ ID NO: 78852 - DNA, 4479 bp, Oryza sativa
ggtgacgtcaacgctgacgtcatcggggtcgtccagccgtgagccggtcgtgaacgttcgatatcgtccgtccgttttggattgaatcgatctcgaccgtcagttcgcgtgaccagtcgccgtgcgcccggtccaccaaaaccgtagcccgctgatgcaataacgttcttttccttttcaaaaataattcattattgcgtcataattcaattttaaccgatttaagtgttttaatccgatttaatcttcaaaattcataactaattcatcttagctccgatttagttggttcaagtctctaaatttttctaaaactgagatctacacattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattatttctattcaactattgcatttattttcgaatgtcattgggtggaattaacctattctttgttatagcccttttgttcttgattactttattccttgataccttgggttataataatttgactggttgaactttatttatattggttcaactagatattagatataattgcttagccctgcttagaaacattagcacactattgggataactataattcacttttatttcatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcggtggattgtgttgtgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgagtctaacaatgtcttttgtgattagtcccacacttctcaccctaatagaagatgctataattggtaataatttgattagctcctggtttggaatggtacattcctggtttggagatagatctgtacagccgggatggttgttcagaatggttgggcctatacaacagggtacgttgtatagtgttggattaatattgtttaattattacttaactgttttattaaattctcaaatgtttgctaaatgctgcttttgcaaatggaaccctattatgccatcctttgttatcctgtgcacttgcatatttgatgcgtggcttgctgagtatgtcatatactcaccttgcaatcattcatcagaggaagagttctacaatgatgctgatggtgtgaaggattaggtgtagccttggtcaagctgcctgtggagtggagtcgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgaaagcgtttggaattttggatagaaattccgggcgtgacagaaaacaatgcataagttgaaataaatcaatagctttaaacaggttcagcatgctcaaagggttgtttgggatctgtgtgacttgccttgctggccttggaactcttcaaattcttctcctgcgaaaacagactctccggaaacgtcggaatctaaacaaaaaggagcaaaatcaccaaaatagcacataaacaagcatgaacagtacatgtggatatttttaacatgtagatctcaattttagaaaaatttagagacttgaaccaactaaatccgagctaagatgaattagttatgaatttttgaagattaaatcagattaaaacacttatatggattttaattgaattatgacgcaataatgaattatttttgaaaaggaaaagggatttattgcgtcagcggctagggtttgcggtggaccgggcacacggcaacggttcacgggaacgaacggccaagatcgatccatccaaaacggacggccgagatcgatcgggtctacggcggctcacgagagacgacgacgatgacgtcagcggtgacgtcacctccggcggcggctcggcgactcggcagctcgggcgcacacgctcgccggcgaacgacggcgcggcggcgcgaacggagggcacccacgggtagcggactgcacgacgaactcaccggcgaccaaagcaacggtggaaaatcaacggacggcgacggcgtcgaggaagagcggcggcgacgatcggcttgacgacgacgacggtgctccggcggtcgacagcgacggcgtaggggcggacgaggacggcgacgagatggcgaccacgatggcgacctccccgagcgacgacgacgactggagcgacggcgaagcacggctggagcgacggcgacgacggcggctcgaggttacacggcgctagggctcttccgatggcgagaggcgaaagcaaaggtggcgacgggtagaggagacaccggggatccttttataggggttgaaaggcggcggcgaatgcccacagcgaccggcgacgagaaggaaagattagggttcgggagagagatcgatccgaatcgaactcgaatccgcgaatttccaaacgaaattagccgacgattccataatagaaaagatagaggggatcccggggatcatttcccctctactgatttcatcgaaaacgaaaaggggccgcccgaattttgaaggagacggcggcgcagctcggctagggttcgggcggcgggcgcccggaggttgacgacgaccctgacaggtggggcccacctgtcagcgggagagagagaggagagcggcggctcggttgcggactgggctgggccggggaggagagagagaagagagattttgggccgactttcggcccaaagccaaaagaggatttttaaaacctttttcaatttaaattatttattaaatgcaattccatttattaaaaatactttcttagctcaaataaatcccagaaaaatctaggaattatagaattaagcaaagtatttaatgaaattttatctggccccattttatattggaatttattaattaaaattagatcttctcttctaggcttttaaaattatttctaaaaattccaattaaacaacaatttatatattttgaattttcagggtgtgacaaacctaccccccttaaacagaatctcgtcctcgagattcggaagaactggtgaacagatgcggatgagctgacttcaattcatcttctcgttcccaagttgattcttcttccgagtgattactccactggactttgcaaaaacggataactcgattcctggttcttctctcatttgtttccaagatacggattggtttttcaacataggtcagatcctcttggacttctatctgttcaagattagcttcttcggtaggtacccttaaacacttcttcaattgcgacacatggaacacattatggactcctgccaaagattgaggtaactctaactgataggcaacctcgtacggagtgcgacacttccgaccatacagtgcttcgtacggagccatctgtagactagcttgataactgttgttgtacgaaaattctgcataaggtagattcttatcccaacttccaccgaaatctaaagcacaagctctcaacatgtcttccaaaatttgattcaccctttcggtttgtccgtctgtctgcggatgataagcagtgctaaagttcagcttagaacccatctcttcctaaagtttcttccaaaaatttgaagtaaactgactgcctcgatcagacactattttcttagggacgccatgcaaacacacgatccttgccatatacaattccgctaaccgacttccggaataggttgtctttaccggaatgaaatgagctacttttgtaagtctatcgactatcacccaaatagagtcatggccctgatgacgttctgggtaaaccagtgataaaatccataccgatttcttccacttccattcaggaatcttcaaaggctgaacaaacccgcgggtttctgatgttcttgcttgactccctgacaaacataacatactgctacgtattctg

SEQ ID NO: 78853 - DNA, 797 bp, Oryza sativa
tataggtaaatctaccctttgtcgtctttttatgattggaagtttgtagtctcttgtcctattaaagcctgtcggtaactttgtttagatagtctcttgtcctattaaagtctgttggtaactttgtttagatatttgtattggcacgtttcttgttttcaacacgagtttttcctctgttgacaagaaaaaatgagctgtgaatctgttaactgttatattcatattcctgcattccagtcgagtccatgtttgtttttcagatcccttaaatattgcctcatttttatttttgacggttcataaaaccaacaagggaacaaatgaagcaagctagagaacaaagcatgccatcagcacccacaacacaacatgaacaccaacattagaccattggagtgttcagtgcctaacatgtaacagaagcttaacacaacacaactttccctgtcattttgtctgacattgcttggcaacttggcatcaggtaacagttaaatgggcttggtcctttgggacaatctgttctttgatccacatggagaccggtaccagcacaagtaagaagcacagatcatttcgttttgttggcattgcttggcatcaggaaacagttaaattggttggtccttggggacaatctgatctttcatccacatgtagataggtaccaggcgcataataagaagcggcaagtcgtccccatgaccaagcggaagatgaaggtgaaaaggattcactggtttctcaacatcttcagcctttggaccaagttgcaacaagaacaaaaggtgaaa

SEQ ID NO: 78854 - DNA, 2247 bp, Oryza sativa
tcatgggaaacacaattgagaaaataccgtaaactgcaatgcaaagaggacattagagaatcacctcccagcagagacatagcgatcaaatgtgtcagtcgggtaggggaggtcctcagcgtcaccctcaatgatgttcaccccattcagtgccaccttctgcctggccttctcaagctggtgtggagactggtctagcagtgtgacattctcattgtccacatgcttgacaatccccaatgtggtgaacccagtgccaccaccaacatcgacaaccttgagcccatggtggtagagttcagcaggctccaatgcatcatccctcatgtcctcggtccaatgccccgggtttatgacatggtcatacacaatggaaaggaacctatagaaccagaatgcttccttcttgtgttgtatgaacctaggttgtgatgctggcctagcagaggagaccgcgcactttggtgcgatatactttacccttgatctcacaccacttctatttctcaaaggaatcaaacctattttgaaggccccaagaatcctaatccaccgggagctctaaatgtagaggaagaaaccatttccttcattgttgtttgaaaacttggatcaaatcacgtatggcttagtgtatcgttgggcaagagaatactggttttatgtacgaaagaatcaacaaacaggaatggactaggtagctcctatgcttcatttgtgaggtttcttggtagatttacaatgcaaataaatagaagatcagtagatcacatatgagtcctgtacgatgcaggagagagggagctagttcttggccatggtaacctcagctgcaagccacaggaacttgagaacatgcaacagccatgtatgtaagcatgtgtgtgtgtgtagtcgtgtacagtatagaccttttttgtgatgcaacaaaaggcttaagcttctattccatcaggaattcaggatgctgatggctttatttgtcttcatctcctctagttgctccattgatggggcatgtgggttggggattgtaaacctatggatgacaattctggacaggaatgtatgggggacttgctacttggcatcttgcagtccttttagttctcatccaaacattacacctaatttgtttggtttatgctacataaacagctttttttttggaataacacaaattcaaaatgaaagttacaagagctgcccataacagtctaaaatacaagtatcatttaaagtacccataattttcagttctaaggaagattaacagcatatgtgtgattacacaattacttctgcaagtgaaaatattttattgtgtaaacttatggatttctttaagttcacaaactaaaatgggtgcaaatgttaccaacttaccatagacaaaacccatattttggtaatcctaatccacataatccaaattgataggtatacacctctcaactctaatgtggacaaataaaacatgtttatagatcttgctagttaagtaaaaagaaaaggctaacagtgacacctttctgcttttaatgatctgtaaatgactatatatctttagtgccataaaaaattctctatgagataaatatataggtctacgaccaaggagaactcatgatcaaccaaagtaaattgagcatacctggtcaatgtgaagaggaccatgaacaacactggagcagaaatcaagcaaagaattatatcgcatgagctctgatgaagatatacatcacatgggtacatcacagaaggggcagcaaattcatttataattgatttaccattactccaaagaacgtcaaggtgacttccttttttacattcacatggcaaaggtaggaaataaaaaaatgtgtaaaattggttagtgcggaagttcccaggagctaagattgaatttgtacaactatatcattcagagtgaagtaatacttttacagggccctggaagctgggacaagtttcaaacataattcctcaaaaaggtaactaaaataccactttcagattacttgttgagactatggaggatcattcaggatttagtagagtgaattgcagcttggactgtctcttgttaccatagtttcactttgaatccgctttaccttttgcttcactttgaaccccctttttcttcttctccagctctggaaatagcattatctcctaggtcacaccacttccgcggttctgcagccgctgccataatactggcagtggatatgtgcctga

SEQ ID NO: 78855 - DNA, 710 bp, Oryza sativa
tatggcacaaatctttctgtgaccactttatataggagtatcccctactagctacctttgcagcaaatttcagagtccaactgctgtcatttctgaacacacattgcatccatccatccttactactgtttttgtttttgtgagagggattaaagtttagccccactttagtccctccaaccaaacaccaccttactgctgttctctttacctcatgccaccaatcacttgtcgcattgcctcttggaacctagagtatggactgcaggagacagaagcttgggctcataaacccaagccaatcatttggagatagatactgccatggctggctgcaaacaagaggtatagctaaagaaaacaaaacaaaacaaaatgcttactactcgctctgttccaaaatacaccatccgtcctagaaagaataaacttctaggctcagaagttgttgttgtctcgtttaaaacaaagggagtttggagtattaaggatttataggttgtttagaaaatactaagtttagggcaattttttttgtcattttagttgtcaatttttaaattttgaattgcatagattctctttccaagcatctaattggctttggaattattgaaatgatgggaattgtagaaatcagagaaggaatgcttatatgagtattaaaaactaaatactagaaatcctgatattttgaaacggagggagta

SEQ ID NO: 78856 - DNA, 7502 bp, Oryza sativa
  unsure (1)..(7502): unsure at all n locations
tggcacgcttttcaaactgctaaacggtgtgtttcgtacgaaaactttctatataaaagttgttctaaaatatcagattaatccattttttaagtttgtaaaaaataaaactcaattaatcacacgttattaccatattgttttgcgtgaaacacttaatcttcatcttcaggagattcaaacaccaccttagtatactttaaattcaaaataaagaatctataaggcaggggaaagtgttttctaattgtagattagattttttccaagcccaatcgtaaaacaatactaaaaatatctaaaaaagtatcaaattctaagacttggaaacaaacttcaaattataatctgtagctgaaccacgtgggctcaagatcttaattactaaaagaaaaacaaacttcctaaaggacgaaggaccattgactccgtgaggtacgcaagctccgtcaggacgtggagcgctcctcctcgtggtcgagctagcgtcgtctttgcctcaccaacaggggggctgctagctggcgcgtgcgcgccagaagcgagcatctctctaactaatctatagtagtattagttaacacccacttaactactaatgacgagtaattagaaaaagattgtcaagattttttatttttttgggagatttttttcaagtcagatttgaaaacttttgatttaagatttaaattttaaagtcaaaatttgaaaactttctactcggatttgaaaactttcaacccgagattttgaaaactttcagctcagattcgaaaactttcaacttgagattcgaaaactttcaagtccagatttaaaaaatttgaaaactttcaacttgagattcgaaaactttcaactcagattcgaaaactttcaagtccagatttgaaaattttgaaaattttcaacttgagatttgaaaattttcaactcgagattcgaaaacttttaagtccatatttgaaatatatgaaaactttcaactgagatttgaaaattttcaactcgagatttaaaaactttcaagcccaaaatttaaaaatttaaagttaagatttaaaaataactagtaaactaaaactaatcactagtaaaaaactaatctaaactaattacgtggaacagcgaaaaagaaaaaaaaagaaagaagcagcgaaaaagccgtaccagcgaaaaagaaaaaatagagagaaaggaccagcgaagaaaaggagagcgcgtgcgcgtgggctgcgtgggccggaaacgcgcgttggcggcgcgcgctaactagcttttccgcaccaacagatgtcactcagccatggcaagtcggcagctcaacggcgatgtagaagacagaggtatatggggtattggtgccacgggacagctatggcggccgccacagcatgccacaagggagggtccacccctgagtgaatatggtaacatatatttatcggaatatgaaaaaactctaattgagcttgtcaaatcaataaagagatgtagctcgttatttttttaaaataataaattgatatttctattttttatcaattaataataatacaaacagttgcacatttcacttttaaagagaactacaataagtaagaactatattcatctatgacagtaagtagtatggcatggtttaataaaaaaaaaagtacttcctccgtttcacattaacattaatatgaatgtggaaaatgctaaaatgacttacattgtgaaacggagggagtaattgggtaaacgaaaaacatatctaaagcatcatactagaaaaaaaatacatgcattcaaataacaacgtcaatactcagtacaaacgtgaacatctagagtagagaaggttgaagctaattagctgtatatgaagagtaattcatttatgatcccgaggaaaaaattttttggaaagtttccgatcgttccagattccgacggatagtagtcttaacgtattcgtttctgtttacgagataaaaaaatcagaatttgtttccgtttctgaaattttaggaaaaatttcaaccaacactttctgtttccagaaacatgtccggaaaccagaaacattctgaatcattttcatccgtacctaaaaggaatgcaaactaatcattactcaacattaattaggaacccccaaccaggattagggccaatctctttggaatggttaatggtggatataccaattaagaggtatggtctctaatatttacatatccaaacgagatcttaaattgttatcaatatttatgccaagttgatactttaaagtgtgtgtgagtgtttggctatgtgcatgttagttatgcagagcctangattgttctcagtacgatacgatagtatcaccttgatgtacttgacaagcttcctttatatcaaaaaaaaataccaagttgataatgtaagctgtgaactagctagcactaacaaacaattacaaagaattaaaagtttataccttgaattgtgaaatatgatcattgtatatggaacatgtttgatgcagcaagctaaaaaaaatacagaattatgacaggttctgaacactaagcaggcaggaaatcaaactggtgaattatgaaatgtgagcaaaataagataaaggaacgcatgatatgaggttcttaacgattcactggtttatccatataatggccaaccacacacaacacaagtaactaggactccacaatcaaaaataacatccacactctggacggacacatatagtcacaacaaaatttgatccactccaattaaaacacaagaaaacttatttgggtctcaaacgtttccaaacagcaggcacagcttgcaacacttggtagtagtttcattcagcattgcatactatttgcagaagcccctcagccttcagttctaatagaagtcaatattgatggaacctccatggctaatttagaccaatgccatcaactgattggtcgtgagtttgaacgaccaattcacctaaagttgaaaggttcagaatattattaggaattcaggtttctagaaatgatagcacaaggatatacaagactacacacatatgtgtcatggttaaaagtggtatatacattttttgaaaaggcaaagttgtatatacattttttgagaaggcaaagtggtatatatacaatttttgagaaggcaacgtggtatatacattttttgagaaggcaaagtggtatacacatacaatctaaaatgaatgttttatgcttccttgctatgaaaaaaatcactatattaatttctagataagatggcaaattcattcgcataagtatggtcacacaaaaatgtgtgatggtaagagaagtaaaataaatgtcgcaaagaaagaacaagtaaccctattctattagaagctgccaactaaaggcctggcacattggagccccaaatgagagtgtttgttcgaatgttaggaaacattggaaaatgaagaataaccgtttggttaaccctaatgcaccaataggcccaactcggaagaaagaaggcatccatcttgaagaaagaaccacccatcagttcaagatttaatagtgacttgaagaatattggtggcacctccattaccactcttttactaccagattttctaaagttgggcatgcgttgttgagaggatcaaatatcgtttcatttagagcagcattagtcagctctcgagttttaagataccaagaactgaactccacaagttttggatccaagtagaaaggttcccatctttcatactcggcaaatttaaccactttagcgttgtgcttgatagcatgattgacccaagaactagcacggtcaatcgcaaaagaatctctcttgaatgtatccatgggagcatcaagattgtcacggctaagcaatagtttgttaatagaactaccaaaaatttccctatctaggcaaaaccaatttatatcaagctgatcaactgcaagcaagtcctcttgctgacccaccagtgggacgggacactagttcgcaccgcctccttcatcgataagaaggacattatgtggtggattagattgttagggagttcgctgatcctaccttttccatagggattggagggttccttgtggcctgcagtgtataagtggatactctgttacttagtgtaagtacatgatctttgagaaccacacaaacaactcgcaacaattttacaatttttatgtgtgctgaagtctagcttcacagagatattgctatcttaaatgcactttacacaaatgataaagaatttcccttgggtagctttgagtgttttcttagaacagtaaggaggttgaggctcacacatcaatcaagcgttgcatgagaataacaaatattcatggtttttgcaccaaaattaccaatgtgtaaaggacacaaatatgaaaattgctttaactcaaacaggggaatcgggttgtggatttgcaaattttattggcatatatttttcatgcgtaaagcattccagaagattagaatcatgtgtagactatggagaaaatacatcatgtaggcaccataaaaaagaacataccactagatgatgtcccctgaacatttccttgtgcatggataatttcgccatgcttattcttctcatggagcaagacaactgaaggggttgaagcttgctttcgaacatgaagaaaattgttcaacagcacaggatatgaatcatccaaatcgccttttataagaccagtcctccatagataatcactctaagtagtgcgagaaagaaaaaaatatgagaacttttattaaaacataacatcctatattgaaccataactttatgaataccagagaaagcatacaaagatagcaaattaagagggcatgtccacaatctggcaagccaagaataagtgcataatcaatatatgaaagaatttatctagcgatacacgtataagcgaataaatcagaaagtgatgattctatccacaatattaaaaagaagttaatcgaaaggggaacataaatatttggaattgtgtataaacgaacactttaattaaatacaacctcagtcctagtgtcttccgcgctacaatactggaatagtaattaattttttttaattagattgacaaaatttgcatagaacatattgcaaccatatgttctcaagtaagatggtcatcctaactgtatcacacaattgttatagctctaagtagttatagacttcttggcaataagttgtactcattcaggagctttgagactttgcaataatcaacagatgaacaaaattgctactattaaggttaacaatattacgtgcattaagatacataaaaaataaaattaatatctaaggaaattatattgcttaaaaaactattaagaacaaaccgtcatacaaagtcaatagctattttgtagattctctcctgtattctggaagccacattttgaagatcaatcaatgttgttgaagtagttgttttcaatttcatctgcaggcttaccaatctgcaaagagaatgccgaatattaatatgagatacgtaaatatttcactatggtacttccaaccgaaataatccaaaatatggttctaatataacaaacaataagcagccaggcaattgatggattggggtagcatgcctttatgcaagaaatacatgcctgctatgtattcactatttgagaaatgcatctttgctaaagtaacatgtttggaatcgcagatacattctcataaatactgaaatatcatttgtccaaccagaagtgtcatcttttagcaaagttgtgtcatcatgcgtgctaatagtttggaggagatcattgataaccaataacacggaggaattataaatactacaaacaaaacaagaagaatgtgtgaacatgggaccatcttcttcatgagttttaccacctacatccaacaaaaaaaaacaacctaaacctacaagtattatctactaacagatcttccctattttttggagtagctgcatcatctcatatatttttggttgtgtaaggtggactcagttacacaactgcacaatcaacaccatgacttctccagttcttcccctgttcttcctcttccctaagagttttaacacctaatttaataagctagcccaaaaaatttgaaagacataatatatagactatgtgcagcactaaaacactagtccattaagcttagacccatgcaaggagctggccacaaaatttagtattgaattatcgacatgcaaccttagttcattttattttggcgacgaatcattaacttgggtcattttctaaatatgaaacaatttaccttttatatttgagtacaatcaaaatataaaaggtttgaatccaaccaacaaaattttgccaagaacaatgctttttgggcgatctgggcctgtggtagggctagatccttgtccattatagccagagccgaaccaaacactaatagatcctcggttttttaaaagtgaagtgcgtggatctgctccaaaaaaagaggtagaaaaggtggagctaccttttttcagatccacaactccagctccatgtaaaatttggagctctaccaaacagatctatctgttacttggagctagaaaatgtcaattggatctgacttccggtatgatgaattaattagatcattaacaagtatagcatggatgatggtttccaatcttgataaatcatcatcaattgaagactctataatcaatttctcatgggaaaaaaagtaagaacatgagagagagagagagagatgagggggagtgcttacatatcatgtgttaccctatcgcgaatatcctggccaaggcgggtcctccagtcgactccttcgtcgataatccctaactcgtccatggtgtgcttctttggttttgttaggcagaagaagtgcccagagaggggaagaacaataagaggtcgatgatataggtagaattgaatcttataggctttagttgttggtgggatccacaaaagaagtaacgcttccatgggagaaggttctggctcacatgacatgacaacattgcctagcttataacacgggagaggggtatggcccacatgatgtgacaacatcacctagcatataacacgtgatgtagcttctagaaccttgacaaaatcctatgcaaaaaagttttgtggcaattgatgtccaatatctatgagtcagaaaccgagaccaaaaatcaaaccaaaaataaccaagatcaaacccaaaataaccaagacaaatgaaaccgaacttctttgcatgggatattcagactaccgattctattcaagccttattctaatccactcctcattcctcagccagtcccttgtgctccatcaactgccacagccagcaccccttcctccattatggtgcttctctccctcttcttcccgcctcaaaatttcttgagcgtgcctcctcggcttcaatcccatcttgggcacaccttcttggctgg

SEQ ID NO: 78857 - DNA, 938 bp, Oryza sativa
tattgctagtgggtgatgatgtggtatggttgcatgttgagcgcttagtaggctataactttatagaaagtatagattagtcatagaagcccgaaatcaaaggtcatttatatttatattgtgtgactacatgagtctagaattgatgaggataggggcacatttataattttttatttagtggatcgaagaatgaaaaatatttaaggatgaaaatgcaatagtgcttgacaaatggtctggcagagccagggtttacgatttcgagatggccttctgtttcgggctctagcggaatgacggttttcacgaaatctggtggacaacctgtagattccgaacaaatttcacaaaccaaaatttgaatacaaattttctgagattaccaataagctcgcaaaaaccggtcagatttggcaaaattccgagcaaaatcatcgaaatttcaatcggtaactagaaaaagaggtaagtatttttttaatttcattattcttttctttcctactgtaaattaatacattattttttaaaaaaaaattatcccataggttctatgaagatcatactatttataagatttttttctcttttttatcaattcaaatttaaatttggatgaaactcattcaaatctcaaatggtttctacttttgagcctcgtcgaaacgtcgaaatttcgtgaaattcgactggttttcgtcggaattatgaacctgggcagagccgtccatctattctccatggagacgttttcagaacttttcccgtccttaattcaacatttatctgtgatgtgatgtacgccacgtggtccaatcagacccaatacaatccgccggcttgagaaggagggatgatgatatgtttagctgacccaaagctaaacaatgcaaaaaaaaattctaaaactatattttataagttaaaattgaccg

SEQ ID NO: 78858 - DNA, 4268 bp, Oryza sativa
ctgagggcagcctcctccctttagtctcgatacgccctgacctatatcaccaataataaccggggcagcccgaaccccaagcacggagggggcggctgctgctctaccccgggcccgactccctcgggggaatgccacatgggtactgagggcagcctcctccctttagtctcgatacgccctagcctatattaccgatagtaacccccggcgttaaccctagccgaacccttccatgagtggccaggtttgacgccattcttctgatccagtgacatgtgtgcctagtattttttgagtcatgacacatttccgcgatcgcggcccagcgcgcagtggaaaaccgcatccctggcaatgatgggccgtcacctcgcaattgccacatcgcctggggtggcgcgcggagcggatgcgtcagtggcttcgctagcgaataatgatggcgattctgtcgtaggctctctaaccttccattatatttgagagatgatgtgaataattcaaatcatcatacaaacataatgaaacatctgacgcctcgagagaagaatattagagacattgctgggcctttagcctgccagtcaactttagcctgagatgtacccgtcaatccactcgaaggtggcgaccagatgtgttacacattcaggagagctgacaaaaatggctaaagatctacaaacatctcaaatattttttaactcatactcatgtgaatctagttgccaggatgtgcactagattcacactttcatcttaagcatggacatacatagcaaacacaattaagatgaaaggaacttaaggacttacaacaactaaatagatacataggccgaccggcaaatagacataaatatagaacaacggaagcttgactacccaaatacaagcacaccgactaggggtataccccatcaagttctcatcctagaagaagcaatcgaaacatgcatcactcaaagactaagtctaaatcctgcaagcaaaagtttattccaacagcaagagttagtatattaatcaaattaatgtattggcaagcacaagacaatcctaacatactacatataaggcatatattcaaaggaaggcattatgtagtttattttcggcataaagaggttttgtttcacaaatcttttgtaatggagtggcaattcaactatcaaaaacaagttttaacttttatcattaagttcatcataattccatcataatcaatctcttgttgtcatccttgacaacaagtcataatatatcaccacactcacagaactcaacacattttatcaatttcaaaccaagttacatgttctcattttaaaacatagtctatactcataacacttcaccaaagcgctcatgaccgtgagcatggctaatcgattagtttagagaattccgcagagtttgtacagctttacccacatgatctgaatcgctctagtttggtcggtacccgtcggtaccaccatactatacgcattaagtacattctagaggtcacaacgaagccttcacactacttagaatctagccttgcaccagcacgatacgtgttcctccatcctagacattcttggaatatgtctagaaccgctaagtagcaggcccacgccttaaactaccacgatgggaacccaccacgtggcacaataccgttgtattggacatgtttagtcacctaaactaccactttggggtaaataggaagctcctctgaattattccaactcatacacaccggcctaccagaatgcaaggctagttctaaatagattaatcagcttagtccatcccatactagcacatgtggatgtacgaataactttaagttggtgacacaagttcagtccttacggactcgggcaaacactccccctatcggtatgcaactaacatcatatgcacaccacttgccgcccaagtctaaaatcacattttacttattttagttcacaaatacctatcatattcattttattccagcaaaggttcatgcgtcaaaatcatattttaattatagatggaatgagcatttgcatgtttctaagcatggctaagcaagtagttggacatagagcatatataaacctatttgagcacaaagagtgtactctaaccatttctaggggtttaagcagcaaggatcacaattattgaaggtagggtatgcagcagataggtcataactaccttatcccaattttaaatatcggtatagtttaagttcatatgcaactttgcaaacaaatattttcattcctcaaatcatgggattcaatgtgttcaaaggatgggaggagaacttgccttgatattgagaaatgtttgcacctaatccattccttcaccgcttatgcaattatctaaataaaatacacgttatgcaattaaacaccgaaatagtcaaaaatctaaaatgctctaaaatgtatgatttgtgcataataagtaggtactgatctaaaatgaacttaggtgaaagaatttccattttgtctcattccatttgagagttatgaattttagaagttatgtcggtatgtagtagtgtttaattaggcagtgttataaaatgtttctataaattgattttaattaaatttgacttcacagaggtgaagagatgagttttctaagactagaacatttggtttcacaatttttagagtttctatgaatttctaatgtattttagaagttacaactttttatagctgtatagtgttatataggttcatggctttagaggtttaggtccagaacttgtttcatcttgctagtgatgtttaaaatgaatgatttagtctactaatcaaattttagttcacaaactttgagttgatattactctactacacattttgtaacttagggaatgttctatgttaatgactttacatattaacctagagttttgttacacaagctatgttcatctaggttttagtgaatgaggatgaatttatagcttttctggtctaacaaattttagttaggtttaattagagctagactacatctatatatatacatacctatgttttgcttaatcaacactatatgattagcaccaattttatccaattaaggttcagagctataatttgtacaaaaagtgccacattttactttactaaatttaagttcactctttttctgactccatagaaacttggttcactctttctggactaaggatgaattttctataagttgtacaaattaaaggctaccccaagttggttatttccttatataaatatttagatgtttttattatacagaaagtttatatttttattttacaacttggaaatacatgttttggtgactctacagaacttgagtttactcaaagaggagttaagatgaattttatatgaacttctaaagtttaacttatctaaaacttattattttaaagataatagttttaaaggctttggaaaagaagtaattatatacttttatttctcctaatcagagagtgtaagttgatgaatctgtggaacttaagtttgttcaaaactaagttgagatgaattttatatgcattttataaatttctatattaaatttaataactttatgaatctacagaagtttgaatcatctcaaaatgagctatatttaattttatatggattttacaagtttaggtgttttcttgatatcaaattattagtttgtgtatttcttttatcctttttccagtttttaaatagttgggtccacaagtcagtgagagactaatatgcaggaaggcccttgaggtttcaaggaatcaatctgcagtccaaaatgtgcgatgaaccaaattcattaagagtcctcagattcttttaattcattactaattagtccgttgtcccacatgtaagtctaacatattttacattttaaaccttacaagatttaaactttctctaaatgaggttctcagtgcctaatgacatggggcccgctcgtcagtgagacggtggccggcggacagagcagcggcggctcggcgagtttctcgccggcgccggcgatgaacggcggcccatgtcggtgtgcatccaaaagagaaaaggtagcctacataaatgcgaacccgacggtatcctttttgcgagctgcagtggtcagaatcgatggcaatggcggcgcgagcggcggcagtcctcggggtgacgatgcaggttgatttagaggtcagatctaggtgaatggagtgcatgcatgtaactaataggtctccaggatgctca

SEQ ID NO: 78859 - DNA, 11795 bp, Oryza sativa
atcggctagtactccgatactactctatattaagatatgaaagtggatgaaatatactgaacaggaaccgatctaacatcaggatggcctaatagattgatagcaagcttaatatatttcaaacaaacgagatcttagtatagaggacagatttagcatatcaagcaaacgcaagagcgacaagataactaaaccagataagatcggatgaaaacctgatgctatctctattagcaactatagacgggctagatattgcaattccaaacattactcgatatagatcaaactcaactgatgcagcattaagtcatgaagagaagtgcaagatctaaacaagtcgatagaagctcttctgagatggtagatacgctatataacctaattcaacgtcgataactaacttgccgactgttttcaatgatagaggctagccgatggggttggataacgatattaatctaggttatatagcatatatgataactcggcgattcacataggcaagattagagtgtcatgatgatgtaagcactaatcccgagaacgcaaaccgccataacaagccttacctcttcgtcggagatcgagaccgatgtagcccaactcgaaagcaagaattcgtcaaaaacaataagagtagaaaaagggtggcgatgcgctgaaagtattattgaactggtgttgtttgtttacaaggcatctggctatatttatacccgaaatagttaatatatccttgctggacacgactttatctctattacaatttaaaacacgaacaattcccttagacggactcttatcaaaaaatatatctaagggaattaattaaaaacatcctaattaatagatacaattgccttctttggacccaatccttgtatggcaatatcggcgtagtgtcttaccaccttgaaaattcagtcaacggcttgattgtctagatatcgtgtttcttttcatacttagtgctgcatcagtacattggacctactaagtcatgtttagaaccatgatctctagccttcttcttgattgctaatatggtagtatcggggtttcagctgatcttacctaatatatatgtttccttatctgttccatgtatattttccatctatatagacatatcacctaatagtaatatatcaagtctaggtcatatcggctgggctatcaatattggctattgacctatatttggtatattactatagattgacttgcccatatagatctgtactagagtattagctagtatattatctttcttgctctaatgtcacatcggctattttaataatattgtcttaagcttctttatcaatcttgatagacagtgttacaatcgatgatgtatatttagggtttaatattctttgatatatctattctatagccgattttgtctaactccatcggctgagaccaccaatgatacgttattggcctatcgactgactaactctgcttttgtctttcttgctgattgtaggatcaaattagctggcacgtccttgacacactcgagactagccttggacttacactggagttaagcagatctcctaggccaccgtattttcacgcaagcaccatggtagatggttgttctggtctagttggtcagaccgagaaacaagaccgaactatcagaatggccgattcacacatttgtgctgacaagtgatcagtcttccattttcaatgaccaaaaagactggactgaattatcagtaatgatggaacaacacccctggaaatacctatcaacaggaagttgtattccagcgtggttcttataggatagtacgttgcggtgattaatgaaaaggaaatgactgagattaattatccctagaggtattgtttgaatatgtttttaaccctgagctacaaagcaggatgtttccaccccaagaatagttggtgtcgccatagttggcgtcatgtgttcatctatatgtgcgtcatgagttggcgttgcattcttggcaagctgtcacaaaatcattatccaggctgacatgcacaatgttgtcataatgaatatagatctactacagctactagtgtcattctcttgcacgtctctccaaaaaccagtcggaatggaactggagaggccaacatgcgacacgatgtgcatgcggacaaacacgcacgagccgcttccctggcacatactgtggggggagaggggtgggggggggggtttagaccacacatggttgccacatcacaagggatacctccaactggtttggatagacccagtttttgaaaggagttcaaagtgaaatttggacaatgtatataatcatgtcaaagaaaaagcatgttgaaaatcaaatcatttagaagccccgaagcaaacatagtcatatatagaaaaaaaaacgaaacacagatgtggttatgcttcttgtggtagaacttatcttatccactagagttaagttctgtactttgacattgttacgacgtaacaacgttggtttgtgtgagtatgagtcttttgtcttttttgcaatcgccaaccttgcacgaaacatatttctttacacaacacatgtaaaggggattggtctcacttcataatagtccccttcaacaaattttgccaactattcgaatgaaccaattgcctcagttttaaagtacaagcgtttcaggtagaatccaattgacaggaaaaagctaaaatcatgcggttttgtgttggaaaaaaatcacaaagataagattaacatctcgaggaatgggatttattcgtggaatgagcatacgctagggttcctctaccaattttcagatttcaccgacgatcaaaaagaatattgtttttcagaaatttaatcacttctatattaaaagcactccatttgctgtacattcgggtcaacattatccgtacaatttatacagaaaaaaatgcaaaaaaaagaatgaaaaaaatattatgcaaaattcatcacatgtttttctaccaagaggaatttctaatccctatgactgtcctagttagttgttaacagtgaaatttggtaagctccgaagtcatcatcggcctaaagtcagtatcggcttcagagtcctagaatcgaccgatgggaattattaagtcaccaatagtcggattcttagtagattcggttaaggaaattaatctactaaaggaagtttatccagaagtgaccgagttcaaggaggatgcggcataacagtttatctattaattaggaatattctgttagtttccttttatctttaggaaagtgtgtttagtgtccgataaggagtttatgttttcctttaatctttaggaaaatttttttcttttccaacaaggactagtatctacccataggtataaatatgtatacccggggtcattgtaaactatctccacgaatacaaattcagcgcatcaccatcctttttacttttctactttttcgacgagtttatacttatcatggctgtttgcgttggcggggctagggcttcaacactctgatcttgtcaatgtaagcacctatctatcatatgtagtttggtggtttattttacttgtatcggctaagattcgtattagggtttatgctggtatcgactaaattgctttaccaaattagtttagctaaggtatctaccaccctgaaaatcagtcaagggcttgattgtctagatattatgtttttttttcatcagccctagtcgtgtacataattcaaatgtatttccattcttcaaacaagctatttcttttaatattttagtattgcacatatatcaaggagcatgtcaatgataatgatagtacggccgctcaccactctatgaggaaagtccactcttattaattatacatatgttgcatggatagttgtatgaggacgtgatggatgcatcatatcgtatttatgtttgatgccaatcattggaaaataaagagtagagatacgcaatgttaattttcaccccctttttatatgcctaattgtttaaacacacctctaaatgtgattaattgattaaaacaacacaataccaagtgatagatttcagtaaaaaaagaaaacccttttcttagacccttaaaatttaaaagaggcccccagaggttttttgggtttgttttttcttaatcccagataattgtcatttgtttccatttcgtaacaaacatacatttctttctcatatagcaaataaagtaaataagtagctaggtaatcttaacacgaaactttattccatcttgatcattgtttcttcatcttgccaatcatatgtagttcagaatacgaggcagatcaacaatcttgactggcttcagaatataatcctttgctcctccatccaagcacctccaacaaggaaaaaaaaagaaggaaaatggagcacatattaggatccacttgctcagattgagaatttatcaactaaggaaatcaaggtatatgtgtttgtacttactttctaatcctttctgggatgttatcagaggaagcaattaccactgggagatgtgctagtttaggtgatttctataagtaaaaacaagtccaatttgaacatgtaaaatatttggtagaaacattataaaatatatatgatgaagattaacactatactccgatccgtgatactattgtacgcaccttcacttccatgagtaagtcatagccggtcatgtctggcatacagtaatcgctaacaatcatgttcacatcatgttcctgtgtccatcagagataaatacatgtttgttatacagttgtaaataacattacctaataaacaagaagagaacttttaatttaccgaatccaaaaacatcaatgcttgcatgacactttctactgcagtcactgcatatatcaaacatggaaacacttagttaataatagtcaaaaagaatgtcagaagatatcaaacatggaaatacttagttaacaatagtcaaaactcggaaacttgcataacaaagaacctcggacgttatggcgcattaaggccatggaaacaacatggcgatcaacaagggtatcatccacaacaagcacatggggggatgacatcgcaaactgttggtgtagagttactttgaattgttgttgaggaaaatggacctagaatgcacatatttatagtgcaaaagtcttaaaatcttggagatatttcaaagatataatatcaattcactggcatgaaaattagctgtcatatcttacagtatcactagtgactgtatatttgataattttgatataccatacaatgcaaaatgattgatggctttgtcctctttcgtacccatagtgttgttcatttttcacaaattaattatagtgaccttgcaacaattatagctacctaggagcaaagatacagtctaatgaatgagcatatattttatatatctgtattgataaatgaatttgccctatttaatttgtacttcctccgtttcaggttataagacgttttgactttgctcaaagtcaaactgtttcaagtttaactaagtttatagacaaatatagtaatatttataacactaaattagtttcatcaaatcaataatttaatatattttcataataaatttgtcttgggttgaaaatgttactacttttttctacaatcttcggtcaaacttaaagcaatttgactttgaccaaagtcaaaatgtcttataacctgaaacgtagggaaatatgtcaatacaacaaagaggctaatagaaactaattaattggtcacactctggtttgatagacggcatggtactaaatgaaagaaaagaaagcaagtgagcagtggcgtactttggcatggcgtggtccttttgtccgaaaggcccacctcgtggagctcttatcttctcctctatggtttttacatgaatttattctaggaataagttcatctgaggtcccttaacttgtcaacgaatccgattttcgtccttcaatccaaaaaccagatacaatgggtccctctactatcaaaaccaatgcagacaaggtccctcggcgatttagatggcggttatggctgacgtggtgcctacgtggctaatttgactcggtcttcatctgacgtggcaatgacgtggcgctgataaaacatgtgggacccacatgccagtttcacaccaaaataataaaaaatggatggacccacgtgggccccacatgtaatcctcaatccccagcggttgctggtgctcctcttcctcctccggcattgctcctagccagcggcagtggcggaggtgagcggtgcctctccctcccccgggaatccgccgctgccttaggttccaggctcctccctcgccggcccaccgcctccatcctcctccccctgcaccgcctctgccgactactcggcgacgccggtcccgtcctccccaacaagctcatctgggtgattttggcctgtctcccggtgaaggggctcctccgttgctacgccatgtgccgtccctgggcgcgtgtcttggtgcgggtgctgctcagcgtaggctgcgtcaagggtgggcgctaggggcaacggctggcagcggcgccgtaggccagggccaggcaggcagcaggcagcaaggtttgcctcatctctcatgcttcgtgatggatcagatatctgctactgctatctctatctgtatgctaaagttgttcatatggttggttttttatccatatttctgccctgctttagtgctgattatattgctggttctgttttagttacctttgagatgtgcctaactgcctaattcatttgctattgttttatccagtgagaccatggaacaagaacggaaaggagaagtttccagtgcatgtatacttacaatcataattctgacagtgggtttgatgtccataaaatctttgttaagaggagcagattccgggttctgttgttaagaggagcagattccaggttctgttgttaagaggagcagattccgggtttgatggatgaaaatgaacgtgtttttcttattgggtctccctgtttgatcatgtgcagagtcagtggtgataatgccaacttttgggttcataatgagttcatgacgatgaactagttgtgtctatgaattatacctctgatggaccgacgagccagtggaaaaagggaatggtgagggcggcgttgaactcgcaggcccaactgcccaacgtgtcggcaggaagagcttcttgacgagctcttcttcttctccttcccgccggagctggagatgacggcgtacttcttgattttgcgtgcgaacagccccatgaaggcgttctccaccagcctgtcccggtattcggtcttctcccccatcggtgctggtgccgccaccgtgaaccgaaagccgctgccctgatctagttcggccgctgctccctcgtcgcccgccgcttccacgacctcgtccccctcgacgactctgtgctggtccgcgtgactgcgtcatccgagatgaccccgcgccaccgtcgtcgtcatcatcctcggcggcagcggggactggggagaaggacgacaacggctgcggcgtgaggagaagcaccgacggcgcggcgtgacctctcactgccggattcccgggggagggagaggtgccgctcgcctccgccgccaccgctggataggagcaatgctggaggaggaagaggagtagcaccaagccagcaaccttaggggattgaggattacatatggggcccacgtgggtcccaccattttttattaatttagtgtgaaactgacatgtgggtctcacatgttttattatttttttggatcgaattgccacgtaagcgccacatcaatgctacgtcagatgaagaccgagtcaaattagccatgtagacgccacgtcagccaaaaccgccatctaaactgccgagggatcttgtctgcaccgattttgatagttgagggacccgttgtatctagtttttcgattgaaggacgaaaatcggattcgttgacaagttaaaggacctcagatgaacttattcctttattctataaggcccaccttgtggtcttatttttgtggcgactcgaagctgcgtttcatccttcattgttttccaaggctctcctcgcgtgttccttctttattcaggtgtttaggaatggaatcagatggggatggatgaatcagccattggccatctaaatcgtggtgtttatagataagaaaacattgggaacatggcttcattcgggaacaatggtgatcaatggcgtctcctcaactcttgagcatatcgacacgttttcagatgagatagctgcaataggatacagtcactggacaaagtgtgaacactggaattccaggcaaatgcacacagttcagtgaacactagataaattatctcctcctttatgttttgtgatagttacatgtgggagttcgtcacaactatagctggagttctatgaccaaaatacttcaccgccatgtgctggccctactcttgttttgaataatgccttgtttacaacgattttgtcatagaatctcatacctacggatggaactagctaccatggacccatgaggtccatggctaccaagttctatgacaaagtactttgtcaccatatgccaacccaaatttctaaattgcgcaacatttcagatggccatgtttgccatcgtgacactttttgtgaccacaaactcaagtttccactagaatcaaccgagcctgaactttatgattatttattgaaaattcatcagagattaacgatggattccctttttatcacagtgaatccattatagaaggccaaatctattgtagtcatatatgtcatgggctgaaaaataaagagagaataagggggtcttgcaatggcggagatagccataaaagctgcgactcgtgaagatgtaaagtttgtgatatatcttaagaaatttataatatgagcataatatctttcatcctcatattttgtacaacaaaaagcccaatagagacatactgcaactcccacgtaacatgtaacaggatgtttagtgtcacatgactgcacgacatcataggatagtctctttggaacattggatatatgaatttcaatggaatatgttgtaatccttacaacatattcaaataagacattaaaatgttaccaataatatgagctgtcaactggccaaccctaacaaatagttgctagaagtaacgactgtgaaataggatcattgtgcatttgtgcatggaaaatgtttgatgcagcaagctaaaaaccaaccataattatgacaggtctaaacaaactaagcaggcaggaattcaaacttgcgaattacaaaatgagaaaaacaagataaaggaacacatgatatgaagttcttaacgattcactcgttcatccatataatggccaatcacgcatagtacaagtaaccaggactccacaatcaaaaataacatccacactctagactgacacatatagtcacaaacaagtttgatccactccaattaaaacacaataaaacttatttgggtctcaagcatttcaaactagtagacattgcacactattgcatcaatccctcaacctttagttctagtcgaagtcagtactgatggatcctccatgggtgatttcgaccaacgccatcaactgatcggccgtgagttcaagtcaccaatccatctgaagttgaaagattcacaatattattaggattttagttttccagagatgatagcatagggatgatgcaatcgatggtactgatcagactaagcttcagaaacaccttccttagaataggtgagtgcttgacgtattggcgtagaggctagaaattattgtcaatgcaccattcacccaagcgcaatgttctaaaattcctgaacattggcccgctcctagattgttccgtgaatataaacttcatatgtgcaaagcaaaaaaaaagtcttctatgaataccgaaaatttgttgcagaaaggtgatactaaagatattaattctcctcctcagctcaagttattatatacgacattacacaaatatgtgtcgaggttaaaagtggcatatacatttttcgaaaaggcaaagtggtatatacatttttttaaaaggcaaagtggtacgcacatttttttgaaaaggcaaagtgctatatgcatatcatccaaaattaatctttcatgctttccttgctatgagatatatactcactatactaatttctaaataaggtggcaaattcattcatgtaacaatggtcacataaaaatgtatgatccaagaagtggcacggtcaatcgcaaaagaatctggctggtatgtatccataggagcatcaagacactttcatggccggcttagcaatagtttgtcaatagaactaccaaaattttccccatccaggtgaaaccaatttatatcaagcttgatcgactacaagcaagtccacttgttgacctgtcagtgggacaggaccatgcacaccgccaatttttccctgtctaagcgaaactaatttatatcaagcttgatcgactgcaagaaactccacttgttgacccactagtgggacagcacactagtgcgcaccgcctccttcatcgacaacaagaatgacattatggggtggattagatcattagggagttcgctgatcctatcttttccatagggatgggagggttccttgtggcctgcagtgtagaagtggatactgatttacttagtgtagctacatgatcttggagaaccacacaaacaacttgcaacaaatttacaattttaatgcatgcttaagtctagcttcacagagatattgctatcttaaatgcactttacataaatgataaagaatttacctagggtaactttgaggtttttttttaaaaaaaaacagtatggatgtgaggctcacacatcaatcaggcgttgcataagaataacaaatattcatggtcttgcaccaaaattaccaatgtgtaaaggacgaaaacatgaaaaatgctttaactcaaacaggggaatcaggttgtggatttgcaaattttattcgcatatatttttcttgtataagtccaagagattataataacaaagagaaaatttatcatgtaggtaccataagaaaaaggaacaaattggtatttaaattttcatgaactaactgctagatgatgtcccctaaacatttccctctgcctagataatttggccttgcttattcttctgatggagcaagacaaatgaaggggttgaagcttgttgacgaatatgcataaaattgttcaacaacaccggatatgaatcatcaaatcaccttttataaggctactccttaggtaatcaccctaaatagtgccagagaaagcatataaatatagcaatgcgagcatgtcctcaatctggcatgacaagaataagttatatattattgaatggtgaatgagccaaaacaaagtacttgccacacgaggataaaatctatatattatagaagttatctacaaatacacatatataagccaataagttggaaaggggtgatttctatctgctatatgaaaaaactgaatctaaaagggaacataaatatttggaattgcgtatgaacgaacacttcaattaaatacaacctcagtcctagtatcttatacgtcactataaaggaagcgtaattaaacatttttaattagattgtcaaaatttgcgtacaacttcttacaaccatatgttctcaagtaagatggtcatcctaatggct

SEQ ID NO: 78860 - DNA, 2380 bp, Oryza sativa
ctgcatgctcgtgtatggtaattaatattgttatctaaagtagaatagtgggaaaaaagtctcactatgttcctttcaatggttctggcatgatttgttctgttataaagatacattattctttcaatgagcaattggcatttagtttggtcaggtttcttgtaagtcataggcttatcatttcagtactatgatagtttgtatttaaatgatgtattagcactgatttgcaacctgtgtgaccttttatatccacatgctcactttttggttgatatgtaggtgagagaggccttggagtatctacacaaaagccactttattttaagggaacaaacatgcatcgcattctgaaaggttttatggctcaggtactgaaaattaaaccaaatatccaagtcctctggccactgcatatttctttgtatcaactcacagtatgtttttgttcttttatgggatttcaaatgctgaactctacataattctagaatgtagatatgaatggcttgctagttatacagcataatcccagatttttttttgttccatttgcaggatatatctactctagattgcattctagcatccattttttccctaactatactcatcttatcaaaattttcaactgcagggtggtgatttttcaagaggagatggtattgattcattatcccaggcatcttctttcaactgacttcttgctgttgtacactttatagctcaacgttacatgctgtttccaggacgtggtggagagagcatatatggtgcaaaatttaaaggttaatgactaatgaaatttgtggctgccatagaatttttttaatccaattagtgtcaaatgcattagtatgctttcgctaaagtttttgtatgtactttctggtgttctacagataaaacttcaagttaaagcatgaccaacctggtgttctttccatggaaatgctggaccagacagtaatggatcccagttttttataacattcatgccaacaccacatcttgatgggtattgcttctttctgttagtcagttggcaattttctctgttaatctctcttctagttccttgtgcatattaagttatgcctttctttctttccttactgcacaaagatataggcttgatatctaccaataccaaaatttaacattctagagagatttagtctattaaaaaaccttgaatctaaaaattctgtacaaccatgaaagatcaattagcctcatgcatacacacataaaagttgccatttgttaaataatatcttataaacagcacatttatgtctatgtatatacaccatagaaaactctctggagtgggtgtgtgtgtagaacacatcattaagccctactcctttcttaaatgtgtctacaagttgtgtcaggtaatggttgagagtatgtggtggctccaacacagtgtatgttgcccacagaagtaatcaatttcctaatttctatggtgttttcctgtggataagaagtcatataacttccttttaccaatggctccaaaatctatcaacttcaaatgacttaaaattataatcgtgtaccaaacatgtggtctttgggaaggtggtcactggaatgcccttgctgaagaagcttgaagcggtaggttctgataccggaaagcctacttgtgaagtgaaaatcgtggactgtggtgaagtctctgattcccagaatcagctaaagggagagaaaggtaaaaagcaacataaacagataataccaaacagtccatgtgttgtctggttagctttctcactacttgttcttttgcagaaaagaagctcagaagaacagaagacaattctgctgctgaaaaaagggtcaaaacccaaaaaccacctactcatgataaacaaaagaaaaagagaaagcattattcttctgattcctatagctcagattattctgacacacagtcctcagatagtggctcggaatcagaatcatactcttcgtcatcattggatactagctcatccagcgaccacagacacaagagaagaaaaagttcgaagaaggataaacacaggtctgcaaaggggaaaagcaaacacaagaagactaagagaaagagtagaggaacaaaaaggaaatccaaacggtacgttgatgacctgtatgatcttggtagtgttattagcttataatgatgtatttgctgaaagatcccctgtctggagctttttacagaagctacaggagctcaagtgatgattcagatagctcaaagacaggcggcagcagttctgacagtgaaagtgaaggccgtcgtacgactcgtaccaagcattcctcgaagaaaggtaggacaatagaagagtcaattcacattcatttgctatgaaaa

SEQ ID NO: 78861 - DNA, 1889 bp, Oryza sativa
gaacgacgacgtgaacccggagcaacgatggctaggtccgcgttcccataaaaccactgcattttaggggctgagattagaggggatggaaccggcatcgagactagattaaggaacgcaaaagaagatgaaacggccgctgctctatttcgttggcgaccttcgtcttcttggtggccgacgatggagatgaggaagaaaggagcagccggagctcgttccctcgatttgcccggatcagaagtcgtaatggggaggaggcgatgcagctggcaggaagtgaagacgaggctcgacgttgccacgtcgaggccacgcatcgaacgcacctgagagttgttggcgccgatctttcctctctcacgttctctcttgcctgctggtcggttggaggattgcacagggtgaggacgagccacagccactgataagtgggcccaaatcgatgacaccaaggttagggagaaagggaagggtagaaacaaaggtagacttgattttggacgattttccaggatttatttctcttccccttttttgttaattcatatattaatttgtgttgcagatgtgttcatgtggattttattgcaggtggatgaatgtacctagtttccatttctttggttgcacttaaaaattatggataggttgctcacagaaaattgaggaatatgggctatttggaaactagtttgaatttttaggaggtctaaaaagaggataaaaattctagaaaaattatatttagttatgataaataatctagtatttaaataaattatttaaagtatacacttttatgcattttaattcactttttgggtgaggtatggttttagccaataaaggattataattagtctactatgtgactgttttgactaatttatttgaggcaccaaacttagttattaagttgtaccaaaattacagtaagttgtatgtgttaaatagagactacataaattttcccatgattttaccttgcatattttattttaaataattagcaggatctttctatatatatgtcccactttataaatgcatctaaagatttttatgtaaagtacattaaacttctttcacttgtgatggcattattttgacttccttatcttatcttttaaaattatacctcatgaataacttttgttttgcttagtgaaattatttcccttaattatgttcatgagtcctaatatgcaatgccaaccaaaatccaaatgcactaagaagactcaagtcaaaacatgtcttatgcgagtatgcatgcttgctcttacgtttgcatctatgccctaggttagagatgaaaaaggttttaatttgttctcaaattttaatcatgcaatggtttaggtcggttattacctaagttaaaacgaaaatttttggctgtcaaaattggaaaagttaatttcaaactattttgacgagaaatttttaagtccgagaatttcaggtatgtgacagattcttttggtaaccgcgcgcaattaaggcgggcgtggctcgccccgtcttgaccgcaacgaccgcacgcctaccacgcgtgtgtcagaagcagcgcgggaaatgagagggtggagttagtggccgtgagaaacaaggagccaggcgtgggtgaggggagtacaacagggcgccgcgtaaggatttccttcccttcctttcgccacttcaatcttccacgcttaccgtgccctagccttctcggttcttcgcctttctctcgccgcgcacactcgctcgctttgtccctgctccgccagtgcgatggcgcgtggttccacaccactggacgacagcgtactgcctccctcccgcatcgtcagcgagaggcaggtggggctgccgcggaaatccatgccaacactgcccag

SEQ ID NO: 78862 - DNA, 1077 bp, Oryza sativa
aaagctagtaaattaaggtttgattacttaaaacaaattacttactgtcaggttcctttcagtactactccctccagtcacaaatatgtgacttttggaatgcgtgcaccgtgcagtcaacatgtttaaactttgaccatcaatattgctttgaatattttgaattcaacttttaaaaatgttatgattatatttgtcttaaaaatagtatcaaaatattataccagtaattcctaataaaataattgtcttgatgactgtgtcattgtgcaaaacgtcacttttttgtgactggagggtatttagcagggataaaaatgtcctgttcaacattgagataaccttatcctttgagtacccaattgagatgtttgtttgtatttgcagggatgatcctggtgcgagagctaggagcagtcctattagggctgatgcaagtttaacaaaagtggatggcaacaatggtgctgatactgcagaggctggtatatctagagctgaacctgtgccaaccaatggtaaagatttagcaatgggctctacagacaacggacagcctcaacgtgtcaggaaggggcgtggttttactcaacaatatgcatttgcacgtcgatacaggacaccatctccagagcgttcccctgttcggtctcgctacaatgatggaagaaatgataggtggaatcattttaataggtactgcagttagattatttaccacatttttttaaaaaaaaatgatgattaatttaatgtttggatgccatcatgtgcaggtatggaagaaatggtccctacggtgcacgctcaccagtaagaagatatcgtggttccccaagagccagtagtccgtccaggttggtatcttctgattatccttggaatctcctagtggtcagtaccaattgattgggtagagtggatgaactattttgaatatagttgtgtactcttcatgagttcatgccttctttggggttaacagtgtagtttgttattatttagtaccataatacccggggttatgtgcaacgtgccgaaacatctgattttgttcaacatggcccatgatgagct

SEQ ID NO: 78863 - DNA, 809 bp, Oryza sativa
caggcggaagtgatcccaccattcagaggcagggccttgcaactgatgtgatgcaaatgagaccttctcctgatcagtgcactgaagtaaatccaacttcttctctatggcatgcagccaatcaccagcttcaacaggattagtggtactagagaaaacaggcggcctcacacgaagaaattctgctaacttattctgaggaggtacatgattatttccttggttctgctggttctggagttgttgcatcatcatgttcattagctgtgtctgttgagcaagaacttgagcaagagtgggattctctccattgttattgttactggggccattcccgttgctgcgagtgttcaccatctggcagggcacaagaagagaaatcgggggaaactacttaggatagagaattactttaacttttattgatcttaactgagttttattattacaaactgaagactcccacaccactaaactcaccaacttcctaacactcaaaagcacctaacactcaaaaacaaacaaacacatgcaattacatcccaccactgatgtaaatcacatgcgacccacacacaagcaaacttaaagcaagcaaactaacacaacgatctaagaccacgatttaacaagtcactctagttcttccgagcatcggaggtcgattgaaggctcgttctgctcgtcttcatcatcttgagttgctacccactcaatcttggaatgggtgcgcttggattcttcttcttcatcatcacttatgatgatgatcggaggatctgctaaggtaaaggcaacttctttctcca

SEQ ID NO: 78864 - DNA, 17596 bp, Oryza sativa
agtttatatagaaaacatattagtactttcaacacaaagtaaacatattattaaaatatatttggtgctagatttaacgagactaatttggagttatattgctaattatttttataaaattgattaaacataaaaaagtttgataacttatgataggatgaaacagagaaatattatctaaaacaaaagggtttagagcttcgaaatgtactccttccattccaaaatattttggaactacggaagtatatttttgaaatcgtattaacagaaaaaaaaaaacatatgaacaaattgttcaatccaattgatcacatgaatttgtgacaaatgttgttggtggcactaaaagaaaatcatagttacttttcgagtaaggagagaaagcacgaggctagagttctccttctcgtttccaaaataaaaaccgctcctcaccgatttataaaaaatctacaaaaaccagtaaaaaccaacgatttttagtcaatgttgtacgaaaaccaactaaaacgcttgttaccacaaactaatgatcagtggttttacgagaaccgatcgtttttggaaccctaggtcaaccggttccaagttagtttctcacaaaaattctatgaaataggtattttcatagtaggaatttgttagttttccaccaaaattcttgtagaaatgggccattcccctggaatatcatagaattttgtggaagccaatctagagcagagttggattatttttcataggattgcaatctttcatttcatcacatttcctttggtaccaaagaagccctaattccagtaactagatatgtccgcactttgctgcgggatatatgttagataacggagaaatgatgaaatcattcgaattgaaatattatgaaaatgatttaagaataatgatgtagtatgtgtatgtttagttttggaatgaaataaattatagatataattattatatgcttgtatcttgaggatttgtacttaacatgttgatgtcccatgcttgcatgtaggttttaggagtactaataaatactatgtttggatgttgagctttaggtcaaagttgaccgttgaaccccccccccccccccccgccaagatttgtagttctgtatttatttttatttattacttcctccattttatattataaacagctttgtttttttaagtcacacttgtttaagtttgataagtttaaataaaaaacatagtagtatttacaacacagagtaaacatattattaaaatatattcgatgctatatttaacgaaactaatttagagttaagttgctaattatttttataaacttgattaagcataaaaaattgactattacttatgatatgaaacgaagaaaatattatataaaacaaaagggtttttaagctccgaaatgtactccttccatcccaaaatattttagaacgacggaagtatatttttggaatcataagagaagaaaaaacatacgaacaaattgttcaatccaattgatcacgtgaatttgtaacaaatgttgttggtggcactaaaacaaaatcatagttacttttggaccaaggaagagaaaacacgaggctagagttcttcttgttttcaaaataaaaaccgctcctcaccgatttatcaaaaatcaatgaaaactagcaaaaaccaacgattttcagtcaatattgtacgaaaaccaactaaaacgctcattaccacaaataatgatcagcggttttacgagaacccatcgtttttaaccctaggctaaccgatcccatgttagtttctcaccgaaattctcatgaaataggtattccataggaacttgttagttttccaccaaagttcttgtgaaatgggccattcctctagaatatcatagaattttgtggaagccaatctgcaacagagtcggattattttttataggattgcactcctatatttcatcaccttttcctttgttacaaaggagcccttacctattacaataattaaatactgcatttgcaaaactttttcagatacaataatggctggattaacagggaaaaattgctccatgttgattgtcagactaaaaaaaatcatttttatgggtaaaactaaaaaatatcatagtaattgtgtggagaggagcaacggaacaccgggtattgctagtgggtgggtgatcaccttcctctcctcctagcgatcacccgtccctccccctgtacgctcttcctctccctctttcctcctccccttcttctcttcctactacagtacaccataatattttttttaagaaaaaacaaagttggaaaatttatgcacagaaatactatatataaaaaatttgaattcaaattcaaatttgaaacgggtatgtaaacttttgacttataaactttgggtctataaactttaaactttagatgtataaactttagatgcatagaaatactatatataaaatatatttgaattcaaattcaaatttgaatcaaatataattcaaattcaaatttaaatcgggtatgtaaacttttaacttataaaatttgggtctataaactttaggtatatatactttagatgtatagaaatactatatataaaaaatatttgaattcaaattcaaatatgaatcggatataatttaaattcaaatttgaatcgggtatgtaaacttttagatgtgtaaacttgaggtgtataaactttaggtgcataaatttactaaaataggaaagtaatgcggtgccaaaaaaggaaaccacgtggaggagaggggggcgcgctaggggcgatcgatcgcccgttagccatttcgcagaacaccgctgccgccgtccgtcaaggactcaagagagccaagactgggctttctcccggcaaccgcccttaaggtgtgagacagcacgacaacgccctcaggagggaaaatgacactcgagcgtcatcgttgttggtccggccaagaccgagctgggttttcacccaccatccaccacctgccaatctaccatacatgcaccactgctccaccgccaactaaacttccgccggcgtgtggggacatggcaccggcgccccccgccagccagtcttcgcgtgcagctaccttgccgggctccgtctccatcggcttcgcctcctgctgcacagccatcacgtgccagcagtcctcgacatcgctggccacgctgcatggctaccggctgcacggctgtcagccacaacatgccggcatcggccagccatagccccccccggccctcgccgtcacccacgcacctcctgcccctccgccgccgtcgcggcctccgcctccgtctccagcgcctccgcgctgttgcgcctgccgccgccagccacaccctccgtcactggcgcccgcaaccaccgcatccacaagatgctaccaccgccaccagtcgtcatcccgctccaccaccgccagatccggccgccgtggcgtcggcgccgccgtcgccatcccacaacaagtgcggtgggaagtgtgctagcacttgtcctcgccagatccagcgcgaatctggcggccttgtcctccgcagccagcgcctccaaactccgccgccacccccgccaaacgcagccgcctgaacgcccttccccgccaggtctggccggtcggcgcggatttgggcggtttccgcctcccaacgccgggcaatccccctgcccttgtgcggtgagacggagcgaagccccgccaccgctgtccttgtggccgtacggctttgccggcagctgctcgggcggcgacgaggtggaggagggagggcggtgggcgacggcgaacggggcgcctcccgtgtcacctgagaggaggtgacgcgagagtagatgctctagtttgtgtgataacagcttgctagttccataaataagaacaaatgaatcggccatcgttgttcccttcgatcaagaggctgccatacagaaataaattacggatctcgctggatcagtcaccacacaccagtggcatgaatatggttaacttagtatatatttccttttaccaccgcaaaacaatacatcgaataataggtacattctgagcataacaatgtaaattagtgcaagtttaatagtacagtcaattcatagttctaaatcatctatagccaatttataccatagttatctataaatatacactacacaattaatatctggttctatctctcatacacgcatagcttcctgaaatccgtatccgtgttgcagttggctataaatttataactcacttcttttctctctgctctctcctctctcctctcttatctatgtacatcactctcacttatagatggcttatactgctattgcacctgctcttatgactggaattggaaaaaggattctcttttgggggtgatgccagcataacaggactttgctgcatacagtgagagtgatgtacatatgaaagtaaaattatgacctcaagaccgatgaacagaagcaaaaccataatacttatggaatgtaaatatacaatcaagtttatgaaatactgacctgtattgagaaagtcagcagatgcataaccgtagattgccctactgttcttattggaaatgaacatggttatctagctctcccaatagctggtgtcaatcatcgtaggtaaccatgataatttgtggttactatcccagacaaggatccacaaacagcaagagtccaatccattgtttcaaaggatgaactgaaagcaactagaaaacttataagctcagagaaaaaggaaacttatgaatgattactagatgcaatgtagagtggtccatgttactaggaccagagttctgctagcagccaccatccagattgaggaagcagattaatgaagaatcaactgggtaagaagtacaaagtgaatttacaagcttccagcactaactaaataatggactcaacctgattttgacatattacaaactgttttagtacaagtctttgtttacatcaatacttattgggacaactgggggtagggatgacagtagtttaatccataggtgcccattgcccaactctatttcacctacaaataaagaaataaagaaaaagtgtgtttttagtaaaactagcggactaatgggtacccatatttataatggattactcccatctaatcagggatttggggtgtactcgaatagcattaacattttcataaatgttaatgttctcatagtattatgtacaaaaaatgtgcaaagaatataaactataaaacaaccttttgattcagtaccaatcttttgagatgaaatctgctctgctgtacaccccaatggtctacaactgaaattgtattgtaaacattagtgtttcacaggtgctgctcatggcattgaagaacactcctttgagtacttcggcaagttgaattgcactgttcgtgcaggaaagtctggtggccgctggaatacaactgaagcagcatgtatcaggatgccagcagtcagaccccatattacgtacttctcactccctttctcgtaattgaagtaatgaattgtgaattcttgtcccatccattcacgctcctcagatgtccttttctcatcctgcagtatttgatcagcaggttgaagatagaaatgacaccaagtcactgagatattccatgatttcagtaaaataagtggtttctttatcccctagtttgttccatatgttgaaaaaaaaaactataatagtatgctattctggttaagtctaaactctaacctatattaccactgtacagaaaactacagtatggaaaactatgtggttggtatcttttacacaataaactggtctcctttgtttttttgttataagttggaaatatcacaaacatgcaacccaggttcacataaaagcctggaaatgtgtgtggtcctttaattagcatggtggaaaagacagtgataataccaaccttgagaaacatctccaagggtacatcgaaaatgctatccacctcatcaacattaagaacaggtttaaatgcttgtatatcagagagtatgccaacaacagggacaactaccagaagatgctgccaaaaatatggagaatattaatcctgatgatgacattgtaagagtaatcttattactgattgctagtagaaacaaactaaaagtaattaaaacagtggggcacaacagcataagaattgtagtggagttggatattaagtattgaagcgaagcaaaggaactacattttagaattgcaacagtgcaacaaagttagtaatttacatgaaaaaacatagaattagcctctcccagctaattcaatttgaagagactacctatatatgtgtaaaatgaattgaaaattttggataattttctatatgagtttcacttgacctcatgacatgacaaggcacaagtaccaagttagtcttaataaaacatgtggcgagcacaattcaaacttcaaaggacaaattagctaaatgacatgtgaaatgatccatcaacagacggatcatactagtaagactagccttcagatgtaatcaaaacctaaacaagacaaccaagacagcaaaagtgaccatgttcacagttccttcaatgaaaaaataatgtgcaccatgcaaagacctatagtcccacagtaacattggtaacaaaatttggttcgtttcaacttacaattttaatattcggtctttgagaattaagtttcatttgcgatgcatgatatcaattcaaagcactaaagtacaatatggttttctgtggcatgcaaacatgattgctaccaaacaagaaaggattttggaaagaacagttagcagcttatgcatcaaaacatctataagcagatcctgagtcaagttggtttagttgcccgtgtttggttctaaaatattattaaggaaaatggtgtatagttccatcttccttgctgtttcatgtggtgtaagggagagccaaatggtattctacctttgacaagaagtgctcaagagaggcaacaacagtaacagaagctggatcaagtccaatctcctcctttgcctcccttaatgctgttgctgcatcatcagcatcaccctcctcagcctttcctcctggcaaagaaacctcccctgcaaaccccagatggaagaaataaaaatcaagcaggtttcagaagccaatttgagctaagcaagctctctgaggcagccaaaaagatggatcagctaaaggaccattttttagcttgaatctgtagcagccaaaacgagcagagcaaaatgaaggttgtatgggtttggaattaaggaaccaactcatattattttatttaccctatctaaatcaattgctgagctcaaagcctttccgtggaccagggaaaaaagggcacccagttaggccagcagcaacagtgcaacactgataaggagaccagcccatatgcaccttagaatattgcatagtacaagcattgcatgatagtttttgaagcatattgttagcatctggtgcaccctacttgtccaagcaagcaccaaagattcaatgtcattatcagcatccaaccatgcaatcaattccaaccatttgtccaaactgttaactcaacaaaacaccgcaagtacgctcctcatgtgctcaggataactaaaatatgtgaaaccagcatcagaaaacaaatgtggtccatttcgcgtatatcattacaaacaactgtcaggccaccatcctattattatgccatggtttatgtcactaatgtcaatgcaaaattgatacccatttttaaatatgatcgatgctcattggatgcttgctatatatttacgccaaataaatagggtcaaagactctgccgaggaaaaaaaaaaggtttcatcataaacgccaccctccacattaatggaatagctgagaccacggtaaaatcgtccttggattaatcgatgacagcctaagatttctgtaagagattacaatttagaactgtagtactcgattatagtttattgctttgcaacttcttccaaaaaaaaaagaaattcgcagcggtatacgcccgaaacagcaattcacctacgaatcgtaaaaagaagaagcactggaaatggcgatactctataagactataaccagtaatttgacccattcccctcaaaggcttctcaccttgcccaaagtatccgatcgatcgatcatatcgaggagaagcagaaaaaagattgggatcgatgataccgaggacagctcaccggagtgggaggagagtttggaggagcgcttggtgaggaggacacggagctcgccggcggcgccgcggaagaggcagatcagcacggcggccctccgagggcggaacagcagctcggccggcggcgcggccgcgtcgggcgagggggccgccgcggcggcgtacggggaggggcgcgggcggtggagcctgaggcgctggatgagcgcctggatgtcggcgccgggtgcctccatggaaggtgggatggtgagatcggtggacatggaaagctttggcacttgggtctgcgcggtcgtgtacagtgtagacggtctccatttataatacagcaatgctacgctggtgtactgtccccgtcctaaaatatgctccatcctttctaaattttctaaattgatcatcatataatcgcataaacacggatttcatcgaaatacaattaacacattatagaagaatatgtacatgctagggtgtaattcgtatgatgctttaatcgaatgcgtacatggtatcttaattgatgcgatttaaattatctttggtcttgatgcataaacatatataatgatcattttgggttagagggagtaataacttagaattggatagaaaatttactattactgtaaatatggatattcatatcttgttcggtcctagctattgatattttggatgaaggaaacacataatagaaaaacagttacaaatataaatttctcaacaatgtgatctaaatgattagaagtaaatcaagatttggtcctaatgtaccatatcatgttatgttcttaaaatatttataagaatctgtttttattttaaaaaattacaagtatatatatatatatatatatatatatatatatatatatatatatatatatatatatatatttgtatacacaggtgcacattcatctctttaaactagatgaagcccccactttgcggtgagatatatggatatatgttgaatgtcgtaaaacttatcgatggatttgatttgggtaaatattgtgaaaataacatgagaaatgataatttagcatgcttgtatcttgaggtttagaatgtactctccctccatccacaaaagttacacatatttcacatttaagtttttccaaataaattgtttctatttttagtttgtatacattcaagacttaaatgaaaagataaattaagtgtttgattagaacctaagaagttatttaaatactcattggttgcatggttgtattcactcattgattttgtaacatccaagatgatttaatttcttcttggtcttagtgataaaaataatatgtgtaacttttgtagacgggggagtaatgaattgtagatgttattattagacatgtatgttgagttttaggtgcttagtggattgacgtggcatacttatcaatagatttgatttggagtaaatattgtgaaaataatgtaagaagtgataatttggcatacttgtatgctagaggtttagaatgtaatgaattgtagatgttattgctatgcatgcatatttggttttaggtgttcggtgggttgatatgacatgcttgtatgttaatctttacgatgtagtaataactaatatgcttgtatgttgagatttagatacataatgagttgtaactttatataatgtatagaaacatacaaacacacattatctttgggcatgtttggaggagaaaaaccagcttttaggttctggttcgttttatgaattctagccttccaagaatctgaaaaagagaagattgattggagtagtttttattccgaaagaagctataggcttagttcacgatgcatatattaaatttgattaatcaagtcgcctcgccatacacatctctacgtggtcttgcatgtatttccatttctatcttgcttccgttatttacgaaaaatactctcctgtcaccaagatgctcaaccttttggacttgaaaaagggaatctcattgacatgtatcaggttctttgaaacatcaataattcagtatggattatttcttccagcggctttttcgcaagtgcccttctgaaacgcatctgtgcttgtcccaagatcgaagtgggagcagtaaataagcaattagtttttgattggttacaaacttttgtaattttttcagtgtgttttgttccctttgtaatctgtaaatattaatttatttttataaaatcacactgttgggcaaatgcctgacagtaatttacataaaaaaaataaacaaaaacattgtagcatttctctgctgttcaacctggtaggaggcacctgacactcatgcgacaacgtacttactactgagtgagcatcactgtatccaatcaaattaacccaaactaaaattgatattaaacttccaaattctgactatacaaggtctgtccagtctccagagcatgtatttttttcctgcaagtacaatttaactgtatgtattttcagaatcctgattccatataattcgacttttgctacatattgcattgaattttttttagaacagaatgagcatcggagtttctaaagactgacgctaatcaaaacaaaatatattacataatgaaataaaaaaatgataaagaaaaggtcgctttgcgtttatcttcttggactgacattggtccatattttcattgcgagtgcttaacttggccaatatttccattatttactctatcacaaaacacaccaaaagacacgcaacatatatgtatccacatcctatagtttagtttccacattctcagcagttctgctgcaaacccgtacatctatctggatctgcctgaccacattgtcactacttgctcccccatattctaatgatgtaatatctttatttctaattctctccaccgtactgctacatcacatgagtatgatatctgaaatccatatataattgcaactggttggattgttttctatgcttaaaagaatagccaagcaccaggcttttctgcagaaatgctgacgagtgatgtagcagggaatctcagaaaatcagactatgacaatttttttcatcatcaattatacagtttaaacaatagtttactgttcaacataccagcaggataaggccatctcgcatttaatagcaattaaaagatcagcctgaagataacggattcacaaattggttaactagtgcaggtagtggactagtgatacacaaagaacaccatactgtcatatttgtctcaattttaattttgaaattttgcaagaagcattcataaaaaatcaatcacaggataaccaaaggtgccctgcagcaggcctagtgaacaatagaagtaacagcaggagctacaagagaaaatgtataagaagatccaccacagcccccagcgcacaggtaaggaatagctgttattcttaattactagaaaagataagcatatgcttcacattacttgcttgaaaataacagatatgagcatttgtgaataagcatcaagtgctaaaagacgacctttgtaagctctagttgcatatataggatgaataaacatgtacgtgtacctgccagatttcttcatccataagagaataatccggcacatgttgtcctatacgacaataatgcatcattcctgaatgccctgaaaaacatctgagatggcagaccatttggaatatctgatagacatgtcaaggatccacatgcagcatcattaccctttgctggggacaaaaagcaagcaatgtgtgaaagaattttaatacgaatataacataactcagaaaagaagatagagcaatatatttccttaccatttggtcttgggtgactcaaggatataggcaagctaaaaaacaaaaatatttccttggtaagttgcccagaaactaaattaaagctcttgatagtactatttaaatatgctaggtgcaaagaaatacacaaaattctaaccaaataaatggtcagaaaaataatatttgtgatatatgtttacttaaggaataacactatctggatgagaacatatcgtacacaatagtggactatcaaaattcaagttcatatgccactggaagttatcatgagaatatcttcatcttcacaattagaaagcatctgctctacttgaagcaacacccttaacatctcatagatctcatccatctttgggtgtgatttatcctctgcattgaaagaatgcacctcattcttcacctcaatccagctccacccagggactttgcttaatcctcgtttcttcattaccctctgcactgttgccctatcactccacatcccaagaccagaatacatgctggacaggagaacataggtagagtgctgtctaggttctgccacaaatagatggctggccacatcgcttgctagttccacattcccatggattctgcaagcacccaatagggtcatccataccatggcatctggttcaaatggcatagaatcaattagcttttttgctttatcaagctgtccagccctcccatacagatcaacaccacatgcatagtgctccattcgaagaggaactccatacttagtttccattgtattgagaatctctgacccttcatctacaagaccagcatgactgcaggaagtaattaggccaacaaacgttatgtgatccaaaggagccttacgttgcagcatctcattgaaaagtatgtctacgttttcagcttgtccatgttgtgcataaccaaatatcatagcattccaaggcactgaactactcttatctgcctcctcaaaagatttccgtgcatcgtcaataatgccactcttagagtacatgaagattagcgagctggaaacaaaatcattggaagcaaaaccagaatggatgactaaaccatgtatttgtttacctaactgaagcacagcaagttcagaagaggaccgcagagccgcagaaaatgcatactcatcggttctaacattttccgaacacatacatctgaagaacttcaaggcatcggcactcaaaccgtgctgtgaatatccagtcagcatagaattccaggacactgtgtccttaagcaccaaagagttaaaacacttgtatgcatcttccatcatgcaattctcattgtacctagtgtacatggcaatcagagcattacaaacaggcgtgactccttccagagcactcttgatcaccaacccatgaattactctcccttgatgatcatcatgcccatgctctgaacatgaacttatgatacttgtgaaactatacatgtcaggatgaactccactctcttgcatcatcctaacaaagaatttcatcgcctcgtcgtccattccattgtgagtgtaagctccaagcatcgcattccatgagatcaaatccctaatgtccccaattccatcaaagatccttctagagtctttcagggacccacattgtgaatatgcagtgattgctgcattcaacactgtcagccctaacgcagatccatacttcacaatcttcccatgcaactggtgcatcaagaaacagcttgggccctcaactgctgtgagcagcgacgcaaatgttgcttcatctggagccaaaccttctctttccatctcaagaaacagctcagtgcagatgccatgtccccagattcagtatacccggcaatgagtgcattccaagaaacagtgttccgctctggcattccatcaaacacctgtcgggcatccctcacgcggccacatttagcatacacatcaagtaatgcacttgccgcgaacacattgttggcaaggccggatttcaaagcgagcgactgcagttgggcgccgatggcaggacgccgcgctacggcggcggagcggagggccgagccgagggcgaacgtgttggaagcgagcccctgcgcgtgcatggcccggaggaggcgccatgcttccgggtgcgcgccggacgcggcttgcgcggcgaggagcgcgttccaggagacctcgtcgcggcggggcacctcgtcgaacacccggcgcgcggcggcgaggccatcgggggaggagcgggagtaggcggtgaggagctggttccagggcgtgggggcggcgacgccggacttgaggagggaggcgtgggacctcgcggcggcgacggcgaggtggtggtggcgcatgcgcagcggcggcggcgtctatggccgcggggcattcgcggaggtccggtatctatggacttgccgattctttgggtcgcggaagtagcggccggagcggcaccaacctcacctccgttcgccggaaatccccagccccagctagtcagctacctccctccgctctccatggcggctgggttgaatcgtcgaagagcaacggaggaggaaggaggaggaggagccatggcggctgggaagaagaagaagaagatggccgacaccatgctgggccgcgttgggctaacctcttggctatcttgttaaattggagatatttaaccatttgccacatttagatgtggcaattaactttttgtcactgtacccatatgtcatagacacatgtggacccatatgttattgagatagaggtgggaaatagttatttgccaaatctaaaagtagcaaatagttaaaagccccgttaaattggtggcccattaaagctgaacaatagagcacgaaaaatggaacgagcaactagcgcatgattacgtgaattatttattattattaacttcataaataagggagttgaaaaaacgaaacgaggaaaataacgtgtcataatttaatgagaaaattacttatgtaattgtgagttcttattcaatccattataagctcagaactatactctatatctcatcctcctctgcacgcctctaggttttcattttgaattttcattttgattccctctatatccatttcgctagttgacatggccgtgaattaacagttaacttattttttaaaatgactgtattgtcactgaatggtatagtcatactcttcaattccctgtatttcactagttgtcctatttgattatatagtatttttagcattgagatttatgtttctaagtaggtagcacataagatctataagttgtataagtacgagcgacaaacagtatagctagccatttcagaaaaatctaatagccaactcataatcaactaaacagtatagatatagagggaattgaaatgaaaaaaaaaggaagaaatgaggcaaaattcataggtatagataggattgtgaaacacttggggacatattttctcaattctaaatggggaaaattatgtttagagcacaagtagggtccaaatcagaaaataccataaaagtatcccattattgcctcataccacagtccgcactacaatattcagtttataccatgaccatggtcgaaaataccctcgcgtcaagtgcagttgcccaaacctaaatgtagtggagttaaaaaaaagcaggggaaggggggagggagtaaaaattcatacgaaataatatcctggattctccttacgaaaaaaaatcgtgaatatatctttttttaataatttacatttatatacacgaacgagaagaatttgcttaaatataccaatcccctaggatgaaaacgtgggactaatgtttgccgtagcgcaaaaacgcgggaccgataatctcgcgggatggtcgcacatcaccggccatggcatgcgttgggtgggcatatataatactgtttagcgctgttaatacactgtttggacattatttaccactgtttattactgttcacagagccagtaccgcgcagcgggacaggttggtaccgtgttttttgagcctccggactgtctcggtactatgtagtaccgctagccaccacagtgccgcatttttgagattcgggaccgttgcggtgttgcacgaccatcctgcaatacagtcggtcacgcgtttttgcgctgtggccatcctgcaatacagttggtcacgcgtttttgtgctgtggcaaacattcggtccctcattttcaccctgtggtacgggtatatttatgcaattttccgtgccggtatataaacttaaattattaaaagaataagtatattcgcaaatttctttcttctccttacaacacgatttaatagccctctcgtagttcacatcaatttgatattctttctcaattactgttgtccgccttttttcacctctttccggatgtgttatatgactttttgatggacatggtcccaaccacttttttttttcagcggcatatatgtcgcactaagctcatctttctcatcttgaatctaccgaagaacataattgttcaccttgtagcaaccttgatgtccaagagcgaagactcatgattactatcgcccaacgaaatgctaggcgtgtgcctgaggagggatgccacaatcatatcatagggcctggtcgacatgaatgacaatcacggctcatcgtatattagtatatattcatatgaacgtgtgtcggctttatggccacgagaataggcaagcaacaataataggaggaggagcaaccaatctcagtccaaggtgaattaagaggagccgaggagtatttgcaataattgttttatagggaggaatcttaaatacatggcgatattttgggtggttttttgcaaatatttttttataaaaaaaatggatcgaaaagcgtcacgaggagcacaattgaaaacccaagctattcactcgataatcaaagatccctatcctcctttcccaagagcactgatagcttcacactagctcgtagagatgagaaagtcagagcacgggtagcctcacaatgacttgcattagatgagaaggtgaattataatagtgatatctaggtagggtaccatcgataattttagattcgtgtataaaagtcgactctaacagaagacacatctgttactgtggatggaggtggaataataaagtataaaccaaagaaagttgtgtaagctgcggtataagacgaccctgagattccgaaccatgattttgtttcctgcctgtgctacactgaacttttcctttaatttgatggctcaatcgaaaccaccgaagagcaagcaagtataagcttagactaaaccgagagttaaataataagtaaataaattaggaggcaatgcagtaaattacttaagtatatatcaaccacctaaacagctaaatcctatcagtgctaaataagtactagtaactaacacacgacgatagttaatgacaaatgcctaaattatatcaatctttgataccctagttgtcaaaagcccaagcgttctccttacggacct

SEQ ID NO: 78865 - DNA, 2700 bp, Oryza sativa
agcttgtcgtttccgtcgttgcaaaggtttgtgagtgcgtcgaaagtgatcaagaagattattgaagatcgattatgcaaggcaagtcacagatcctaaacacaatccttgagcatgttgatcctatatttaattctctatttatttcaactgtgcatttattttcgaatgtcaccgggtggtgtgaacctattcctttgttatggccaatttgcattgaatgctctattccttgataccttgggtaataaattgattagcttgaaccttgtatattagattggttcagctaaatgctatatgtaagtttgcttagctatgcttagaaacattagctaactaaaggggttaattataaactatgttatattattattattaattatggttacattaaatggtagctcacgatggttaatcgtgtgatgttaattaattgataattaaaatctggttaaggtgggttgtgagcatatggttttgatggttgtgctcatgacaattaaggaccggttcgcgagctactgttgtgaaacatttatcgtgccaaccacaagccaccgtgggcaacagctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccatttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttaatatctggtaataatttgcttagctcctggtttggagttagatctgtacagccgggtatggttgttcaggatggttgggcctgtgcagcatgggtgtgctgttcagtgttgattaaaattaatgattaattactctactgttttacttatcttaaatctttgctaaatgctgcttttgcaaatgagcctatattatgccatcctttggaatccttgtgcacttgcatacttgctgtgtggcttgttgagtatgtcatatgctcattcttgcaataatcatcaaacctcagttgaagataaaggatccagaaggagaagacgtttggcttataccccagttgagctgcctgtgggagtggagctgaagccttcgctagaccgtaattccgctgctgttttcttttctttgtaagtatgtaacgttattattatgatggatttgtatataaaattgtcagtttgtgtacctcggctgattcctggacgaggattttacgcacaaataagttcagaaattactagtgaatttctgggcgtgacaacgccctactgctgtggaagtagaagctctcgtggtgctaactatagttgctcctcaagttggctgacgtgctcctggctttctctcagctgctcctcaagtgtatccatcatcccgcggcgatcgttgcactgatcagatagctgctgaacctggtcaccatggacctagagctgtgccttcagtgagtctatctcactgccccaagcctgatgctcctcctctagctgaagctgctgcactgtgaggtcagtcacctcggtctctaactgtcccacacgcctctgctggtcgtcgatctctaacagagcctcctcgtcgaagttgtctactgcctcagcacatcgggacagtcaagtcactatcgggttgtagcagcaaggtgtgtcctggactgtgcagacggagttgctctcctctcgaaacgggtggtgagcaaactcggtactcgccaactcagctcggtgaatagagctaagtcggagaaggcctcccgggctgcgtcctgcatcgcggtctccggtaagtcgcgacggtggcgtgtcggaaagctgtagcctgactctgaaggaactcgtgtatgagcctcaatctgggcctcccaaacgggtccacactgtctcactcggtagatcggaaatctggggtaccgtaggcgcctcatcactcgatgtagctcaatgacgtatccctctgagtggggtacgcccatctcccaggtagtgggtgaatcctgatctgtcatctatttttaagaaaaaccaaagtcagctaaaagtaaaacttgttttgtgaagaaaatagttaagagtaagatgaaaatcgtatagagttttgtaaacatagcatttttatttttttttgaaagtattactaaatgggaatttctcccttggccaactagaaaggggtggggtgccatttggtctttcctacagtcgtatggctctgataccagctctgtggacccccgtttttataacaggaatcaatcgtgtaaacagtatcatttccctggatcaagtagtctggtactcacgagttcatagctgaaataccaagtgcacatacacgagagtctagtgcgaattattacatcataggcccccaggcatagtcttagaacataggaccgaacggtccggaatacattccaaaagcaaaagtagataaggcagcggagttaaggcagcggcacgccatcgccataggcaacgaccgtaactaagac

SEQ ID NO: 78866 - DNA, 16730 bp, Oryza sativa
ctctctctcctctatatctcacgcggtctgcacggtcacactcactctcggtctcactccctggagctggagcgtattaaaacccttctccgtccattcgatcctgccacttcctttctctcgccacgatctcctccatctctctctctcttcctcctcgccggccgagtcagctatctcgccgccgcctgagtacgtacgtccgtctcggtatggccatggccagtggcggcaccgtctgctccatgtgcggcgacgtggggttcccggacaagctcttccgctgcgcccgctgccgccgccgcttccagcactcgtacgcactcctccgtatttgcctcgttaatttctacctctctccctattgattcctggcgtctaggtaggtacatagtgatcagaactgacgcgtcgtggcaacggatgcatgcatgcagctactgcaccaactactacggcgacggggcaccggtggaggcgggcgccggcgtgtgcgactggtgcctcagcgacgccgccgtcgtcgccgggaagaaggggccatcgtcggaagggaacgaggagccgttctccagggagtaccgtggcaggagcaagcaggcggcgtcgaccggcggaggcgagcaggagggcggcggcggcggcggccggagggtctccaaggccggcgctgtccgtaggtacaagcttctcaaggacgtcttgtgctaaagagctatggtctaatacggaccatagctgatggatcaatccttcattttcactgcgtcaccccgtcatgtacaaaactagctctagctagctaggtgcccatcgctaggtaattagatcatccctgtgtaaattgtccccgtgttaattaaccgcgcgtgtgtgtatgaatgtatgatactactccatcctagctaattaaagctatatgtatgttttcatagacatgtcatgtttgacgagaagtatcaacttgacaactagtgaaaggaggagctagcctaggtcttgtatgcgtgacattcaccaactaattgtcgtcaaaccctacttgcaatacgtgcggtgcttcccgtcattcattatcgatcgtcatcggatcgaggaaacgagctagactgtcctcaactcgatcgatcggttgatgtttacgctccaaatcgcgatcagtctccatccacatcgatcgtcttcaaacgatcgcgaaacacgaaccatacacatcagtactagtacttaattaagacttcaataattaagcactattacacgtctgcttgattattagtttcatgcatgaaagacgacgatccatcatccatcccttcctctggcacttgcgatatgtacgtggtactcggtagttgatcggtacgtactaatccagaagaagactctagaaggcgatcgcgttgcatgctcggcaccctcgccttttttttcttctcctcggcggcgtgccgatgcagaggaatcaaatcaacaactcgtacaagtacggagtatgctgcaaaatattaaaggactccaaagtggccgacaaacaccatgttatattccccccacttgtgggttagcctcggatggcacgcagatctttgtgggcgcgtgaatccatctatccactcgatatccgtctcgccgtggccgtcagatggatatgtaagatcgagctttggcagacggacagcacagtgtacgtgctccggtcaatcagagctattcgattgatctgctccgtacgacgagataaacgaacacggttggtgtgcgtgtggcttgcgttgcggcacgtcgatcgccctatcaccccgcggccgagcggccggcccgtgcttgcccaaatgtaacagtggtgttggcattttggcagaccatgtttgaggggcacactgccactgtatatcattatattagatagatcggtctgtcgaaccaagtgttctagtgtaattttttttatgagaatttggaaaaagggtagttgatgagtgtgcacggactaacgtggcatatttccgataactgtttattcaacagtagtttatattttctagataatggattaaatattcttcaatgataatatctattatattattaagacagctcgaaaagaagacaccacgttcaccgtggaggctagaaattcccacgttaatcgaagaaaatatgaattatttacaccgttggattgtaagaggcatagatttcaatgtctgagatttaagacaaacttggcatgttaattaagagatacggagtaccgtacgcgtgtagaattagaatcaatctctagctaggacctttacatgcaaacggactcaaaagagttttgtccgatttcctaaaccaattaaccagagttagagatgaattaggctataatacacatatataaataaagcagcgggcaacgaaccactatagaacagtaatttggatgcgtttttgttgatatgaagatagatgctagcagcgagcgacggaaatccgaagcagcgggtcaagccgtgcggctgcacagtgagccgtatttgggtgatgcacacgtcagcaaccagaatagcatgatggcatgtgcacggatttttatttgattttgaaataacacaataaaaaatgaaagaagagttcatgtagaacacaattaaagattaattgaaatccataataaaaaataaaatagatttagaaactagaaaaatcaaatataagagttcaataagagttcaagtaaaaatacattttacgaacaactgaaattaggaataaaaaataagaaatattagaagaataattcatatagacatagtatgagattaataaaaaaatatgagattaataaggaatattaaaagaagagtgcatataagaactcaatatgagattaataaaaatttggaataaaaataaataaatccgaaattagcaaaagaaaataaaagaagaattcaagtaggaatatagtttaaaattagctgaaattcggaattaaaaataagcaatattgaaagaagaatccatataagaaccaatacgagattaattaaaatttagaataaaaaataaaataatatccaaaattagaaaatttaaaagagagttcaagtaggaatacaattttgaaacaactgaaattgaaaataaaaaataaaaacattaaaagaacacaatacggtaataactatttttttaaaaaaaattctgaaattagaaaaagaaaaataagatttcaattaggaatacaatttataaataactaaaatttttgataaaaataaagattattgaaataagagaccatctaaaacacatgatgagataaattaagtaacatgcctataaaaaagtagagtggtggcggttgatacgacgtataaaaattgttaataaaacaccaaatagaatcctaatgacgattaaaaggagggacatcaggcaggccgtgaagcaaacgagtaaggcggttaccgggacttctagaaagtaaaaaaaaaaaaataaaccccattgataatcatattcgatttttaaatctcaatgacaataaaaaggagaagcagcgggcggggtgcacaagagtatagttgcagagccgccgacggctgacgggacttatagaaaataaaaaatgaattccaacggtatttatgttcgatttttagaatcacaatgataataaacagtagacggcggacgggctgtagaggggcatagtggcatcgtttgatgggacttctaaaaaatataaaaaatggaactacaagtccaatttttaaatgttcgaaacttctaaaaagtaaaaaaaaacactaataatcatgttcgattttaaaatctcaatgacaataaagaaggaaagcagcgggcgagctatagaggagtacaatggtaaagccatagacggtttggcgggacttttagaaagtaaaattgaacctagacaataattatgttcgatttttaaaatctcaatgacaataaagagaagagacattagacgggccgtagatgagtataatggcaacgtttgacgggacatctaaaaattataaaaataaaacccaacatgacaataaactctagaaactataaaatctaatttttaaaggttccaagaagaataaaaagaaatagtggtatatcgagcaagcaaataaagaacgagatgacataaggggtagcaactggtgtgacttttaaaaactagaaatacgaggatgataagggttggtctttcaaagtcttaagacaataagatagctatctaataaattttaagtaaaatcatataaaaaatatgtgatttttttaggtgctagccgcgcaattgtgcaggccatccagctagttcgtttcattttacaagtcgctttggaaaaaatatagtaacattaatttttcaacacaaaacaaatatattattataatgtattcattattagttttaataaaactaatttgatgttatagatgttattatttttttataaatttgatcaaacttaaataagtttgtttagtaaaaaaatatcaaaacacgacttatatatgaaacgaagagagcattagttagtgggcgtgtacttcaagacttcaagtcaacccttgtcaatgctaaactgggatcaaactcaggaagttatggtctactagcatggttaacaattaccaggcgagcagatcggatgcataggtgtttgagcggtacggccactgtgtatcggtcaaggactgcctccgttctggaatagtgaccgagcacgtgtagggggtgcacagcaaagacaataattctcgaccctggctgcctgtcagcctgtgtgctaaaatgtgttggtggtgtactggtgttcctgttggtgtgaccgtgatactaggctgaattggtgggaagcttgccggagaaatgatcaaagagcatagaaagaattttgatggccttttcatctacacgacatggaggatttggctacaaagaaatgctagaaattttaacaatgactatggtacagcatagtcattgtcacatgtggttgactcaacatgtgcaaagccttcgatgaagcgcaaatcgtttagatgataaaacgccgacttttgctgttagtggctttgtactttctcaaagtgctataatctcctccagtgcataaatctgaagacacctcttggagatgtccctgtacgtgaaactgcttctttctcctttaatgaataggcagaactcgtgccattatcctctcgaaaaaagatactaggctggattcagactttcagagaagaggatcacagtatcctgtgggtctgcttgggctggtcgagtgggccacagtgacaaattgtcgtagacttgggttaagcttaagcctgatccggtaactttccgatcttcttgggccgctgaagaaatctcatgcaaatttgggccatggaagtccaacgagctaggcctattgattcttgcctacaagcccaagcccgtgtacaacgcatcccacaccgttcgttccgttgctgcaactgagctgccattgctggatgcgtctgtgacggaatccaaattacctgagctgacattacacaaaactggaagacaataaatacagaatagcaaagcaaggatcggatttccgattaatcacagttcatacatagataaggtgaagctggacggataacaatatttgagcaagaaacactaagcaaagaaggaacgtgcagcttgcacactgagggcaggcaggcagacagacaaacacaagagtggcactcatgtggaaaagattccgaattgcaggcgtgatttctcaatcatttctgcgcaaagcgataaggtaattaacaacaccattgcagcctcgcagcgtcattaaacgacagcaatgcacagaggaatgttgccgcttaataatgcagagagcaggacagcgcaactaatctctgaaaaattagtggctaggagccttggatcatagcaaaaaagtgctaacaactgcactataaaatgcgtgcctcgcgagtcacaaaattggctgttgtcagagaatatgaaattgcagaagattcttgcaattttcctgttaagtgcatttctgcatgatgtctgcatgacctacatgataggagcacaaagcttttacatctttggtaaggctttcacttacatggattaaaagaatgttaggtgctagcgaaatactagtggagtaattcacagcttctctgatgtaattttgtcggagctaaaaccctgcaagctatgataatcaaactagactactgatgttggatagaactgcatattgtcaacaactccaccgtccagatatcagccatgcatgcagtcaacgaccgccctcactacaaaaatttctcttctgttaccatcaccaacatgtataaatgattaaatgtactccgaacaaatgaaatctttcacctttgctcaactgcacttccattgggggaggaaatgtaggaagaataattttcaatggttacaggataaaagaaaccaatgtatcaagtcctaatcatcgtctgtccttgcctaatgacgtctttgccaccgatttagcactatcattttgctgtacctgacgcgaacttcgtatatctaatattatatttcatcgacttcaaaatttagagttcccatttgctcctctaccgatcggtgatccgaactatctagaaatgtagaaagtgcagtttgaagacatccagtataacctcactgtatctagcgaagatattctgagttgagaatgcttctacctgaccaactgttgaaaaatgcgagctttcaacaagagggcaataattatcagccaaatcacacagcagactttccctagttactcgtatttgtcatgcatatggaagtattccctccgtttttaaatatttgatgccgttgactttttaaaatatatttgaccatttcctatcatttaattcattgttatatatatatatatatagacacacacatacatatatatatacatatacatatatatatatatatatatacatatatatatatacacatatacatatatatatatatacatatatatatatatacatgtatatacatatatattacatattccacaaaagttcttgaataagacgaacgatcaaatatgtgctaaaaagtcaatggtgtcaaatatttagaaacggagggagttgaactagtttcaacagtcagacgaaaaacaaattgtgaaccattttcctgcacaagctaccttttcctttgaattgagaggaagagttttacgcaacttgtcaacagtggcttttcacggtggaacctaataaaattcaaaattttctaggcatgacgttatattttgtaaaaggaacaaaagcaccgggcagactttttgagtgtacactggcaagaaaaaagaacttcacttcgtttcgtcagaatcataagaaacaaaggcagcaccgcagcacatcaaacatttcctgccattcaaatgcacaacatatgatccatattattactgctagctaacatccagagtcttagtattctcatagccacacattagtcctactcctacttaaatttcataatagcaacaaaacatttggacaaagcaaagtgcggttgggcagaggctagtatcaatcatagaacaagctagcgtctaattaaaatgtttttggtgatcatccgcaccgcccgttctattctaaaccacaattgaagctgacgaattaagttgccagcacgacgccatgtgtataaaaggggcctaagctgaacgagcttcgccacatcagtaatcgccaagctctctttcaagcgtagagacctctccacacttatcagagtaataaggaaaaaaatatagattaaaaatggtgaagctcgcattcggaagcttgggtgactccttcagcgccacgtccgtgaaggcctacgtggcggagttcatcgccaccctcctcttcgtcttcgctggcgtcggatccgccattgcctatggtgagctcaacgcattttccggtttgatatgtacagtagtatgtttcatttctgacctaccgacggcttggtttgtgtagggcaattgaccaatggtggcgccctcgacccggccggccttgtggcgatcgcgatcgcccatgcactcgccctgttcgtgggcgtttccgtcgccgccaacatctccggcggccaccttaacccggccgtgacgttcggcctcgccgtcggcggccacatcaccatcctcaccggactcttctactggatcgcccagctgctaggcgcctccatcgcctgcctcctcctcaagtttgtcacccacggcaaggtcagcacgcacaccatcgccatagattaaaggcttagatttaaactgctgtgtatatatttcccgacaagaaggacagcgcgattaaccggtgaattcgatatccgaacgcgtgtaggccatcccgacgcacggcgtcgccggcatcagcgagctggagggcgtcgtgatggagatcgtcatcacgttcgcgctggtgtacacggtgtacgccacggcggcggacccgaagaagggatcgctcggcaccatcgcgcccatcgcgatcggcttcatcgtcggcgccaacatcctcgccgccggcccgttcagcggcggctccatgaacccagcgcgctccttcggccccgccgtcgccgccggcaacttcgctggcaactgggtctactgggtcggcccgctgatcggcggcggcctcgccgggctcgtgtacggcgacgtgttcatcggctcataccagcccgttgccgaccaggactacgcttaaaagtggatgaaccgaattaattgaagtatccgtgtcagtttgcatgcatcgtacgtttgcttgatttgatattcgtcgtgtgtgatacgttcacaggctttgtattttccggtttaccttctttttgtcaaacacggtacatgtaaaaggtcactttctgcgattgttgtctggaaggggaaatcaaaattgtaaaatttcatcgacacaattgataagatcaatttgcattagatttggtttgtaccaggaaatttggaagccatgtcccttttctggctaagataatctatctatctatctatctatctattatatctatctatctatctatctatctatctattatatctatctatctatctatctatctatctatctatctatctatctatctatctatctattatattattaaaacagctttgaaaggagacatcacgttcgctgtgggggttagaaatttccacattaatcggagaaaaagaaaaaaaaagagtccaagtagaagtacaatttaaaaatagctgaaattcggaattaaaaataaacgttcgctgtgggggttagaaattcccacattaatcggagaaaaagaaaaaaaaagagtccaagtagaagtacaatttaaaaatagctgaaattcggaattataaaaataaacaatattgaaagaagtttccatataagaacccaatacgagattaatcaaaattcgaaataaaaataaaataaaaatccaaaattagaaaaggaaaggagagtccaagtagaaatacaatttaaaaatagctgaaattcggaattaaaaataaggaatattgaaataaatttccatataagaacccaatacaagattaataaaaaattgaaataaaaataaaataaaatccaaaattagaaaaggaaatgagagtgcaagtaggaatacaatttaaaaatagctgaaatttgaaattaaaaataaggaatattaaaagaagagtccatataagaacccaatacgagattaattaaaattcggaataaaaataaataaatccgaaattggcaaaagaaaataaaaaataagagttcaagtaggaatacaattctaaattagctgaaattcagaagtaaaaataagcaatattgaaagaagaatccatataagaacccaatacgagattaattaaaatttagaataaaaataaaataatatctaaactagaaaaactaaaagagagttcaaacagaaatacaattttgaaacaactgaaattgaaaataaaaaataaaaacattataataacacaatacaatattaactaatttttttaaaaaatctgaaattagaaaaagaaaattaagatttcaattaggaatacaatttataaataactaaattttttgataaaaataaatattattgaaagaaaagaccatctaaaacacatgacgagataaattaagtaacatgcctataaaggagtagagtggtggtggttgatacgagatataaaaattgttaataaatcaccaaaatagaatcctaatgacaattaaaaggagggacgtcaggcaggccgtgaagcaaacgtggaaaacggttgccgggacttctataaagtaaaaaaaaaacctcattgataatcatattcaatttttaaaatcttaatgacaataaaaagtagaagcagcgagcggggtgtataagagtataattgcagagccgccgatgattgacgggacttctagaaaataagaaatgaattccaacgatagttatattcgatttttagaatcacaatgataataaagatttggcggcggacgggctgtagaggggcatagtggcatcgtttgatgagacttctaaaaattataaaaaagtaaactgcaagtctaatttttaaaggtttggaacttctaaaaagtaaaaaaaaagcaaatgataatcatattcgattttaaaatctcaataacaataaagaagaaggcagcgggcgagctgtagaggagtacaatggcaaagccgctgatagtttggcgggacttctagaaagtaaaaaatgaacccaaacgataattatgttcgatttttaaaatctcaatgacaacaaagagaagagacagtggacgggccgtagagaagtataatggcaacgtttgacgggacatctagaaattataaaaatgaaatccaacgtgataataaactctaaaaactataaaatacaatttttaaaggttccaagaagaatgaatagaaatagtgatagattgagcaagcaaataaagaagaagatgacataaggggtagcaactggtgtgacttttgaaaactatataattagaaacacgaggatgataaggtttggtctttaaaatcttaagacaatgagatagctaaatagctatttaataaattttaagtaaaatcatactaaaaaaatatatgattttatttaggtgctagccgcgtaattgcgcgaaattctcatattaatcggagaaaaataaaaatagagtccatatagaaatataatttagaaatttaaaattatattgtcattttaatatatttgaataatacattgagaaaacatatatgttattatatgagagaaaatataatgatgctagccgcgcaatctgcgcgggccactatgctagttattattaagacatctcgaaaaggaggcaccacgttcgctgtgggggctagaaattcccacattaattagagaaaaaaagaaatatctacaccgttagatcgtagtgggtccagattataatggtgcagattgatcaatgaatatatggaaagaatcatacagcaaattgatttttcgtatccgtgttgttgtactaattcgtatccgattaaccatcgaagaaaaaaaaaggacatgcactgccatatatatatatgcatgcctaaatagctagcctagcactcctggagaaaatatggatggcgtcccggagagaaagcacaccaaatgtcatgcatttttttcaatagattgatgactagcacggcaaattggaagggagtacctgtcgtcatatttttcatcaaataatagtaagcatgtatttacgttataagtccctaaaattatatatgtaattttaacgtatttagactataagtctcaaaattattacatatgtaaatcccaaacttatatatgcaagtgatgtaagtctcaaaattataaattattggcgactaagatatagggttttcgaagattaattggtaatcctaattagcaaataacgtaaaaagtatagaagaaattagaaaaaaaaaagagcggagtgatagacacgtcatgatgaatcccaaaatttgatctcaatacgaattcgtagaattcgacaaagttcaggtaggaatacaatttagaaattactgaaatttagaattaaaaataaagaatattagaagcagtgtccatctagaacacaacaaaatattttttaaaaattaaaatttaaaataaaatacaactccaaattggtttttaatatgaattcgaaagagttcaagtagtatctatttatcatattattgaattttaatattactaaaaaatatttgttagatgatatcatgttaaaattatagtggttaaatttaacacaaaaatcaaatagaatcccagtaatgattaagagaaggaatgatgggcaagctgttaagcagcacaatcacagtggttggcaagagttttagaaagtaaaaggtaaaccaaaatcataatcacgttcgatttttaaaatctcaatgataattaagagggaatgcaacgggtgggtcatagaggagtacaatggcgaagctgttgacggtttgccgggacttctaaaaagttaaaaataaacaccgatgataattatgttcaattttaaaatctcaatggcaacaaagaaaaggaggcggcggatggactatagacgagtagagtggccgcttttgacggagacttataaaaattataaaaaacaaaacccaacgagacaataaactgtctaattttaaaagttccaaggaggataaatagaaaccctaatagatcgagcaagaaaataaaagggtgacaaataagtaagaggtagcgataggtgtgattttcaaaaatataaaactagaaacatggagataataaggttaggttgatcaaattcctaagataataatatagctatttaacttttttttaaaaaaataattttgtatggaagctagccgcgcaattgcgcggtcacccagctagttatattattaaaagaatagaaaaaggagctcccacgttcgctctcatggcctaaaaattctcacattaatcagagaaaaaaaaagcagagtccatatagaaatacaatttagaaatagcagaaattggaaattaaaaaataaggaatattagaagagaagactagagtccatatatacatacaatatagaaatagctgaaattcggaattaaaaaataaggaatattagaagaggagactagagtcgatatagaaataaaattaggaaataactgaaattcgaaattaaaaataaggaatattagaagtaaagtatagagtccatatagaaatagaattaggaaataatagaaatttggaattaaaaaataaggaatattagaagtagagtaaagagtccatatagaaatacaattaagaaaaaaaatagaaattcggaattaaaaaataaggaatattagaagtagagtatagggtccatataagaatttaaactaactaaaattcaaaataaacataataaaattaaaagtatagtttagagtccgtataaaaatacaatttacaaataactaaaattcaaaattaagaaaaacatgggaagaagagtttaaagtcaatataggaatacaagttagaagtaactgaaatttgaaattaaaaattaaagaatattgaaagattagtttagagtccacatagtgtcggtgacatgggatcaggagtatcatgactagaggtttgaggcagacgcaatcgcccacgtggcctggcaccctcgggggacgtcgggcccgagggtgatgtgttcgccctcctcctagtccccccgagggggtcgggctgcacccccctcggccccgagggccgaggcgccccgacccctcgtgggttttttgctccgcgtgtatgggttaggtgagcacagtggggctcacctaccacatttattgcggtttgactgagcgtgtcacgccgcatgcaacgtagtgcagtgcactcgtttatccggtctgtgaccagtcacagaccggtcagatcgcgggttaggtggccacaggcgatctgacacacgcctcgccccatcccgtcaggacgagggcttctaggcgctcgtccccagctggagctagcgtgttacctcccagagatggcacgttagccctgatcagatatatgccaggcttcatcctaaccattacaagcaagatgttgtgtgaagaagggcggacatgtagattgctaagctgacacgtggtggacaagaatgaccgacgtgactggtctgactccggtcatgtcgtcagcaggcggccacgattccacgtcgcatctgctcccggcgaaagtgggggtagttgtgggccgtcccatcagaaggtgactcggatggcaactatacaaatctccgtccatttatgaaaaggtgggggaggtccccacaaaaaagagggaaatggtgcatgtggtatcctcttaagatataaaaggaggaccttgcccaccgagagagggggtttttctttttcttggactgaacctttccagattaggaacccagaacaagggagaggctggctcatactttgtagctctttcacacacgaatccaccaaaacacaggagtagggtattacgcttctaagcggcccgaacctgtatacatcgccggcgtcttctgtgcttcctgtctcgcgaaccttccacatacagattgggagcttagagtctcacccagggtccccggccgaaccggcaaaggggggcctgcgcggtctcccggtgaggagccccacgctccgtcatctggcgcgccaggtaggggactctgcgagtgatcttctgagctctcgcactccttcgtgtgcgccaagctttttctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggctgaaggatccgcgacttcgacatccacaggaggtggagaagggcggcgagatggggagcgtcgcctcctcgtctacggcgacggcagcacgccccagggcgcgctccaagctgcaggcgcgctcctacgtcacccgcccgtcgtccatgacccggagtctccagcccaacgttggctggacgatgtggccaaattggtcatgactgcacggcagcgcctaggtgctggtgggcggtcctccgccaccaaggcctctggtgctgctaccaccggctccgcgtcgtcaagacggagggcacgaagagcggcagccgctgttcgccattcggccgccactccttcgtcgactccttcgacccgggaagatctgcgtggggggccggacgcccgcaccagcatcgagcgccggcgtaatgaccgacgtgctgcccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgacgggagcgtcaaccccgccgagtttctccaagtctacacgaccgggatcgaggccgccgggggtgacgacagggtcatggcgaatttctttcccatggccctgaaaggacaggcgcggggttggctaatgaacttgccacccgcgtctgtccactcttgggaggatttgtgccaacagttcaccatgaacttccaaggcacatatccgcgccccggtgaggaagcggacttgcacgcagtacagcgaagggatgatgagtcacttcgctcgtacattcagcggttctgtcaagtccgtaataccataccatgcatccctgcacacgcggtgatttacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagacagggcggcgtgataggaggaggaagaagaggtcagcccataccgacgacgagggtcatgtcctcgccgtcgagggcgctccgcgggccacccgaaaggggaggcctgcgggtgacaaaaagaaagaggccggcgctcccagcagggagcgcccaaccggcaagtggtgcaccgtccacaacacttcccttcatgacctcgcggactgccgtgtagtcacagaccggtcagatcgcgggttaggtggccacaggcgatctgacacacgcctcaccccatcccgtcaggacgagggcttctaggcgctcgtccccagctggagctagcgtgttacctcccagagatggcacgttagccctgatcagatatatgccaggcttcatcctaaccattacaagcaagatgttgtgtgaagaagggcggacatgtagattgctaagctgacacgtggtggacaagaatgaccgacgtgactggtctgactc

SEQ ID NO: 78867 - DNA, 15790 bp, Oryza sativa
  unsure (1)..(15790): unsure at all n locations
ttcggaccaccaatccacctgaagttgaaagattcacaatgttaataggatttcaagtttccagagttgatagcacatggatcatgcaatcaatggtactgaccagactgagcttcagaaacaccttcctcagaacaggtgagtggttgacatattggcgtagaggcaagaaattatcggccatgcaccattcacccaagcgcaaggttctgagattcctaaacatcggcctacttccttgttgttccatgaatgtaaacttcatatgtgcaaagcaaaaaattacaagtatgctatgaataccaataatttgtggcaaaactgtgataaataagagaatatntctcctcctcgggttatatttatatatacaacacctcacaaatatgtggtcaaggtaaaagtggtatatacattttttaaaaaagaaaagtggtacataccaattttttgaaaacccaaagtgtattatacattttgttttgaaaaggcaaaatggtatatacatttttttgaaaaggcaaagtgctttataanattttttggataaccaaatggtatatgcatataatccaaaatgatggttcatgctttccttgctatgaaataaatactcactatattattttctaaataatatagcaatttcattcacgtaagtatggtcacataaaaattgtatgatgtttatggaagtaataaaatgtctgcaaaaagggattagtgatacctgtctatcagtagctgtcaactctatgcttgtgacatctgaagcatcaacgagagtgattgttgtgaatgtcaggtaagagtttgtaaatgaaaaactgcccgtttgttgacccttgatgcacaacgagaccaaactcggagtacagatgcttacattatccagaagagagcaaccgatcaaatccaaattttgtagtgaacttgaagaaatgtgttgcacctccattaaacactcttttagtaccagattttccaaaaccgggcatgcgttattgagacgatcaaataccatctcatttagagctgcattagtcagctccaatgtttttagataccgagaactgaactccacaagttctggatccaagtaaaaaggttcccaacttggatactcagaaaatttaactactttagcgttgtgcttgatagcatggttgatccaagaaccggcccggtccactgcaaaagaatctagctggaatgtatccatagaagcatcaagatggtcgcggcttagcaatagtttgtcaatagaactacggaatttttccctatctaggcgaaaccaatttatatcaagctttattgactgcaagcaagtccacttgttgacccaccagtgggacaggacactcgtgcgcaccgcctccttcatcgacaagaaggacattatgtggtggatcagatcatttgggagttcgctgatcctatcttttccatggggatgggagggttccttgtggcctgcagtttagaactggatactgagttacttaaattcagtgtgaacaagttttgacattgattcagtacatgcttcttagtgtaggtacatgatcttggagaaccacacaaacaactcacaacaaatttacaatttctgtgtgggcttaaatctagattcacagagatattgctatcttaaatacactttacataaatgataaaacattgccctagtagctttgagtttttcgtttttttttaaagaaaaaagtaaggaggtgaggctcacacatcaatcatgtgttgcaccagaataacaaatattctcgattttgcaccaaaattaccaatgtgtaaaggatgaaaacatgaaaaatgctttaactcaaacatgggatcgggttgtgtatttacaaattttattctcatatatttttcatgtatcaacctgtctagaagattataatcatgtgtagactatggagaaaatacatcatgtaggcaacataaaaaaaaagaacatactggtgttcaaattttcaagaacttactgctagatgatgtcccctgaacatttccttctgcctggataatttggccctgcttattcttctgatggagcaagaaaaatgaagaggttgaagcttgctgatgaatatgcagaaaattgttcaacatcagaggatatgaatcatccaaatcgccttttatcagactaatcctccgtagataatcaccctatgtagtgcgagaaagaaaaatcatcagaacttttatttaaacataaaatcctatattgaaccataactttataataccagcgaaaacatacaaagttagcaaagagagtgttccacaatctggcaagccaagaataagtgcaaatattattgaatggagaatgaacctaaacaaagtactttctatatgaggataaaatcaatatattatagattttttctagagatgcacatatataagtcaaaaaaacagaaaaggatgatttttgtcaactatataaaaagtgaatcgaaaggggaacataaataattggaattgtttatgaacgatcacttcaattaaatacaacatcaatcctagtggcttctgcgccacagtaaaggaagagtaataaacatttttaattagatgcagaatttgcatagaacatcttgcaaccatatgttttcaagtaagatggtcatcctaacggcctcacacaattgttatagctctaagtagttctagacttctcggcaataagttattgtacttgtttaggagctttaaggttaacactattaaggtgttactattaaggttaacactattacgcgcattaacagacataaaaataaaatttaatacctaaggaaatttgattgcataaaaaactattaagaacaaaccatcgtacaaagtcaatagctattttgtagattctctcctctattctagcagcaactttttgaagatcaatcaatgttgtagaagtagttgtttgcaatttcatctgcaggctgaacaatctgcaagcagaataccaaatattaatacaacatatttaatatttcactatggtacttcactgtttaatattaatccaaaatgtggccagtcaagaaatacatgcatgctatatattcactgtttgagaaatgcatgtttgtgaaagtaacatgtttggaattgtagatacattctcataaatactgaaatatcatttgtccaaccaaaagtgtcatattttagcaaatttgtgccatcatgtatgctaagagtttggaggagagcattcataaccaataataaggaggaattatgtatacgacaaacaaaacaagatggatgtgtgaacatgggaccatctttcttgtaagttttaccacctacatccacccccccccccaaaaaaaaaaaagaaagaaagaaagaaagaaaaagcacctaaacctataagtgatatctaccaacagatttttgcttttttctggagtagctgcatcatctcatatatttttcattgtgtaaggtggactcagttacacaattgcagaaccaacagtccaacaccatgacttctccagttcttcctcctccctcaaggtgggaacatgaatcaccttaagggttttaacacctactccaaattaaatatgctagccaaaaaatttgaaagacagaacaaattaggagcagaactaaaacactagtccataaagcttatacccatgcaccatgcaaggaactggccacataatttagtacggaactattgacatgcaaacttagttcattttcttttggcgatgattcatttactagggtaattttctaaatatgaaacaacttaccttttatacttggatacgatcaaaatacaaaggtttgagtccaatcaacaacgttttgcccagaacaacaatgatttttaggtgatttgggcatatggcagagttagagccggagttgaaccaaacaatactagatcctcagttttctaaaagtgaagtgcgtggatctgctccacaagatatgcagaaagggtggagctacctttttttggatccagaacttcagctacatattagatttgtagctctaccaaacaaatctaactgttacttaaatctagaaaacatcagattggatctgactaccgatatgatgattcagttagatcattaacaagtatagcatggatgacgatttccaatcttgataataaactatcatcaattcaaaactttgtaatcaatttctcatggaaaaaaaagtaagaataggggaagagagagacgaggagggggcacttacatatcacgttttaccctatcgcgaatatcctggccaaggcgggtcctccaatcgacaccttcctcgatgatccctaactcgtccattatgccgattaactcaaatctttgcttctttgctttcgttaggcagaagaagtgctcagagatggcgaagaacaacaagaggtcgatgatataggcagaattgaaccttataggctttagttgttggtgggatccacaaaagaagtaacgcttccgtgggagaagggtatagctcacatgacatgacaaaattacttataacacgggagaaggatatggcccacatgacttgacaacatcacctagcttataacatgtgaggtagcttctagaacctcaatagagacctatacaaaataaaattgtggcaattgacttccaatatctagggttaaaaaaatcgaaaccgaaaatcaaacccaaaataaccaagacaaaaccaaaaaaactgaagcactggtcaatgttcccgacgtcggtctcaggtttgcaaaggccaattcttatttcagtttatttggtctttgtatggggtatccggactacccattctatttacgcgttatccgaatccactccttattcctcagcacatccttgtgcagttgcgctccgtcaactgccgtagccgacacccttcctccattctggtgcttctctccctcttcttcccgccttagaatttcggccgggcccacttacatccggcagctttcataggtcatagactgccctttacgcgttatccgaatccactccttattcctcagcacatccttgtgcagttgcgctccgtcaactgccgtagccgacacccttcctccattccggtgcttctctccctcttcttcccgccttagaatttcggccgggcccacttacatccggcagctttcataggtcatagattgccctttacgtgttatccgaatccactccttattccttagcacatccttgtgcagttgcgctccgtcaactgccgtagccgacacccttcctccattctggtgctttgcgcactctggcagtgcagttgcgctccgtcaactgccgtagccgacacccctcctccattccggtgcttctctccctcttcttcccgtcttagaattttggccgggcccacttacatctggcagctttcataggtcatagactgcccccacagaccaacacaagtcttttctgcacactttgtcctcattcatgcgcacccgggaagaatttccgagtcggtcacccatcccaaattgctccaggccaagcacgcttaaccttggagttctttagagatcggctttcggaaaaaaagttgcaacttgttaatatcagtatcctattaatcctattaagccctaggtcggaatgttacaacatggttctcatcccatctatgcatccacctccacttctagtcgggataccctcctcaggccgccatgcatctacagtaaggtggaaatggtgggggagaactgaagctaagggtgtagcagctggtaggttatggccacgatggtgcctctccggggacatgttgcagcttgcaagggcctatcccctccgtgtaattcgcatcttcacactgctactagcaaaggctgccaatagcggccatctcctctgaggagagttggaagtccacatgaaagttgagaaccacatctggacccatctacatgtaagtgtgcggtttgcctgcatgcagtcctacatgggagatgagtgttctattctggtcggtcataccaagaacagagaccaaactatttgttaaccgaatagtcgattcacacatttgtgctgacaagtgatcagtcttccattttcaaacaccaaaaagactggactgaattatcagtcatgacggaacactcacccctagcaatatctatcaagaagcagttgtattataaagtggatcttatatgatagtacgatgtggtgatttaaaaaaaaaaggaaaagattgggattaatttatccctaaaggtatttctcggaaatgtgtttaacccggagctaaaagcgggacgtttccacccaaagaatagctagtgtcgccatggttggccaccccaacacgccatagttggcgtcacgtcttcatttgcatgtgcaacgtacgttggcattaagctgtctacaagctgactcaaaatcatcatccaggttgacatgcacaacgttgccatagtgaatatagatctactactagtagtagtgttattctcctatatatacctctctccaaaaaaccagtcgaaattgaactagaaagaccgacacgatgtgcatgcaaacgaatgttcagcagccgctcccctagcacatactgtacgtggatgccacattataagggataccaccaactagtttggatagacccagtttttaaaaggagttcagggtgaaatttggactatgattaatgtgtagtgacgcacctcagactaccattgtgaaaagtcatatgtaatcctgtcaaagaaaatgcagatagaaacttcataggtacagtcatctggaggagttggtttgctggctagatgccctcgctttaaagcttttaaaatcaaatcacttagaagccccaaaacaaacagagacatatccctactattataaaaattgaagatgtttttaccagaattttaataagtcatccgtatttgaatcggttttatctatatatttacctattataaaactgaagatgattccgtactcataggtagtttcgtccatcctggtcatgctggttctgtccgattgagttcctattgatcattccttttttttccaacatgagcgttgaatctgcatcggcggcgagcaaactagagcccatatagcttccggtatttttttatccttttttcgctgtttctttatcacactttcgggttttttttctttcgtttttctcgcatctcgccctttttttatctcgtccgatccatctcacgtgcatcccgccaccgccgagacataccctcagcgctgatttttgaaagaaacggaaagaggtgatcgagtggatttgaggggaggattggctcaggcatacagtcacataactgccaccgccaagacaaaccttagcgccgccattcgattttgggaaaaacagaaagagcagatcgagtggattaatagcccttaaccaattttgggagatcaagaaagatttggatgaatttgaggggacaattttgggagatcaagaaagatttggctggatttgaggggaggattggctcatatgaccatcttccgaggttaaagacgactgtcgatgtgtgagcggggtttgtggcctcacttgtgggctaagctcgagaggagagagagagagggagagagaggggggtagtggactgggtggggctaaaaagaaagaaaagaatgggctttcagcccaaaaccaagaatgaatttttattaactttttcaattatgattatacagcggttctaatggttcaatttattggcaagcttccaatagttgttgtatccctgaaaaacggtttctccgttgctacgcacgggcatttttctagtatctatactaatatataaaacgcaagttgtttcttccctacatccacccaagaaagtgtacccataagtttcctagctgttggatcctctaatctaacgatgtacattgccgattggattaacactgtgattagtgtcggattaacaccaattagtgcttcgccaatccttctcttcgctaaaaaaaacggtcgcccgtgtctccacccagaccacccgcccctccacatcccccccaccgccgtccgccctccaccccacccgcacatcccagccacccgccctccatcctcgtttcttaatttctctatttatcttgttttcttccacatttacatatccaaagtggaattcttaggttggacaataccacactttgctaccgtctgcctttgcagggcaggagagaggagggtcagcattctaatggacgaggaggatgcagaccactgccgacatggcgaaggggctcgacttcctcctttgcgcttagatgctggccatctaccaacttcaatccatctaacatcctcctcgactcggtgagagctagcctgtcactttgctcaactgcagtacaattttcagtcattgaccaacatactcttagtactgtcacctattgttgacgcaaaaaacacacactaatcagcacatcaggaactatcttcttgatcacatcttgtagtgtactcatcaaaaccccagactgattctagtaaaaaaaaaacccagactgatcaaacaaggcatgatgaaatgtttcatcaactttatcttgagatgtttcaaccatcggcttaggagattgtcccttgttggcattgacttcctcttcagacatgttgggtataaaacacgtgtcccactgggcgtgccaaaaatgcgttgacgcaaaaaacacacactggcttgggagacctgcttagctctagtgcaggtccaaaggttgatgagatgcagacgtgccagttagtttgaccctgcaactgacaagatatacaaatagcagatcaataagccgatcggctgacaagccgatggagtagttccagcccatgccgatacaagccgatagcgagagggtttcgaggtatcggctatgtgtttgatgtggagtctgacacttgatgtaaataacaacataaaggcaatcggttgatgataatgaaagaaagcaacaatataatccagtagaaaccaatcggctaacaatgacatgatagaataagcactaatccgaaggttaaagcatacatctgctggagatccgatgtcataaaatccacaagattagataaacaataaagtctttgttgtcatcgtctaaatccaatctatatgcaatccttgtaagccgatgcaacgtacagatacctcatcgactgaaaccccgatgaaacccttattgggaatcatgtatcattcttagactatagcaattcagtattttggctgctgatgaaatcattcttgactgaacatgtgatcagtagcatttgtggaaacttgagaataaaacttcagtcaactgcatattgtttgcacaactctaattataatttttcctatcatttgcatgagtttgggtgtacttatttgtttgtgcaaatttaatgcatttttaacattatctgtctgaataatgataccgtcagaaaaattagaacttatactccatttgatatattatgctaacatacatgggttccacatgcacacacaactatgtaattaatgaaaataataaaaaactaacaatttctaccctttcctttctccattaatattaaattatctctttactgtccgattgctacaatatttttatatgtattaccaaataatggataaacatagataatatattttgagaaagtagcatgttttatttgatagtatgatgaaccctgagctccactcgagacactcaaggctgttgttggcctgatctttcgatgagttgatgataactacgatttgggagaaatggtgatgacccgactacaaccgtactagacattgttgtgttgcgccttagcgatcgatacacctcttcgtgagttgttgatcttgccggtgcaaatcaaccttattactgcaaacaaatcgaagaaacaagcaagaacaagataaaagaaatccgaaatgcaaataggaattgagtacaaatgataagttggggttccgtaatgagtaaaccggcgatctaaccgatcacgggattatatggcaaagtagcaaagctaaactttaactaaacaaaacccaagaaaccctggagggatacctagctatttataggggtgggagaacgaccaagggtgccctagggttgttctccaccaggttggggcacaccccacatgggccccacttgagtcggggtcccagacaaagttacaagcccataggccctttataggtgacgcaacatcttgtttcttcaattgcagctcactaagacagaatttcgcaatgagattggatccattagaaagaggcctcggagagctttccatcaagtactcgcggaccaaaaacagagctcgtatgcatatttggcggccgtttgaagttagcaatgtagtaggtggccgaatcgaattccagcacatggaggacttgatcttaatgtcttcttgttgatccatgatatgagcaatggttgtatccatagttgccatgatcacatcatagttcagcacctgtaccaagtcaaagcatacacaacaagcattcttgatttggtttgcgtattttgcaaacaacgttgaaaggctaacttaataaaactttattctaaggtcaaaacatagtagacctaatcatggcttaggcagtttgcatctcttgacgatgttatcttcatagttcttcatttctccctaggaattgactggctgatggagctccctcatcgtcacgatcacatccgtcgcgtatatactgaaagggaactctaacagctctctcctaattgattggttcatagaactcactcttggtcacttgttgtggtggtggatccacttcatcgtcaatcgattcatacgatgccatgagtattgcagcactagtgagtctcgtgggcttatacaacgaaggaggacgtgtgggagtaaggagatgatttgataatatatttatcggcagatgggtacaatgagtcaacgatttttggatgattcacttgcatgtaggaggaaatgacatcacataccatatcattcacaaatattgtcggtgatatgggccagggggtacctggtctaaggggaaggaaagcccttcctgtgtggcgcgcacagcgggcccggtccccctcagggggtcacgccttcgattgggaagcggctgcctgtcccccctcccctcccccgggctcggggtacctcgtcgtacccctcgggcccgaggggttgaaccgcccctgaggccctcgctcggccgccacgtggtgaccacgcaggagcctcgagcaggcgtgagcgctgtccaccaggcgcatttatgagcggcgcgccaaccgccccggtcgcatttaatgcgacgtggcagggcatgcgccgttcaccgatggacgtgcgcctagcgaccgccttttgaccggtctgtgacccggtgatggatggatgggacgggcgacagcgcacccacgtcccgattcgtgtcaggcggcgtgggagcaggtatgccctgtcccatcatgcgcagtgggaggtcctgcaggtcgtcatctccgatgaacgtgtgcccatgaagtcaccaaacatttaatagcgaatgatggggggtgccccccgtgtcagccgtaaagttccggtgggggccacccaaggttagccgcatggattgcttccggcccaaggcacaagatgcattttaatataggcattgtgggccccactcccgtgagaagagagcaggggcgatgcatgtggtatccccttcatctataaaaggaggaccatgccctacgagaaaaggggacgtctcttagaaacccaggtttagggaagaggctggctaagccctagcttgtactcccaggatctgaagtctttgtaaccccacgaagatcatcacacacagacaggagtagggtgttacgattgatagcggcccgaacctgtataaaccctctatgtcaccctctcactttccacctcgagagcttgattcctgtagactcgcctcgctcggacgagtacacgttcctcagcattgcacccagtcccctggccgaactcacaaggggggcctcatagcctcccgctagagaggatcacccctcgacaaatatatatttacattgttttcatcttgcttttcagtgagaaattacggcatggctaactcctatgatctgttagcaattgttgttcatggagttgaaaaatggacatggtagcctcagaagaaatgaaaaaatatctataattttttttttttgcactatgtgaccaatagttttacatacgtgttaaaaagtcacatgtttgacataaaaaaattcaaataaaattaccccgcatatcaagtcaacttttttacaaatttggcatacaataaattttggaatatataaaagaaaaaagtacgaattaccccccctggtctatcacggtcgatcgaattaccccccctgaactacaaaaccggacatccttcaccgcgaactatgcaaaccggacaaataacccccctggctcaatccgcagtggttttcgtcctacgtagcagtacagtcagcaattttattttgttttaaataaatcaatgggccccactgtcagtttcaccctctctacctctccctatcatatctctttccccaatccccctctctcttctccctcccctcaactccagcactcaacggtggtggtgagccgaggacggcggcgaagaagctgggtgctgcggaggggggccaaggacgttgcgggtagttggcgcggacgtcgcgctccacctccgcctccaccgtcggtcgcccaagctcgccgtctccactgcgaccactcgagctcgctcctccaccgtcagcggccgcccgagctcgctccgcgtccgcctacaccataagccactagagctaccggtcgttgaggtaagctccacgtggatccagccaccttgaggtcaagcggcaccacggtggttgggggtggcaacagcgagaaggaggttggggacagggatgacgctggggagattgggcggcggcggcgatttcgcatagagacaccggtggattcgtgcaaacgacgcgctccgcctctacctccacctacaccgtcggccgtccgagcttgccgcctccaccgtgaccacctgagctcgtttcgccaccggcggcagcctcccgagctcactcctccaccgcctccaccgccggccactcgagctcgctctgccactgtcgccacccagcccagcgaggtccacctccaccgctggccacctgagaaagagagagagagagcgcacaagggggacttggagggatttgattgaggaatatgtatgacttgtgggcccagggaatttttttttattttatttgctgactagattccacgttggcgccacgtgtacaagctcaactctaaaccgctatgaacaatgctcaaaggggttatttgtccggtatgaatacttgagggtgtaaaatatctggttttgtggtttagggggtaattcgatcgaccgtggtagttcgtggaggggggtatatcatactttttcctttataaaaaaatatttattaagattggatgatggatacacatctctactacacattttcctttaaaaatcatttttttaaagtcacatgaaaagaaataggtccaatcagaaaaatctctatttttaaagagttccattcgcatggcaacatgcatgcggagatggatggaaggaataattccaatcttacgtgacaatatgcatgcggaataattctaacttgtatggttgatagcgtgcatgcatgcagagatgaatggagtgaattagtctccaactaatatcttttctcctttttgcgctccaacaagcaccgctgtctataaataaccggtgttgggtgaagcctacaattaaaataccagaaatgctcatactatcgtcaacctccaatagtaccctacctttgtgagctggtaaggtgctattatcctttcctttgcttttttttttcatttttagttcacattcctgcatgtatcattgtgttcatacaaatatttgtagaaaccaatcagtttcaccttccagcaagttcaagatgtcgggttctatggggagtaagtcaggtagcgggagaggcagcggtaccaccagcaacaaagttcagtgaacaggtaaatgaaccaacagtgaacatggactccatagatgatgtataacctcctacaaatctaaacacaaagagagaacaccgtcaatacatgaaacaacatagacctgtcagaatcctttttgactatatgtacgatagtaaccatcatgttgagagtgacacggaaaaaatacaagtgcaagtatgaacacttcaaggaggaatttactcggcatatgcacaaagtaaaggctacaatcaaaccaagttggccatcatggatacattctattagatagaactctttcttttttactcccctttctttctccctccctctcttgtattctctcacttatgtacatattattatttattaatatagcacaataggagcctctcctgctgtttaaccgtaaaaaaaaacactcgtcatcacttgtggccgatcttatccattgcgtataacagcacttgtcaacactcgtctaacaactctctctgaattgattggttgatggagctctctcttggtcacttgctgtggcggtggatccaattcttcatcaacagatttataagatgccattagtatttcatcaactcatgggcttatacaacgaaggtggatcgtctgttaggagagaggtgaggagagggaggattgtgtggaagtaaggagataatttgaggatatatttatcgacagatgggtacaaggtgttaatgaattttgatgattcatttgcatgttggaggagataatcatgacaaaactaggtgggactcgcatgtaaatagacacactccaatagaaatacaatacttataagcatgccactatgcaacagaattgaatgagctgtcactcattctcaccccatcactaatttatcacattatatcagcactagaatttaatattaaaatttataaacattattgagatttgataatggataaacatagaaaatatatttctggacatcagttaccatattgttcacaaatatatattcacattgtttttgtcttgcttgtcagtgagaggttacgatgcggataactgtcagaccctaaaaaccgctaaattataaattgttgtgaaaaagaaatttctaggtatttttttaataattaaagtaagtgttgagctagataaaacttctcttaaatactttgagtgttcatgtattttctatattcttcccgtaattttttgagctttggaagtatatttaataagtgaaacaacatttcaacatttatttaaattaataaggaattaaaatctttcttccttccctcgggccaaatccggctcactcctctcctgtctaccttcctcagcccgcagcccgcgcccctctctctcgtccggcctagagagaaagaaaagtctcctttgcaaccctctacctcccttctctctgacgcttcgggtccactcggcacagtgccgtcttcctcctccagccagcctcactccccgtgcccgtgcgttgcaacacagtctcctccaccaaatccgcccgcgccgttgctcctcatccaaaattgatcacgga

SEQ ID NO: 78868 - DNA, 3618 bp, Oryza sativa
tcgcctctccgggatgctcatgccggagacgctcgcgctcgccgccgcctccagcacaaacctgagcccccgcaaacgcgtaagatcatccgcgattggatggagagtgcgagaggtttttttgcgagatgatctgatccggagttcgtgtttctgcgtgcagtattccaggtgcaggagcgccatctccgcgcaccagcacacgatcgggaggtggttccaccacagggacgggagcagcagcagcagcagcagcagggtcgacaaggcccgcgccgagcgggcgcgcgtgcacgccgcggtcaccgtggcgagcgtggcggccgccgtcgcggccgtggcctccggcgcggcgaacgacccggacgacctcgacgacgccaagatggacgccgcgctggcgtccgccacacagctgctggcctcgcactgcatcgagatcgccgagctcgccggcgccgaccacgaccaggtcgcctccgcggtggaggccgccgtcgacgtgcggagccccggcgatctcatgaccctgaccgcctccgcagccacaggtgagcaaccatgcatcacgacaggccttctctagctcctgccacgcatgccaaccccgaagcaactaaatcatcttcgagttctctcgcaacatggcagctctgagaggagcgacggcgctgaggctgagagcgcagcgggaggcgaggagcaaggtggcggcggtggcgccctacgagaagaccggcagctgccgcggcgacatatggtgcaaggaagggacgctcctgaaacgcagccggaaaggtaaagctcaaaaaaagcctctccttgacacggacgcacgtcacaacgtcgtcacgtcgccgcgcgcccaaactgagctcgatcttgggatggtgattttttcaattttctcatcaggcgctttgcaccggaagcgcgtggccgtctacatcaacaagaagtcgcaggtgatcgtgaaactgaagagcaagcacatcggcggcgccttctccaagaagaagaagagcgtcgtgtacggcgtcgacgacgacgtgcaggcgtggccggcgccgcacgcgtgcggcggcggcgccgtgcctcctgctccggagacggcgtcgtcggagaagtgccagttcgggctgaggacggcgcagggcgtggtcgagttccagtgcgagagcagggcgcagaagcaggactgggtggagtcggtgaagaatctgctccggcaggcggccggcgggacggctcagctcgagcactccttcgaatctctccggcttagcgcctcgtaaaacgtaaaaacccagtgaattcgttttcgtttgctgtaaaatttacctgtcgagaccccgactgcccgttcattttatcgcaaagggagcagccgagacgtttcagtgttggagctgaagaataaatgtgcatacttgtaataacatgaataatttgtataaggatcagtagataaatgtcggtgttaagattttgatgtactgctctctttacacacgccactcattacctgtttaggtagcaattccgctcaaaaatgcaaacacgcagtgataagtagtactcatatgaattctgaaggcgttttttgacctttcagtcagggtctcgggggagagcccattagttattgaccctcttcatttacaggtatcgggggaaagcaacaatttttgcacgctaccaatcgtgcatctaactgatagcactatagcacagcgcacaaactttgttgaacgtctcgcacgagacggtgcaaagttctattgatatagcagaaaaaaaaaacgagattacgagggtcgtagccaggaaaaaaaattaaccatcacccacacaccaatatcgccaacacacaagcccaggagaaggctagcaccagaccagccgccgctaagcgtgactgaccgccactagatcaacaaagctccaccaccacactagctctgccgacatgtgggacccctgcaccggcgccccccgccggccaaccttcgtgcgccggagtccgctccacacccaccggcagctcctcctcgcacctaggtcgcctcctccaccgccggtcgcgcctctctgcaccaagccggcctcctccaccggatgcgcctcgcgccaatccggcctccctccatcggctgcgcctctcgcgccaagccggcctccatctccgccgcctgcgccaagccggcctccatctccaccgcccgcgcctctcgcgccgagccggcctccgctgccatcggctgcgcttctctgcgccaagctgatctccgacccctccacccaacgatgccgcgccggccagatgcaaccgtctcccacgccctcggcaagccgtctgaggccgccatgcctctgatgaccgccacggcaccaccaccgcagccgctgctgtcgaacactcagccacctcgccgtcgccatcctcgcctcgcacctgactccttccgcgccaccaacgttgccaccgcctccacagtcacggccgccgcgccgctgccaccgacgcgaaccaccgcctccgcaaaccgtcgttgcgccgtcgccctccaccaccaagcagccagcaaccgccgccgccaactgccgcgaccacaccgccgccgctgtcgccaacaggcgtcgccagccgaccaccaccgaccgcacccagatccggccgagagccgccgtggacgttgcagatcgcgggcgccgtcggcagccaccgccgccggcagcaccacctccagaagctcctgccgacggatgtcgccgccgctgccgccgcgacgggtgcccctgccacaagcttgccctgctgtcatcgccacgttgtcgcgagctccgctgcccccgccacgagctagctcgatccggccgccgggtggctagatctgccttcagcgtggccggatccagcgcctctgccgccgtcgccatccccgccgccgtcgacccagccgcgtctctgccgacaccatcgccttttggctgtcaaaccttacaattcgaatttaaaattccaccccctctctcgaactgagctattccgatgataaatcactaggacgacataagacagacacataacctacgtaccacaatttcttcccgccgccgtctccatccctgccgccagccgccaccccgccagatccggccgaggcggcgcggatctggcggtcaccgtcgccactgccctgggttgctcccccggccgcccggacgagatgaggttgacgagaaaatgaggagccccgccgccgccgtccttgcggccgcgcggctttgccggcggccgctcaggcggcggcgaggcggaggaggaagatgggggggaggggcggccggagattgacgcctcccgtgccacctctgggggagggcgacgcgagaggaagggtagaactcgcttcagaaatagtgaacttttgtagctgatggcataagatggtcattaacataaattactcattcgatctcaagtaacaatgttcatacaaagactatagatttcactcaagtatcaccttggtttccaggtacaaattgctcatcttactcctaactagatgcaattcgaagaaactaatatagaaaaggctggtaaggagttgt

SEQ ID NO: 78869 - DNA, 4384 bp, Oryza sativa
aacgaacccgagcgccgctgcctcccgtcgacctccagccgtcacccaccgttgttcccgccattccgaacctttgccgtcgccatccccgtcatcgcagcgccgaggagaagcccgtctaccccttcgatgccgcggcccgtcgccggaaagccgccgcctgcgccgacccgagctcgccgccctttggagctcgccgccggtgtctcccttcgccatgtgtcatcgtgtaagtagtggtaaggatcgcctcggtcccttcttcctccccgtgccctctgtttccgccggagcaccaccgttcgccggcgaccctcggttcctaagccggcccgcgtcgatcccgcatggcttccacgtcgttgccaaattaccaccacctcagcgccacgtcatcattctgtccacgtgggagccgatctaaaccttggatcagcttcaatctaatcggttggatctcaatcaactggcggtcaagatcgatctgagccatccatcccgtggacccgtggaccattttgtggacttggttcatggtagcggctccatgactagtaggtcccacctgtcatcaaccttatctctcttctctcctagtgctgacgtcatattcctctacttttgcgtacaaacataattaaatatgatgcagtaaatcatttagttcgtttttatagggttttattattaaaactttagtaattcataattaattcatatgaactcggaatgagctcgttcaagtttcaattcatatgaactcggaatgagcttgttcaagtttcataattcatatatctctactcatttatgaacttcagttgtactgtttatttggtttctattagtgttttctctcgttctgtttatgaaggatcgttcgttcactggagaagttcctgaagacgaagatgcttatttgtaaggcaagtcacacagatccaaaataccctttgagaatgctgaacacatgtttaaaattctctatttcaatcaaatatgtatttattttcgaatgtcattgggtggtgagccttttttctcatattatggccgaagatgattttattatcttatgggttataatttgactaggttggaccttatatattggttcagctatatattagatgtaattgtttatccatgcttagaaacattagcacactattgggataatgaatgcttcacaattacttaatgatggctatttaatggtagctcgtgatggtaaatcatgattggttaattaaataatcgccagctaaaacctgataatggtgagttgtgagcatagtgttttggtggccatgctgatgacaattaacgaccagttcgcaaactactgttgtgataatgataatggttctgaagcatattattcctccctctccctctttcgatcttctaattggaagaacaaaagagtgggttggaattcggttctttcgagccttgcttgggctcgttctatctttgaatatagcaatttccattccacctcaatccacattcctttcatgctttgagcttccaggaaatcacggttgtgggaaaccacatcacggaagaaaacttatcattcctcatgatcccacagatcctgataagctgcctggagaatagagaaatcatccaggagaatagagaaatcatccattgctcggatagagtcaagataggaacaaagtgccctctctaaaggtagggttccatcagaagtacagctccgttcctcacgtagagagctagaaattcaagaattacatccatcctaacacttgatgtcctttcttccattaagaagagcctcagtcgcccaggtatgttctcgagagggttgatgtcattcaactactgttgatcctactcgtaaaggctcagacataagccaacgtgagcaacgtctggatgcgttgtatagcaatatggttcattgtggagtgccagactgagaagtggcagagagtccacagggttgctggggagtctatacctttaaaaagggtgactatgatccggggatagtgcattgcttttaattgtgtcatgcgaggtgtcttgtcacaatcctgtttcgaggtatcgtggtgctactgatggcatggctacatgttatgggctatgtcttgtgggtaaatttatacacctccggttatggggcgagcctaacaatgttttttcgtgattagtaccagaatattcattaaaaataataatgtgataaatgatgatgctttggtttagctcctggtttggagattgggtctgttcaaccgagcatggttgttcagatatggtggggcatatgcaacaggtatgttgtatatcattggattaataccttttaattaattactctactgttttacaaattctcaactctttgccaaatgcttcttttgcaaatgaaccctatattatgccatcctatattatcgctgtgcacttgcatacttgttgtgtgctttgtgaagtatttcatatactcgccttgcaataatcatcaaacctcacttggagacaaaggattcagaaggagaaaacctttgtcttaaatcctatttgagttgaagcttcgctagattttatttttccgctgcaattttcttcgtggtgaggactaagttattcttctgtaagtattttatcgctttacttattatgatattctgtatattaaattgtcctttcatgcacctcggctaattcctagacgaggatattaatgcataaattagttcgaaaattatttgttagcaattgttgttcatggagttgaaaaatggccttctagcctaagaagaaacgaaaaaagatttataaattcgtttttgcactacgtgaccaatagttggacatacgtgttaaaaagtcacatgtttgatattaaaaactttcaaataaaattaccccacatatcaagtcaatttttttaaaaaaaagataatacaaatttggcttacaatactatttcttttttttaatattggaatttataaataatattattaagattggataatagatacacatctctactaatataaaatttagttttttaatgtcacaatgaaaggaataggtctaataagaaaatctctatttttggaaagtttaattcgcatggcaacatgcatgcggggatggatggaaggaatgatttcaatctcccgtgcatgcggaataattctaacttgtatggttcatagcgtgcatgcatgcaaagatgaatggagataattagtccctaactaatttatcttttcgccttttgtactccaacgagtaccattggctataaataatcggtgttgggtgaaacctccaagcaaaataccagaaatcctcctactatcgtcgaccttcaaaattgtcttgcctttgtcagctaataaggcactacgatcctccactttgctatttccattttcatatttagttcacattcttgcatatatcattgtgttcacacaaatatttgtagaaaccaatcggtttcacgttccagcaagtttaagatgctggctgcactaaggagtaagtcgcgtggcgggagagggtagtggtaccaccattaacaaagtcaatgaatagataaatggaccaacagtaaacatggactccatagatgacgtagatactcgtacaaatccaaacacaaagagtgagcaacatcaatacatgaaacaacagtcttgtcagaatctttttgactatatatgtgatacctaccatcgtgttgagagtgatatggaaaaatacaagtgcaagtagtaatacataagttatacaaagataacaccacctttcaatttattaaataatagtgagatatatggtctccgcaagtaccaataaagcagtttttgttttcttaagtcttttacgtaccagtaaagaaatcttggaagtggactggattattattatgataaaattttaatttagcatgtgcaaatggtttgataaaaaatgtatcttccaatgtaatctttctaaacactgattttgttcttctataatcggacaatctcaggacaaattcaagcatatagttacctcatgacattgccccatgggacaatcataggtattgacgtgctgatgttcaaaaataatttattattatattgcttatgcttttattctttgcagattttactggggtcatagctaatgtggggccaaaggactttagtccggattggcctatgggcgtgagagatgtagcactattagatatttggtactaaagatgctcaatattctttactattatattttaataatttcatatttaagccaccaaccttattgcactttccagccatgatattggattcttttgatgcttggtgataaaggagattattaccgagat

SEQ ID NO: 78870 - DNA, 2428 bp, Oryza sativa
ccacggtagcttgctatcgggctctcgcgtgtcgccctagcgttgcactactgcttgggcccggcgcaccccaaccaatccacgtttcaaagatttgatctgctcatttagttttatagattttcatttgttataaatatttttttcaacttgcctaccgcagcgcaatgctgaattgctgcctgggctgaaaattagtatatcaaattagtatatcagtataatcaccggatggacgggggcatttttcctggtcgattagtccatttccgtttccgaaccttttggtcgattaatccgtttccgaaccttttctggtcgatcaatccagttccgaacctgcatggctgttattcgatgactcctgtttcttgactgtgttattctttactaatccctctcgctgcccgtccgttctatcgcaagggcgtggtgttggggctgaaggaataaaatgtgcatacttgtaacatgaataatctgtaaaaggatcagtagagatgtaggtgaatcactgaaacatgcaaacgtgcagtaatatctcatctgtattccgaagacgtttttgccctttccgtcagggcgtcggggaaagcccattaggcccagtttagttctcaaattttttttcccaaaaacatcatatcaaatatttggacatatatataaagtattaaatatagataaaaacaaattaattgcacagtttgtatggaaatcgcgagacgaatcttttgagcctaattagtccatgattagccataagtgtaacagtaacccacctgtgctaacgacggtttaataggctcaaaagattcgtctcacggtttacaggtgagttatgaaattagatttttcattcgtgtccgaaaaccccttccgacatccggtcaaacgtccgatgtgacaactaaatattttcttttcaccaactaaacaagcggcagttattgagccttttcatttacaggcagtggaaagcaacaatactagactaggcctatcaatcgtgtatcgaactgagacagttcacaagctcagctacgcaaacagagcaagagtcaacttttgtagcatggtcattaacataaactactcattcgaggtctcagtcattatttgacttatacttataatttaaaatttaaatgttacaacttggagtaagtttccatttgttttcttaatcatagtttattttacttcatttgcttttcttttacgggtcacgaggacgaaatgaagtgacacacttagtttttttctcgaacacgtaaaagtattacacgtcaatatattaaaagaatagaatgacacacttagtcttccgtgtcaatcttgttgggctaccttggaggcaacgcctcagcacttccgcaaccatccacacctactcgtcgcctaaaaacacatatataaaagttttacttataaataatctttatttgctaacaaacaattaagtgaaacaatgggttgctcgatctcaagctacaatgttcacacaaaaactatagatttcactcaagtatcaccttggttttcaggtacatagtacgtaccattgctcatcctacccctagctagctggacgcaattcgaagaaactgatgtagtgcacgctggtaaggagtccaaggactgataacctcagaaaatccaaacaaaaattcctaagcaaatcctaaaatccaaacaggtaggagtagtgtttaccatacaccattccacgcagctaactcaatctacgcgcccacagggccacagggaccgacgctactgtctcttacacccaaccccaacgaccaaagcgggggagggcggagctagtatatatagggaggtgttcaggaaccggtcaaaaaatttttttaagctatatatcatctattttcatcatgtatgcactcgtcttaatataaacttagacacccatatgagcttaaactcgatctaaaatagaataaattaagcaagtggcaacatcctcctttacgctttagcaccgcccctgaagacaccacgaaccgtccagtaacaaacataaaaaaacagctaacgacgaacaaaagctacagataaactaatcgcgagatcaggagagtccgtaccagctgacggaactggcgagcagatgagcggcagttgcggcggaagaacgaggatgaggacgacgagagaaggctcatggtggggctcatcggcggcgacctccccggtggccgtcgtgctacacggtatcagggccggattagtggggcgaaaaaaaaatccagcagctcagtcgtcgtcgattcgctcccggcgtcaatccgggccggacaagtcaacaagccccgttccacatctcccgagccagccacacccgtccgatctcgcgtcgcgattcgtgcaattccgaccggcaaaggccacgtgggcggccgat

SEQ ID NO: 78871 - DNA, 2652 bp, Oryza sativa
agcaaatctcgctaataatatcctttatcacctagcatcaaaagaaatccaatatcatagctgcaaggtgcaataagattggtggtttaagtatgaaattattaaaatataatagtaaagaatattgagcatctttagtaccaaatatctaatagtgctacatctctcacgcccataatctaagccagactgcagtccttttggccccacattagctatgaccccagcaaaatctgcaaaaattaaaagcataagcaatgtaataataaattatttttgaccatcagcacgtccatatctatgattgtcccatatggcaatgtcatgaggcaactatatgtttgaatttgtcccgagattccctgattatggaagaacaaaattagcgcttagaaagaacaaattggaagatacactttttgtcaaaccatttgcacatgctaaattaaaattgtatcataaaaataatctagtccacatgaaagatttctttattggcatgcataagactcaagaaaacaaagacggctttattggtacttgaggaggtcatatatctcactattatttaataaatttaaaggatggtgttatcttggtataacttatatattccaacatgcacttctattcttccatgtcactctcaacacgatggttggtatcatacatatagtccaaatggattctgacaattctatgttgtttcatgtattcatggttctcactctttgtgtttggatttgaaggaagttgtacatcatctagggttaattggatacatgccactgcaaatatggcaaattagaaaaatgtcactactattcatgaaatcaggtagatgccactataatctactaaaattagaaccatgccactccatcacgatttccgtcctatccatcacattttccgccgtctccgtcttcatcttctcgttgtcctcgtctcgacggcggatgggccgatcaggacggctgtgcgctggtgctgagccaaagcaaccgcacgacggcggtgagatagccggccaatagacagcatgcatggcaggcgggccaacgcagcgggccgacggcagcagcaagagccagcaaccagcaagcaacaagcacaacaagcagaagcagagcaggcaagcaatggcactatggcagcaacattgcagcattcattgatttctctggtggaagaagaaatcaagagtaggaagaaagcatgccctcgccggcggcggccgcagccgctctcgcgaccgtcctcgccagcggcggcgcccgcgcccgcgcccgcctccgtgaccgtcctcgccggcaaccgcgcccctccgcgacctccccgcgagcgtcctcgccggcggcgactgcgcccgcgcccgcctccgcgacctccccacgaacatcctcgccagcggcgcccgcgcccgcattcgcaactgtcctcggcggcgcccgcgaccgtccatgccggcagccgtgtccctccgcgacctccagcgagcatcctcaccggcggcggctgcgcccgcgcccgcctccacgagtgtcctcggcggcggccgcggccctatgcgacctccccgcgagcgtcctcgccggcagcggctgcgcccgctcccctccacgcaactgtcctcgtcactcgccttctcagcgtgcagacgcgacggaggaggatgacaacgtgagagagtaggacggaaatagtgacgggagtggcatagatccaattttaattttttttagtggcacccagacaataaggtaaataatagtggcatttttctgatttgccacatttacagtggcatggatccaattaacccccatcatctatggagtccatgttcactgttggctcatttacctgttcactgactttgttactggtggtaccactgccctctcccgccacctgacttactccccatggcagccgacatcttgaacttgctggaacgtgaaactgattgtttctacaaatatttatatgaacacaatgatacatgcaagaatgtgaattaaagatgaaaatggaaatagcaatgaggaggatcgtagtgccttatcagctgacaaaggtaggataattttggaggtcggcgatagtaggaggatttccggtatttttgttagaggcctcacccaacactggttatttataaccagtggtgctttgttggagtgcaaaaggcgtaaaaataaattagttttggactaattccctccattcatctctgcatgcatgcatgcacactataaaccgtacaaattagaattattctacatgcatataaaccgtacaaattagattggaattattccttccatccatctccgcatgcatgttgccatgcgaatgggactttcagaaatagagattttttattggacctattccttttcatgtgacattaaaaaatatatttttatattagcagagatgtgtatccatcatccaatcttaataaatatttttttataaattccaatattaaaaaagaaatagtattgtatgccaaatttgtatattttttatagaaaagttgactttatatgcgggttaattttatttgaaattgtttaatattaaacatctgactttttaacacgtatgtcaaactattggtcacgtagtgcaaaaacgaattta

SEQ ID NO: 78872 - DNA, 6294 bp, Oryza sativa
tttgtgaacgatatggtatgtgatgtctggaaatatattttctatgtttatacattatcaaatattaataatgtttataaattttaatattaaattccagtattgatataatgagataaatttgcggcgggggtgagaatgagtgacagctcattcaattctgttgcatagtggcatgcgcaaaagtactgtatttctattggagcgtgtctatttacatatgagtcccacctagttttgtcatgattttctcctccaacatgcaaatgaatcataaaaaaatcattgattccttgtacccatctgtcgataaatatatcctcaaatcatctccttccacacaatcctccctctccttacctctcccctaacacacgatcctccttctttgtataagcccatgagactcactagtgctacaatactcatggcatcttatgaatcagtcgatgtcgaagtggatccactgccacagcaaataaccaagagagagctcgatcaacaaatcaattcggagagagttcttagagttctctttcagtatgtacgtgatggatatgatcgaccacaagtaatgacgagggagctctcccagccagtcaattcctaaggagagatgaagaactatgaagataacatcgtcaagagatgcaagctgcctaagccatgattaggtctactgagttttgaccttggaataaagttttattaagttagcctttcaacgctatttgcaaaatgtgcaaaccaaattaagaatgcttgttgtgtatgatttgacttgttgtgtacaatatcatatttcatctacaatctcatacaatctcatactagtctgacaaatcagttttatttattgttaataactaatataatttttacttttagctcgattattaaaaaaaatattaaaagttacttaggaatttccgcagcaaaacgcggggaatcacctagtactatttatgcttaatgccaatcattggaaaataaggagtagagagatacagtgttaattttcatcccctctttacatgtctaattgtttaaacacacctcttaaagtaattgattgatgaaaacaacacaatattatgtgatagattccggtaaaaagaaaaaccgtgtcatgaaaccataatctttgagagaaggcacccgaagtattatcgagtttgttttcttaatcccagataattgtcattagtttccatttggtaataaagaaaatgttattctcatagagcaaacaaagcacaaaatagctagttaatcttaacacgaaaatttattccatcttgatcttgccaatcatatgtatttcataatacgaggcacatcaacaatcttgactggcttcagaatataatcctttgctcctccatccaagcacctccaacaaggaaaaaaaaagaaggaaaagggagcacatattaggatccacatgctcggattaagaatctatcaactaaggaaatcaaggtatacatcgtcatacttactttctgatcctttctgggatgttatcagaggaagcaattacaaccgggagatgtgccagtttaggtgatttctatgagtaaaaacaagcccaatttgaacatgtaaaatatttggtagaaacattataaaatatatatgatgaagattaacactattgtacgtacgcaccttcacttccatgagtaggttatagccggtcatgtctggcatacagtagtcactaacaatcatgtccacatcatgttcctgtgtccatcagacataaatacatgtttgttatatagtttgtaaataacattaccaaataaacaagtagaaaacttttaatttaccgagtccaaaaacatcaatgcttgcatgacactttctactgcagtcactgcatatatcaaacatggaaacacttagttaacaacagtcgaaaagaaggtcagaagatttcaaacatggaaacacttagttaacaacattcaaaaacatggaaacttgcataacaaagaacctcggacattatggcgcattaaggccatggaaacaacatggcgatcaacatgggtatcatccacaacaagcacatggggggacgacattgcaaacttttggtgtagagttactttgaattgttgttgaggaaaatggacctagaatgcacacatttaaagtgcaaaagtcttaaaatcgcggagatattgcaaagatataatatcaaatcactagcatgataattagctctcatatctcacagtatcactagtgaccgtgtatttgataattttgatataccatacaatgtataatgattgatggatttgtcctctttcgtacctatagagttgttcattttttacaaattaactatagtgaccttgcaacaattgtagctacctaggagcaatgatatagtctaatgtatgagcatatatttgatatatctatattgataaatggcttggccctatttaatttgtacatatttaaatgtcaatacaacaaagaggctagtagaaactaattaattggtcacaccctggtttgatagatggtatggtactaaatgaaagaaagcaagtgagtagtggtgtagatgggcatggtttggcccattggtccgaaaggcccatcttgtgaagcttgtaccttctccactatggtttttgtatgatcttattctataaggcccaactcgtggtgttgttttcatggcgactcgcagctgcgtttcatccttcgttgttctccaaggctcccctcacgtgctcctggaatcggggatggatgaatgaaccattgtccatctaaatcgtggtgtttatagataaataaaccattgggaacatgctttcagtcgagaacgatggtgatcaatggcgtcttcccaagtcttgagcatatcgacacgttttcatatgagataaccgcaccgggttataggatccagtcaccggacaaagtgtcagatgtacattgatttggaaaaacaaattctaggcaaatgcacacagttcatgtgaatactagacaaattgtctcctcctttatattttctgatacttacatgtgggacttcgtgacaactattactggagttctatgaccaaaatacttcaccgccatgtgctggccctactcttgtgatgactttgtcatagaatattgtacctacagatggaaccatctaccatggacccatgaggaccatggttaccaagttctatgacggaatactttgtgaccatatgccaacccaaatttctaatgataaattgtgtagtgtttcagatgaccatggtgacattttttgtgaccacaaactcaagctgccactagaatcatccgagcctgaactttacgatgatttcttgaaaattcgtcatagatcaacgatggattccctttttgtcacagtgaatccatcatagaaggccaaatctattgtactgatatatgtcacaggctgaaaaaataaagagaggataagggggacttgcaatggcgttatggcggcgacaaccataaaccgtgactcacgaagatgtaaagtttgcaatatatattaagccatttatagtatgagtgtaatatcttcatcgtgaccatattttgtacaacaaaaagcccaacacatacatactgcaactctcacataccacgtaacatgatgtttagtgtcacgtgaatgcacaacatcataggatagtctctttggaatggtggatatacgaattcaaaagtcttgttctaatccttactacgggtgtgttcagaacccagagttcccaactcacctctcgctttttccgcacgcatgtttttcgaactactaaacaatgcattttttgcaaaaaaaattctatacaaaagttgcttaaaaaatcatattgatccttttttaaaaaaaatagcaaatatttaattaatcacgcactaatggatcactccgttttccgtgcggggagtttagttcccaactccccatatgcgaacacaacctacatatccaaataagacattaggccccttcttagttcccacacaaaaaaaattataccctatcacatcgaacgtttgaatatctgcatgaagtattaaatataggctaaaaacataactaatgcacagattgcgactaatttgcgagacgaatcttttaagcccaattgctccatgatttaataatgtggtgctacagtaaacaattgctaatgatggattaattaggcttaataaattcgtctcgttgtttactgacggattctgtaactagtttttttattagtacccgaacacctcatgcgacaccctgtattacccgatgtgacacgctaaaattttacacccctagatctaaacaccccctaaaatattaccaataatacgagctgtcaacttgccagcactaacaaacagttacccgaaatagttccaggaaagcgttttatgcagcaagctaaaaaccaagcagaattatgacaggtcctgaacacacaaagcaggaggaaatcaaactgctgaattatgaaatgagaaaaaaaaaagaggataaagtatcgcatgatatgaggttctaacgattcactggttcatccatataatagccaaccacaaacagtaaagtaaccaggactccacaatcaaaaacaacatccacactccagactatcgcatatagtcacaaacaaatttgatccactccaattaaaacacaagaacacttatttgggtctcaaatgtttcccgctagcaaacggagcttgcaacactttgcaatagtttaattcagcattgcacactattgcagaaacacctcagccttcagttatagtagaagtcaatatagatggaacctcctcggctaattatgaccaacgccgtcaactgatcggttgtgagttcaaaccgccaattcacctcaaattgaaagattcacaatattattaggattttatgtttctagatatgatagcacatggatgatgcaaatcgatggtactgaccagactgagctttgaaaacaccttcctcaatataggtgagtgcttgatgtattggcgtagaggcatgaaattatcggtaatgcaccattcaccatggtgcaatgttctaagattcatgaacatcggccctctcccattacgctccttgtggtagaacttatccacacgagttaaggtctgaacattgacattattaggacgtaactatgtgcgtgtgtgtgaccatgagtcctttctccttttttttttcttgcaaaattcaccaacgttgcacaaaatatatttctttacacatcacatgcaaaggggattgctctcacttcataatagtttgcttcaataaattttgccaactattcaaatgaaccctttgccttggttttaaagtacaagtgcttcaggtagaattcgattgacagcaaaaagctaaaattatgtggttttgtgttaaaaaaaatcacaaggataagattaacaactcaaggaatgtcatttattcatggattgagtatacggtaggcatcctctgcagatttttcagatttcagcaggtgatgccgtgacatgcatgggatacttcctgaaaatgaaagtgatcaccgacgatcgaaaagaatcaattttcagaaatttaatcactatatattaaaagcactcagtactctgtacattctagtcaacgtctgcgtagtacaatactccgtactacaatgtatacagatacagaaactaacgcaaaaaaaaaagagagaaaatattatccaaaattcatcccatgttctaccaaacaagaacattttataatctctagagtatgaatttcctagctaattaatgagctgatgatcacttgacacgccaaagaatccaattaatcatcactgttctcacacgggaagccggagcagcgtctccgatctgtgcgcgctccggctcggcgcgagaaggcacccactgaaccgctcctcgccgccgtccacgtcgtgttccggcgacctgccgcggcgccggtacgccgcctccacgtcgtcgaggatggcggacacctccgccatccgcggccggctgcgcccgtcgttcgccacgcacgccagcgccaccctggccgtccgcgcgagcaggcgggactcggccttgtccgccggcttgccggcgcgctcgtcgagcacctccgccagcgccggcgggccggcgcgtatcagcgggagcgcccagtgcgccagccggccgccgtcccattgccggccggtgaggaggtggaggagcaccgcgccgaacatgtagacgtcgttctccg

SEQ ID NO: 78873 - DNA, 6031 bp, Oryza sativa
gtgccaggatatataccgtctcggcgaacgcgccgatggaaccttcgcgagcacccatccatgcatcgatcagacgttgttgttttacgcacgtacgctaccttcctcgtcgagccgccgcaccctctcttctcgatcgtcgcacgctatccaattgcctcgggcatggctggctgcggtttcggcgccgcacgtcccgctccccgcgcgtacgcgtacgtgtcagctggtcgcgttacggtttcgatacaggcgcggtgcatggtggcgtgaagacagcagccacgcgcgctaggccgctagctggcgtcgttctgagttcgtcacaagcaagaaccaagtctcgtatcgatcccgtgcgtaaatttgattggttttgcgcatgtttttgtaatgataaatcgactgagaaggttaaattagcgtggtgctagtttgagatttgcgcacgctgtagctgattagttggtgctttctgctcgtcgtggagacgcggagagtatctgatccgtgaaagcaatggcacgtgggtggggcctgaaaaggtccgtcgtttaggttcgctgtgtgcctgtgtctgacaaatcctgttttatgagtagtactccgggtgcacgtagcagtcaggtgcagcaagcctgcaaagcgacgtggatgaattctaccctatgaccaggaagcatcaagcatggtgcaacgaagagccaagggcatggaaaatggttgctccacgtaagctgaatgcgtggaaccaaacaagaagattttaattaatttcgagtaggtgatttttttttctgtttcgtattttcaatgacgagcacaatacaagattttttttcctcaccccaaaaacgagtggacgaataaaatatgctactgggatatactttttttataaatatcatttgagtttaccttttaaacactatgtggaaaaatgctcttgaataaaggagaaaatattggggagggtttctctgtatgcgtgatgagagagagaagagcattatgtgcagttctttttcttattacgctcaccgcatctatgtatcatctttaatccagtttagttatgcgatttacaataaaaccattatagcagctacaacaaccaagtattgaaattcatttgttgacgtcggtaattgtagttgtcgattgcaactgcattgcggacatggtaaaacataaccgagcaaactctttatgagattactatttgatgagagtttcctcatcaacaaaaatttttgatcaatggagaaagagaggagatttctctcgttctccgcgcacacgcttcccaaatgttaaaatatcatattaatttatttttaaatttaaataattaatacttaattgattatacaacaatgactcatctcgttttaggtatcttttcaatattctcctttctccttctctcaaataatctcttagttatcgacttgtaaatgaattgttttttcttaacaatgtcatactactcttccataagaaaataatgaaaatacttctaaaaagttatatatatttgtcacatgtttatcatataaaagtagtagaagagtagacaaataaagcaaccaataggcatgctccaattccacaagaaaccaaacgaggagctacaacaaggtaggaattgtgggtgaccccaagcaatactccacctccatccagatattgcaactacccttcctatcccagtcaaaagccttcaaaaatttattatctccaccacatcatcacaagccgcagcagtcagaaaaacaaggggaagaagagcagattggattagcgccgagccgaggcggcctcgacgataagcttcgcctcgccggccgccgccatgcggaacccgcccgggaggcacctcctccgcgtcgccacccgcgccgtgcgctcctcgtcggcgctcggcagcggcggcggcggagggggcgcctcgacctccgccacgtcccccgtcgccgcctcctcctcatccggtggccgcccgcgcacccgctccggcggccgcctcctgcgcgccacctcgccgcccccgccctccgccatcgccgcggccgcgtgctgggagtcccgcacgatgcgccgcgagggggaggaggagtgggaggaggtcgtcgccggggccgaggaggcggttcatggggcccccgtgcctgttgcggaggaggaggaggagtacagggtggtgttctggtcgccgcccaccggcgacgaggtccgcgcagccttcaccagcatcgaggagtaagattcgtttgcctctcgcttaaatcctcgcctaaatcaggttgctgtgaatgattatgtcagttagttttgatcgaattgattgatttagattggaaccgtattggtcatatgcgtttgatgcgagaaagtcagcgaaaatctgttgtttgtcgttagtagtgttcaaatccgtgctccagtggcaggttgtgatggtctttgtcgtgtgctgttcaatgtttgcaattggtgggtttggtttctcctccataattggatgtgagcctggggaagcatcgtgtacttccgtgatctgcacggacagatgccaacggaccttggaacacttgccgtgcagagttcatgaatgaacaatcatgagttcgttaaagggcatacgtttcttgaaaatttggactgttccatggcatgtgctgtagtactatacctcctccgtcccaaaatatggcaacacagttaacacaacctattagtacgaatcaggatagagggtaggttgtgtctaattcagtagctatattttgggacggagaaagtaggtgatttctgaatggaattttaaaggattaaaattggacaatacatggatccacctattgagggtatcaaaattcaagatatatacctgtagttacatacagaattatgactggaaaagtagtaacattcaagatttgcttgcagccttttccaatcccatggctgagtttcttatacactttgggtttcttctattattcagaagcgacctaacaaactgtgttcttgtcataaccgatgatattcatgggcttatggctacacaaaagatcaagtttgctatcttttgttgaaaatggatctaaactaataaactaatctccgtactgtactcatataatcttgaagacaagaagaacattgttttagatggagctgtcatacaatatactgtcaatcatctatgctgaacatgagccatttagatgtagtctgtgttgtttgctccatctgatcaggctaccatttgcattcagggtatttggtgatccttttcgtgcgcattcttatgaaactgaggagcaatcagcattgtccacctcagtacattcgtcatctggcaattcatcaggatcagatgactggattgaacctgctgcctatgctctcaactcaactgctcttctgacaagggaacatagaaatgttttggatgccttccgtttattgcaaaaagatcctaatgttcaggtgagaaagatataaccaattctgatgtgcgctgtaacaatttattatgttatatcagtttattgcaaaaagatcctaatgttcaggtgagaaagatataaccaattctgatgtgctctgtaacaatttattatgttatatcattatctattgggacatgtcatttacatagtcctttcaacttttgctccatctattgcaaaaaagatcctaatgttcacctgaatgagacctaacaatcttcaggtgctccagaatgtttattactttgtatcatttattctcaattggaacatgtcattttacatagtcctttcaacttttgatgtacttttgctggcttctgtccgaagttctgacatagaagttcatgaacaattcgtctctgcactgactctgctaaccttgtcttcaatgcagaaaatggtcatgtccttgtcatgcgacagggctgtatgggatgctgttatgaacaacgaggcagtgcaagaattcaggagatctttccaggatggtatgttacactaaaattttcatgtttagatttgctggtcataagcaatactatttggccttctcttttttccaaaaagactaacttgtcacagcaatacagcatcattttgatgatccttttcaccttagtactgcaaaacatgcaaatacttacaaattctactgatttatgcctttacttcctagctgttcattgtaatctacccatctttcagacaaagaagcagcaggtagaaagggaaaccctggtggtcctgctggagtgcttaagtggattctgggcaacacccaagcaaaaataatggaattcatgaataatataatgaagattgtgaacatgcttttccactctgatgatgatgaagcgaagcccgacctttacactgatgcagtgaaggtgtcattcatgctctcagttttcatcttcatcgtggtggccattgctcgtatcaagtgagcacaacaatccgtcgactttacatttcgttgttttgtggtctcttagctatgcgcaggagcacctctattcatcttagtttagccaacattgatgccaatcctagtttgtcaggctcagaagtttaattgcctgtgttggaatcatgattttatcatagtaaatctcaatatttaagcttcccttcagtcttatctcattaaatttcctggtgcttttgaacacagttttgagccgtgggatttcaaagtgtggtgatgcaagattctgcaagccgtgtgtgcatgttttgtaggacagctcatgatttccaagctatctaacttaaattcacacgaaattgtacatcgatgatttctgtatcatttgaccctgttagtctgttgtaaaggattggtttgtctgtgtcccattttcactgggagattaatatacttaagaatagataaatagttccgcttgcttggacgatgggttggaactcgcccgtcgcgttgccgccttgcagcagcaagttgaccgtggttgtcaagcccaatctctgaagctaccttccccgtccacgctaagaatgtcgagcaacaaatccacaagcacccaccaaccttaggtcaaatcgcaccaaacaaagcatatgcgcttatgtttggaagtttgaattgacactgtaacttttcatccgaataaatctgcaccaagattgattgtgcactcacaaaattgaattctgttttcccttttcatcgacgtttctcatagcaatgagattcaagatcacatttctgttacatccaaagggtgcaaaaccatctggttccaagatcaattccaagttcgaacaaccaatcccccaaaaaaagatgccaaaaacaacgaagaattgaattaaccatgcttattgcctgcccagaaattcagaaattcagccagtgatcatggtgccggtgccctcgtcggtgaggatctccagcagcagcgagtgcgggacgcggccgtcgatgatactcgcggtgtgcacgccctgcgccagcgcgcggacgcagcactccaccttggggatcatcccaccgcccaccttcccgtcggccaccatctgccgcaccccggcgatgtcgatctccttcacaaggctcccggggtcattgcggtcggcgagtatcccggacacgtcggtgagcagcagcagcttctccgcgcccaacgcggcggcgatctcgccggccgcggtgtcggcgttgatgttgtaggcctgcccggtctcgtcggcggccacggtcgcgatgaccgggatgtggccggactcgatgatggggtggaggacggacgggttgacgcgcgtcacctcgccaacgaagccgagtgcggcggcgtcgggggaagggcgcgcggtgaggaggcgcgcgtccttgccgcagaggccgacggcggtggcgccggcgacgctgatgagggagacgagctgcttgttgaccttgccgacgagcaccatctccacgacctccatggtgagcgcgtccgtgacgcggaggccgttccggaactgcggctcgacgccgacgc

SEQ ID NO: 78874 - DNA, 3471 bp, Oryza sativa
gtgcggcacagtgtttgggtacttgtagatggtggccggcgggcggagtaggtgatgaccgggctcccgagctggtgcggtgcgcgagagcggctgcggtttgacacgagcacgtgcttttccttttggtgttggctataacaagggttaattggatccatgccaacttttttttcccacctctcgcaggcgcagccaaaaccaccgcaaatagttaaatgcccccaaattctcccacctcctcggcttgctacctcaaatcgcaatccggggattaggctgggggttggtgcctttccccttcgcctcgccggaggagggattggtacggtggtttgggcgcattgggaggggtggttagggttcgtatcatggagggcactgatgatcctgacccggagcggcagcgctccagctctgttgcaccggcgccgcctcgccggctgcggtggcagccaccaatcggtccgtgcctcccccgcgctccgacgaaaagaaggtacaccctcgttcggaatttagtagttccttctcgcttgatttctgggtgaaacaagtaggatgaagtgcatatatgtgttgatgcgttcaaatgttcaagtttgtgacttcaattttgtttggattttgcatctggtattctggttagcttgagtcaattgccttgtgatagttcgtgaatccattggagcttcttagcatcagttattctactcatcacttcatagtttgaagggagagcttgcccttgttgtatattcctctagttggttttcagagaccgaatgctaaggccaatatggcaaggaaaaaatgggatgagaatccccacggtgatttatgcccagcacgagaaacaacagatagtatcattctaagatgtcaagcagctgcaagattatgggaataattaggactacttgatcttgcttaaaactcagaatcagtagagtaatatgcttcctagaggatattatcaacggcaatcaagaattcagggaaactgacgaatatggccaatctagcatgtcatcccaaaatataagtacatgccacaacgaatatacagagggagtgcatgctgtgagttagagaatttttttgagaattaatattatttttatggaaaatcgcaaaagtagtggtcaaccggggaaaatcgcgaaaataggtccctgtcgaacggatgcagttcgatagggcgcctatcgaacggccagagcgcgactggcgacgagatcggaaggctgccgttcgacaggacctgtcgaacagcccccgttcgacaggcagggctgtcgaacagcccccgttcgacaggctgggctgtcgaactgccgcagttcgacaggatgtccgtcgaactgccgcagttcgacagggtcgcgttctccatttatttgtaataagttatttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatagataagtcaaggacgatcagtgcccttcgcacgcttgctaggtcctcccttcttactacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgactgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggacactcgccacgtcgtcagacctggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatactaacatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctatcccctcccctcgctccctccggcgctcacggcgacgatgtggcgactctcgacggcggctggcgatgtggtcctcaaataaatcgaacaagcatcgcgggctgggagacggggctttaaaccggcctgtcgaacgcccattgtttgacagggtcggtggagggacctgtcgaacgcccccggttcgacaggcctggcggcgcggggtggtgggccctgtcgaactccctccgttcgacaggcaagcgtgtcgaacgccagccgctcgacagggctctgtcgactgcccgtcgttcgataggtgccctatcgaattgcacccgttcgacagggacctactttcgcgattttccccggttggccactacttttgcgatttttcataaaaataatattaatcctcaaaaaaattctgagttagatgggagataattcgaaagacatgttcattatttctgctaaggaaaattatggtga

SEQ ID NO: 78875 - DNA, 2944 bp, Oryza sativa
gccgggctccccgagcacgaggtgcggccgcatgcgcttggcggcgagccccggcgccgccgcgtacacggtgaagtgcctcccctgcccgatcaccctgctcgggtggaacccgtcggtggcgcgctccacgtcggccagcgggaccaccggcaacggcgccaccgcaaccgcaatcgcaccaccgtcgccatcaccaccaccaccaccaccgccggcgccaccgcccgctctcgccacgcgcttgttgcgccagagcaggaacagcgcgacggccagcgccacgaccgccgcggcggcgacagcgacgacggcgtggtggacggcttcctcgacggactcgcgcatggccgagctagctagtcaatggatcagagcttcgccgccgccaccgccgccgaggacatggacgaacgggcgtggcacggcgcggcgcggcgcgcgtcggtgtcacctgatgagagagattaattggagacgtttcgtgagcggattttcagtgggattaagtagcacgctaagtgacacggtacgtacttgattaaactaaacatgggtcaaatctgctatgcgtacaatggcaacaaccgaagtcagtgtcattgtgtcaacagaatgccatccaaaatatttattgggtggctgacatggttggaatggttggcatgaattggttttactagaaatacttatgggtatcatgctagtatttttcttggtactttctagtatcttcttaaggcaaaaacaaatataattgttattgttaattttaatgaatttggttggcagtcaagcttatttattgtgttgaacatataagatttatatttctgattcgcacttgctatttgtgtctcaatgaagaatttacatttctttctgcttggttgtttgttttttttttctacatttgaacccgacagataccccattaagaatatgtaggttaacctctgacgatgctggtgtgatcttgtaaattaacaagatttggaccttctggtggcacacgagggattcatgtacaagaacttgccaagttttcttttttagtccagccaaaacatcatgttctaatccaacaaatttgaatgcaaagattgccctctgcctccctagaaaacatattgatttcggattcttattggaaactttggaaatttgtgaaaacataagcggaaggatcattaattggaaataagggcctattcagattgtagccaaaataaaccttaccaaattttagcaataacaaaattttgataagatggtaatattgtcaaaattttggtaggatttcttatgtattaactaaatttagtaacaaactaaacgttttgtaactttaccaaaataaaatggtatggttgaaaatggcatcaaagtgaacagaccctaagttttgttacacattttgaactgaaaaaaactttgagcctgttgttatatatctagctagctgttgagacttcaaagtgtgcattagagggagatcctggacatccaattaattaattaaacagagatgatcatggccattttatgataatgtagtcaagtgcaactgtgcaggtagtaaatcgatcatagcagttgggcggggtttggatgcccaatcttacgtcgactctggaccaaattcatgttaggaattgcaagtttgtatttttatgtttgtgttcatgcacccaacacttgaaacaggtattagttgttataactaacgtgatccggtggagtttattaagggcagagcaggtaaaggaaactgattgttgttaacttcgctcagaagatcttatgtcagcgaaagaacaaatactacaaatggtgaactttctttttttgtgagaacttcgttagttaagtttcttatttgatgatcctccctagtttccgaagttcacaccatgagaacaaagacgagaaatgactacgatacatgggaaaatttaatgaattcattttttttctcttctagttcggacttgtgatttagtgagaatttgtttcacgcatatacccatttctattttttttatgaatttagataacttttatatcctattttgatggatttttacttattaatggtttgatggttatcacagatatgttcacacgatacatcccagttttgatatcttggtaacaacatagagttctttaaaaaaaaaaaacagatagagcaagccacactaacggggatttttttttctagcagatatattttacccatattgttcaacaaaagtagtatatattttctagaaccaagatttgctcaaacaaaaattataaaattcaaccatcaaactaattagaaggatcctcatatttgtaagatgtcctactttcctattaaaattttggatgggctgatcatgggccaactggccgctcagggcccaattaagcctcggagaacaattataaatgcagtggcagatgaccttttttttacaattttttattaaaatatttaaaaatcgtttcaaacatttataaacctagacgtctcacaccctctggaagcgcctttttaaaaaatcgcccttccagacgacgttaagggacctaaatgtaatgtttttatttgtattttttacaggatgtttttatttatattcaaaccctttccgtcggattcaattgcttaaaaacctgtaattaatgcttattcgacactctaaattattttaaaattaaaaagtaataatctaccaagtcgtagatctcgtcgagatctacaatttttatataaagtttattttcatacaatgttttggacatctaaaagatcttaaatgaaaaagttgttaactgcaaagttgtagatcttctcaagctctacaatttcattaaaaattttgatttcatccgattttatatgatatatttttaaattacaaaatcatagaatacacaatctatattgaaa

SEQ ID NO: 78876 - DNA, 5473 bp, Oryza sativa
gaacttgggagagaacaattgtgatatgccaaatgccatattgccgccatttactgaggttaccaggtcactcttgtttatgacacagaaaataaactgtacttttttcctagcaatcatgcagttttcggcttgtatgattgctgcactctttcaaatggagagttattttgttacttttcactagcctgccaaaggatgctcaaactacatcatagatttgcaaaagagatgcctgatcattaaatgcacttttattcttgctaaagggtattagtgaaatgtgtcaactgccaaagggcatattaatacccttgacaatactttgccatactgatattctagtgttctctgcacgcaataaacagtaagtctcctgctcatgcactgtttgcccttaattccagcagtatggtaaagttgcattaacgcgacactctctagagggcatctcgagccttttcgagttagaggtaggatcatacgcggactacctcgaaccagcgttttagagatggcccacaaggcctgcttctctccagagaaatgcacgagaacaccggttccgcgttgtatacttgaattttgctctcctttaaacaaatgaagtatctagcttcatagggctcatcttgatgtttcttttgtgccttttgtgtacttaagtcgcattacttcctttcaatatgctgttgaacttgtagatttcacactattcttttttgttgacggcttggttttgctatacttcaatgcagaaatcaaaaacttttggaatagctagaagtccataagttggagtactgttcccttgggagtaaattaatgatctaaaacagcagcagagtgctaataatgagacccttggtctggttaacaagccttgggagaaggctagctatacttctatgtttcctttactccaaaaaaccacaagtcttcaaacatttaccaagtgtttcatttgaacagcttgtgatagagttgtactatgttgtttctgttcacagaagcagtagtccttgctcagaattctgccagcggtaatcaacgtagaatatgaaggaataaggcaataagcctcccaaaaagcatattcctaagcatgtgactactacagctggtttttttatgatgctaccaagtttctggcgaattcccagtcatattatagtgtatctaggttcctcagtcagcctgagtaaaagttagcctgggcaaagaactggcaaaaaaaaaaaaactggttattggcacttgcagtttgtgaaacacactttctgttgaatgaacgaaaaccttgaaagcgcttgccccttttgttgcacttgaatctgcctatcacccaaatttatcttgttcgtttagcaaaaaataatatctacacagtagttcttcacattgttagcgtgataatatgtgctgaatttttagaaaatctaaagttagtaatgcacaatatacatgttgggttgcttagtaaaatatatacgagcaatcatcacctgtgtaagttctaaagagggacacacggtcatgtaagtcctgaagaggtcatgttagcttgatttataaattgtttggatcaaagaagaatatttcttaatgagttgtgttgcaatcttattgtttttaaatgttactgcagatctttatggaaggtgtcatagtgaaacaggttgaagatggtttgcatttagtggtatacaccttgcacaggagttgcagcaggcaaacagcatggtggatctctacaatgagacaaggtaatgcataaggatacaaaaaatatgatatgcttagttgcttacgggactgatgaagacacggtttctcctaagtcctaatccatttgcagttaaaagtttggttagatgtggtagggatctgtttcgttgggcaatgctcaaagaaagatggtggactttttttttcgggaatacgcaaggagcgcattttttccattaagagaaataaaagttatttacaaggataaaaggaaaacaagcaggggaccgatacaggacgctatggaaaactataggaatatctcgcactaaatttggctaccacgacctcgtaaaggccaaacagcggggatcccgtgattagccgacttccaaagcatggcctcctccgccattgctttcgccacttcggtccaagacctttgttgttgattgaagatttggttgttccgttctttccaaattgtccaagccatcagtgtcacgacggtgtcgaagcctcgacgatgccgctccccaatcttcattcggctctcacaaagccaattgtggaaggatggctcattgacaagtaagcagttcggactccttattgcctgaagcgtccaccaccataattgtctcgattcagggcatgctaccaagatgtgatcaatgctttcctcgtactgatcgcaaagaacacagcgatccgggtgtggcaaccctcgactgcgcagacggtcagcggtccagcatctgttaattgcgaccaaccacaagaagaagcagcatcgaggcggagcgagcgacttccaaattggggtggaaaggaaggtgacacgaccagaaaacaaggccttataggcggattttgagctgtattggcccgaactctcccatttccagatgattgaatcaggagtagtaggatcaagatccaccatttggacaagcgaccaaagctttagatattctagaataggctagatcccaagtgctcctcggatgtctttgatccattggcgacctgttagtgcctcaaccaccgttcgacgccagcgcacgcgtggtggaattttatcatagatgttcggagcaatggaccgaatgcaaccctcttgcaaccagctatcttcccagaagagaatagtttgtccgtctcttaattaacagacggtagaggctgcaacgaagttcgtttccttttgcgaccccggaatggctagcccctgccaaggtttgcttgaggaggaagatggtggacttacaggatgaggctaaaatattgaggtggtcaatggatcaaacaagccaagatcaaagaaagattgattggaataaatttctggtctgcttatagaattatataaggaaagataattctgtgagatgtcatctccaccctgtgacaccttccaggagatgaaggaatagtgaaatgtggtgtcggccacaaccgacagaaaaatgtgaataatcttgctccatttcttataaacttggtcatcatattgaatctaaaaacataccctttaggttgtgatcgaaaagtgttactaccttattttcggtgctgaatgtgtgcagaagtcattcagaaacagcaagaaggggtgcccttcctgtggatcaagcttttgggctagtgatgcagcctactcctatctgagatgctgcagatgcagttgcttgtaaagtgattcgaagtggacttattcctattttggcatgctgttgggttttgtagaggagaaagacccattgtatggcccaacttgttgggctttgtagatttgcaggccggctgtcgttggcatgtgggatgccaatgtggctagctgcatctttgtgaagtgttccttcatctcggaaccactagcagtcttagcttccttatacacattcaattgcttgaagatcctatgaaagagtgatgcatagtgagtccaaaacatgtcatgcatggtatactcctatagttctattgctcctaatggttgagatgatggaaaggtactggttctgtctggagtctagattttaccgggtacacggttccagttttttttggctgctagccaaatcacatcaaatgaatttctttagcaacagaatttgatttgtctggcacgggcaacttggttgataagcttggatgcatttgtataactcatgtcacgggcttaaatcagcgtattatggttatggctgatcacttgccagcagaattagcgatgattcgttgttccgggtggaccctgttctgtaatttctgactttgttacaattaaggtccatttcctgacgagagctcattgatggctttcttgtgcctttgtggagacaggttggtagaggttgctgagggcatcaaaacctttctccctgtttcctttttctagtactggtacgcttggtgttatcgagtttatgtccatgatgccctacattgattgctggactgaaggagccctgatacgctctactgccacgcctcgccaagataagatggcacttttgtttgtaagcttcctctgttgtttctcccgtggtgcgtgtcgtggttgggtttcgacggccagtcggccagagaagggtcgtgtcacgaaaagccttgcccgcactttgaactgtcgcggtagcatcattcctgctttgacccctgatgaagtcatgcaatccatgcatcgcagctagaggcgttcactgtgttccgccttattcgagctcgtgctcttacttggtccttgaaaaagattcgtgattctttttttcagttgtacctgagatgctcccattttcagagcttccggaattttcagccccccccccccctaaaaaaaaactaactttgcacttggattgtgtttggttcctgaaaaaagttaaaagtttgataaaagttggtagtttggaaaaaaattaaaagtttatgtgtgtagaaaagttttagatgttatgtgatggaaaattggaagttgagggtgatctaaacacggccttgatgggaaacaggcaggagtagaatggtgcaaggtaggtaggtgtgcaggtaggtaggcgtgcgcggcgtgatctgaccgcgaaattaccctcgcgcaggaaccgaaccaagctagttgtgctccgtattcgctgcaactgtgaaacacctggagcatttgactccatacgcacgaggaggaagtacgcgaggccggccggccggcctgccggctgccgacgctgtcgcggcggcaccgattgatcgatccgtgggcccgcgaactccactcctattccggctaacgctatagctcgatctaccaccagccaccgcaccggcgcaccgcaccccgtgtccccgtggcatccacattaaacgccaccgtccccgcaacagccgccggctcgggtgcacgcgcgggctgaaaacagtcggaaacaatactcgatcggtaatggaacatatttatcatttaaactactcagtatcgatattaatacgatgtaaaagaaattatgaaaaaccaaattttaaaaattaagaaaaagtacggtcagaaacagtacccatattacgaaaacgtcgttcggtcgatcgggaatttcagtatctgttttcaccccatcatcgcgcacagccggcaagcttgcattggctccctccgatccctctcctaccaatcgcgacgatttatcgaggttgattcagcgcgcgtcgtcataccgccgtcgcgatccgcggcacagcgagtagcatg

SEQ ID NO: 78877 - DNA, 11665 bp, Oryza sativa
ggtcacaaatcacacaattatttgtagtactactctcagtctcgtttatacgtgctgaaagagagtgggacgataaatttcacaggaactttattgtatactagtagcctgtcttttattgatcagtttactttcggcatgaagcatagaacagttccatgcgtagctgtaaaacgctcaattcgtcatgtactgaagcaaatgaatgttcaataaaatcaccctggtgtgtatcctgggaacagggatttttgccatatatgctctccaatgatcgttcttcaaaagacccggtacactgcacacacagcaaatttattgtgcctagctaccggctgtcctagcttcctccaaggctccaatccaaagtctcccccactgtttgcttgcgcatctgttgaccccaacacattggtgtgtttgaggaggaggagatagagaagattaaaaagatatgtaaaacgagttgaatcattagcgcataattaattaagtattaactattttaaactttaaaaatgaattaatatgattttttaaagcaatttttctatataatttttttaaaaaaaacgtaccatttagtagtttaaaaagcgtgcgtgcggaaaaggagtaacaatcttccctatctcccctgaaagaacaatctcccgttagtagtactgcatggcatttggcacgggatgcaacgacattttgatcgagctgccattctttcggatgggctctcttaatttgttcctcttttaccttttggttcgttcgtacgtgaagccgcgatcgatcgattgatccataggagtctggaccattaattcctttactgcctttgctgattaggatgatgtctgcacatacatcgcccttcttctaacaaaacaaagaaaaattcctcacccggcgcgtcttcatcttcttttctgtgcctaaccaagtagacatcggatccccatcgatcatccagcataatgagagagagatggactatatgcgtagttgtgtagattttcttgccgtgctcttattaccacccggccgtataatgcagcaagtaaagtagaagtatacacagtattgcagttaaaggagtggacgcggtgctgagctttcataccactcgagtacgtgctcaactattgaagtttcagtactcctcgcttcattccctccctctatctcatctgctcatttgctaggtgctctcttttgtgggccatttttgagccctaaccatcgtccgcacaatcacaaggaatctaatctttgaatgcctttgatcctcgtcattatgcatcatcctttattcaccttgtctctacgtgtagtatagtgtcgctcccatcagaaactagcagctgcctctcagtagactttaatactggtgcagtggtgggttgggtaacgcattcttttcttacagtactagtacctcatgcacacaaacgtgcaaaggattagtattaccctctatcatatggcgtgcgtgcgtgcttgctagctagtcatgtcagtctggtttagagatagaggcaggaggcgcctatggtgcaaaagaaaaggaggaaagttaagctgtgcgtggcgtgcatttgctcgtacgtgtatgtgcaccatcgatagggcgcttgcagcctttgcttattaggcggcttgtccgttggcaaatgctgtagtgcaccaattatccgttctttatttacatgctggtcgatatgcatgctatacgatccaatgagtataaggaatggacacgggttactcattagtgagtacttgttgacccaatattgcagctgaaattaaatcaactataccacacatttactccctccgtcttgaaataggttcatttttaactattttcatttgttccaaaataaattcaattttagagaaatcattgcactacaatttgtgaaaataaaaaaataattgtttcgagagtagataaaagtaggaagtagttgcattgagatttaataaaataaggtattctaatcttttaattttgtattggtatatttaagatggtgaaaaatatacttattttaggacgcaagaattatctaattttgctcattttgtttgggcatcgatcatctgcaaaccgtacctgtcactgacatgtgcgtcccatttctctaagcccacagatcagtagcagtaactgccactccatcctggtttagtatctgcttaattggccgagttggccgggtacatacctaacaagcagcagctagcgcgcggtgtggtacctagcttggacagcgaccaatggtactgtttggcgacccatgatgatcactggccgggccggcgcgcatgcatgatggtgcgccctggacgcattcggtgtctcgactgcgatcgccgcggacgtatgcgcgtggcgcgcgtaccgtgtaccgtaccgccgctggagagaccactcgtacgcttgcacgctgtgggcgtagtattgcagccggccggccgcgccagcgtacgttttgtccttccctaagaccatttccaacccataacactagatataatttccataaacttcacatcatcgagaaactagtactagacactactcttccaatgcaaacaccactatttcatgcttcaatttaatgttacttatctcacatgatgtcttggatgttgtgtagaaatcatgtctcgcatggtttccttctctttcctcatttattcacttgccacatcattttttatcctatgtagcagcttatttaatgttatggacaccatcctagtcattgggttgggaatggcctaatcatgtacccctcccatgattaccccaattaatatggagtatatacgcagtgagcgagcgtaccaccaaattgaatgaaggtccccggtccaggacgacgaacagcttaattaattcactgcgttaattaatttttgatgatctcgatcgatccgtttcgttggacacagcacagcggcgtgcctggtagaagaatgtactagtaattctttgattggtgttctaaaaaaaaaattctttgattggtctgatccgacgatggatgtgtgagattgtgagctgtgtgtggtgtgtgcgcgaatgcgaatcagcgtcagaaaaaaagaccgaagaaccttgaggggagaaagggaacatcatatcgacgtcgatctctccatcatcttctccatttccttatacgtactactagctttgatcacgtcgagacttttgcgccccgaaaacgaatcgacggcgccacggcggttgtattggtcgcgtggctagctaccctttgtttgtcgctgcccctgtggctttgcgctttggccgtacgacggcgacgacgtcccggccggacgacatgctgcgtgagtgattatttcattatttgtattttgggagtggtttggagatgaccatcaaagggtggcgaggtctatcgtactacatggaaaagctagcacggcgtacgtacgtggaattgtgggcgacaacggatttgttcaggtgatagcgagccccctgacgcggacataacaacaacagcaaggcaaattaatcaaggcttctattggaaatctacgttacggtaggaaacgtatccggcggggacatacgtatattaagaaggaaacgtgctgctccttctagtagtacatgttttctgttcaacttttcgatggcaaagcttagaaacaaaagttaaatccctttaactagtcctaggtagatacagacatactttgtacagtagtatatgtgctatgctccgtactgtcacagtagatggcagtcaatcgttgtagtactacacaggagggagttcatcacgccagattctcgcgccctggaggaggcgacaaaccaacagctggcacgcccagcagccggccggcgccaccgctacttgttgtggctccccgcagcgcgcggcagctctctcgatccatttccgatcgagccgagcgtgactacgccacgacagacggggatcaatcaggagaaaaatcaatcgattacccgtacatacgcgcaggcgcacgcaggcatcagcgcgcgggtcagcgtagcgaccccccgttttctctcccactactcgtgccgcgccgcgccgctcgccgctcccgcaacgcttggggccgcggggaggcaaggccgcgcccgcgcgctggcgcggcagcgttgcagctggccacccgcgcggccgcctgcgaaacactgtggacctctttcgtacggggcgcgcactgccacgcccccgtcgcgcgctgcccgcacgcggcatcacgttgcctttttctttcgcctcggcttcgggttcagtacggagttttctctgtattcaccgcaccgcaagcggacggctcggtggaccgtaccagtaccacaccggaccgcaaccgggccgtatctgaaggtgcacatgtgcagcgcagctagatttttacattgtgatccttctttaaaatttattttgcaaataaaccttaaaaaactttttttttttggaaatttactctttttcttggtgccaaggttatcggtgctgacgtttaatgtctccgcaccaatctcactaataccgacaccatgtgaagggggtcagcattgacgacctatttgtatttttttaaaaaaataattagcatggtagcccacgcagattgcgcggctagcatcattatattttctctcatataatagcatatatgttttctcattatattattcaaatatattaaaatgacatcataattttaaattttgcaataactttacgaaaataaaaatgtataatattcatattgtattttatatacgtgttagttattaattatttttaatatcaaattttagttatttgtaaattatatatattcctatatggactagacttgtctttcaatattttctttttttaattccgaattttctgtaaattgtatttctatatagactctaggatttctatatagactctaggctcttcttccaatattatttatttttatttctgaatttttattatttctaattgtatttctatatggactctaaactcttctttcaatattctttaatttttaatttcgaatttcagttacttctaaattgtattcctatattgactttaaactcttcttcccatgctttttttaattttgaattttagttatttgtaaattgtatttttatacgaactcaaaactctacttttaattttattatgtttattctaaattttagttagtttgaaatttctatatggactctatactctacttctaatattccttattttttaattccgaatttctattattttctacttgtatttctatatggactctatactctacttctaatattccttatttttaattccgaatttctattattttctacttgtatttctatatggactttagtttcctcttctaatattcctttttttattccgaatttctgctatttttaaattgtatttctatatggactctgccttttctttttctccgattaatgtgagaatttctagtccataagagtgaacgtggtggctcatttttctattcctttaatataataatagatattctaattttttttcttataaatagacaccatgtgatagtctctttgcctttgaggacttatttgtgataaaaaggttatatttcaacctttctttaaaaaatataaataggtcatcgacgttaacatctttgtctccaactcctttacatctcggcttctaggggtgagggtgttggcactaggacattgaacctcaatactagggtcattgacttcaagaaaatgatctcatcttataataagtttttatagggatctatttatataatatgtacttgcaggggactaacaccatcctttctgttcagccaaaacactaaagagaagaaggtcttgagattttcaagtgttcaaatggtaaaatactattttagcggtgagagcagtataatactactcgaacggtaaagtactattcgagtggaaagttctattcgagtggttttatgctattgaagcaactcgtcccgtttgagtgtgtttctaaccagtaaaaagtaaattccgagagccatataagtgagaaggagtgttcgaaatctcaagatggaaagacgacccaagatgaaaaaacgactcatgttgaaaaatatgaacaaagatggaaaagacgactcaacctaatgactcgagagaaaaagctactcaaccaagaaagatgccaaaagaagattccatagagaccagttttcaaacactcatgccagctagtgccaaaagaccataatgacctctacaatgtaccataatacatctagggttgctgacatggcaagagtataattttaaactcacaagggcccatgggggcaaagttgtaatctcacatgtacgattgtggggtatataagccgatcaaaagcatgtagcaagacaagacataatttaatactactagagaaacattagccatcaaagttctgtattttgtatttgagctcatttctttggataggcgagaaaagaaactttcctgtttatctccaaacttattcgtgacctaatgtcacgacataatataaataagttttttttaaaagaacgaaaacataaaaaaaatgtaatgttgcgcagctacttattgaaggtcacctactccgtctcatcataaaatggtgcgatacgatctgccacacattatatgacgagcacttttggccattccttggtctctcacccctcggctgcagctagcaaacggaggtacggctggtctgtctacccataccctactaggctggctgctgaaggatttaatcgtgatctcgtgaaaagaatgaaagaaatgaaagtgattctattcagactcagctcagcacctcaagccaccggctatgcttctcggaggcctaggagagatgtccagttgtacaccacgcatatgtttggccccggtgcaacgggtgcaaataacacctctagtctctagaaaaaattattgttctaaaaagagggtctctacaaaaaagacgtttgggcagacctttgttacttgtagcccatatatgagtcgtaccattgttcgccggccccatgaggcccacatggtaggtggagctacgtagaacaagcatcgtgttttcttgtagaagtactacacaacactagaaattctacaaaaccaggtgaagaaaaaatattctacaaaccagactaattgtgtaagtagataattcaacgcaattcaaattgttggagtttcaatttcgagatactgtaagctattttggcacttttacagttatctttcaaattgaccaacactcttcagtaccttctaccactaatggtagtagggtgcatgagtagaatttaaatcaaaccatagatttcttatgggcatttaaaatattttatccaaagctttgttaaggtagctttatcaatttatttattttaacacgatatatgaaacgcattggtaggttttttttaagtaaattgcatattgcactggatagagtgaaccttggtttgctttgcaccggatttaatacatatttttacattgaaataaattgtacctcacactaggtgttgtatcatataattgaagggaaaatattgtaaaatatgtgtaaaactttcaaaacccttttgaatttagacaatatttgaaagggatttattaaaataatgaaatatcatgaaagccctttcatatatatatatatatatatatatatatatatatatatatcttcattattgttcattgaattaaagatttggttttgttttctcattgaatttgaagatttcgttcagatttcggatttaataagttgaagatctttctgactcatctatataaagcggatgaaacaggctagcaaaagacacacaaaacacgatacctcttccctccccacttctaacatggagaacgtttttactcaatctgcactactctgtgtgttgtttcttagtagttcaatagttggaggttgctctcctacaatggaagaagaggtacttctcttgagctatatatattgttataattcaaattcgattttattcaactgaaacatagaagtgatagctagtctatattgatttgttccccttttcccaaacaattaaccaggtccaaaagaattggcgaacattgatggcccctctacttcatgtgaatttctcttcatcggatcatatatcaactcaagctgacccagtatattatgtgagtgtcatatactccttccgtccaaatataaaacatagttagaaatttgttccaaaataatgcaactcatatcttcttacctatcatcgatgaataaatcgataaatttctttcaatatcccatcaccgtacctactaatataactttcctattaatttggggcattttggttctttgtctcctttcttaactccaccataggaagctaaaatttgagtttttttggggagtatgttttttttccctagatctaaaagatgcacttgtactcatgatcatgattttcatgaccaaatacgtactttggcagtttgcagcatatggatcgattccttcagacgacgctatcaagtattacggattagaggccaccatggacatttatggctttaatctagagcatggacaacaaaccggaggtttcatttggatttacaatacggatgaagcatctgccgtgaataaagttatagctggatggaatgtaagttaaacttatctgcttgatttggaattgtaatttcaagcctacattagcttagctggttgatgctcaacaggttcatgagcttctcactgtcaatcgaagatgtgtcactaaacaagttactttgattaatcatttgctccatgtcttttagttttaacatttagttgtattgtacctcatacaggttgagcctgaatcgtacaatgattcacagacgcacttcagtacttggtttgtaagtttcttcataaacactgcagtttcctatccatcaatttttatttttattttttttgccataataaagattttgtatttattatgtcataactcattctccaattaatgccagattgaaggttctaatgtttgtcctgatatgcgttgtcctggattcgaaagtgtatttagctcagaaatcgttcctggaatggtgattagccctgtttccaccacctctggcaagaaacaatacattacagtcagagtatccaaggtttaattattgtctaattaataacagaacaatcttacattccttttttttatcccttcatatataaaatggaaatagtataatgaatctggacatacccatgtctagcacaacgaatctagatatacctatgtccggattcgttatactaggatatgtcacattccatgctggttgagatattttagcacggagggagtatgcgtcatgacactatattttgatgatttcaggatcaaaattccggtgattggcaaatctactatggctttaatggggatgccaagcttgcaggttactatccaagatctctgtttacaagcttgtcagataaaccagtgacaatattgtttggtggctatgccttgagaaaggatcaaaagccaagtcctccaatgggcagcgggaatgccccgtttaaaaacgccgcatcatttcgtagtatcaagttttttgatgccggtggcaacgcccatccaatcgattttcgtctcggatttatatcaaattgttacactatttctgttattgaaaatgatgggttcttttatgggggacctggcaatatttgctagtagtttgtaatcgagcttcaacttagtgtaatgaatatcctggggactgcacccacagagaaattgagcttcaatagagttcatcacaactgttgtgccactcttagttgataagtatttagcctcatcgtttgacgtattggaggaaaaaacgaaatggcatatttgcaaatgaaaaataatttgtgaataaaacttttatatacatgttctgacgatctaagagtaaagactgaaaaataaactatggaatgaaaaaaaaaactcaaaatcagctccaaattccaaatttaagattaaaaaattaaattttggctgataagcataagtggaaagatcaagatacaagattctaatatactccctccatttcgaaaatataagcagataaggagaggaaagggaaaaagaaaaagaagccgaagagaattacatatgcgtcatggttccttgcttttagtttcactttcacttttacccagggtatttacatactcactccgatttgataattcatgtcatatagacagcgacacattctccaaaacctatctttgaatataattttctattataatataaaaaccttaataagtactccctctattttatattataagttgtttaacttttttcttagtcaaacttcttagagtttgaccaagtttgtagaaaaatatactaatatttttaatataaaacaaatatattattaaaatatattcaatgttcaatttaatgaaactaatttggtgttatagatgttgctaatttttttataaatgtggtcaaacctaaagaactttaactaagaaaaattaacgacttataatataaaacggagggagtatctaatttaatttgattttttaagtctcatctacacatgttgtcccagtgccttaaaattaatatttcaaaagttgctaattgtcaaagttataaaagtttgacatcacccttataaaagaatgataggaattataaaaacaaaaggagtatgtgacattatctttcggatactttcatcgtaagtgatccctcggagtggatactttcatcagaagtgatctctcaaaaagagagaagaggaggtgtacacttggcatggttgcataaggtaaaattcatatcttgccttttgcttggtcgagctagctagcccatgtcaagccagctcgtatcacaccgtagaaaattaaaccctactgtcacatagattatgagaaaatatatatagagagctatagaaatatagaatctagaaaataaataaaaaccatatttttttttatagattctcacaagctatttctcataatccatagtttcctaaacaataccaaaacatctaggtacttcaacgcgcaatatatatgcaaaggaaactactccttcgtgatgattaaaaaaaaatagggtcatcgaggccaatgtcatgggctcacggcgacattaggatggagtgccgccgcaaccttcttccggccctacgcaaggaggcaggtgccactgtcgccgtcgtccgccttaacctcgagaagcaatttcctccttctgcctctaccccgggaggctgccgtcatcatcgacttggatgccgggaggccaccatcaccatccacctcaacttcgtgaggccgtagccgtcgtctgcccccaggaggcacccaccactgcccccatctactaactccaaagagaacaccgccgtcggctgcttctagcatttcaggtgcctactactcctacgtatctttttagttcatatattggttacttaaggacagtggcggatccaagatgatgaactacttgcag

SEQ ID NO: 78878 - DNA, 2571 bp, Oryza sativa
tttttagttcttaaatataaggtttttttgaaaagagcagtactaactcagttaaatttggaactaagattgagttaatgtttggttgtaaaagagactattgcatacaaatcgacaacaaaaagatttcgaaaatattgcagccaccagcaatgttaatttataaagaaaatgatatgtatatgctatacataccacatttttccacattttccccttgtgtggtaagcatgtttgccacgcttttatgctccaaatttgttttctggcacacttctgacatgttttgctagaaaatgtgtgtcgtatgatttagctaaaacattttatggctccaaatttgtttaccacacttttggtatgtttagctagaaaatatgttcatgacatatgggtctaagagtaaaccttccttttgttttatttcatctcccttcccccttttattttttggaacacatctaaactcttggtgaccatacactgctcactccaacctagcctatgaacgtctataacaaaaaaatcattgacgaaaactccagtcaaagcgtccgtgtcatcgttatcgtccatgacactctcgctatgactgcgggagggaatagaggaaagtcaagggatgacacagaagaggacgcaggcaccaggtggaggaccgtccatcagagatgcaattgatgatggtgagtcgaaaaagatgaagaggatgaagaaatagaatatttcaaatagtagcaatcattcactttgctcccgttacgactgagggggaatgttagaagtacaaatatgttagttagagataagagtcaaatacgaatatggagataagatatatcctagatatagaatcctagagataaaatagagtcctagagataaatctactcttacttgtattgtactctaagtctctatccaagtatgtactcctatatataccctatgagagggtcgatgtaatagattagaaaacattagaatacaacaaattagatttttccacatagatctcagatatttatgatgattattactaatataactgacttgtactccttgaactgaattaggggttctctgatcagaaggaattgaatacaacttccattataggtgaaagtgaaattgagtcacatatcaatttttgtttgttgtaaaagagtttctagcatgcaaatgaaatataaagaagatatagaatattgtaatcaccaagaaagtttacataaaacctgagacatattctacaatgacacaattttccactttttttttgccaaaagtgtggtaagccaaggattttatctcccaatttatgtggcacacttgtggcatgttttagctagctagaaaatgtgtctatgacatatttagataatacagtaaagaaagtagaatgctagaactttgtcaataattcaatactagcctcaaatggttaacttatcaactttgggaaacattggcaacaaatattcgcactaacgagattaaattttagccatttcggttaaaccgagattcatgagattttgagattttcgaaatttttggacaaatttttttgaaagtttaacccaatttaactgaatttgactaaatttaggtcaaattcacaaaaaattaagaaaaaccaaaaatttcagacgagataatgatttgctaatggttcgaacttaccgaaattttgaaaataatcgttgtttaatatttccatccctcccaaaccaagaacacaaacgatcctaagcgtgtccctgtactcaggacaactaaatatcaatggtccaacaaatgttccgaaagaacacagttattccaaaattaaagttatattaaaacacaataaaaaaaaacagcacacgcagcatgttattgtcaactaaataaacaagagatgcacacaaaaacaaaacgaatgacactgactacacctttggtagaaaaataaaagcttaaacattagtccgaaaaatagaattaaacccggaatttgtcccttcgtcccacttactaacagacggtcagtctttaaaactaaacttcgtctttaaatttgcccaatactatgatatttatagtaacaaaatcacaattacatataaaaagtaaattcaaatgtcaatccaataatattaattatttctatcaaataaaactcaatttataataaaacattttttatcaaatatatttcgatagttgaactttaaaatacatgcgggcatttcaatggaacgaaagttataataaaatattactgatcaaatataaaaatatatttggatagttgaattttaaaatacatgcgggtatttcaatggaacgaaaggagtaataataattaattaattaatcaagcgctcatttatacacgaggggtggactcctgcttgccgagcctcgcccggcgctccatcgacagcatccgggcgaagcgcgccagctcctcctcgttggtgcccctgccggcgtcggccacgttcctgccggtctccacgtccaccctgcacgcctgcctccgcagcagcgcggccccggcgccggcgagcgcgcggaggttct

SEQ ID NO: 78879 - DNA, 7074 bp, Oryza sativa
ggatatccgaacgaaattcccggatagtttccaaccgttttccgattccgacggatattatacccatactgtattcgttttcgtttctgagaaaaataaaccgaattcgtttccgaatctgagaatttccgaatagttccgatcaaacctatccgaatccgaaaaatggttttgacggacggattaattaattgcttaccggattgttggcagcaacacctccatcgatgagattgaagacccggggctgaccggccttgtccttggtctcgaaacggtgaccggggaggtaggtcggcgccgctgacgtgctgatgcacacgtcggacaagagagcattcttggatgcatccttctgtgcctggacatacatggatataataaaatgcacatgtaaattttacttctgtttacaatatatagtgatgtcctttttcatcactatagtatatatatactatacagcttacaaaaaggattgtaataagtttacatcaaatctagagaagatggtgggctggaggagcttgatgtcaaatgtggggatgacgacgttggtgatggcctggctaatcctggtgtcaccgagcagctcctgcacaatggaccggaggtatcgcccgtcgtacttgggacccatcatgctcttcagcaaacccaggggtcctttgctgcatttatacatgggaacattaaggtttgcctggatgaattggcatgatcagaaccgtgtagaagtgactgaaatttgtacgtattttcacatgatcttaattaattaactgccagtcgactaaacttgcagaataaatagcctgaattgaaatgcggcaactatagtataaagttgtgaaattcaattttctttctttttaaaactaatttaaaccactttacgcttatctaattatctgctgtttcatctatgctctaagtaaaacttgtactaaagttaactcgctgactgattcacctaattaactacattaattttcataattaagttaacgtaccctttttttcacggcgagaaataaaagtacagaatgttggatgtaaaatttggtcgagaaaaaagtaaatacaaacaccgtatacatgtatacgtacatgacaggagggaatatcttggggctatgccggaggtagaagtcgacgatgtccttggcggcgaagagcggccggccgtcggcgccgggcgccgcgagcatggccgtcaccagcccgcccgtgctcgtcccggcgatgacgtcgaagtagtccgccaccctcgccgccggcccgtccagctcctgcagcttctcctccaggaacgccaggatggtccccgggatgatcccgcgcacgccgccgccgtcgatgctcagcaccgccacgatgctcccgaacgccggcggcggcgacctcggcgtcggcagcgctgccgccgccgcagtcgcctgccgccggccgagcgccgggtccacggtcagtgacccccccgcgcttcctccgccgttgctgctgccgatgagctcagctgggacttgcactggcgccatggctggctgcttgagcgagctagagatcgactgagttgaagggggaggttggtcgcggttgtaattatagtgtgggagcatgcgtccctcgccggcggtgttatatatacggcggcgaatggcggtaggtggtggcgccggagatcagcacgtgcgattggacggcaaagcggatcggggggaggggagctttcccggaatctcgctggctcgtgcttttgcattgcatgcatgctctgcttgaaactgtaaagaaatataatgtgccgtacggataatggcccgtgactccgtgagccgtacttttctacgcggataagctggatatgtgtataatactagtcccgtttttaatagatgacgccgttgactttttccatttgtcttattcaaaaaatttacataattataatttattttgttataagttgttttattactcataatactttaagtgtgatttatgtcttatatatttgaataaaatttttgaataagacgaatggtcaaacatatgagaaaaagtcaacggcatcatctattaaaaaacggagggagtatatactaatatgcttacgaaattaatttggttgcagctaaagctcgtggtcgtcatgatgcacacgctacgcagccacgcatgtaaagtactccctcgttcatattccctagcagttactccctctattctaaaatataagtatttttaattcttacacgattttatatatgctaatttaactaataacatttacaaaaataagattttatttttaataaaaagagttgcatattatgatagcttgttgaatgataaatctaatgacatcaattttacataattgatttttttactattaaaagtcaaagtcaaaaacgtttgatttgtcactatgctaaaaatgcatatatttttgaacggaggaaggagacctattacatatttagatttttcaaatatgttatttctatttatagtctctatttatctcagatttaaatgaaaaggtaaaatgttgggttagaatccaagaagttatcttaatactcatagttttcatgtatatatatactcctttatctttgttacatgtaaaataagttaatttctttttgatcttggtaacaaaagtaataggtgtaacttttgtgaaataagagagtaaaatatataaacctatcataaaaaaagtgatttttgtgtacgtgactctcggtaggttacaaacggacctggccatgtctgcaaaaatcgagcgagcatttttcgtataagggtcattaagaagcccgcatgtaaaaattgatttcgtaggcgaacccctaaggggccgcatgaaaaaataaactctttttttttcatgtggacctcttaaaatgcccgtatatgaaaaatcattatatgaaaaatcatttttatgtatgcgggtctcttaaggatcgatctacaagtctaaatagcctcctccttctcgtcgctgtcctcttcaactgccgccggccccatccacgccaacatcgccgctccacgccgcctgagccacagccccgccggacccgatccgcgctcctcctcctccaacaccgcccccgcatgccctccaacagctgcctccgtggaacaagacatgaagacggaaaaatagacttattcctctacagtaaacatgctcacatcccatatgagaaattaatacccaacggtggcccatttgttacgtgcatataaatacacacacacacacacacatatatatatatatatatatatatatatatatatatatatatatatatatatatatatatatatatatatatataattaaaaaataagtaaggctttcggttgatttttttggtccgtcattaaaggatgggcccacgtgattatttcgccgctaatccgtgaatccggatgcattacggcgatctctgacgctccgcacaaaaagagaaacgaaaaaaagaaaaacctagcgagcagcccagccaagacggcagcaggccggcccaacaaaaagcaaacgtagcccagtagccagcccacagagtagagaagcagcagcccagtacaacatgtgtgatactgtagcaaatgagcactgtagcacgaataataccacctaaataggaggcttgcctgatactatctatatctataactaatataaatattcgtattttttctttcgtcacatctaattttcgtccgtacacaatccgatttggttagcaatagccatggaaaaaattgcaaaaaaaaatccgccgcacccgtcgtcgctacaccgtgccagcgagacaggaaggagagcgggagagggagcgcggacgctgtcgacgccgccgttgggagggcgccgtctccgccgcaccccgccatcaccgcgccgtgccggcgagaagggagggagaagagaagggaagcggtgccggtgggggggagacaacgccggtggcgggggaggcagccggctggggggagggggagaggcgggagagggggagagggagcggcgcccccggaggggaggggagggcgaacggtgccggtggggagatggggagggggagaggcggcgtcggggcgggggaggcagaggcggccggctcggctcggctgggagggagggggagggttagggttcttatcaattttaaactgatctgagccgtccatcaaaacgaacggctgagatcgatcgagggtttgggccgcaccacttgggctgcaccacttgggccgcacgcgggccggcggtccaccaagtgagaggaggagtatgggggcattaagtagactttgatcgcttacgggctgaagaagaaaataggctgaaaaaggctcatagagaaaaaataatttttatttaaataaatgctgaaatgatatttgtattatcaaaattaacaattaagctatgtaaattccaagaaaatttcaatgagtgtaattaatatataatttcaaagagtgtaattaatattgcagaaaatttatatgtcattaaattacaattcattaaatagttcaaatcaaagttcagtcaccatatcattatccggtgtaatgcatgggcattttactagtacacacaagaaataataaaatcagaggtgtcagatcgagaattccagatcgacaccgctctatgcctcgccgtccccacagccacagccgaccgtggcacaggcacttcggcctccgtagcaacgccgtgtgcttggcatcctccgtgccacgccgcggcatccatgctgggcccgcgtcttccacgtcgtgatcccgtcctctatgccacgcagctgcacgcatccacagttccacacggtggggctcccactctactccgcctcctcaaccgcgtcgggcttccgtgccgcaacccgcaaggccgtggcccgttctctctctctctctctcccctttttttccctttttttttgcgtttttctcttttttttctgtcttttcgctttttttcttttttttttgcttccccctcccctcacgcgttttcctttttatcctattctttttccgatttttttaatctatttgagttgaaagttttcaaatcttaacttgcaaatttttcaatctaaagaaaattttaaatctagagtttaaagtacttaaatcttgacttaaaagtttttaaatctcgagttaaaagtttttaaaatttgtcttaaaatttttaaaattataaatcttgacttgaaagtttttaaatttaactgttgaaaatttttaaaaagttaaagcttagagtttcaaattttaaattttaagttgaaaatttctttcgcgtaaagatttattttcaatcttctagtaaaaaaaatcttccaaaaaggaaaaatatttttttagttactgttattatcctaaactaactcggctagtcatgtaactccttcagaaatcgtgcccaaaaatcgcacgtgcgtgagctagctttcacgcaccttgacaccgcctccaagccaatatcgctcccaactccgaacaagcccaacttcagtgacggtgcctgtcttccacgctacgccaccgcatccaagatgggcttatgcactgctctgcctcaatcgcgtcaggcttccacgctgcaagggcatcattgtatgtagacacggacagtttggcaccgcctacaagccacagtcgctcccaactctcaaccagccccacttaagcagtggcggagagaggttgtgctatgggtggtcgcgattcactagggaagttgccatctcatcggcggatgtggctgcttggggcgtcatcaaagatggagaggtagcggcggtgcgagggcaacgattcgtggggtgttgccgggcggcagcaacggccaaaggtattgtcgcacgggatgaggaagcggcgagacggagaggctgcactgctgcagtgagaaggcgagagacgaagacaggccggatgggtcgacagtggcgaatccagaaaatcgattcgttggtgtcataacatgtctatcggtgtcgtagtatgctaattatacttagatcatggtgttataacatatagataagcagttttgttataggttgtaccaaaagtcgacggtgtcgcctgacactggccttagtaccgcagatccacccctgtgggtcgttccggactttgggagcattcgatattgtgggtccgggatatcagttgagagagggggttgcacttggcataacggatatataccaccatttctaatgttttaagtagtatagaaacgagtgtgtgcatgtgcggtgcggatacatccgtcaaagctaggggttgcatttcttcaaaagaaaaaaaaaatccacgcacggttgcacatcacactcatgcaatacatgcgctcctgcatgcatgcctctcttgctgctccaactactagctctttcttgcttaatgagcgtgcagttcctgcatgctcggatggctatctagcttagcaagctaagcatcacttgcttagggattgagctcccgctaatctcgcactccacggtactagagtcacacaaaacagcacaaccacacccgcgcatgtccataatgtggaccaacaggttgcaatacgctatatgcatgcatgccccctcatcacctcatgcatgataatctcattgctgctttaatttgctagtagaagaaagggaaacttgtggccatgcattatcaaacaatattgtttgttgctggtaaataatgaagaaatatatatttttttttgaaaaagatcactttgtattagcagcatctatcagaatgatggtaagagttaataaatactagctcttagcaattgatattgtgtatataactacaaaggttgggttcatgcacttacattagtacttcctccgtttcacaatgtaactcattctaatatttcacacattcatattgatgttaatgaatatagactcatatatctatcgtatatctatctagattgttaatgaatctagatagatatattcattaacatcaatatgaatgtgggaaatg

SEQ ID NO: 78880 - DNA, 5614 bp, Oryza sativa
tgtgaagtgaaatatatgtgataaaaaggtaacaaggcacattacccggtataaagtgtaatttacccaatttacaaagctttaaatgaactgtcgtggggatgattaaatttattaaggccataggccgtgtttagatttaatattttttcttgccaaaaacgtcatatcgaatgtttggacccatatataaagtattaaacgtggacgaaaaaaaaccaattgcacagtttgcatgtaaattatgagatgaatcttttgagcctaattacgtcatgatttgacaatgtgatgctacaataagcatttactaatgatgaataaattaggcttaataaattcgcctctagtttacaggcggaatctataatttattttattattaatctatgtttaatactttaaatgtgtgtgcgtatactttaaaaaaaattggccaaggaagccatactccacatttcttgtgctatcgccagaagtgaagcaaattactcctaacacgttatgttggtagacaagttcattattgtgtctttcaagcttactgaaaagaaaagctttgtttaatggctgatagtgacctgaaccctctggtgctggcgaaggtgccaagggtacgggtgtacaactcacttcatctccgggtgtgatccacatgtggattgttggacgtccatcttactaacagtcctaattaattacccagaaaaaagacgcttttttcatctataatttggggtgtcctggtaatggggatcagacagctgcctattactggttgtgatttgtgtgaacagcagagccaattcaattaaaaatttgccaactttacgtacaaatggtcttgtcacgaagtgagattacggatgccgcttatgggtaggatggatttggcgaatggctatcacgtagggagtgggctgctttgggaaaaaaaaacaaacttgcttttttgctgaaaagataaacatgtgaagagagagaaataaatatagaacgataattggaaatcagtaacaaactaaaaatgaaagaaattgttgagagtaacaaaaaaaagtggaaatcaaacgggtggttttcatgattcctcacgaaaacatgtatttaaggccgtaccgatgtgtatgatgatgatggataagatgtgtattcaaggctttacttcaaatcaggaaaatcgtacctaatcagccatgacaatgaaaatcacgaattaaagcacgcggtttagaagcttcattctcaaggagaaacaaacaacgggctcaccggagttaacccctgaaacaaggatcccaacttcccactaccggtaacacggatgaccacaagcaacccatcttgactcccatccctccgttccccccagaagagtaggcacgcgcgcgcgtatagtacgtatcacatgaaaacgaggtccctttgatgaaaaataacgactcccatccctccgttcccccagaacagtagtagcagcatcaccgcatcacctccatgcccttgctcgtgcgcatgtatcaacacagtcacacagctactcaccacgagtccaagcttctgtttgaaagagtttaaaattctatgaacacacaaatatatctaaaaattcttttaattttgggaaaaaaaactcgagctggtataaagctgaagcatccctaaaaacaagcccaagacgaaatgacgaatgcgttacgacatgggcggagacggagggagatcagggtcgcgagtacaggggcgttggcttcaccgatcgatcgattgggcgatgggatctcgccttatccccccgcgcgcggcgtcgcccgtcgtctcactgtccgcgcggcccggccatatttatgcgcgcaaccaccccgctgtcctcgctgcgacgctgcctgcatgtccgtgtcccggccggtgcggggcgtggcgccacgcatggccgtccgcgtcaacgtacgcctcagcgtactacacccccatctttcgtgcgtttctcgcacacgccgcagatcgaattatccgttgtgtttttgtttccgtgcggctgcagagagaaaggaagtgactggctctctctgtctgtgccggaacaaggttaattacaactgccgtgattgttcgcgctttgggatgggacgaagtggaggggcccggatcgatcgaaccttgccgtaatttcaaaggtgcgggcaaatgcatgcagcatcgatctttatttagagactttctttcgtgtcacattaggtccaaatcccgggtagatcatcacctttagcactacccgctaaagatagaaaaaatataggatgacccccggaggaaaaggagatgcgctgataaattaattaaccggacacatattcttgccccacaatccaagcaaaggaaggagagactgaaggaaaagaaggatgattttttatacatggtctgcttcccaaatttggcgacgcaaacgcaggacaaaacgacgctgattttttggctcaagtttctgtgcgccgtaggccgtagctggcttgcatgcatgaattcttttggtcatgcgtggaaaattacgggttgtacatgcaggctgctcgattttagcactgacgagtgttttaccggcggcgctttggcttttagtactcccacagaagtggctcctccaggcggaacacgccggcggcggcggcaccggcgccggagattaagcccacttcgtcttcccaagacgacgcgcacgagaggcccgagctgggcgggccgtatctgaggtcgaggaggaggtcggggaggtcgaacagcgcgtcgtcagcggcgtccggcggcgggggcggcgaggcggaccggcgctcgcgtcgtccgatccgtcggggttattgctggcgcccgcattggcggaggaggccgggaagcggcggcggcggcgagcgcggctgcggcctggacgtccttgggcgccgcggtggccgggcgcggcagctcgtgggcgaggtccggaaagttgaggtgcgcggcccggcccttgatggcgagcgcggcaacgtcgtgcgcgcgcgcggccatctcggcggtggcgaaggtgcccagccagatgcgcgacttcttccgcggctccctgatctccgacacccacttgccccagctccgcatgcgcaccccgcggtacgtcgggtggtgcccgtccttgcgcggccgcttcttcttgccgccggcgccgtctgaggacgacgacgcggtggacggcggggaggccggcgcctccccgcccgaggaggacgtggtcggctcggaaccgaacgacgagtcgtccatggcgccgcgcgctgtggtggactggtggtggtggtggagttggttggaagaggagagcgagtgagcgagctgtgagctagctagagcgggcgagcgagcgactgtgcgaggcgaggcgagtggcgtggtgtgtggtgaggtgggagggaaagcagtgggagtggtgggtttttatgatgagcggatggggcgcagaggcctctcgcgacgtggaaagagggaaacaaggcggggaatagtgcggggagaatgcgaatgggtgagagcgactgggtgagaatcaccacgggttttgaggacctctgcagccgcgttgtttttttgcgattgaactgcctcgatgttagtggcaggtttcattgcaagtctgcgatgaactcttgggactcaattcatgggtgtgcgggtttgtcatcaatatgggacatctggaaaacgcacttgtttgtgaattgtttttcatcgaatctgttcattaaagccaatgcactaagctattgctaaatactactttctaaatattcgacgccgttgattattttaaatatgtttgaccgttcgtcttatttaaaaaatttaagtaattattaattcttttcctatcatttgatttattattaaatacttttatgtatacatatagtttttcatatttcacaaaagttttttcttataagatgaatggtcaaacatgtgctaaaaagtcaacggtatcaaatatttagaaacggagggagtataagagattttgaagggatataacacttcctagtactagcaaatactatcacatccatgtaaaatttcttttttgagacagatgaggtactatatttgttatactccgtctctcttggaatgactacatgtttaactctgatggctttcttggtgacgagttgcctttgagcgtctaggtgagaacacttccggtacattagtgatcgattgaaaaaatgatttataattcgttcaaaaaaaatgatttataggaaagcacaatgcacacctttagcaccttgatggaattattgatgcatgatttcattccactccgggagttgggattcgcaattttgatattggatcaaaacctctcacgagtggtatctttggattttgtaaaaacagttgataacaaaaagaaaatgaaatcaagataaatcatgtcaaaacttaaaattcagtttgaaaatttttgaactagaccgaaaaccaagcggtttgtgttttcaacaagccggaaaatattgaaatttggaccggtttccaccaagacaaatgcaacatactacatttaaaggattttgcatttcactccattactaaaattgcatttaggttcttgagagatattcaatcatcaatgcataataaacaagtataaaaaacgatcctcaaaagaaaatataaaatttgcggatcatgcataaaacaaataaagggaaagattatcttttcacccacctactaaccgtgggttgacataaccccaatggaaattacaaacaaaggataaaagctgcggaaatgcttgtcgccgggcgaccggcgcggggggagccggatcgggcgctccccccgcacgcgcccctcccccacgtgggtccactacttcttccccctttttccataaaaagatgtttcacctagtgtatttacaatgtttcactatttatagatctaatgttgcaataaattaaaatacttttttgcaacaaaaaaccacatattttggaaactctctattaaggaaatttggtttattttttgttccatcaaaaatgtttcacctagtgtactcacaatgtttcactatgtatagatctaatgttgcagtgagcgaaatattccattacaacaaaaaaacccacatattttagaaaccccctattaagggaatttggtttattttttgttccaccgaaaaatgtttcacctagtgtagtcataatgttttactatgtatagtcgttatttgctaaaacattgtttttatataaggtgaaacaacacccgatttaaacgagtgaaatattttcgatctacttagtgagacaattccgatatacttggtgaaacatcgagcaacatttaaaaaaaatcaataataagttaattttttttcgtcggaatatatccatatgtggtcttgttttgaagatttaattgcaacgaatttaatggtgcaatcggatcatgatttggataagtaatttaggagaaaaatcggtttaaattagttttgcacgtaaatcgggcgctgacgtcccaaattttcttgaaattgtcgggcgcccgagccttaggagccccgttt

SEQ ID NO: 78881 - DNA, 2054 bp, Oryza sativa
  unsure (1)..(2054): unsure at all n locations
caccgcagacgcacgttcaagaagatgaggggggagagaaagaaggggtagggattttgacaagtgggccttagcgattttgttagaaaaaaaaattgctgactagactgctatgtgggctatttgaaccctaaaccactcgcaatagtgaggggggttctgtctgtttttttgagtttacgggggcaattcgatcgaggggtaattatactttcacctttattatatggtgggtcccactatcctatctccccttcctttttttttgtcctttttgctcttgaagagcaatgagtggtggatagggtctttggcccaccatgagttagagattgtggtagaaccggcgcttatttagtcgtctttttctttctctttcttcctctctctattcatactcacctaaataatctcattcgatatttcaatataagccagctgagtaggattgttaattatacctacctaagcatacgatattcatggatggatgtatatacatgctaattaattggcataaatggatcaattttctgcaggtacggcccaattttcaggacaaacataattgctcaagacatgatcgtgtcccttgatccggagctgaacaacttggtgttccaacaagaggagaggctcttccagtgtggtacccgaactcattcatgagagtcttcggtgcagatagcatcatcacgacgttcgggtcctcacacaggcacgtcaggaacctggtcctccggctcttcggccctgaaaacctcaggcgagcaatgctccaggagatgcagaaacgggctcaggccagcttgctctcctggcttgatcgtccgagcatcgaagtgaaagaagaagtctcaagtgtaagcatgcacatatatgcatgacctcaattatgatatatagtgtacgacatgatatatcattggatctaattgcttgtttagcacagtagttaaaagtctaattaatatatgttgtacattttttaatattatttataatcctggcagatgataatattcagcataatagcgaagaagttaatcagctacgactcttcagcatcaaacgggaagttgtggaaacagttcgatgcattccttcaaggattacttgcaggtaaacatataaaatatatagagtggctttacctttcaaataatgtttagatagaatatgtatatacacgatcgatcatgacaatcaattcgatcactgtatatatatgcagggacgaaaaaatgtcatgaggatgttgagagaattgctcgacgagaggaagaagaagacagcacatcaattggaaagcatcgacttcttcgatgctttgattgatgagctgaagcaggagaagcctgcagtgagtgagaacgtcgcgttggatctgctcttcttgctgttgttcgctagcttcgagaccacctcatccgggatcaccgcgatactcaggtttctaacggacaatccaatggctttggaagaactaacagtaagtgcaaggaaattaactactactctgatactacgtactagtagaactagctactgatgctttccttctgtatgtacattgctctgttgttggatatggacatatgctttctttcctgaaaatttaattagtatttgtggcgatgtgttagaaataattaagacttaattattaaagtattgtgctatatgcatttgctgataaaatgatactaattgatgccttcaggaggagcatgatcgcatcctgaaacgaaaggccgatccaaactcccaaatcacatgggaggaatacaagtctatgaaattcacatctcatgtatatgcatattacctttcagtctttttattactgcttgcttaatgcatatttgtaagcatgacttcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgatgaggcaatatcatcaatcccatg

SEQ ID NO: 78882 - DNA, 8288 bp, Oryza sativa
  unsure (1)..(8288): unsure at all n locations
ctactaatgtgataagagtgtttcttagatttaaataaaaattcctttattctggtcatatataaactggttgtttgtcatcactacttactgtcattgtttaagagttaggtgcacttttaataaatgaaattgtattagtaccactaaaacaaacgatacattattaatacactaaaaaaattcatctacactacataacccgccgttcatcacttatttttacctctatatataaataggctaaatataccatatctaccgaataatacgataacatcattaaaaataaacatgaatgcctctctaatgtatgaagtcggctgtatctaccaaccaaggcttccgtatgtaatgccttaaaacatacaggtctcgcatcgataagccatgcccctaaaaaccatcgtagagtacaattttaacacttagttcactattggtacactcacagttgattatattggtaagtacgtcactttagttacattgcctatgatggcctttcatggacaccaccttaactcaaccatgtacatgtccatacaaatttatgatggcatagcaagtattacaccctgcattgaaggataaagagggacagaaaaaaagaggtgatgaaaataattttttttaagttttgagtcgaattgtggtagagaatagacaaaatatgtatatgaagttagtaataagtacttctcaaattttattggaatacatacaatattatgtttttcaaatgagtggggttaatcattcgacactacttaaaaaaaatataactaaagagacgtaccaccacgaaaatctgcaaaacaccatatcattatttatattttgataaagatttatgcttttgcgccaaatttgtttccacgatatgttgtttataactatacgatactcatttactaattctaagaatgtacttattttcacaaacttatttacactaactaatttgctagagtgcaacttatttacatacactaactaatttgctaatttgctagagtgcacttatagatgggttcagtggtgtataacattcgtccatcaattatacatggtatattagaatttctataactataaaaaatatatcataagtagtttgatgcgtattttattggattattcatgttttgccaatactacttggcaaagaaaatacataattctagtgatgaattaagggttgtattctagcaacacgattgtctaaaatcttatttatttattttttttcacatgtatctatcatgtatgcttcgcactcctcaaataacaataaaaaagttttgaaaacttttaatagttttagaatctcaatctcacccaaaataaacctaaaaagatctacttaaaaaccaaagctaaattatgttgttttattaccactcgctaaaatttaatttaattttctcataaatctattaattgtgcttctgacacctcaaataagaaaagttttgaaaaaattccaaatgctttgagaatctcaatttctcccaaaattaaataaacctaaatagatgtacttaaaaaacaatgctaggttttgtttttttaattttttacatatgtagattcaaattaacgttatatatttgtcaagtgatatttgaaaccataaaatatcatatgaaattatttgaaacattattatcgcattaactattacatgttggcatcatttgccatgatatatttatcacacaataagtttacgattaagtttaactgtgcatatctatgtatagtattatttttaataaaattatagattaaaggttgttgacaacaaattagtgctgaactgatgatttttcctgatcagtatttctttccgatactactatgtacgtgtgcgtgctttctttttatttttttttggctttatctttttttatcatatatggtgtaggtatttaaattttgttttcttcttgggaaggagacgatcgtacgacttaagcacgtcacttttttttaccatgatagagattagtagcataatccctttttttgagaaatcccttttttttagagctctaatccaatgtttaaaataactggtccactaatttaagtgaaaattaaaggttggatggttttctttttttactctaaatttctaagatttctctaattntattagagcatcacgtgataatgtaggagtggttgcagtacatttagtagacttttagtatataatagattggtatgatttctctaaattattggagaaccacgtagcggtgtaaaagcatttgtagaaagtttaatgtacttttagtatataatagatagatttagaagatgcttgaaagaacattgattggatatttattatagatcttaatttaactaaatatatttatatttgtgaagtaatatattttatatttatattgtagaaagtcatattttaaataccgttgatttgtatgaatgtatgttttttctgtcttttttatgtatatgtgtatttgtttttcttctagcgaagattatgaaagttttgttttcaatcatatatacgtttgtacgtacggaaagtacagcagtgacatttgtaacgtacaaactcatacgtacggactgtagcgcttgtatgttataaacatgaggaagttattattttctaataatagatctaatctaatggtgtaaaataacgggtccaccaatttaagtgaaaatcaacggtgagattagatagtgctatgtggcggcttaggagcgtttgtagaagtgccacgtagcggcttgagagcgtttataggatgtttaatggacttttagtagatagattttgtcataaaaagttagaatctttaaaacaattgacaaaatatatcgggcctgtttggcgcagctccagctccagctccatccctcctggagctggagctcagccaaacagtttcagctccaccaaaactgggagtggagttaggtggagttctatcacaaaatatactagagttatatttaggagttgaagctgtaccaaacatgaccataatatatcattttacaaatattcgagtttaaatttttgaaaaattaatttatttttcaacgtttaaatacatgccagtaaaatactttgtttgactgcaaaatggttcttctctaactttgtaaaatggcattttatttgattaaaaaaattatatatcgatttacatttttcttggaaaagatttgactgacaaatttcttatttcgaactgtttgatcacaatttatcatcatgtatgagcaatgccctgcaatgtaaatattatcttatgtgaaacccttccatatcatattatgctttcacctgacaaagctaaaagccatagaaatcataagggcctactttctcaaattaccccacgggcatattcaccacgtgacaagctagcccaagcagttctcactagtaatcatgcaataaaattaaaatattatattaaaataataatttaggaactaatattaaattttcacagataacattcaatataattacaattatattttttaagctctaaatttgacccgccactgcatcgcccccattggatcatgctcactctgtgcgtaggttagcctcaggccctcaagtgtcaccattagcaagcagaacatacgcctactccgtctaaactgagacagaatcacgggcccacccgtcagtcacccaagctccaaaacccaaaccccccctaatctccttcaaaactgacacgagatggtgggtcccacccgtcagtgagacagccgcccacgccttaaagcccaaacccaccttaatagccacccactactcccactcccacttcgctccactccacgcttcccccatgactcccctgctcctcctcctcctcgccctcgccgccggcgccggcgccgcctccttccccgccgacttcgccaacctcttcgccgccaaggccgcgctctccgacccgtcctccgcgctcgccgcgtgggaccctggcctgtccccgtccctctccccgtgccgatggccgcacctcctctgctccaacccgtcgtcctcctcctccgccgccatcgccgccgtgctcctctccaacctctccctcgccggcgagttcccggcgccgctgtgcgagctccggtcgctggcgctgctcgacctgtcgtacaatgacctcaccgggccgttgcccggctgcctcgccgcgatgccgtcgctgaggcaccttgatctcgccgggaatgggttctccggcgaggtcccgaggagctacggcgcggggttcccgtctctcttgacgctcagcctggccgggaacgagctgtccggcgagctcccggcgttcttggcgaacgtgagcgccctcgaggagctcctcctcgcgtacaaccagttcgcgccgtcgccgttgccggagacgttcaccggaatccggaggctacaggtgctgtggctggccgggtgcaacctcgtcggagatatcccgccgtcgatcgggagcctgaagagcctcgtcaacctcgacctctcgacgaacaacctcaccggcgagatcccgagcagcatcggagggttggagagcgtcgtccagctcgagctctactcgaaccagctcaccgggagcttgccggaggggatgtcggcgctcaagaagctgcggttcttcgacgccgccatgaaccagctctccggcgagataccggccgacctgttcctcgcaccgaggctggagagcctccacctgtaccagaacgagcttaccggacgcgtgccggcgacggtggccgacgcggcggcgctcaacgacctcaggctgttcaccaaccggctggtcggggagttgccgccggagttcgggaagaagagcccgcttgagttcttggacttgtcggacaaccgtatctccggcgagattccggcgacgctgtgcagcgccgggaagctggagcagcttctcatgctgaacaacgagctcgtcggcccgattccggcggagctggggcaatgccggacgctgacgcgggtgcggctgccgaacaaccggctctccggcgccgtgccgccggacatgtggggccttccgcacctgtacctgctggagctcgccgggaacgccctgtccggcgccgtcgcgcccgccattgccacggcgaggaacctgtcgcagctgctgatatctgacaaccgcttcgccggcgcgctgccgccggagctaggcagcttgccgaacctgttcgagctgtcggcttccaacaacgtgttctccgggccattgccggcgtcgttgaccgtggtcaccacgctcggccggcttgatttgaggaacaactcgctctccggcgagctgccgcgaggtgttcgacggtggcagaagctgacgcagctcgacctcgccgacaaccgcctcaccggaaacatccccgccgagctcggcgatctgccggtgctcaactcgctcgacctgtcgaacaacgagctcaccggcggcgtgccggtgcaactcgagaaccttaagctgagcctgctcaacctgtcgaacaaccggctcgccggcgtcctgcctcctctgttcgccggcgagatgtacaaggacagcttccttggcaatccggggctgtgcaccggcggttcgtgctcgagcggccgcagagcccgcgccggccgccgcggccttgtcgggagcgtcaccgtcgccgtcgccggcgtcatcctgctgctcggcgccgcgtggttcgcccacaggtacaggagtcaaaggaggtggagcacggaggacgccgccggcgagaagtcgaggtgggtggtcacgtcgttccacaaggcggagtcgacgaggaggacatcctgagctgcctcgacgacgaggacaacgtggtcggcacgggcgcagcgggcaaggtgtacaaggccgtcctcgggaacggcgcccgcggcggcgacgacggcgccgtcgtcgccgtcaagaagctctgggctaacggcggcgcggcgaagaaggcggcggccatggaagccggcggcggcggcggcggcggcggcaaggacacgttcgaggcggaggtggcgacgctggggaggatacggcacaagaacatcgtgaagctgtggtgcagcctcagcagcggcgaccggcggctgctcgtctacgagtacatgcccaacggcagcctcggcgacctcctccacggcggcaagggcggcctcctcgactggccggcgcggcaccgcatcatggtcgacgccgccgagggtctctcctacctccaccacgactgcgcaccgccgatcgtgcaccgcgacgtcaagtccaataacatcctcctcgacgccgacctccgcgccaaggtcgccgacttcggcgtcgccagggccgtctccgccgcgccgcccaccgccgtgtccgccatcgccggctcctgcggctacattgcccccggtgagttaatcattgcgcacctcgatcgccatcgccatggcgcccgctaacgattcttgatttcccagagtactcgtacacgctgcgtatcacggagaagagcgacgtgtacagcttcggcgtggtgatgctggagctcctcaccggcaaggcgccggcggggccggagctcggggagaaggacctcgtcaggtgggtgtgcggctgcgtcgagcgcgacggcgtcgaccgcgtgctcgacgcgaggctcgccggcgcgccgcgcgacgagacgcggagggcgctcaacgtcgcgctgctctgcgcgtccagcctcccgatcaaccgcccgtcgatgaggtccgtcgtgaagctgctgctggagctccggccggagagcaaggagaaggccatggcggaggagaagcctctcctcgtttgatcacacaaagccagcactgatgaacacactgaacagtagtacctcactttaattagcaattagcataatcactcgcttcaaaaatcagttagcataatcacattaacaatcagtagtaattaatgtactcaagtacccagcattaaggttgaagcctcaagcatgcaatgtaagctagaactacttaagtaaaggtcctctatgtatagctcattctagtattttcatgggttaatgtactactaccagtttgtctaaagtatcaatgccaacaaggatttggtttaagctagatggtgctaacacttttgactctgtggaccatctgcattattctgtgctcatttcagaccctgaaaagtgaaaaaggtgcctcttgttgtacctgaacttgttgagcggcttttttccattttacatgttcagttatcacttgctatcagtttatcacacagacacatgtataagatatagtgattgatttggcttggatcgaacaaactattgggtagtaattactcatagcaatctaaaatcgtatggaacacaacatagtacaataaatttggatagatctcctgtccaaattaattgtactatgttatgtcccattcagttcagattcatatattatgggataaggggagtaaaattgctattttagttttaacatgttaattacttttcattttagtataagcatttctaggtatgtacctgaacatcatctctcgacccggataaatatgatccttcagtgctgtaatttttgggccattcagtgctccattcaattgcaggcttaggttgcagcttttgctattaagttgggagcattcagctgtggtggagatcaagtgacagcaacagaacaagaggctgtacagaagctgtgctggctcttttcccttcttcccttacctttctgctagcctgcagggtttagatccaaaaaggttaggtgatttgttgttgggattactgttgggctttgcatctgtcaggatatgcaaattgtggacacagtctggagtcctggaccatagccacacaactgtgtagtgaatgtctgcatctacagtaacatgtacatttggtgtcaatggtcctgaagaaaacctttatgaaatgctaagctccaaattgtcctcatagatttcagagaaaatgtttttactgtctttaagtcctttgtcactgactgatccagacaattaccctctgcttggacagtttatatgaggggacaggatcagcatcagtgaattttcgttttcacttctgtaactaactgaattcaacggctgccgcacaccatagcacagtaaccagttaaccccaaacttgcccaagtgtctgtctgaattacatgtgggtccatgctgttggtactagtagtagacaggagactcttcggatag

SEQ ID NO: 78883 - DNA, 3069 bp, Oryza sativa
  unsure (1)..(3069): unsure at all n locations
atgggcccattgaaatgacatccgctnnnnnnnnnnnnnnnnnnnnnnnnnnnnnnnnncgttgcatcatgtcttagctttatagtcgtggcattccattttccaatcctaccttaacacgggggagcaagcgttttaattaaaaatagatcatttcggaatttttttaaataggtccttgacatcagtgtcatcggcaccggccctcttgatatgagtaacttagccttcacggagagtgatggggacggtgcacgggagagtgatggggacggtgccaacgttataggcgctgtcatattggaccacatcgcctataatactgacactgtgaaatgagtctatttctaagtttttaagggtgtatttgtaaaataatttttcaaaaatgtctagaatatgaaaagccggcatagtgtcggtggccgaccgagagctgcgtgtttgtatacgcgcagtcggatcttgcgtcgacaaaggggggtcgataggtggatgcatgggtggtgccatcctacctgccgcttccagcggcggagccaagggccggctagcatgggcaggtgcctggactccgccgcatgcagccttgcattagatactaaatacggtgcttaccattagtctagctacacatgcatcattagattagcactaattatcatgattagtctttagccacaacccaattttacttttatccatgataaaatgttaaaatctataacgagaagtctctcgatttggtcttacacagcaacgcctggcgcggcattcgatttagtcgagaagcatcagagtttagaatttgagagaagcatcatagtgttaggcatccatatcttttttcccttcttaaaaattttctctcaaattacttatccgatctactatccgattacactattttgttcattgtaattaaatctttacaacaagtctcacacgattatattacgttgaaaaactacaaattacttttataatatatctaaattacttaaggtttcactaaattacttcttaaacatataaaagtaatacaataaagtctaaaagttatttacatatattataaaaataacttaagaaaaaagaaagtaactttgtcatgacattagaagtaaatccgttgtagggataaaaacataactctatctagaaactaaattaatcagcacaaattacggaattgactaaaaacaataataaaagtaatcacctcatagcattacgaatgtataggaagtaatttaatcaaatctaaaagtaatttatatatatgataaaagtaacttagtatataataaaagtaatttacaaatataatttttttattaaatataatcatgtaagatcttgttgtacatatttaattgtaacgaacacaacagtataatcggatcgttgatcagataaataatttaagagaaaaatttatttgaaatttagatggataatgaggatgcaggtggcgggtgctactacttaagaagggtaacgggttgatacacactgtattatttttgtaaaaagatggtcactagttagcacttacgagtgcatgcgctctctttagtcgcacgtaaaatattatatgtatttacttgttagtttgttatctatcattagatttgatcatgctaagaaaaaaaaaagaaccttctgcatccgccactggcggctgccatgcgtattggccggggcctggggtggcgtagtggggaaatttcatgctgtactacagtggagctgctgtcgtgcggggaattaatgcgggcagggtcatcagagtacggatcgatgatcgcccgagaattttttggttgttggattggagagacctcgcgtttcgtcgcgtgtacgtatgatattaaccatggacgacgcgagaatacataatgcggagcccataaccaaagtcatcgccgtttttaaatttcatcgtacaaccattatctatattgcaatatggaaacatcgtacatatcggtgctgcgatacgtacgattctttctacgactgttgtacgctgaaacacttctctcgtagcatttgttagggctctacaggattgaaaaaatctatgatagaaaaaaaaataaaggaatagaaatgaaattcgatcggccgggtagaaaaccaaggattacaaaatacaggactttggaagattttagactttggatgtgcctgggaactaacgtaggaagtaaacagcaattaattttttctgtcgtcattattcatcgatctaatatccttcacattactggagaatatatgggtgaacactcattttcatgcagtggtggctcaggaacaattcgttgggtggtcctacttggcgtcccaaattaccatgatgttactacatcaagtcaaatatgtcaaatacagtgaaaatatagttcaaatatagcaatatatatcagaacatcacaaattgattaaaaccaacattttcagttcaaagttacgaaagttacttcctctgtttcaaaatgtaagactttgttgcattgttcacattcatatagatgtttatgaatctagatatatatgtgtgtctagattcattaacatctatatgaatatgggtaatgctaaaaaatcttacattatgaaacagatgaagtacaaattaatgagataaacaaaaattgcactacaatgtctccattccttttcatgtctcactgcaatttttgcactacaaattaatgagccaaacaaaaattttccaatagcactactatatttgactactcactaagttgttgctcaaaaaaatatctaagtttcagttttcattcatatttttttatccacatttttcattcatcaacgaccaatctattcaaagtaaaaactaaggctactcatagtgagcaagaaataagtaactcacctatgcactaaacaggggccggcggcagggggctcgtgtcgctcatccgtctcgctggctcgggcatcatggaggggcagcagggtgcactggagcagatcagcagagccgtcgagcgagagggacccgatgccagcacagcggtgggggcagaatca

SEQ ID NO: 78884 - DNA, 717 bp, Oryza sativa
  unsure (1)..(717): unsure at all n locations
atttgtcctgaagattaagactacttatagagctctatctcacttcacatgaattggttaaaacggttttatattgctatgacagtattttaaataattaaccaagctaattttgattccaaaatttcatatccttactcctgtaaaaaggtggctgcactactacagaaagggtaaaaggtgccggttcggaaaccctaataggtgccggttttccctatcggcacaaaggaggcggcactgatgatacttgtcatcggtgccggttctagaaccagcacctattacctaataggtgccggttctaagcaaaaataccacgtggctatcaaataggttcaaaaccggcacctatttggtcctaataggtgccagttctaaagcaaactgccacgtgggtgtcaaataggtgccggttttgaactcaaaaccgaccaaataggtgccggttttaagccaaattgccacgtggctgttaaataggtgccggttcaaaaccggcacctattaggaccatattggtgccggttcaagcctaaaaaccgacacctatttgttgggtcaaaaacaataataatttcagtgaattcatccattcaaccccaattccatataaacccaaattcatccctacagnnnnnnnnnnnnnnnnnnnnnnnnnnnnnnnnnnnnnnnnnnnnnnnnnnnnnnnnnnnnnnnnttgttatcaaaggccgt

SEQ ID NO: 78885 - DNA, 2859 bp, Oryza sativa
tctaacccatactcatgcccatcgagtggggtaccagacttacgggtaaaattgtcatccatggttcgagggaatgcaacaggatgaacggcggggcaggaggggctggtgtttgtcttggtcagaagtaattatttattttatcatataagaacaagctatcggatattaagataatggaagtacaactcagcacattagttaaattacttctgccttagaataccgaactctcacaaatatacatttttacaactcacgtgggagaaaccttgtttatttctataccaggaggaatgttaggttgccattctggaatattttgttagcagtgcaaatatgtgtactaactgaatgctaaaagtggtagtacctttgaaggcattgtttgatattcatgtgatgattgcaaacctgtaggggggttttttcctcgagccttgaccagtttcaattttctcaatattctactttgatgttgtaaacttgagaggttaaacatttaagtggttgtattatctgctaaatctataatctatctcattacgggattgtccaaaacatcgttagtcggatgtagagagctcgaatatatataagccagttgggatcaatcaggctagcaaacagaggaagccaaatcagccaagcctgaattctgaatgtgaccacgaatcaccgtatcgtcctgtttttggatgtgaatcgacacgagattttgtcaatctaagagatgtaccacaagtactcaagcgaaggcccatggttattgagtgcaagcaaacgcaattctccacgcggagacacaggagttggcgtaacgggcttgcaactccattacccgtacccgttagcaggcagctgcaccataagctcagttgcagcttttatatatacatggataattttactcgatttattcagagtagggacatgtatacaaccactaccatagaaatttatttatattatatttaaatcataaattattgattttgacatgtagctttatgcaagttgggtttcggatcttggaaggttaggagatacagtaacccgggaagcaacaattgcctggatttcttggaagcaagctccatgaattttgcttgcctgaccctcctcccaagtctttgatcccaagcgacaagccaagccagaatgtaccgttggtaccacgtactgatcctatccattaatccataagcaacccagctccaccactctgccactagcacacccacacacaaataaacccggattaaaacgcaatcatgcatgcgccacgatcagatcacattctcaagaacacaaataagataatagcatcatggctatgtgagcttagagagagaataatgcagagccagagagacagagagaggtaggtgattgataataagaaagaagggaagaagaacacaggtctaaccggaggagggcaagagaagatggtggtgatgatgatgcagaagagctccctggacctggtgcttgtgccatgtggtctggtgatcatgttcggctaccacctcatcctcctctaccggattctccgccgccccgccgccaccgtcatcggctacgagaaccacaacaagctggcatgggtccgccgcatggtgcaggtaaaccacccaccgccggccgccggcgacatggagcaactgaattttctgtgacaactgaacagctgaatccaagtgtggccgtggtgatgggaggttggtgatttaccgtgttgctgtcgttgcaggcgagcccggacgagacggggctggcactgagcgtcatctccagcaacatctcggcgtcgacgaacctggcgtcgctgtgcatcgcgctgggctcgctcatcggggcctgggtgagcagcacctccaaggttttcatgacggagctcgtctacggcgaccgcacccaggcgacggccaccgtgaagtacatctcccttctcgtctgcttcctcgtctccttcacttgcttcatccactctgcaaggttagcttcccttcaggcttcagctgctgctcacctctgaaaccagcctctgtaaatacctgaaagaaggatattcaaatttaaattttgaaacttgaatttagaaaaattttagtggttaccagtaaaaaaatacaaccttttgcatttgaatctttaaagttgaatttttggagccactaattctggagatactaccggtattccaaccctgctgaggtaacataacatggcatcaaaatcagaaattttcagacctgtttcctctggagatgcaggtactatgtccaagccagcttcctaataaccacgctggattctgatgtcccggcaagctacatccagcatgctgtgatccgaggaggcaacttctggtcaatggggctccgtgcactctacttcgcgacaacgctgctgatgtggatcttcgggccaataccaatgttcacctgctcggtgttgatggtgttcatcctgcacctgctggacagcaattccctgccattgcacaaccatcagttcacaattagaaaacggcatgatcagagagctctggcatctacagtggttacaaggcaccccagccctcagaatccgattctcagtaacccggtcttgtctcctgtaactttttcaataaattaatagatatgtttgctgcaaagcttggaggtttgtatggagtaacattacatgagaatatgagattcaggtacaaaattttcatcagaaatattgcttccctaaaacaaatgctactacatgaaatgtgataaatccatggaatcgtgacactgtcatcgagaaatgtgttgatgttatcatgattgagctgcaccacatcttgggtcagcatac

SEQ ID NO: 78886 - DNA, 18015 bp, Oryza sativa
ctttttttttttgatgaattgaggtcaattgagtaagacatctggtttctgcaggcacatgacttgctagttcttgaaagattttaccaggagcttgctgttttgcttcacaatcatcgagaatgagtgccttaacatgtcaaattgtaatcaagactagcgttatgttttttaagctagaatcttagctgcctatgttgaggggcaacatgatggaataaagtaacatcattttacatgttttgcgtaatagttggctgtttgcccaagtctatttgtctgtgagatatttaatacaatctacgtaattttcctatggcatttgcaattttttcctagacttttcctgtttgcatggatgcatgctcgtttgattttttctttcaacaaagaattttataacatggttgccattttagtttacaatatgatcattcttctcttctcagatgaaagtgatggtacgtgaaacatttacgcaatgtcttaaaggtggtgcttggctgttatggcaatgctgcacatgtattactgcgacatccgccttagtcatagaatttatggttttgacactccggattttgtaaaagttattttggtagtgtcagggataaacatcaatgctgtatgcttccacacttataaagttataatgaagcaattgagatattcaaagttctgatgtatgctttatttgtgtttatatagagatgggtcagtctgtcccaaggtgataaatgctggaagacctgctcatgtcgtgctatcagacaattgattttgtagagtgaactaaattggtttctgtgttgcctgattttacccctcctagaactgtggttctgttggacctttcaaagtttttgagataatgccccttgatatcatttgttaaaaacaatcaaggacataatgcaaaagcccgagctgtatttcttagttacaattctgggtgtctttcctgtgataataatgataaatgagatgcaatttacaagtactcaattgttgctatgttgtttcgatgtatttttctttttatactgttgtgaaatgtcaatgtgatgtgtgcaaagctgaaccttagtagttacgaggttcaggagtcaaggacactccagtggtgactgaaccatagtttggccgaatatgtcatctgtttgatgtttgaattatccttgactcacagtgtcttggatgttgtctcaattcagcatttgaattctcaatgcggcattatgcttggaaaattgaactgtaaaattatgggaggtgacgggagccatcagtcgtggcacttttgacagtttgtagcattgtattcctgatgaattttgtgtggtctgtcttgccgcattgcagttcgaaggtggtgcgacgtgaagtgctagtgtcagctaaagattgtaaaagtcctatacactagaaatagaagaaaagaaacgaaatgtgaaaatgctttgctttcaagtcaacctatgagaacagattaatcaaactcagttcgttaattctaacacaagaaatagcaatccttcagttttcccagtaaccctcctattctcctaggcatgaggagcagagaaaccctgcttggtcactcacggtctcacgccagtaaaggcagtaacctcttcgagcaagccatgctcacttactcatgggttcgcgcctgcttgccaccgttgtgtgtctgtttgcctttgctgccggctgctgccgctgctgttgttgttggcttgttgccgctctcccgcctgcagcgcctcgtgcgacgacgacgactgcggcggcggtcgctgctcctgcacataggacggcgtacccggcctgaactgaccctgcccctgcctctcgccgatgttgccaccgccttgctgcggtggaaatcgcgggagattttggtgttgagcaccaacctgagcctgatgtgcgtcccacccttgctctctccggttgccctgctgccgcgccaccggacgagaagagcatgccatggcggcggcgagagtcccagacgccgggtgaccgtgccccgcaggccagccgttgggcgccacgtgcggctgccccggcgtctccagcattcgaccggctgctgacaagccgacggcgccgcctctgctcgagccgggacggccgccgcagtttggctgctgcggccgcggcatcctcgcgaggttgcattgtgtgcgctgtgccatcgccgtcgcggggagaggcaccgcgagcggtgtcgacggcatcgcgcgtggcgtggcctctgcatgcggcaccggcactgcaaccgctcggtgtcggtgacctcctgaacacgatgagttgccgcaccggtggccgccggcggactcgttggcttgccgccacagcttacggcacagtgccaggtgatgattgacccggtcgatctgccttttcagcgacactttcaacatgaacagctcgaagaactcctcgttttgcgaacgtaactccttgtacactacaattcatagtttcatacatacatgtgcgcacggtcaggatgaactgaatttagtttatctcaactagctcgatcgattttgcagatgtgaacgttcatcctaccagcgtagtagattaccggatcgatcttgctcctgcgaaattgtcggaacatttgtcccttggacagccgtgcttccaggcacctcgcaatcacgtccttcacctgcattgatcgtcaatttatcacacatttgcgaggtcgatagcatcatcggcggctcggccaggggcgggtctacagtgtaacggccggtgtcaagcgacaccgacgaattttggcaaaacgtatagttaaattgcttatccatatattatagcactatgatttaagcataattagcatactatgacaccagtagatacgttatgacaccaacgaatcaattttctggatccaccactggctcggcgagccgtcagcgcaaacaacatatatttgtaaatgaaaaaaaaaaatatgtgaataaaacttgtatatacgtattcttaacaatctaaaaataaagactacgatgaaaagaaatcctaaaaattaaatttaatttttggctaataaacttaagcataagtgaaaagatatctcttattcttgccttgcttacatgttggagaatttcttccgtatcgtctacaggtgccgtggcatcatcttccgccggattttgatccgcgccgcttgcgcttggcatcgccgtcgccggttattcgctgcagcggtggacacaacgcagtgcattcgttaccccacgatgttacaccttctagcttaattagctagccgaagatggcgctccggtggaaggagggcggcttcgttcccagcgccggagaagagagagaggcctcgctcgcggcggagcttgttggagttgggattctggaacggagagaccgcgaggcgagatgagcgctatcgcgtcttctttaacatgtcaagagcgctcgtgcagagacgggtcatcacgcgcgcgggagtcggtagcacacgtctacggctgcaacacgagtggcctccccgaatattctggtactgtggtctgacggttactagtagaatatttcacaatctttaatagattataaacgcgtaatttatctctgaacggagtattctttttttcttctggacttgcaaacctgagcgcattggaatagttgataatgcactggaattgttctggttgcagttacttggacaaacaaatacttctagaaaccttgtaaaaaaaaagtcgcatcactgtaaacaaatcattaaatcaaacaacgaacaggaattaacagcatggaaaaggagagcatatagggattatcagatcataccaaaacaagaaacttgtcagtttgccactgtacatgtacatccaaatcctactggggaaataatgttgtgcctgagaacagtacttgaaaccacaacagaagggaaagtactataatttggccctgactgttcgtgtcatgtttaagaacagtgttcaaatgccaatcaggtatacagcctgaaacttctatcatctaaggacgacaaaccactgctattatatacaacaaattttctgatttcagtagttggcactgcttctgagtactgacagcatgtgcgctcattttagtctctccgtgctggcatctcggcaagaggtttcaaaacaatcggcttgcttggatctaccacaagtgaagaactcgtttacagaaaagccagtgaccaggggagctttcctgtcctagacatcttcaccattgctctctcaacactagctatctgattgtcggttgctgcatgctccttgattttcttcttatcagctttcttttgtgcatcttttattgccttttgcatcttctctgctgctctcgctctcttcttctccaacttgatctgtttccagttgaggcacaaaaccaacaaagtgtcaaacgacaactctgactatatcccaaattaaaataaaagataatcaatgcagtgggcatacgaagcatacctcaattcttttcatcttctcctttgcctgtgtaacctgattcatctgccattcatcgatatcggcctctttccttctcagcctaatcgaattaaataacatcataactcaatgagttcgaaatataaccttacgggcacaaacaaatctaaatgtcatataaacttaatcaatgacagcattttgtaggctatggattatgaagatcgaatattcaataaactagacaatcacaactcacaagcattcatgtttgcagtagtaattgataatggcttcaattctaatataaggctcaagagatataatgctacattttaatcagctaataagcaataattttctacaagtgtcagtccagaagttatgactgagagatcagaagatgtggattacttgtctatgagcttttcaatctccgcattcttccaggcaaccaacttggcgtggacaaaattttccttatgttttaccgcagaaccctggggccatctccccattctttgcactgcaactgggctattttcgccatctgaatggttaaacgcaccgccattatgatcacttccctcataggcaccaccagcctcaaagttccaatcacgagctgcagatgaaagaattgtcataaaaaatatttttcagaactgacgagactcatgagatttagatcagtacctgaggatatacgagaagacagagtatcagcctgccaatccgtttgatccactgcttcatcctcttcttcactgactttgggcaatctccattcattgatagcatccattgcccccaaacgcctacggtaattatgtgaggagcgagctcggcgcatcaatctagctggcgtggccttgtggatgaatcttggtggcactggattagttctctcaactgcatgttttcaagcgcattcaataaatgatgcgatgcaagaaaaagtcaagttaatctatggagggaggcagcagaagtaatcacatctcctatccagaagggaaggttgtctgggcgtttgcagtctgatgtgtcgtggtgtggtagacggatttatgaaatctcctctgtttggcagcctttcttggtcttcttcctgcagatgattggcttcttaacatttccaaatcacgtatgggaaatgaaaaaatcaaaccggcagatagtacaactaaatggatacaaccaaaagctacttgtaataattctatatggacccagacagagaattatccaaatttagtttgatcgtgtggaaaacatgtaataacataacaaacaaaatgactgagctaagaattctctagtttttggctatttcaagattcagaaagcagaaatgtaacagcaaaccaagattgtcaatacccttactgctttgatatttgaatcgatcaaaggtcacaaatcaaatccaggaacattgataaatcttgcattgaggcactagaccaatggttaaactggaggcgtttgttcctgtaaaccatgcaagaaactgaacaacctcatccaagaaaccaccttcctccaaagaactaacgcaagaagtcggcgaagttttccacaattcaatagttacaagctacgcaagaatgggaaattaagaccaaaggcagcaaaaaaatcaagaaccttcaggactgcgcctccccctggaaaaagaacacggaaactaaccagccgtggcgtgacgaacgaggaggcgtcatcaccgtcgcggcagccctcccctccattgctgctcacggggctgcagattggggacggcgaggcggggcggtggtcggtgagcgacccggcgctccacgcggcgcagctgccgtaggaagacgccgggcggcggccgtagggccccccgcggccgcccatggcggccatcgcgagcagcatctgcgtgctcctcccgacggacgcctccggctcggcctcggtgtcggcggcgtagaacgcggcgccctcggaggcgtcggagcgggcgggggacgagcccggcgagacgcggaacgccgcggtgggctccgcgacgcaggggatcgggatcgggatcgcggcggcgaccgccatcttctcgccgttcttcttgccctcttccggtggcggtgccctccccttgatttctagagaggaagcaaacgttagtcgcggagcgcgcgaggaagttgtgtatttagacttgagagttgagagagaggggatgccttctgactggtgggccaggttcttgtactaaccttcactgacatgcgggcccggttcgtagatagctgtgcaccggcatcagttcgctgcccttttcccttcatctcccgttctcttaactgaaccagcactaaaattagaagcaccacatgaacattcaagaagcaggatatcatctgacaatatgaatacatcatttgcgatggtatgtgcagcgaacacaaattttctgttggctctactgttagtcaggaactaacaagttctgccataacttatgaaacaatattccgtgccatgtgtggcttttagcttgctacaactccggcgcaaagacaaatttgcacctcaattgagttttcatactgtaaacttgtgggtataggggaattggcaaggcgccttttgccctaagttggaagaatttgtaacaacttctaagatcaagaatattccaggagcacgcagagcttctggacttgcaatcctactaagcagcaacacctgttgaatagttcagcatcgtccctttgactcgttgatggcctggtaagatctgctgcaagaaaagttcaatccatagacagatgaagcgcagctcaggggaatggagcaccaaggtgatcagacttcatacccttttgcaaagcaccctgcccttctttcccattccagtgccagcgaggcttgcagcgagacgtgacttgttgtcaggtctccacttaagctctttgaaagtggagaaaagctctgagagggcagggctgatttcctcatctttgattttatcacaagagacaacttttaggctctgcagatcactccatgaggttatcaccgattctagacctcgagttgtcagttgtgagcaaccttctaaggagaggaacttaactctcctgaaaaacaaagagaacgcagcagacataagtcaagatcctgaattaagccaagaaacactttccacgaaaaatgtaggttgtggaccatatctaggtatgtaaaatggctcaccatttccagaagaacaaaacattattacaatactattgccagtgaaaatatatagtaagtatttgctaaagcgttttgagaggaaactattgaaatatccagatgaaaatttgagatggtcgtcgtgctactgtggaagtgtggatgaaggtaaaacatggttttagcctgtaggtaatctgatgtcaactctaagaattccagttacacgaatgcatctgatttagagctttagaggttattcgttcattttattccactaattcattgcagtagattgctgccatattcacacaaaaaatgataatatgccacaatcgatggcatataagcaaataatgggtcagaagaaactgaaaattattccacgtatataaagaaactacctaccctagttagccctggcacttccaatgcaaatcttggcattgatcagtactagtaacagttataagactctagtccagggaaaaacaaatacagggaagtgtaggcggataacatttacgcatcataaataactacatttagtagcccaaagaactacatcaaaagactctaccgagacactgtcaatttgttggcccttttagaacaagtaatcctttactgcatagtttggcagaagatccatgagcaaaaatgcaaatatcctccaacgaatattccataacatcaatccacggtttgtgatggaagaatcggcatggcaataggtggtagtggtttatggtgaatctgacaccaccccaccactgcctattgtctgtgaagaaaaaaaacgtagagagcatggcatggggcaaaaggatatgtcaacaataatttatttctactacatacattgcaatttttttttttaattccataacaaagtatgggcactcagctagtctttactgaatccatttgctcaggtagtggtgcacggtttgtgttcgaagaattgaagcgacctacatctttatgaaatccatcgctcagacatctaagtcatggtttgcatttttaccagtcacaattatctggacacaaaaggagaaagtgcacgaggggctagataacgcacatcctaaaatggcaatatagtgaataacacaaacagcatgtgacttgctcaacacaagaggaagaataaaagtgattatgacaaacaatataacgcaaatacacaattatggaatactttcacttgaacacatctgtaataaataattgcatcttttccaagcaatcatatgctaaaacaaccaaaaatgacaatgttagccaaacatgcagtatactgaacagaggttgactagattatggagcttatcaaagctcacacagacataatcagtagacaaaaggaataatgatggaggctatctaagtgaggtttttacgacactaccgaataataaattttgcgccctcaagtcccatgataactgttatttaattaattaccacagaagcaatagtggcatactgactccaaacatggaggggtccatgcattgcaatttgcaagcattatatctcctgacactaaaccagggtcagaacaaccaatcatcagttacctacgactacttcaattggcagcaagtcactatcacagtctgacagatcaaatataaagcaggaataactaaacaatcaaagttcaaatacacaatctgcccacattgtgcgatcattgtaatatatcaacaacctagattgaaaaatgagattggtgattactatacctgcacagtcctgccatggcaaacatgtcatcttcaaggccccagcaattctggaccaataactcacgggcaccctcacaaaccaaaaggagagcatggagggcacgacggtcacgcagctggcactgctgaagctgcaggctctcaagcgtgaggcaggcaccaagatgctccgcaggcccaggatcgtcatcaatcctgcaacatccttgcaaccttagggttttgaggttgccgcagaaagcgagcgcagcaagccacccattgtccatcttgtggttggcgatggtgagctcctcaagcatcgcacagcaccgccccacagccgcgatgccgtcatagcttccctcgcaaccaacaagctccagcttcactaatctcttgcatccatgagcaaggatggtgaggccgatgtcggtgacaccaccatcttcactggtgccatataacgcagaggaggctgcgacaaggcggaggatctgaagatgcgcaaaggcggagactgggcggagggcgaggtcggtgcatcggtggagctcgagctcttgcaaagttgcgcagccgccagcgatatccatcagacccccggactccgaggcggctgtggctgagaggcggcggaggttggggaaactggcggcaacggcaacaaggcccctgtcgagcacgtcatctgcgaggaaacggcaggcgacgagcggcgggtccgcgccggtgtctagggttagcgacacctcggcgcaagtgaggagaggggaggtcggggacggcacggccggagcgacaatggacgccgggaacaggtcgaggtccgccagttcggggaagcggtggtgtaggcggtgggtcacaaaggcccagtccctgacgacgaggcggcggcgcaggcgccccgcgaggcgcatccacctcctgcagaccagcgacgcggcgcccgtgaggtggggctccgggaggcaggcgaagacgcggaggaggagcccgtccgagaactctagggtttggtccggcggcgccaccggcgcgggccgcgcctgctgctgctgcttctccaccggcggcggcggcggagtcgtcatcttcttcccggacagcgaccgcaggtcaggccaccccttgagaccgtcgcggtgcaggccccggccatcgaggacgcagacctcgggctcaggcattcaccgcgaacggcggcgcagggccccgcgtagccccggccgcgccgcgagaggagaagcccccgcagtgcggccgggcgcggcgtcggtccgattcgggagagattccggcgtggtagtgcggccgtgaggggatctgaggactttccttttttttttttcaaaatttttgggggggtttgggatttggaaatttgcctcgcccctcgctgctggaggagcgggataagagagagggtggagcggaggagccgtggggccgagcggtggtgggggcaaacgctttgaaatcctttccttgtctccgtgtgcaaggtagtatagcgttcgttttggctccttgcgccgttgcgcggccccgctgtgcacggtggaggattttctcgagagttttccttttttttgcttgtgtcttggcggagagttttgatggctcgtttgtttcttctgttcttgagcgacgtgatccgggttgttttactcggcacggtttcgtctctgcgtgagggatgaacagttccgttttaatggaggcacgtacggtacgtgaggtttgttgggtgtcccgtgtaccgcgtcattaggttgtgttctctttacgtagaaaagaggctcggatcatttacctaggctcttaagtgtttctgtaataatggatcgaaggacaattaacgccgtctgggcggatccgtccaaaaccaggctgttgcctttgcctgaactaattggcggatcccattgtgaacctccatcaaaatacagtaatgtaggatgaaattagatcacgttaatactataaatagataaaggtatattcatatttgtagtattacgatggatttctattgcatcttgtagttttcgctgtttcataacattttttttaagagcaatgctacacgtactaaatttttcttactaaatttttactaacaatcatctcaaccatttgatttaagtagatggaagttacaaaaaatctagatgcactcatagcatgacacatcagtgttagtaagaatttagtaagaaaaagttagtatgtatagccttttcctttttttaattatttgtacatcattgtaggataaagtttggtactactgtttgcaatatcgatggtcatttgtatatattttttgtgcgtctagaatgttacaaggtctactgctgtttatacatattaccattgccttgtaaccgataaagatctcatagcatttctaaaagtctcctcaaatcttgctcttcaaatatctatatatcaagatagccaaaacgatagatttctaaatttcatacgtactcaacagtttttccatattctactctccaaaattcataggtttcatatgttagtgtctcttgtcccctccttcactctcttttgttaggcatttgtaggcattctcatcctttggtaggtgtggagcccaccaagagccaaccactatgatttaccaagttcggccaacaagagaagacatttggcattttgacaagttaaatggtttatcaagcaatatgttttttttatttgctacaaatttagcaaagagagctaaatggtaaagctcttggagatgatcctagacatctatggtatgtgaaacatacacgaatgtaccatagctaaaattaatgctcaaggagacgggaaataatctctaaaaatgagaataaagtgataaacctaaatgaggttgaacgagtgggccggttaaaaattattccgttagataagccctttatctatccgcgcatactacttgggaataagtccacttactggctagcctcgagctcccgccgccatcgtcaaagctccacctcaaagctctaggaagtcctcccctccgcgtggtgacccatttgcttccccgttggtctcccctctttgcctcctggcgctccaccagcccttgtcgacgtatgacaccctacgaccctcatcgatgccatcggcccctctcaacgtcgtcacggcattggcatgccggctgccctcaccaagctccgactccaactccgttgtgggaggccatgtagaggagggagagagaaagggaagggggagtgaggatgccaccacgtggaggtcgcttttatttttgccacgcaaatgcctagtcaatacgagtagattgggttaacttgtcacgttagcaaaatcaaccatctatactattgtcacgccccggactagtaccgaccggaactagcccgtgacgctccaaataacctgttaatcgataccagtcccaggaaacagtgctggtatcacaggaagacagattatcacagcaacagaggtctctttattatagagtagaggtacagtcatgttgggctgtggacagatcccgagctcacaattgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactggggggggattatttatatagagcaagggtgagtacgggagtactcagcaagccatgggaaataagtgtttaatgcaggcttcaaggaaaggctgttgtttttgcaattgattttatttgaactcttttctaaaaacaactaggtgagtgcttctcaaacgacacggatgagacagtgcgtctcgtccggtcggagtatgtgcaatgcatcagtctttagaattgattcaaggttggcacccggccaacagcttttcaaacggccacccgggccaacaactttcaaacggccacccgggcctagctgatcccgtcagctgcagatttttcaaacatcgaacccctttccacaacagcaatttcacaagcagtagtcaaacaaaactacgctaggaatcacctcacatccgcccatgaccatgggcacggctgttcgaacagtttgttaacctctgcagagggggtacactttacccacacgacattactaacccggatcacccagcccgtggggatcagccacgttgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaggtgcaagagcgggaaaccgtacacccggtacgttccccggtccgcggttttggaaattcatttagttcgcaagcaccgacccaggtgtcgggttttccaagtcttttgtaaaacccaagttttacccaagaggtttttcagattttaagtttgaaggcgcccgtcaatactcgcacagggtgcacgaatatcgagacgcgactagatggttacaaggggacacgatataacaattatcaaaggaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctagagcttgatcctcgaaatcctcgcactgcggttcttcgggctccgaaactatacgcaaaacgggacaactcaacaaacggcgaaaataaagccctattaatgacctctaagcgtgccattagagagatctcgagatttgaggaattttggaagttgaacggagtcaaacggatttacggttgggaagatattgaatttctaagattactggatttttggtctaaaggaaaaggatttaattaaatcctttttgaaaaagaaaagaaaagaaaagaaaagaaaagaaaagagggagggaaattagacttttcctcgggcggctagggcgcggcctgagagaaaaggggcggctcggccgagctaaatgggccggccggcccaaggcggcccaaggcacgcgcgcgcgggaggggaggagagagagagccggtggaccgggctcaccacgcgcggtcccgggtgggacccgcttgtcggtgacacggttcaccgtgcggagcgagcacgcggcgcacgcgcgcgggcggggagggacgcggtgtacgcacgcggttcgcggtggacgcggatgcggcgggcccacgcgcagcctcacggctcgcggtggaacgcgcgcacggggagggactgaccggggtcggctcgacccggtcttggccgagctggcgccgacgtggcgcctacgtggctgccatgcgggccggcgggaggtagacgacgacgccggccggaacggacggcggacgacagcggcgagcggcggagcgaaccacggcgatacaggcggaagcgagcacaccgggtggttgcacgagacgaggggagacgagccaactgctcggattcaccggagggagcttgacggcggcgaattgcggtggcggcaaccggcggcgggagaagggggaaacggcgacgaggttactaggggccgattcccggcggcgagagcatctacgcggctacgggaattcgatgctagcgttggattaggaggaaacgcatcgagggaggccggcgacgagaggcgcttccgagctcgggcggcgacggcggcgagcacacggtgagtgacggcaacggtcagggcggcgccggctagctacgaggaggctactcaagctactacccgagtctaaggggaggagatggagcgaggagggagaacggggagatgcactaccgtgcgggacggggcgcagtgacgagaggccggcggcgcgggagtaatctctccggccttgggccggggaagaggaaggagagggcgcgcccggagtccccttccgcgtccttgctcgtgccggctcctccgaaacgcgcaacgacgaacgacgacggcaaacagagcacgggaggcggcggcaatggcgtggaggcgagtgggagaggaagggaaagggggagctcgggtttataggatggcaatgtcggtttgggaaccgacttagggcggtcaaaggagagggctggcgctcggtggtcgcggccaaagcggcgacagggaggagggaggaggatgacgccggtgggaggaaaaagggaaaagagggagagaaaagggggcttgcccccttgcctcttcgcgaaaaggaggagggagcgggagcgacgcggcagagggaggaggagctctgcctccgtcccttggaggctagcacgcggagtggcggggccgggcgatgacgacggcgatgacggcgggggcggtgtggagcggagcggcgacacgggcgacaggcgcgggcaggcgcggcagaggctgacggcggcagcgaccaggcggtcggccaacacggcacgcgcgcgcgggatgcaacgggaggcgcgtcggattgagcggcgcggctcgggcgcgcgcactggctcgcggggccgagcggctgcgcggcagggcagcggggccgggcggcgcaaacggcgcaggcgcggcacgggcgacgaccacgcgggcgcgcgcgcacgcgaacaatggcgcgcgggcagagcgagggagcggagagggagggctcgactcggcgcagctcacgcgctcgcgcgcgcggcgcgcgggcagagcggcgaagagggagagagagagagagagagcgccggggagggagggggagatgggccgagagagattcggcccattgaccccgggggaggcaaaatagacttttgcggagggatttgatttggaaggatttggattcggaaatgagctcgacgatagatcggggatttgagatctgaggtggcacggacactagactacaagaaaagaaacaaatttcgcaattagggtttttaagagataattttcccgctaggcgcgacgacggaacgggcgctacaactatattatgaggatctaatttaattcggttttacaagttggagcttaaaatttctggtattgtaatttaggaatgtcaattaaactcaatgtttagatgacaaacgacaagtagacttaagctgctcatttacgctgctgcaatgaaggcccgaatttcatcaaagggcctcatagactgatcttgggttcaatacaaaaggcccatgtggagactgaaacccaacgtagccggaggcgcacgcacgccgtggccggagctgcatgagacgactggtgatctgaatgaatgccggctatttaagtcaacaaatctgctattcaagtccacaaattaacaacctgtcatgcaaatgatcaccaaatccgtaattatgtccaaaaacacacctcgtatcacggaaatcaccaaatatatgctactagtactattcaagtcccagctgtagattttgaacagtaacttaaattccacattcgtctttgcctctcgcgggtaccgagcccgacaaataaaagcagaaggaatttaatctttcctttgtaccactgtgccgtcgacctgccagccacaggttgcagctgcctataaaatagacagacggcaagttgtacacacatatccaggggcgcgcacagtgaaggccgcggccgcgctgctgttcgatacacacaatcggcggcgacatggcattggcagccaagctcctcccgtccatcgtcgcgttcgtggctctcgcctgctgcgtcctccgctcatccgtcgcgtccgtcgaccaccaccggaagctctccggctggtccatcggcggcgcgacgtggtatggccctgccaacggctctggaaccgatggtacatctacctcacggactcgatcgatcatcaccagaggatggaccatatatgcgagcggcctgcaggcttaattagtactgacgaggcgtgctgcatgttgatgtaggtggcgcgtgtgggtaccagggagacgtcgggcagccgcctttcaactccatgatcgccgccggcagcccgtccatctatgagtccggcaagggctgcggctcttgttaccaggttcgatcgttcaattcgtctcgccagctgatatatcttttaatactcttttgttgctttccaagaataagacagtcaactctaacgtttactcgtttgtttgctactcctactgccaatttgggaattaaattctgcaggtgaagtgcagcggcaacccctcttgctccggcaagcctgtgaccgtcgtcctcaccgacctgtgccccggcggcgcg

SEQ ID NO: 78887 - DNA, 697 bp, Oryza sativa
tgtgcttgttttaccactgagaaattcagacttcagtttagcaaaacgatctttggaattcgagaattcaactgaagcttatatatggtaaaaaatctagccagctcacatgatgattttacaaagcaagcacctggatagatcacaatatactatgcaaaaacaaaactacatctcgccgggtagaacatgggactcatggatctgaaagttgcacagttctaggtttgtaccttgcgaaacatactactgaaagttaaactgtacataagctcttctttcaggttagggaattgcagtgccggctgggttgccatggtagtaaaactagtaagcaccacagatgctgctaacttgaagggaaaagaactgcagcagcagaagctcaaggaagctcgaggtgagacgccctagaacaaccaatgcttcttcttggttttgcgggttaggagatctgcattgtacataacaggagcacattcagaactaacaatgcaaaatatcatggtagggaatgttagaatttaatgatgtaagaatcataagcgaaaattcgatgttcatatagtctaagaaagacactcaccgtcagttgcgtacaggaattgtagtgccttcacaccagaagcttagccacaactctacaaatgcgggtcatgaaagaatcagataccatcggtagattaaaagcgtcgca

SEQ ID NO: 78888 - DNA, 694 bp, Oryza sativa
ggcccggcacggcctgctacagtaacgggccgtgccggcacggcccgtttagccgtgccgtgcttgggccgctggccgagcacgcgggccggcacggcacggcccggctactgtagcgggccggcacggcacggcccggggcacggcccggcacggcacggcggcggcccgtcaggcgcggcaggcgggcggcggtccaatgggacggcgacacgtggcactaacggctatttgaccgttgaaatttgaaaataaccgttgggaggctaaaaattcataaaatttcaaaaaatctcaaatttcgccctataaatagggcatgaaccccagccatttctcctcatcccacactcctcatcttgtgctctcaagtgttttaagtgctctctttgttctcaagtgtgcatttttttttgattttgacaaaatttgctcaaattttgtcgaaaatcacaattagtttcgtagttccacagtttgatcgcagaggtttcaagagctccgcggttggaaagatgtaagtaatattcagatttgtgtatatatttgtattgtgggtgtgtaaaaacatcagtattcgacaattctgtttatgtcggtttaaattttcagaatggatccgaactttccataccagtcgccgtcgttcaccttgggtgatttcgaccccaactacatgtcggggttgggcggt

SEQ ID NO: 78889 - DNA, 12550 bp, Oryza sativa
ttcatagtcgcatcgaagtatcaagtatcgaacccaacttctagtttagtttgttgagcagatgacgaactccttttaatggtatcagtgaacaggtagtttcaggaatcaacagaggtagctgcagcgttagctctgtaccgtgttgtacagggcggcagttgctgcctgcatgtggtgttgaggtcatgaggaccttctgcttctcactgattgtgtttcatcaagagaaaaaaaggtatcagttcccaccttgattaattgagtgtgatgaaagtctctctttagaggaaaatggacagcacatttgaaggtgggcctctaggaaatggacagcacagtggtggccttggttggtgctttacaaatgctctgctgggcgcgcgcctgggccttgtgaggcttttgtggcttggcaatagtacacttgcctccctaaactgttttaccgaagcaatcaactgcaacgacctccaactactaaagcaggttcactttcacctctagaaatatttttgtttccctaaatactggttgcgatttcaccttgacttttttagggtaatatattgcaccatatacagtggagaacacaactttaaaatatagatggggcgaagaacggagatgttcactcgataagagcaatcgaacacaacagatgtggtagttatagttcaattgcataattacctcgatcattatttgtggcctgcatgtgttgtgaagagacaaactaattattagatgttcacaccttattatatctaattttgatggcctataactactataaggggtagtgggtcttggaggtgtggggtgatacgggtagtagctgggacggtcgacccactctgactaatgggtaaatccacccctgatcatatactaggtgtgtttggtaatttttgggaaggggagatagagtttagagaggggagttgatgatgtgattgatcatatgtgtttgctattttactctaagtctcttgtttgccgaaacaaactttggtcgttgatagttttttttatggaaattgtattttaagtgacgatggacgtcttaaaacttaactagcttcgctcatgagggaatctcctctcaattttcactcattataagtgagaatcacctataagcatttgatatccctaaagaaaaggtatgctccctctctttcaatataaatgcaacttagcatagacatgacatatctcagaaatacgaatctagacagtattgggacaaagggaggaggagggagtattgtctataagcatgcggacatgggctttgagcctttgaacaagggacaaatttctgatatcaaaatgcattatatgtacacaccaataaaggatggtgtttggaattttcctctatatccagagcaggtgccatattggaataagccaaatcccccttgcaaaaaaaaggactaacctaaaatccatgtatctcgtgcgtggaaaatagattcctagatgccaaaaccattctctattattaaaccccccacaacaatcaaaacaccaaacgggaatcatgatcaacttgcgaggtcaacacacccaatgatccatctcaggaaaataaagaatttagagcaaaaaaacaaagaaagcgtcggcagaggcagcagctttatcacaaatatgcatgtactacgtatatcagctatcttatcgccattcgccaataataatctcgttcgttattcccgtatttcccctcgttgttttctcggggaaacaggcgtcgtgcgcgcgtgggacgtgggcgccatctgcagcacccacccaccagcaggaagtcgtccaccggcgtggaacgctccaggtttcggctgggcgacgcacgccgcggagccaaaaaaaccaacgcgcgcgccgcgcgcctgctggggagtacggcggcaaggcgtgagaccacgcgcggggcgatgagaactttcggcccgggtttcggctgccgcgcgcggcgacgaacgggcgagtttagccggtagagcctgacccctgtcggtggacggtggtgaggcaccgggtacacgtgccggcgccagcgccaagatcggcggggagctactacccctgattattcctcgattcacggcttggacatgggctttgtcaaccgtcaacaagtgatgactcatgatcactggccttttttgagcttctagtaaattaaaaaggctcactgaggcgtgcgtaacagcgacagtgcaccgtgatttatagctttggctactgtggacgcgtgtgatttaaatagaccgacttgcggcgatgtttggatcccatgtgcaattggtccggcattcgtattaagaacttcagtacagtagtaagttcagtagcgtctaggaatgcgagcaccatagcgcttcactttctgccaaaaacacactactccagattttagggagaaacgatcagataatatatgccgatggacgtcggtggccgggttcgagtccggggccgattaaatcaactgcaactaacgtgcttccgagtcagagattacggacggaggagaagtactactaatcagcgtgctccgacacgatcgaactgaagaaaagaagagagaacgcagaggagccccatgtgccactgcttaaacaagcaggcgcccctacatacacgtgtctcggatcggacaccaactgacaaccccacggctagctccacgaggcacacgatcctgcccgtctactcgtcagagactagtaacgtgggccccacgccaacggtcaactaattaacggccggttcggttttctttactgtgtttgccacttgctcctgcgtgtgttcctcccttattttagcagaaagatcacctgctccagtaggataaaaagaagaggttcgattagaccctagacaggcatgattgatgattccaaccttgtttgccaataaaaaaactgcgtgattgcataaaagctagtagccaatttaatttcttggataaattgaacagtttagtttgtttaaaaccattgaaaaaaaatcaataattcctagtttcggtcactatgtgtttccaaatatcaaaagatagagatagccatttaggacgatgctagaaaaattgatagcctaagaacaaatcaatgtattttagttagacataattttctctctcacaaaatattcatataattttaaaggatttgaaggggatttttggagtcagcctaggactaagccctaatttccctagcttgtagctccacccttagagatcaccaaggaagatgtcgttgccttttcacatcctgcatttcagtgtcctcgctagtgttgaagtaaagaagacatggttttcatgttgctaagggctgatttagtttgaagacaaaacttgccataccaaaatattggcattttaaacgtaattttgttaatgtttagtttgctacgaatacttgtcaataccacacaaatgttgccaaaatattggcattggcaaaaaacttccacatgatttggcattgccaatagtttggtatggttgcaaactaaacaagccctaaatctctatcagtgtctaccgtattcttaaggtactcaatgaagacttacgaagtattttctatcaagttattcatgataattagcggtgatgaccgatcagtagtatttggtagttagtacaagtcactaatttgttgtgtgatattggtatacgtgatgaaaagttaagaggaacgatgatggtggcaatgctcgttttttattaatattataagtgcgggagttgattaatatcgtgtttacgctcgtctatttatatctcttatggtatggtgttttagaatatagagttcttttctatttcgatagatctttcatatttcttagttgtaggaatagagttgttattacttctcttgttgtatatataggccccgttcgtttcctctgaaaagaatggataaagttttggattttcgtggcacgtttttcaaactgctaaacggtgcgtttcgtgcgaaaattttctatatgaaagttgttctaaaatatcatattaatttattttcaagtttgtaataattaaaactcaattaatcacacgttattactacctcgttttgcgtgaaacacttgtttaggagattcaaacaccatcataatctatcatagtggaaaaagtaaaaaaaaataatcaaagtttgtaacgactaaatacgaacaggagcaattgaaacgagctactgcaactgccgccttttctgtaagaataccgcaactgctgtcgtcttccgtttagcaacaaccgttttaattcaaatttacctttttccgagaacagctcgaaagcacatagcgtatcggcggttgcttgatactcacaaagtcacaagtacagccacatttcggctacagaatctgatccaaaggcagatacagagcgtatgcacgtatgcgtgcatgtggctgtggggtcgcctcaactactaagaaatcgaaaggtgtggatgattagagctctctccattattacaggattagctatttcatccactaattaattgctcttatttgacgcgcacacgtagaagttcagaaggtcagaatacaattagtttctgaacatctcttgttcttctgaagtctgaactgtactgctcatgcgtgcacataatgcagcttcttcccccaaacacctcaaaagctctgtttaactatgcagcacgatatatatgattatgctctttgccacgaaaaggggtgcgtcgcatcgaccggtcacatggcacaggacgacagggatcaaattattcggcaaatggcggcagtgcaaagctcaaaacgcagcaatccgaaaaaacattctcctgtgcaggctggcacaggaatggatgaatgatcgatcgttgcattttgggggtcacatcgctcgtgcatgacaggtaaggtgtggtggtaaggccggccatcctgcatgatcagcagagagagagagagagagagagagagagagagagagagagagagagagagagagagagagagagagagagagagagagctaaagattgatgaacatttgggaaaggaatggattcgaagatgatgttcagtagacagtaaaccaattgttaaatcgtgtgcgtttgagaaaggtttgggccagagatgttcgccaattcttggtttttttttatgcgtgctatcctaaccgccgagggcaactacctcgtgagatttcgttttctttatcatgatttgggcgttggagaacgtgatcacctacattatcaaagaggatggcctctgactccttccattttgtgttatactactaaccggtagcaacaatatgatcatgcatatgggattatcctatcgcccaaaagaaaatcatgagaccgatcgaccgatcaatcctccccaaattcgtcctcaaatcgcgtgtgatttacttcattgttgttttgtttacttcgcttttttgtttttaaaactaaagcttgatctgacattgatgacattagtgatctccggggccgtaaataaataaactcggagattcaactcatgatacacctgaactattagcagttagcttcctgacttctagcacttccatcatttgagtttgtttacttaagtctttgtgtagaggtcttgcacaaattgccatcactctcactcttaactttttttatttttttagaaaagttttaaaataaataaagtcaacaaagtaattatataatctccaaatgcacccctgaaagattcttacataattcttacaaacaaactcttaattgttggatgtaattatatgggagttaaattaaatctagattttagtcgatgtatagagatcacatcattgtttgtaaggtttttgtaagaaaaaacattgtacatatagccttttccttacatataattttgttaatattatgtacgcattccttaattagaaattaacatatgtacataaaacaacaactttaggatactatccctaataccctataacaattttattttattcatttattcacatttgacaactagaattataccagtgggtaaagaccaatgatataatagctattaggagctccgataaattgaaacattaggatcgctatatacatcataattgaaaagttaatgaaaaattcttccttggttttgggccaaatactattcattccttcctttctagccccaacctagtacactaccacccttcgctcggtctgtctcttttcgatccagcaggcccaacttgcacaaccggctaataaatatatttaatgtaattgtgctgcgtgtgcgtgtggtggatcgaatcagaaaaaaaaaatcagaagcctaaaaaaactggacggacagaaaaaccccgaaaactttatgtatcttttaattagttatattatagatgtaagaaatggttatctttcatgcagcttgtgtaatgacttgtatctctttcatgagagatgactcctcatatttctcttacatctcgtcatttgaatcaacatggcagtcttggaactaatacttactcgccactccatcgtgggcacttaattagccaaaatgaccacttttaaaataagttttagatgcattttttttctaaaaaaagttttagaaatggaaatttgcctgcataccttgagatttgggatagcttaagtccctggcaaacgcaggaaatttaaccaaaaaacaatatcatgccaacttcgggagcaacgtactactgtacatagatcaattctttacttatgaatggtatatataaaattgaactaggcgagatgcatggtttcagatttgactgttcttgaaaccgatcagacttgactgttagttgtgaagttttccctgtgttccaattacaagtagacactagctaatctaatactaacagtagcatccctcttggttgttctgtagtgtactgaaaactaatacaacaatgctactagtgcctgataagttgatcttcgaacaatgtgcgcttatagcaggtacatactctgagattgaatttctcaacttgtgttatcccaattgtacttcaccaatccacttccttacaagaaattcagctcgccttattttgtaggtactggatactgatcgaaaatcaacaacagttcgtttagcctttttccctacaccaacttgtcacgttctcaccaataattctcgaccggcagaatccctaaatttcttgccacgtacgtctgcatccctccaaaaattccctataaataccccttctcggccactccctgcaactcacccaagaacacactcgagctgagcacgtctagctagctatatctctcaacatcttccgagctactactagtagctagctagctagaggaagcagcagcaatggcgaaatcttgcaccttggtactactacttgtcgcactggtcgggctctcacttcttgtgagccccattgcttgctcccgcaagctcagcaagccgaaacccaagccgaagccgagcatgagaagccggtggtccgggctcacaacaactacaccggtagcccgtcggtgacggtcaccaccggctgggccgccgccggcgccacgtactacggcgcccccaacggcgacggcagcgacggttagtgctcgcttgctttcgctttcgagcttacagtacttgcattgcacggcattggtcgagctggaactgaaattaaaatggaatcgggggaaaacttgcaggcggcgcttgcggctaccagaccgccgtcgggcagcggccgttctcgtcgatgatcgccgccgggagcccgtcgctgtacaagggaggcaaggggtgcggcgcgtgctatgaggtcagcacacacacacgacactgacacatgtacacacagcagtgtgtggtcacacgggcgagctagctattactgctgcgagagctttcgtgtagctccattaatggcggaaagtggtcggctgatcccaactcaatgcgttcatgtggccgtgtacgcaggttaaatgcacgaccaacgcagcttgctccggccagccagccaccgtcgtcatcaccgacgagtgccccgggggcatctgcctcgccggcgccgcgcacttcgacatgagcggcacttccatgggcgccatggccaagcccggcatggccgacaagctccgcgccgccggtatcctccaggtccagtacagaaggtatatgcacattcgcatcagtgcagaatcacgaatcaatggcgccggcaagctgtagtataattagctaaccttggtgcttaattccgttaatctctcgtagggtgccatgcaagtacagcggcgtgaacatcgcgttcagggttgaccagggggcaaacccgttctacttcgaggtgctcatcgagttcgaggacggcgacggcgacctcaacgccgtcgacctgatggaggccggctgcggctggacgccgatggtgcagaactggggcgcgctctggcggtacaactccaacaccggcaaggccctgaaggcgccattctcgctccgcctcacctccgactccggcaaggtgctcgtcgcaaacaacgtcatcccggcgagctggaagcccggcgtgacgtaccgctccctggtgaactactcctaaattaattacagctctctccacatctcctgcaagaagctgcagtgcagagttgcggtaaattggtaattacagatttataattagcctcgggttaattatatggcgggaaatgtgcgtccgggtgttgcgagaggcggtgtcagaagaggaggaaaggaggtttaagaatcgtgttcttccctccacggtctctgcattcccctagtgatgtgactgtgtcgtcgtcgatttgtctgtaaaattttatttttcttagttatatcttcctctgttattgtcatgttgagggagaagcttgagctgcaactaatgttgcatgccgatgtatcaagtttgtgtgtgtgtgttttttttgtaccacgcaaatctttcagataaatggattagtactgtcagaagatttctgtacttcactggaactcatgcattgttgtcgttctgtctcaagttcaattctcgcttttaggctgtgtttggttcctttcaaggttggaagtttggattgaaattggtacgatattactgaaaagttgtgtgtgtatgattggttgatgtgatgaaaaaagttgaaagtttgtatccaaagtttggatctaaacacagccttactgagcagggtctgtgatctctgaagtactgctccctccgtccaaaaaaaactcaatcctagatttgaaactgaacacattggtttttttttttaacggagggagtatgtcctagttgcagttcgaatccctgaacaatcaaccagtaatttgaactggagtagcacaagatagatgctgtacaaagaaaatactggacgtgcattttggtgtaaatcatcagcgcgctgtttctgtgtcctcctttttttcttttcgctgaaacctaatactcccaaacagcataaactccaatgctgcattatccgcccgcacattgcaaagtactactgtagtataagttgtgctataaattttgctctcctgttatgctgggttcctgccgacgaagacacatgcagttctcatcgaaagtagacaaaagtgcagagtcttgaatgttacacacactgattgtactcaattattagtagtttaagacacgaactggttttcaatggaattattaatgcatggagtacacttgtgctcctctacataccggagcttcgcttgtcctcggcattatgaactggaaactgagaaaagtcgtctagtttgtcatgtgggtctgacaaatgaagattatatataccaggagcgacgaccatggatttcgattcagaaagtttttttttctaaaaaaaactctgcctatttctgcacgagtgtgcagattaatattgtacagtacccgccgtcatatggatacagatttttattttaccacttagtttatgtcatttgatctacttaattccactagcattcaatttcttatttgaaacgtgccgctggttgcatggattaaaaataaatctcaaaattcaactagcaaccaattgcctgccccagatttaccggaaagggatacccacatgttagtgctcaactgcacatccagttttaccatgatctctacgtagtagaaattactttaaaccattatctttttttttctgatacaatgaaacgtatatttggtactagcatcttgactttttggttgtagaatatctttttccacaagcactgataatagaactaataaatcaataattgagtttgcttttaatcgtgacaatattagtagagaacaccgtaaaaataagtatgtaaaaaatagataaatttcgataacatacgtgtgtcgtggatatggattttcataccttgatgggatctccacccgttacttgtatgtcacctaaatatttatcaaaaaattgaaaaacattgataacatatgttaatatgaaatatatcagtgcacaaacatacaataccaaatttgacttctacaagttaaagcaaaaaaaaaaaggtttaaccaaaaatagttatcatacattcgcagctatatttgttatttttcttacatcttacagaaattgaattgtaatatatttaatattaatctatcttgtcaatttattttaaatctgtaatgactatttaaatagcatttacggaactagaggatatcacctatcctcttgaagaataaatacactttcccgtgtgttgttggtatatttctgctcgcagaatgcaaaccacatccgatgctaacaaccaatcacggcctaacaaactagtagtgcggagtacgtgccaacattttgatatggcatagtctcagccagcaagcaaaaaatctgcgcttgtctcctttttctcgttttaatgcatcacatggcagaaagtgaccgtgcgtaaatcattcataactaggagtaggctatttcaagaccttcaattgctcacagtacaacgatctagcggcggtgatacgaaagagaccaccatctatggcacatagctctctttcccaagaagaagaacatgctgcagacctgacctgcaacctgcattcaggtgcggctcgcgcgagtggtcgatgtcaaaagacgctacctagtcactgtcaggatccatcgcgatcctccatggctgcgctccatgtgcccgccaagcgcacacgacaacgatctggatgaaaataataatcgctctcgaaacggcacagtgtacgagcggaaaaccgatcgagagctcccccatgctctgaccgctcgcatgttccgctcccccgttctgtctcccttcccctcccccctgctaataatctcggcgtcgatggatcgatcggttggtctgtgcgtttcacagtccgtgtagccgcctccggccaccaccaccatcaccaaccaaccaaccaaacaaccgagcgagcgatcgtgcaggcggcgtagcgtgaggtgaggtgagcagcgcgcgcgcgcgcgcgcgcgttccccaccgtgtcagtcgcgggcgcatgtggagagattctccggtgacgggagggtgaaagactgaaagcaacgggcgcacatggcggtggtgctgtgcatgcatgcgacgcgcgcgcgaccccgcccgcggccacggttcggctgattttgttgggtattcgcccctattcgaccaggggtggtcaaaactcaaaaccccgcgaacatgttaattggcagcatcgaaatttctaatctgtcctgtccttccatacatctaccctggattcggatcaggccactttggcagtacccaatcatccagccatccagcacacgagagatggcccagatttaaccgtgtcatacatcattttagctatttgaacaagcatagaacagtttcagttcagattttgcctgcaatttctctccctttgatctgaattttcttgaactttaagacaacccaaatattgttaaagaaaagtagacacatacttcatttcattatattgaacttcataatatcttgcacgcataattgacaaaatgagctagagtttaagcccttgtttagtttccaaaatattttttccaaaaacgtcacatcgaatctttggaaacatgtatgacgtattaaatatagataaataaaaaaaagtaattgcacagtttacatagaaattgcgagacgaatcttttgagcttatctttgatcttatttttctattataatatataaaataaataaatgtatatttacttttattatggtgttttgaaagacaaatttatatatgttgtcctttaaactaaatatttttaaaattattgatggtcaaagttataaaagtttggcctcaaccttatctaaaacgtcaaataatatggaaccggatggagtacatgatagctataagtgatacagtaacccatatgtgctaatcacggattaattaggcttaataaat

SEQ ID NO: 78890 - DNA, 636 bp, Oryza sativa
  unsure (1)..(636): unsure at all n locations
tgggtacnnnnntttgaatttcntttcgannnccnttgnnnnnnnnnnnnnnnnnnnnnnnnnnnnnnnnnnnnnnnnnnnnnttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagagctaaacattaataatcaatcaagagcagttcaatttagctaagtagtttgccctggtttgaaaatttcctagctcagccactgtttgcgcccctgcggtaccgaccgtatccccttatataaattgaacattacaatcaatgagaatcaaacctctctcgcacccttgtaccgcaacataaatcatgcaactttaacagttcagtcaagagcagttcaatttagctgcatgaatgtttgacatggctttttccaagagccaagccaaacaccgattctggttcttttncaagtcaaaccacata

SEQ ID NO: 78891 - DNA, 9721 bp, Oryza sativa
  unsure (1)..(9721): unsure at all n locations
gtgatgaagactcttnnnnnnnnnnnnnnnnnnnnnnnnnnnnnnnnnnnnnnnnnnnnnnnnnnnnnnnnnnagtatgctgaggtaagttctcatcggctagatctccttttctcgcatcagattgatttcccctcccctcatcttgttttcttcttctctattcttgttcgcatctgtagcatctgtccaatctgattgcgattccaagtctatcgcatgaggaacattatttcctcggtccgattggcaatctagaccctactgacttcatcatcggcaaaaccaatagaatcccctttagattagccaaccctaatctaggtcactggaggaacaccttcaagttttggccgtctctcgagaaaaccacccctgagaagagttggactacatggtacaagcgtgtatcggctagcaagcaaacacattgggatgaaattggaatcggtcaagcacttgccctcactatagcaaattcagctaaagatgaacccttaatggccgccgccacctacttctggtccaatactatcaacacctttctattcaaccaagggccgatgacaccaactctgatagatattactatgatcactggtctagatgtatcctcattggctaatcccatgaacctgaacaccaaaaaccaatacgatttcaggaccaaaagcatatgtggttggtctggatatgtggcagcatatatgggctaaggatctattactcctcgagagcatgtggcctttttacttatgtggctagaaaagtttcttttctgcgaatccagctgtggccctacaaccaactgacagtttgcagccgaagctcttgtgtcaaaaagagaatttcctctaggtaaaatcctcctcggctacttataccaaatgctgaacaatgcatctgccaaaatagccgtcggctcggtggttggagcaggtggaccatggtggttgctacaatcttggctcaacttaatggtcatgaaagttgtcaatcggccatcagtgacagaagccgaattcccaaggctggagccgattgtagaagatggtgaagaacgcactcatcgtggatgcatgtcatatggagaatatgcatccacaccaaccgatgccggggcaaaactatcagctgaactgctcaaggttggttttgcagtttttatgagggctttcagaaagatgcccgggtctggtttccctatgaagacttagcagacattcagctcccgttggactttagatttgaagatatcaatcatgaaagataccaaaagtccagggaagttttctcaactgcaatcagcccatgcatcctacctgtcggtattcatcaaggaagaaacatccaagtctcttataaattctatcacccaatgagatcagccagacaacttggaatggaccaactcccaatcggcttatttttcgccgataagatccagtgccgaggagaaatttcattaaccttgatgatggattggctgcttaatctccaaggacctcctctgggcagcattgaaaatatcgagctggcgggattcaagagcaaaaactttgacagatgattgggtgaatggaagttgcatctattccaccaaccggcctcgatgtacatgacagatctcttccctgatgttatacctcaggtaaaccttgtcattattaatctgaacaattgtcagccgattcataacttgactaatcttttatttatattttgcatacaaccgaatcttcccctccacatcaaagcaacagtggcagagacactgaatatgccccaggtctgattcccaatggaggtgggccatctcctcccgtcatcggctatcatacccctaagacttgaactcttctccaaggcctaatcagagaaccagccgatgcaggaaagaagagaagaaccaggtcatcggctgtggacacattggctccagccccaaagaagaaggccaaactcaagaagcctaaaccaaccgatgacctgcctgccctagatccatccattgaacaagctctggatgaagaagaaatcggcgaggatattgaccaagccgcagatgaagtaagcgatactgaaagaacccatcggcttcacctaagcaaacttctccaactccttctgctccagtccatttttcaaaggtaagcagctttctttttgcaatcccctcacttatagccgattactcatagattttaaggttgcagaagaagaaaattgctatgaagaagaagtcggcagcaccaattcccaaaccggctccaccagtaagatattcttaattcttttaatagtcgatctcaaccgattttccttaatacttatctttttgcagcctcctcctccttcttctcctattcagcaaccatcaagcgatcacactccatcggctgcagggagttatcatgttgaagaagaagtacaaccagctgctcctaccatcccagtaagtcttgtctataaaaaacttgaatcgaccaaataactcatgttgagactcaatctttaaaattccttcttgcaggccttagcccatctgttctctttcgatattaaagattatcttgatgaagaaacagaagaagacactactagcaagtctttagctcccttgtccgataatgtgaagaaaacccttgaagacatctctcatcggctagaggcatcatcattagacagcttagtggtaaattgtgggccaattaggactcggttacatgaggttcaagccctaatcccagatgaactagccgatgtcctcactccggctgtctaccttgagcagcatcaggagaaagccaaactaagactagccgaacgtcgggagcgcaaggatattgaagccacaatccaagccaatcggcagcttgtgcacgaagagaagtccaagcttgatcagctatctgagggcccgatcaaatccaacattgatcggctcgaggctcacaagattgagctcttggcacaacttgaagaatgcaacaccgagctggatatggaacacaaaaagctggccgatcttccaaaatctgtcgaagaacagaaggcaagactaaaatcggctatcaagaatgttgctgatctcaccaagtctttgaaagtcattcctagaaccgacactcaagatgcccaagccattgaagaagtagaacaaatgaggcaaagggctatttcagctatccaacaatatttgtctcggtgactttctatgtaatagaccttagaaatttttgtaatcggctaagatactctggtactttattgtcttgacaatcctttgtgccgattaatataacttctaaatttgctcaaaaattttcatttttcgtatatatgtgcccccctaattttacaatgtcaaaagcattgctaaaattataaaaacaactaagggcgatataaccatatcgaccatctgtacatcggcaaaccacaaccgattacaatatgaaaaacaactaagggcgatataacaatatcggccatctcaaggcgatgcaaatacattggctatcatgtatcggcaagcatcagccgatcatgcgttaacccaaacacttgggtaatatttcttcaagtacttgccatttagtgctcttccataaacttctccatcgagtccttgcaacatgtaagctcccttagacacaactttatagatttggaacggtccttcccatttcggcgaccacttgccaaatttgctatcccgagtcccaatcggcaaaatcaacttccatacaagttcaccttccgaaaaatctttgggcaccactttcttattgtaatgccgagcaactcgctctttatccttggtaacctttgcaagggctcgcaaccgtgattgaaccagatcttctctctcatcggccataaggttataatactcatcggctgttaaattattttgcaactccgttctccttgagccgattctaacttcccatggcaaaacagcctcatgtccataaacaagcttataaggaggaacttggatcaatccatgacaagccatccgataagatcataatgcttcggccaaccaagtatgccattgccgaggataatcagaaatcttcctcttaatcaatttgatcaagctcttgttagatgcctcggcctgcccattagcttgtgcataatacagtgaagaattcaacaatttgatacccatgctatcggcaaactgaacaaactcatcggacacgaaaattgaacactgatcagttgtaatggtttgaggaataccaaatcgatagattatatgctcttgaacaaactgtatagcatccccagaatcaactttcttcaaaggaatcgcctccacccacttggtaaaataatcggttgccaccaatataaacttatgtcctttactcgatggtggattaatcatgctgatcatatcaattccccaacctctaaatggccatggcttaatgataggattcatagccgacgccggtgctgtcacgcccagaaattcactagtaatttccgaactaatttgtgcataaaatcctcgtccaggaatcaaccgaggtacacaaactgataatttaatatacagattcatcatcataataacgttacatacttacaaaagaaaagagaaaatagtagtggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacagcaaatatgcaagtgcacaaggataccaaagaatggcataatatagggctcatttgcaaaagcagcatttagcaaacatttgagaattgtaaaacagtagagtaattaatcatcaatattaatcaacactgaacagcacacccatgctgcacaggcccaaccatcctgaacaaccatacctggctatacagatctatctccaaaccagaaatgtaccattccaaaccaggagctaaattaattaccatcaattaccaaattattattaatgagtagtgtgagactaatcacgaaagacattgttagacctgcccataactgcggtcacggctattcgaatagttttactctggccagaggtgtaccactgtacccacaagacacaactccacaatatgtcaccatatcatcatgtgcccatgctgaacatgtcaccatttgtgtagttgtgacaagacccctcgcatagctcaactcaaagcagcgcacctttcatggatcgtagtcaccccctcaaaaaccagaggcatggactccccagcgacccccgtgggcttatctccgccacttctcagtctggcacaccacaatgagccttgctatacaaagtgtccagccgttgcctaggctggcttgtggttggcacggtcaatgtttcacaaccgaaactcgtgaaccggtccttaattgtcatgagcacgaccatcaaaaccatgtgctcacaaccaaccattatcaagttttagttggcaaattaattaattaaccaatcacgattaaccatcgtgagctaccattatcatgtccatcattaagtaatagtgaaacattagttattccaatcgtgtgctaatgtttctaagcatagctaagcaattatactaatacatctagctgaaccaatatataaagctcaactagtcaaattataagcccaaggtatcaatggatagagtaatcaatgcaaagtggccataacaaaggaatagtttcacaccacccggtgacattcaaaaataaatgcacagttgaaataaataaagaatttaaatataggatcaacatgctcaaaggaattgtgtttgggatctgtgtgacttgccttgcaataaaaggtcttccattaatcttcttggatacttccaacgcactcacgatccttcgaaacgacggaaacgacaagctaacacgcaaaacgagaaaaaagactaataaaaaccaaataaacaatacatataaagtaaacaaacatgtagatcataattttagatgtattataagacttgaacggcttcattctgacttcatatgaattaattaccaattttacaagaataaattttaatatatagatctttattttatacaacttttgcaacttggaccacattaaacccggttacaatgaattaggtatgaatttttaaacattaaccggattaaagcatttatatgggttttaattgaattatggcgcaataaagaattattttgaaaagaaaaagagatttattgcatcatcaaggacggtccacggtaaaccgggtccacagaagcggtccatggaaccaacggccaagatctaattgacctaaaattgaccgaatcggacggccgagatcgatccggtctaccacggcaaaggcttataaggcgctgacatcagcgacgatgtcatcgccggcggcgactcggcacaccacgctcaccggcgaacgatagtgcggcggcgcaaacggagggcaccaacgcgtagagctcggctcggcgaactcaccagtggcttggacaacggcaaacgacgacggatgatgaaggcagcgaggtcgaggcggcggcggtcttcgggtcgtcaatggcggcggtgctccggtgggaaacggcggcaatggagggctggccgaggttcttctcctcctcgcgaacccgatggtggcaacggcgatcgaaggcggcaactgcaatggcggcgctgcgcggctggaccgacggcgacggtggagagcttcgggtcgacggtgtcggcggcgctccggtgatctgtggtggaaaaggagaacgggacgaggacggcgacgacctcgcgatgatgatgaaggagactgtcacgaccgagaaaaatacattttcccgaacgctagtgtattaatccccatcccaggaaaagccagggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaggacttcatctccaaagcttctcttactgaagggggggggggaaagattgagcaagaatgagtacaaccacagtactcagcaagccacaccggcagatgcatgattaatgcaagggggtacaaggggtaataatataagggttaggttttgcagtaaacagcatttaaaagtcacttagttgcccaaagccaattttaaaaagacgatcctagagctacacagtattattaatcaaggccgtgcacccacacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcgtctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgcttcgcaacagaggcccgagcttaatccttatagtacccgaggtacgactaacaaaacccaaccacgcacctcgagcccagcctaaagccattttgggggttttgaatagagggggaggtgtgtgtccaattctaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggtttgatttatcctagggtgaacaaggtaataataacaatagcaataataataatgtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagataacggccttccgaaccttcggcgacgaccgcaaaccacgcttcaggaacctccggaacgacgaagactacgcgaagcacacaagtaaagctacaagcctataaagaagcaataacaatacataaaaagaaagcacagggttctttaggttataacaaacattaggagacttgaacggatcgattcggagctcatatgaccaagatatgatcatccgaagtttaatgctgttacatggagatttgcggattattataattaggttttgcaactataaaacatgtgtaagcgctagcctggaaaagacaggaaggctgcgccgttgacatgcggaccccacatgtcaacctaaaggaccgcggtagaccgagtacacagatacggtccacgggtcgacggaagcagatcccgtgtgtcaaccgaggcgagtggtcgacaaacggactccactagacaccacacgggctgcacacgtggaaaccacgcggctaccgagcgggcacactaacacggtcaccacacgcacaagcgaacgactaccgacaccggtacacgggtaccggggtcgacaaccgcacaacgggcacgggcgacaccgaaatgacgaggacggggcagcgaaggagagatccttaccaccacgcgacgaggcgagggaacgacaacgacgaacgggcgcggcagagacggccgggaatgacggagacgaaaggcgaggggacgacttcggcggcgatccttggacgaaggcgagacgcggctggcgcaacgcttggcgacgcggaggcgaggacgaagacgacgacggggctgcagcggcacacttgacggacgcggacgacggacgagaacggcttgacggagggacgaacggcacgacgaccgggaacgacgagaggatgacgacaggaaccggcgaggaggcgatgagggcagccggcagcagctgcacagagacgaggacggcgcggaacacgccgctacgatgacgacgagggtggcggcgcagcgagacgacgagccggcaaggacgaacgaccgaccggaggagtcgtcaacgacgacgagcggagacgacgataacgaacacaggcggggttcggatggaggggaggcgtggcccagggcaaccttgacgctgcgatgccggaggaggagatggcgacatcggctggcgcacgggcacggctgaaggggttgacaaaagaaccttcgtgaggcgggaggcgagaccgacgcaagcgacggcgttcctgcgaaaccgatggaaa

SEQ ID NO: 78892 - DNA, 3237 bp, Oryza sativa
cattggtgatgcccttaggctgtgtttgcaatctggttcccaacatgcacagtacgcacagaaaatggagcggtccattaacacatgattaattaaacattagctaattttttaaaaaatagattaatataaatttttaagcaacttttatatagaaactttttacgaaaaacgcaccgtttagcactttgaaaagcgtgcgcggaatatatttgactacagaagataaaaaacagataattatggaatgaatacaaataatagtgatttgaatgaggacaaaacaattatgctcaaaatatcataccctaattatgtttgcccaagcagcatcatcagcaataatctgcaccgttgattatcccaagaagctccactctgtttccttgcctccttaagcaacctataatctcgttttaactgcttctccttatcttggatctgttgcttattcatggtgacatagggatgtctgttacgaaattctttgacgaccttgttccatgcttcacttgtccacccgttttggcaccggtaatgtcggttattgtgctcatgaagtaaatcaactaaagccttttctagtcccgggttccatgaagctcttaattgttgagctattagacaaaattagatgatagtaagtaaattttgtaataattaacatgaaaggaaaatactccacaaaaccaagttagatactacctttgggagaaaccttcttcttctgtgtgctacagctctttggcgataccttcttttgtagatgcctttgttgttgctgcaataggcttgctttcggagatagtcttccaaacatcataactgtattgcaatattttattgaatgaggaaatacaaactacattacttactattaattgcccatatcataaatgttgattacataaataaatacaaatcataaaaaaccaaaatattatctatactattcttgctagctacaaacataatcttcccacatctaatactattcccactgatcatttgattgctaagagatgccacatcattttggtattcactgtcaccttccggtagatcaacaaaattagtaggctttatattatcaggtgggttgtccaaccagccctcatcaccattaagaaatcggatcatgttgtggaataccgcagcagctgctggaatccacacttggttctttatccgatggaaagtacctactttcaagatgggaaatcgcttctttaaaacccctagagctctctctacatggtttcttagaatggaatgtcgatgattgaataactccttgtagtctctaggtcgacgatgaccacatccaaactcctttagatggtaccgaacaccacgataaggagcaatgaactgtggtgtgttggcataactaccaactagagaaaatttaccatctaggacttgaaagccactattcattgctgatgtaaggaccctagcatctgttgcagatccctcccaaccacatgagataaaagtgaaatttaggtcaaaatcacaagcaaccatcacattttggctcaaagtcccctttttgttcctataaggagctgccttctgtcacaccctaaaaaatcctaaatatataaattgttgtttaattggaattattagaatttattttaaaaagcctagaagagaagatctaattttaattaataaattccaatataaaatggggccagataaaatttcattaaatactttgcttaattctataattcctagatttttctgggatttatttgagctaaggaagtatttttaataaatggaattacatttaatgaataatttaaattggaaaaggttttaaaaatcctcttttggctttgggccgaaagtcggcccaaaaccttctctctccctctccctggcccaagtcggcccagtccgcccgtagtcgcccgcgcgcgcgctcggccgctgacaggtgggtcccacctgtcggactcgtcgtcctcctcgcgtcgtcgcccggccggaaccctagctgagccgcgccgccgtctccttccaaattcgctcgcgcctttccttctccggtgaaatcaatagaggggaaatgatcttcgggatctcctctaccttttctcttttggaatcgtcggctaaaatcgtttggaaatccgtggattcgagttcgattcggatcgatctctctcctccgaaccctagactttccttcgtgtcgccggtcaccgtgggccttcgccgccgcctccttgctcctataaaaggacccccaagcccgccgctaaccgccgccaccctcgtcgtcacctctcgtcgccggtagagccctagcatcgtgtagcctagcgccgccgtcgccgccacagctctagccgtgcgccgccgtcgctccggttgttgtcgctgctcggggaggtcgccgtcgtggtcaccaagccgtcgccgatctcgtccaccccttcgccgacgccgtaagtcgccggagcaccgccgtcgtcgtcaagccgaaggttgccgccgcttcttcctcgacgtcgtcgccgtcggttgatcttccgccgttgttttggtcaccggtgagttcgccgcttcgccctctacgtgttagtgtcctccgttcgcgtcgtcgcgccgtcgttcgccggcgagcttgccgcccgagccgccgccggtgatgacgtcatcgccgacgtcatcgttgtcgtccgtcgtagaccggttgtagaccgttagatcttggccgttcgttggggataggatcgatctcggccgttcgtttccgtgagccgccgccgtgcacccggttcaccgcgaaccctagccgctgacgcaataattctcttttccttttcaaaaataattcattattgcgtcataattcaattaaaatccatataagtgatttaatccgatttaatctttaaaaattcataactaattcatctcagctcggatttagttggttcaagtctctaaatttttctaaaattgagatctacatgttaaaaatatccacatgtactgttcatgcttgtttatgtgctgttttggtgtttttgctcttttctgtttagattccgacgtttccggagagtccgttttcgcaggagaagaatttgaggagttccaaggccagcaaggcaagtcacacagatcctaaacacaatcctttgagcatgttgatcctatatttaaattctctatttatttcaactgtgcatttattttcgaatgtcactg

SEQ ID NO: 78893 - DNA, 2305 bp, Oryza sativa
gataatatccaaattaattgcgtgtgatgtgcagcagtaggaggtaaagtatgcttcccatggtagaattggcgccaatttttacttccctctcagacttttccctccaaaacacatctgctcgagtcagagagtagttgaatagctgggggaaattaagcaacgaatctagaccatcccttgtatgctggatggttagatgatggatactgctaaagttacatgatccgaatccatctacccctggcttctcatttcacacggcaaatgaaaacagtatatattattgtcctgtgcgtgcagcgtgcgtacgtgtctcactcttgttggtgtttatttaccggcgtccgtcgccctggtcccgacgtagtacgtggtgttatgttaacaggcggccgaatgtcgggggtgattcgtcccctaacctgccactgacaaacaacatggcagtagaatcgcagcaggtacactggtactggttacagcaacagttttttttttaacaaggctttccagtttccacatgcgtgtgtaacttctttgtaacatccagtgtgagtgccggcgcgtctttacatacatatacatacattatacatgcacatacgtacatatacgtgtcgtgaatgggcaggatctcttagggtgtgtttgaggagaagggaattgaggagattggggagttacgcaaaatgatgtgagccattagctcatgattaattgagtattaactattttaaattttaaaaatggattaatataataaagcaattttcatataaaattttttttataaaaatgcaccgtttagtagtttaaaaatcgtgcacgcggaaaacgagaatcaatctcccctatctcccgagacgaacagagccttaatttactcatgctgctgctgctgcgtgtgctgctggtgtacttggcccaacgccgacggttgcaactgtgcgtaggagtggtgtggagtggaatgagtggcttggagtggattgatgcgatggcggggcacccgggggaccgtcgaatgcataactgtaacaacagttgagagcctatggctaccgaacttttttaatggatcggcgtcgctccttttgggtttattttggaccttggccggccggcctgggcctaccgttttgcggtgcccccatgtgaagcgagtaaattaaacaagcggacaagtggagagattttggttgcaggcgacgatgtgacgccttcgtttggccacctagctcactgcacgcgccatggaagacgaaggtctgtgtgctctgtgtgcgtggagggttcgggtggttctactggcggagaccacatcgagcactccagtccgactgactgtgtggcttcagtaattaattaccagtagaatccaatatgccatgtaggattgcttgcctttaaaagtcttggttgcaataagcttcacagatctacagtgccctgcatatatacacagcttgtttagtttgtactaacacttttaacctttggtatgacaataaccaacattgctatcctactaaaatttatgtagtttcggaagttttcactcttaaaacctcaaaaaaaattgatgatggtataaaccaaatccatctcatcacatataaaaaatttgacatcaccaatttttgctagggttagtttgaacaataaaacaaacatacttggtgacatttgaaattattaactcgattacaatgttttttttaagaaacattgtacaaacacaaagctttcacaacatgcgcaggtgcgcgcacattattccgagtatcttcgaaagactgaaccgatatatctagagattgataaagtcaacataagcacctcattatcaacggttacgacgcctaccactaaaaaaataatttaccataaatacgagtactcgtgccaagtctagaattttagcccaagtgggctagttacactacaagaatctactagtagagctacttgattacaatgttaggtcctttttggcatagctgtggatccaagatttttggagctggatatttctagattaacaaatctatggatttaatatagtttgttgataacatttatataaattattttgtgctcatttcaaataaattttaaattttaagcactataatttagcatataaacttcaaatgtactatggatatgagatctaaagccgtactaaatagagtgattggaaaaaaaaactttacaaataacaaacagtttggaatacgtggcataaactatgtagtaaaagattttttttctctttcataataactagctgggtggcccg

SEQ ID NO: 78894 - DNA, 1332 bp, Oryza sativa
taccttgggttattataacttgactagttgagctttatatattggttcggctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccgattcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtagtggattgtgttgtgcaaggggtactgtcacagctcctttccgaggtaccgtggtggtattaaggcacatggtgacatgttgtggggctgtgtcttgtgggtacagtggtacacctctggccagagtaaaactattcgaatagccgtgcccgcggttatgggcgggtctaacaatgtctttcatgattagtctcacacttctcatcataataaaagatgctataactggtaataatttgattagctcctggtttggaatggtatattcctggtttggagatagaactatgcagccgggatggttgttcagaatggttgggcctatgcaacagggtatgttgtatagcgttagattaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttattttttccgctgcttagatctttattgattgagaggaactatctacctctgtaatgacattttattcgcttattaattagagtgataattgtactctattatcaatttgttattgtgtgcctcggctgattcctggacgagggtcacacacatgtaagcgtttggaattttgaatagaaattccgggcgtgacaccttctctccatctatagttttataggaatgtgggtgccatcaataacccctatgtaatt

SEQ ID NO: 78895 - DNA, 2792 bp, Oryza sativa
  unsure (1)..(2792): unsure at all n locations
ggaagcganccgagcacggaagaacaagggaacgncgcgaaaaaggcgnnccgncgnccatggaagncgcccatgaatggcgcagccgtccggtcaaaaatagtggacgattaagggaagattagggggaaaagggagagaaaggaaagggaattaattccccccaattaattttggaatccaacgcttaaatcgcgcggattcgagggaggaacgaactagggttttcacgggagaaaaaggaggccgtgcggaaggaggaaaacgaccggcgcgtgggccccacgcggtcagcgcgcgcagtcagcgcacgcgcggcgcgcgtgcacgcggctggctcggctcggcctggcttgggccgggctgctgggcctaggcaggccgggaggaaggagaagggagtggcctgcccgggaggaaagagagaaaaacaaagggaggggagagggacttggactgcgggccgagggggagagagggagactttggtccagacttggcccaaagggaggagggggattatttttagctttttctttttaataaactttgttaattgttgttgttgtttaataaatattttcggtgctctgaaaattcaagtaaaatttgagggctccttttagaccaaggagaatttaacaaaaattctccggaccacattcgaatttttctggcacgtattttagtgtttgtcaatttcttttcgaattttaattaattctattattccttttagggaatgatttttatttcggaatgaatttatcaggacgtgacacgcaccatctagagcttgtttcacttctccatccttagaagaaccggtcccaggaacatcagcaactaccttcactttgtatttctgaaccaatgtccccttgcaggtctccgtgaatgagctcaagaacttattccatgcttgctgcatcattgtatcaaggtctttttgctgctcaggtgtcaatttatccagagtgatgggcacaatgttggcttcatcaatctcagataaacctagctccgggatcttttctttaacagagccaggaccagccgaggacggcgatgctggcagtttctcggccatggggaactgctgttgtgattctgacttctaatgggtcccaccaggcatgccaaaagcgtgttgatgaaaaacatgatgcctaggagatctgcttaactgtagtgcaggtccaaaactcgccttcgggtatgttagtgtgccagttgatttgatcctgcaatcaacaagaaataaagacaaagaaaccatggttaaatccataaacgatagccgatcggctaggtgccgatgacatatcatttatctttgcgccgatgtcatatatgtatcgatcgacagttataaataaaaaagaaggaactaaatctactcgatcggctatagatattaacaatatatactccttatatcgatatatacttaaatcaagtgattgggatagatcggtcgccatgccgagacagtataaatcacttagatcgaaatatatattaataatgagactatatatgttcatagcatagccgatcagatagatctagcatgtatcggctaatactccgataccactctatattaagatattaaagcaagtagaatatatcaaacaaaagtctaatatacttaaatgcgatttaacatgtcaataaagcatataaaacaaatgtagttaaatcaggtaagatcggctgaaaccacgattctaccctaatcggcgaccaagaatcaggctagagattgagattctaatcacgactcataagatcaaactcaactgatgcaactataagtatgaaaagaaggacaatatctagacaatcaagccgttggaagtttcatagagtggtggataccttatataatctaagtcaacgtcgatatctaatctaatcgctgccctctaccgacagatgttagccgattgtagattagatagcgatattgccagagattatgtaagatatatgataactcaacgaattacataaacaagattagagtatcataaaaatggaagcactaatcccaagaacgcaagccgtcataacaagttttacctcttgttgaagatcgaaaccgatgcagctcaacccgaaagcaagaactagtcgaaataaaactaaagcaaaaagggtggcgatgcgccgagattgtattgaacgtgtgttaaattgattacatggggcttgaggtctatttatacccgagaattacacaacatgtccataacggacacgactcttatctctaacaaactctaagataccataagtctttgcggcagacttttgcctaaacatatctctatggaaattacgtaaaatatcctaactaatagatacaattgtcttctcaggactctatccatgcgtggcaatcatcttgaagcatatcaactcgacctgatgtcgtacaccaagtcgtactgtcggaatcgttcgtatcacctgacccagtctgactcggactttgccgatctcaatcatagccgatccgaactccatccgattcttaatctgtttccgcaacgatcctcatctttgattccgcttcgatctaaccttcctctccgatactgatattactaaatttagtcgttaacacatgccccccaagtctggaatatttggtaatgtttcggatttgccatatatcgactccgagcaagattcgcactctgccgtttcccgaccgttattccagcgctttaaatactaaccgtcgctctcgaaaaatcttcactccgtcacttccgttttca

SEQ ID NO: 78896 - DNA, 3203 bp, Oryza sativa
aagttagcattcttcatttgtcaaacatttcatccatcatccacaaaataatactccatgtcatttatgcctcttcctccaaagctctttcaaaaaaaaggaagagagaggcatggctatgcaaaaagaaataaaaaaagtgctcatacaagtatggagcatgatgatgaaaaaaaaaagaaaaaaagaaagccatgcactctcccaaattttcaaaagaaaaaaaataaatggaggaggaggtatacaaaaggagttggtcatatttttcctttttccacccacaaattaaccatacacatacacatgcacattcttgaccagaaagtatgtcttgtatttccatatatcctttatttgactttgcaatatgtgttatgcaagtaatgctctactcttttccataccttgagctccacataagccttattagatgataggaaaagaaaaggcacaatcgtatgcctttgtgaggaatcatacaccttgagtgattaagagaatcaattgaggagcaaagcaaagttataattttgtgttacataaaagaacccaagttgttcttcatgaaaagttagggtgacttgagtcaagattgttccatttctcaattgctcaggatcgcatggtagacactacgaagatccaaagtataggtattactttgaataatttgtttgaatgattattagtaaggaagtcatgaccctgttatagagtccatagccttcactcgggacgagcaaaggttaagtgtgggggtgttgtggacggcccttaaatcataatatctgaccgtcaatacttgcatataatgaaataaaacatggtatccaacttagtgtaatcatttctactagtgttggtgaaatatgtgtatgcaggtaatttgagaagcaaacacatccgtcatgcaacaaaatgcacctccgcgcattcgggacgcatttacacggattggaggcccaataagtcaataaaacccatttagaattggaccaaaacatagcccaggttgttggggcccattaagcaatctcccagctgaaggagaggccgggatgagtgtttttgggttcggccgaacccaccaattcggccaaacccttcctgtcgcttcccgccatctgcttccaggtggacggcgtggattcctcccctatggcggttgcagggtgttttggtcatttcctatacccctaaccgtcatttggagcctatataagaaggtattcatctcacttcaagcatacacaaccttgagctgaattacaagaggctctattgtatcttttgtacattagaataatgtagagagtgaggggaagctctagaggagtgcccggaagtttggcgctcatccaacttctacctcgacgagtgtagtttactaggaggaattcgggaggagtaccggagctgtcggtacactctgcttcgggttcggagaacttcttctataaagtaagcattcgtgttcttttcttatgttatttaattactttgtctgagtaagatagatttccatctttgcaggttcattgtttagtattttgatgtgaccatgactactaccgatacaaccattactcacatcatggatgaacaagcagatatgaagatcaagtcctccaagtgctggaatctgattcggccacctgctgcattgctgacttcaaacggccgccgaatctgcatacgacctccgtttttggcccgtgagtacttgatggaaagctctcagagccctctttcttacggagctagcctcatcaccaaattccatgtcgtttggaagcaatcacataaacaaggtgctgcatcacctgtcttgggcctctgagcttgtaactttgtttgggaccccggaccaattggagcccatgtggggtgcgccccaaccaggtggagcacgaccctagggtcctcccacctctataaatagttaggtaccccttcaggattttttgggttttgtttagataaaagtttagcttcgctacttttccgtgtaatcccgtgatcggttagatcgccggtttactcgttacggaaccccaaacctatcatttgtattcaattcctatctgcaattcagattgcttttatcttgttcttgcttgtttcttcgatttgcttgcaggaacaaggttgatctgcaccgacaagatcaacaacccacaaagaggtgtatcaatcgctaaggcgcaacacaacaacgtctagtacggttgtagtcgggtcgtcaacgtttctcccaaatcgtagttatcttcaactcaccgaaagatcgggccaacaacagccttgagtgtctcaagtggaactcagggttcatcaggtggtatcagagctttcgttgctcggtgagttttcatttacctataaccagaaaatagccaaaaaaaatttcatacattacctagccacatttgtgccattgcattgttctattcagtttttgctttgttgaatttttgttgcattgtcacgtcgtgttgctggtcttagcgtctagttcgtttagagtttcgagttctggtcacgttttgtaccacagtcgtcgccgccaccgtgtctctgttgtcgtcgggacctatgaaaacggaatcggctcgctgctacggttccatttttctagttttcagaagtttctgtcggtcggttttggtgttgttgagttgcatctagggtttctgccgtgtggttgtctcgctcccgaggttgtgccgtgcatgctgttctattgtgcgcgaggaagaagatctgttgcgcgaggaaggagaaagaaaggataacggatcggttattggaggaagttttgcggattagattagattgggtcggtttgtttccatctaagaccgaacttaccatcttggcatagttagttttccaccgcacagaagttggcgttgttccctgactccgactccctctcgtctcggttccaatgcataccgtgagtggctagacaccttggtaaaaaattttggagtgtcgaattggagatctgttcgtaaaaatggaaccagtataaattcagcattccatttttgtataatttgtaatttgggttttgacttttacagttgagtccatgtaattttttttatttaagtttaagtccttgtaacgttacattgaggtccttgaatctgtttttgtaaaaaaaaatcaaaaaaagaaagaaagaaaaaggc

SEQ ID NO: 78897 - DNA, 10131 bp, Oryza sativa
ccatctgaggactatctccattgaactgaggacagctcatcggcggaacatgaccactaattcccatggaacccccaagcgaaacagaattatcagtggttggagaagaaggggacgaggaggggggtgatttcataccatcaggcgacttaaccagcgcttgaattttatccacctgctcctgcagctccagaacagaatcttgaagcagatccacgcgcttctccatctctggaaaacgagattcaactacaaccttgagcaccaagaactccgcacgactcttctctgtagattgctcacgacgcttctcgctctcctcctgcttgcactctgcgtcctccatcttcttcaggagcaaatcaagtttgctgtcctgatccaagaccttggccgccattttagtcacgtagcggggtttctcgtattcagccatggctgaagctttcctcaagaacttgcgtacccgattgagggagccgaagcttttgcgggatcaggtcgccgaagcaacaatccccacctcgctcaggatttaccacaagaaccgagaggaaaaaattttgggtggtggctctgataccagattgttagctacctaacgccaatccaacaatcaaaaggaattcactcaagaacacaagaatttttccgccagatccaaccggatcggcgccgccgccgccttcaccgccaacttctttcctacttgtttctcaaataagaacagtattagtacatataggagtcaattccctcacgctaccgattcggacagctggagctggtgctcatttggcctagtccagtctgattacacgataattggtcttgcgcacacgaatgggccttgctagacgagtatgtacttcctcccttgcaacttcagtcttctgtagtaaatctgggacgctgacatactcccttctaattctattgccatccactaaatcaaaattttcatagatgacatcggtcaacaaagataaagatagcaatcgattgagtaacaaatggttcaaataccaagaagactaaagggggaggaggagacaccatggagatatacaaaagaaatctaagaacctattagtgattattgattcaatggattttgctaactgccattcgacagaaatttaggggaacaatcttactacttttgtgacttctgattaacttgaaaattcatgcaatggcttccttctcctcaagtttcagcgacccccaacaactccagtaaccctccaacaaggacacggctaccatcccactgggttaggtttttcatggtcagattaggaggagtaatgggttttgaggctagggcgtgatagcctggtagtgcgcgatggtgtcgggaaggcgttgaggcaatggggcactgctgaagctatgagaatggaggagcatgatggaggtggcacggaaatcaagaatatgttgataagtgacgattaatctactcgtgggagccaccgaaaacatagaaagatgatgtgggttggtgaggaatatgatgaaggagagggaacaatgatgtagagaggtggagggaggaagccggtggtggtgttgtggctggccaacgggtttggcctgcgttggaggcgacaccggagaggcagatggatagcgcctctgagccggggaaagaggtgggaggtggcggtggcagtaggcaagtcgagttcgagttaatggggattagggatgagtgcacttgagattataagagtgtgggtaatttgtgaggcattgaattttaatctagtgggtagaaaatcgtattattagtttggggaatttcttagacatgctgtatatggtagtccggttcaaacaaaaatataatttgttacaagcaattgtggttggaagagtactaatagtagatatgctttgttgtggtcttgttgtaatgtcgtggataaaagggacatcatgatcgtcttgcacggtataacatcggttctactaccgtacgtgctcgatcgaggtcctaaaccttcagcgaaaatgagcagacggccggcaaaactgacaataacgataaggagagtcgaaacgcacgatgaacttaagaagtggggggaaatcaattagacgcgtcgtcatttcgttcgtctgtactaatccagtacgaggcaaacttacacaactttgctatgaacctagctacagctcacgggtgctactccctccgtttatttttatttatccactgaattaagccgtgattaacatcaagaaaatgccatctgcgtcagacgtactgtcaccgtgcaagtacgtagacaaccgctcgcttttaattcggtgcgctctgaagctttctctagcttatctacctatatctcctcctgtttaattttgccacgtacttttcctggtcgtgggtcaccatatgacccgatcccagcggacaaactcacatgattacccccactaactatttactgcccgtttgtgtatggttcgcctcgccgtgcggcactggtgcgacgacggctgggccaggggcattagtacgttccgattggagcatttgcttctgccgatccgctgcgtcacctgcaaaaacggccaaagacgacatgcggctgcatctgcatgcacgtacaggaggcagccgtttcagttgcgctactgcgaggtgcgaccgatgagtagcatgttgatgcatgccggtcttattggactcccgaaggagtaaacttgaagagatttcggattacttattaggttttgattggtctgagttacgggttgataagtccttaaaaaattaacaaactaacaaaaataattcacaatttaaaagccagtatgaacaaagaaacttataaataactctaaaattaagttttaaaatttaaattttggattcggcaaataagagaagcatacaatgagaggcttaatttttctctactttttcataccatgccaacttttgtgattcatctattgatggaaaaaaaaaagaacaatctgttttatttctagtcaatgtcttccatcattttccctgcaaattgcccctactatatatactacctcagtgtagaaattggacgggaaaactgcataagggcattcacgatggaagctacttctaagaatggccttagggagaaagaatgtggaatgtagattgaagttatatcttataatacccttctcacaatgtatggtggctttgactagggcctgaaataattcagttcataaacttagctaatatatgttttacattaaataaatatgcagaacaacctttagaatcatcaacaaaagttacatcataaccattggcctacttgtcaaccactaattatattcgttttgcctatcaacacatcttcccactctaggcaccacagctcctcccactccagccaccacaacttcactattgtggatcgaaggcagccccacgactttccccctctccaactgacgtcaccaagacctatgcaaggtggatcgaaggtggtttagatcaacgggctactccactgtctagtcctggctgccgccatccttcttcacctcaaatccagccatgttgagggcagctctacccaacaagttcggcggcaaaaggcagtgacttggtcgatgacatctcctggtcgcggtgatggcaatggtgacagggtcctaatagtatgcagtgctactcttagccacgttcctcctctatctatatctgaccctctccactagttgcggacttgtcggtcgtatctctagccattgcctctttgctttccaaccgacattgtcagtactcgcaacattgaggtctgtgcaaccacgcggaaggagggggcatattgtggggcgatggccttaccgacgtggcttgcatgctttagctacacttgcaagtgtcccatcctaatgagacaattgtgccctctgcaaaggcacaagaagccttgtgaaggaactatctcattagatatatcaccacggctctgacatggtgagcccaagcactcaccctgatgaggcaaccgtgccctgacgacgcacgagaagcctcacgaggacacatctatggctgatatgccatcataactctgatgtagtgagcctgaatcactcgttaggtactcacactatgtatggcctaagtgtatgtgtaatgttgaccttttatctcttttagggtcaaatatctagttctcccaaccatgcatacagctgacggttctttcacggttcaactcaacccttttctaatattctaactcaaacatgtatataaattttaacccaacccttttatttattcctaaatctttagaatttataaagttatttatagactaaaggtttagatcccattctcggtcactctatatgaagagtgggtgacaattattgaattactagtacttgaatgaaaggatccaaacaaactcttggcgtgtggatggctgctcggcctcggattgtctaggctcgccgcattttacgccttggagagagttggtgattgactgtgtgcagtggagtactggatggccagaaaagattaattaggtcctggatttgctttttcatttacagaccttttactgttgcatcaaatccccgtgtatgtttggtcatgtgactgtggtgtgcagtgaatatcagttaggtcacacaccaacactaatatactactcccttcatcccataatataagggattttaagtttttcttacactctttgaccactcattttatttaaaaaaattatgcaaatataaaaaacgaaaagttgtgcttaaagtactttaaataataaattaagtcaaaaaaataataattctaaatttttttaataagatgagtggtcaaactgtgcaaataaaaactcaaaatcccttagagtaccaaacggctgggcttaaatcagctcatctcagcatgcttaatttacagttgacatcagccgtctgcatctatgcatggtttaggctggactattgagtttcctccctccggtgcctagagcgtttgatgttggccaagtgacactgacggtccataggtaggccgtaggcaagtactactcctagaattttgtcagtcaaaatatagctagtggcaatcggtcccttgacacagaattccgcagctaatgggtgttcattccttatagtaatccgtatactcaccagtggcatgcacaccgagaatccgagataggcggcagggagcggaaagccggaaagtgtactacatgcacgattagtcctaaagacatttcatcagcaactggtgagagtatgtggtggcgtagtggtggcaggctattcagctttgccttcacggttagtcctaaaaacggggcaaaatgaggtcaaaccgtgcaagtgaagtgggcactcggcactttgggtttagcaagacagccagcaaccgcatgcaaggctgcattttgcatggagtttttttttctccgaacacaccaagagattgcacgtcaatatatttaaaagaaaagagtgtttgatacacaccataatcagtcagaccgacttatgtcaagaaaagagagaaaaaataaaaacaaaaaccgagaaaaaggaagagactactacaacagctaaacacactccaaatagcgggaagaaggcagagtcacactaccctcccaagaaaaccccaaaagtagcaatgccaggtcgccagctaacgaccatagatggccttctgagaggatgactctagaacccctgagaccgaagagaccgcagagtcaaaaactctggagtttcgttccttccacagctgccaagagactagtaggaccagagagtcgaaaccggcatgaagatgctcaggtaagtatgccctagaaaatggccaccagtcctagagccaattaccacagggtggagagagggcagcccaaccagaagacgacagcacacggagccagacttgccaagcgaacacgcagtcgagcagaatgtggttcgtcatctcaagctcctgagcacaaaaggaacagaccgggtgactatcgatgccacgcttctggagaagatcagtcatccagtagcgctgctaaaatgcaaatcagaggaagaacttgcatttagcatgacccttcatgtgccagagaagatcagaacaggcaaaggaacgctagccatagaaaaacgcgcctggtatgccaaacacgccgagtagcgctggtcacttgtccaacgccaaacaagcaccgtgacagtctcctctcctgcgtgtcacaacatgtctggcgatgtgaacttctacgtatcgcaaccaaaaaaaatttttaagtgtgaatatttaatttgttttttattacaatattgtaggtttatgaagtgatatatcacatattaatatatatatcttcttaattttttttaaaaaaatcataacaattcgagtgacacatagattaaaatagtttccactttagaaactgtctaggaatgcagcccgtcgtcattggaattccatttcagtgattcttgcagcgagaagaagaacgaattaaaattcaatatattcattagagacatttcattttccatttactatatccgttgtagtctagctggttaggatacttggctctcacccaagagacccgggttcgagtcccggcaacggaaagtactttttgctggcagtatattttaaactgcaaataattgtctccattagcgtgtttaaactgcaattaattgtcttcattagcgtgttttgcctgcaattagcttgataactgcgaaaattctaattaggcgtttttcgataggatttttaagtcttcaattatcctcacaccgtgtatacattagcgtgttttgtcttgcaattagcttgatgactgcgaaaatcttaattagatttaatagtaatctaattaatacatggtcccatctgtcatacacacactgcgtcttggagtccgagctacagctggctacaaatctgtagcccgctgctcttctctctccttatttatctccttaaaatatgcctcccctatgtcgattaggcatgctcctcccctgcgcaacgcagccacgtggttcacacggagagggggtggcacagtttttttaattcgtacgtatataaacttcatatatatgtatatttttcataagtcaatatttttatacgtagaattttttatgtatacatacataaactttgtattgatataatacatatttacatatgtataaagtttatacgtgtatatacatatacatgctatatgtatcgggcgcccgcatgacctatttacatgcaccatcgaactggattggtaacgaacctcagcgagcttctccaccatggagatatgaattgaaaatttgacgtccctcatgtcccgcaggatagtaccacctccatctttaaatattttttacgtgaaatttgttaagtattatttattttattgtgatttaatttgttattaaatgtattttaagaataacttatatatttgcatatctgcagtgaaattaactatgtaagtacctttttttttacttattttatcattaaatttactttaaacattatttttttatctttactaatttatattattaaagatcctttacatctggctttttacaataatatgttcctagatgttgcctcaaacctttaggaacacatgaattgaccctacttgtaaaactactataaatacttacattggatgcatatacacaaacatatatcccgatcacataaagcaagtacacctacaatatgtatactagatggtaccccgcgcattgttgcgggatacatgaataaagtaaaaaatggcacgtttggcaggatccttaataaaaaaggattcagtaaccaacataagaatatttaaataataataaagtagctatgggtgattgcttcttggtgaacgaattatgttggatacagctgagtagacccacgctgtttatgaattacaatcgatcatcacgtcaatgaacttggatgaaacagttcaaatagaagaaaaaggtatagtttgcaaggtaacacacttgcaaattgcagaaattccccaagttaagtaagacaacaacagtgttaaaatgtaatgaaaaatcaaccatgctgatactgatgtgctccaccatgctgaaactgatgcacttgccccccgagctaatattgttgttcctccattaaattctccaccgtgaccatgatcttggcattgacttcttcttcagacatgtggatataaaattcgtggtcccactaggcgtgccaatctgtgttgacgaaaaaaatcgaacacaccggcctaggagatctgcttagctcctgtgcaggaccaaagattgatgagatgcgggcgtgccagtcagtttgctcctgcaactgacaagatatgcaaatagtagatctaaacagccgatcggctgacaagccgatggagtagttccagccgatagctgataatagccgataccgataccagccgatagcgatagggtttaagcaatcggctataagtccaatgtggataatgatataaaggcaatcggctgatgataatataatatagcaatataatccagtagaaaccaatcggctaacaatatgaaatagtagaacaaatattgatccgaaggttaaagcacacatcagctggaggtccgatgtcataagatccacaagattagattaaacattgaaacctttgttgccatcggctaaatctaacttatatgttgtgcaatccctacaagccgatgcaacgtccagataacttatcggctagcaccccgataaaacattagcatgaacctatcgacttaacaagacttatattatcaacaacaatctagtagatcgaacctaaccgatgcagcacgagattgtatatgataatctaatactcgatgagccgatagatctgtctaatgtgatggatataacaaatctatttagaacattataattgtagagatatatcggctaagacaggagatcagacctaaccgagacagtcccaactaaaccgatgcatctctaaacacaatgcaattagagatagaattgagatatcaggtaggcaaatatatcaaccaaaccagagcgatccaagagatcgaatcgatgcagccttgaacaacaccaacgtagtcgacagattcaccagggcccgacagaacataggacttaccccttcgctggagatcgaaagccgatgcagccctgcgtcaggtgccaaagttccgccggaagataagtaaaaaccttagggaagagggtggcgatgcgccgagagtattattgatcgatagattgatagattacaatgaccccgggtgtacatatttatacccatagggagatactagtccttgtcggacaagaaagaaactaaaaaggaaaagataaagtccttatcggacactaaacacactttcctaaagataaaagaaaactaataaactatgcctaattaatagataactgtcatgtcgcatccttcttgaactcgaactcttctagataagcttcctttgattgatccaactccaccaagaacacgacatcgtggcgacttgactcccatcggctgattctcgaactttgaagccgatactgactctaaaccgatggtaactttgggattaccaaatttcactgttaacacatgcccccaaattttggagtatgaggacttatgcttcaaaattatcttctgtctcgccttgataactccaaaaccgatcttcatttgcttcttgcaatcggctttcatgagctgatactgatgtgctccaccatgctaaaactgatgcacttgccccccgagccaatattgttgttcctccattaaattctccaccgtgactatgatcttagcattgacttcttcttcagacatgtggatataaaatttgtggtcccaccaggcgtgctaatatgtgttgacgaaaaaaatcgaacacaccggcctacgagatctgcttagctcctgtgcaggtacaaagattgatgagatgcgggcgtgccagtcagtttgatcctgcaactgacaagatatgcaaatagtagatctaaacagccgatcggctgacaagccgatggag

SEQ ID NO: 78898 - DNA, 6016 bp, Oryza sativa
  unsure (1)..(6016): unsure at all n locations
cggggcattgatgattgaataacnnnnnnnnnnnnnnnnnnnnnnnnnnnnnnnnnnnnnnnnnnnnnnnnnnnnnnnnnnnnnntattaccaaatttagtcgttaacacagtggcccaccttgcttccgcagcatataactccaaataatgatatccagtaatctaaacatcacgcttaatttaccaaatactactttaatatcatcgtcatgacttagagtcatcataaatacgatcattatacccacaccattgcatctcccagataagctagcattataataaatgtaacttggatatataataaatttggtattcatatactcggaaagtaatacaataccaaagtactataaagaagaatattctaataaaagtacaagtcttacaaaagaaggaaaaactactagagccatacccgaattcttccgaagactccgaggactgaagattctattctatttctattccactatgctatagagactatactaaacttgagagatgtatgaagcttcttacttgaggtgtcttgaaatggagagagtgaggggtttatataggctggtaatgatggttatgatggttggaaaggtcgataatacccaccaaccatcattgggaatcaatcccagctgtctagccaaaccctgcatccatcggtgttgcggctggttcggccgaacccctgggctggcccaaccggctcagttcctggaaggcggcctcctctcttgttgctcacttcagacttgtgaattttggcccaattgatcgtgtcatttctgagttcttggcctatccttccacaagtctgattctcgacatcgtccgattgattgatcgtctattttgatgccgattttccttcattttatgtttattctctgtaagaggttagtaattctagtgctagtggaatatttattatttgaacacaaatatgcattgcaagcataactagttctcctttattttggtagtattgacgggcgaaattgatcgctaacgaccgtaaacagatatgcatgtatggagaatatggatctctagttgtccaatgtgttccatgtacaacgatatcttttcatggggatttatggctgttggatcaaaaaaaaagtgcagacgcatttgttatcgttgaagttaggggtgcaagtgctttcccatgaacccgcttataggcaaaactagtgcgtaacccgtgggtttgaatcgcgggttacctattaatgggtttatggatcgacccacttgcatacctagatgcggcaagtaggggcacgatgcgaaaagccatgaattatcatttatttgacctataaatgaactcgtgggtcgacccgcttgcatccctagttgaagtaatagaaaaccacccacatccacccctcatttaatgatagacaccaagtataatttgtggaagaagagagtataaggacatgcaagttaattaatattatacattcatgttaattttcaaattggctacatatcatttcactaaatagaaaaaccatcattctcaggtccgtcttttgcttaggtgaaataggattttcccatcactatcatcttctttaaccgatggtgatggagtagaactacttgttcaccacggtttcatgtgcaaaccctcatgaactggcagtgatactcgttttttcataccatgagccgagaagtgaggtaacatatgttcttatggaggaatcacttttaccacaacaagaaggccttcgacggaagagaagggtttttgttacaaaaccaaccccaaaattaacatcgaaaaccaaacatggaagaaaacactatagaaagattcaaacacaatgacgatacttaggcacgatgtttgttaatgtgatttagccgaagcctataccgccaagacatcgactacggatgctcatcaccgatccaacatattacagtgtatctgagttacaacaacctcggccggacactgctggcagccgctccctctcactatactaagtcgtcgtacggttataataggtctacccctctacttaagagtgagcataggatagagtccgacttttactatattcctaacacttgtacaactccaagtcacaaactgtaacctactacctacgcatattcaatacaaactccaccttgaaaaatacgccacaccaatatgaatttgtcccatgcatgaactctgtgaacccagacttgtgttgatcctttcgttgctcacatcgccccgacaagcctccactaggctcaccataaacaagagactccactatccatgtaatttcttcctcttaactccatatacaacagtgatccaccttctttcctatcatcacatatgtcttgccaagcgaaattgaattcctccttaaccggtacatacctgacttctagacatgaagagaaccatttctttcttccgtcttatgaaccgagttaacaaatccaatatccacacttctcgcatccatagattgaatctatgataatttgataaaattcaccattgctttgaattacccgaagaaattaccactataatgtttgctcttcctctttagtgatgcaggttccatatatccctattatgcaaacctgtagatcctgaatatgaatatatcatgtactaccgaacagacccattgaagcaatcaacgattttcccccactgttgtttggggcttctcgataattcccatgttgcttccgctgagtcatgccttgacttaaccagtcacctttgccttgctgcatcatacctccttttgcatgtcttgtggcccacgagacacaaacaaacgaaaaagcaagcatgtccttcaatactggagcagccacctgtttactaatctccatccaactaaaaactttcaattcaaatctgaaaacttttcaattcagatttttgaaaacttccaacttaaattttcaaaatcaatttttattactttttagaatttactgtagctcttagcttactacttgtaattcaaattatttattattttattattaaaaactacagcttagccctaaacgctgcgtttagcattaagtgctttgtttaccatctagaagggccatgtgtgtaggtcacgatgctttacttagtgccttctagaaggaccagcgtgtgcatgacttatatagatcgcacactgatgcgctgataagcacaccccatagtccacactccacaaccactttgactcggccaaacaaccacacggtcatagccctttagggtataaaaaaaaaaaaaaaaaaaaaaaaaaaaaaaaaaaaaaccctcgaggcttgcgagctctaaacaagccgagcttgagcttccattgagcctagcaatatataatttttgttgttatttaataaattaggagatcaaatatgttatttgttagcatcccatacaataaagtatcttgtattagcatcatatattaattttattcttttttcctattctatcaatatgatgaactataaatcaatgttttttaaaaaagattatccatgaaatatacattgtttcacttacaaatcaagctcgagcttgatcgacttcagaccaggcatgtctgaaagctcgaaagttttatagactcgacttgagctcggctaaagcttgtatcgagctcgaacctagtgtagacccccgtttttataacaggaatcaatcgtgtaaacagtatcatttctctggatcaagtagtctggtacacacgagttcatagctgaaataccaaatgcacatacatgagagtctagtgctaattattacatcataagcccgcaggcatggtcttaaatcattgaaccgagcggtccggaatacattccaaaagcagaggtagataaggtagcggaattcaagcagcggcatgccattgccacaggcatcgaccgtactaagacctactgagcgccatcgtcttcatctccctcctggtagtaggcatagggatcctccgaagtttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttctcaagcctaagacctagcatagactgttcaagttttaataccagtgttcatattaaacaatgacggttctgtccaccatccattgtgatcccaaggatagcttcctgccattgaatcgtcatagttttctgaggatgtccaccttccctcctctcgggaagtggctccctcagcataaaattcatcatgcaatatcccatcccccacaagttaagaatttagagtctacccaagtgtaatacatgttccggtgctcaataaccgcgagcacggctattcgaatagatttgttttactcacactgcagtggatgtacactttacccgcgctccgcgactgcccaacacatgagcctcgtcccaacacatgagacgcgtcacggcaaagcctttcgataacctcgcattggcagtacccgctccatgaactttagccctcatgcactctaggcgtcatacgtttctagcagtgagaggagttctggcgctcccgggaagggaaaaacacacacattcctacgttgcttcttgtcgttgaacccagtccatcatgattgttctcttatgggtatcctcatgtagtattgccaagccagcctctgaccatccggaacgggcatccgccatccacctggccatccacctggccatccgaaccgggcatctgccagcagactgcttgccgcatcacacacctaaaagaagaccactacgcatggtactgcctccgctcagctatctactccgctaggtctatacccatacgagaagtgcggttgtacgggggtcgtttcatgcttaacttcatggctcggtccttaattgaccagggacggcactagccttttccggacaccacccaaatcctccggccgccccagtcgaaaacagttgtttcactttattttcctttcacaaatcatgtcatcaatatcatggcaatgtggcgctcatgtctccacatgccgcatctcaattaccttcccaaaggtaattgcccaagcatatagcatttgataaatatgagtatgcatgattctgtaatagcatttctaagcaatggtcatagttgactagggactcatacataatcatgggtacaaagatttaagggtaaacaataataaaggcatggcataatcacaagtaggatgttcatcattgcatgcaattttctttgtaaacaaaacaatttcgtaattgggatcaacatgttcaaagaatagtgatgacttgccttgctcaaagtcttgtgagtcttggccttcactcagatccgcaactccctcgggctctacaagtacgtgcgaagaattgatttgaattccattagaattcaaataaaatccaataaagaccaaatcgaaaagcgagcacgagaggcgattgttatatccacaatattattcgcggaatagaactattcaacctaagatattttgtgtttcctaagtggttttcctaagaattcaacaccttcattttagttcttaaataaatctaaattcctaccgtgaattgattactcatagaggctaccgaaatataatttaaatttcgcagttttacgactataattactctataattaaatcattaattattttaaattttttatttttattaacctccctcttctattttccccttttttttcttcctttttctctcctctctttctttttctttctttttctccctctctttcttttcctctctctctccggctcctctcttcctccctctctctctcggctgcgctccccggcggcaacggcggtgaaacaagaggcgggggggagggggggcggcggcggcaaccaccgcgacggcgacgctggcgacggcgatgcaagtgacgcggtacccggcgc

SEQ ID NO: 78899 - DNA, 1394 bp, Oryza sativa
gtggaaagcaataacttatacaccaccacggacggctttgcccaacgtggcgagctgaaccccccaacccgacatgcatatattttttgaaatttcggaaacacaaaaactgatgtccgattcatacccagatggaggcaggcaaggcaggaacgaggaggtcgccgcgccgcccctccaaccctgctcgccgtcgccgcccgccgtgtgcggaagcagaggagccccgtccacaccgcgcctgcggaactcctcgccggcgacgccgcgccctagctccgcctccgcctccgcagattgggaacggagagagagaggagaggagagaggggggagatggatcgagagagaggcggaggtgggggaagtagtctctccacttcctctctctgttcttaaattctcttgggagggagagctcgcctcccattggagggaacacctggcgggttggcgggtccggatccgacacaggtcaagtgcctgtggtgtggggccacatgtcggtgtcagaggatgagggatgtgtgctcctcctgccgtgctggaagatgcttttaattagctcgtgttactgatgattattagttgtagtagctcgagttagttggaaaatggcggcagatgggaaccgtacaaggtagttggttaagtattgtttgtatcgaaagctccaattattgtcacttggtacacaaacagtaggggctcatgccttaaccattctttgttgcgtagggagtacttgtgtagggtaactaatagccaaagcatcacaaatcacaaaccagaacttgacagaaaattggcctttttaaccagcacctgacaaccagccaattttctgttacagcacaaagtacactgttacagcacttgacaaaaaacggtgggcctgatcggaactgctggctgctgcagccgtcacgactgtggccgttttcagctgctgctgtagctgatttttagctctcgcagccgcagcggcggcagcagcaagcgctaccgatctctctcagtgtttgacatttccgacctctttaaaaataaatattttttatacaattttataaagctacttaaaatctgcaaaatttttacaatccaaaagaaccatttttttatgctactgctatttacattgaggtgttgctttgttggcaaatggcaaatcacactgaaactctgaaacccgatcatatataccttgacagcgtgaaatggctcgattaatttctctaggataagaacgaattcgcaaatgctcctcctacggtaaacaagcacatcaccatccagggtgcgcacgtacgcagcacattgcaattaccttttttttttcccttgcttttttgcagctagtgagtggagtagtgaccatacttatccacagc

SEQ ID NO: 78900 - DNA, 5833 bp, Oryza sativa
acaagtatacatatacatatacaaagtttttatacgaatatatatttttatacataaaaaatacatatacataaaatttatattatacatatacgttgtctatacgtatatatacactttatatacatattataagtatcgggcgcctgcccgacctatttacatgcaccatcgaactggactggtaacgaacatcagcaagcttctccaccgtggcgatatgaataaaaaaattgacgttcctcacctcccgcagaatagtaccacctccatttttgaatatatctttttgacatgaaatttgttaagtattatttattttattgtgatttgatttgttaagaatggcttatacatttgcatatctgcagtaaaattagctatgaagtaagtttcatttattttgctttaacttattttatcattcagtttactttaaacattatttttttatctttactaatttgcattattaaagatcctttatatctggcgtgatttttttatgtttacaataaatttaaataaaacgtatagctaaatattatgtttaaaagttaagaacgtcgtatatttagagtaatatatagtgtagaaatgcaagaaaaaaacatatataggcacacatatagcttgtctaattgcagtgaacacaaggacaaaatcaacttgcatatatacattttggaagcagcaaattaaataatcggttagttacaaaatagaaaaaataaaaggaaaaaaataaaaataaaaagcaaggctcctcaaagaatcgtacagtaaggaaaccttttagaatcaagcttgctagcctattaatttacagtcccccaagcaatacgtccctagatgttgcctcaaacctttaggaacacatgaattgaccctacttgtaaatacttacattggatgtatatacacatacatatatcccgatcacataaagcattgatatagtacgtacacctacaatatgtatatatatatatggattagattagcactaattaattaattaattaatttcttagttcattagtcggcatgacctccttgtcatgaccaggtcactcttgagtgttcttttctttgctctctgatgaaattccgatgccaacctgcagccagggcaacgactcccctgccactttcatgtccttgaggtcgccgatcttggctctcttggcgctcgtgctgtccgcttcatcgtcctccgtggtcacgccgccggccgcgtcgttgatgcggctgctcgtcgcggtggtcttgttcacgtggctcccgttgctgtgccctgtccaggactgcaggtacaccgacgccgccgcgttgaggcagagtgcgccgtcgttgagagcggcgacctgctgctgctgctgctgcctggccgcgaccgcttctgccagtgggttcgtcggcacgttaaggtctagtatccgctggtcggtagggtcgaatattgggcgcccgagcgtgagctggtggcacatggcggccatcatggcgtggtcttgggcgacgggctggagcttcgtgagcgggtccgttgcgcccgacgtcagccagtggcatcgcttgtggccgccgagcgcttgccccgacgtgaacacccggtggcagatggagcactcgtgcaccttccccttcttcttgaacggtgagacggcggatggcgccaacggtgtcggcgcgaagtcctcgaccgacatcatcatggccatatccgtcgacgaagctccggcgaggacaatttcacctgcgccaacgccgcttgccgctgccttgccgtcagcatcagcactggcaccgatcgtgtttgcatccatgctgatatcgctggtgatgacatgagaggtggtggccctggtattgtcatgaggagcggctgagacgtgttgctgctgagtctgagtctgactagtctcgttgcggctgctctcgagcttcgcggcgaagcatcctttcaccttcttgtggctggcacggtgcccgccaagagcctggtgcgatgtaaacaccttcttgcatgccttgcactcgaacatgccacgtggcacggtcgagatgtgctgtggcaccacttgcggagcgatcactgtcatctgagccatcatgggggctgccatcgagattggctgcggcacaagaacctgttcctctcctcgtccttgctacctgatgcgcaggactcttggtccgcgtcgtcgacgacgatggctggctgtgcaacacgcgacgatgatgacgaagaagaagagagcatcacgagaaagttggcgaggtcttcctcttcggtagacggagccggcagctgtagctcggacacggagccggtcccgacggccatcactttagcacggcgcgagcgcttccctttcgaccacccgcccgcagccagtgtgaggtcgtccccctcctcctcctcctcgccgtcgttttcgtcgccaccgtcgtgaagcggcggcgaacggagcgagacgtcgaggcgaccgtcctcctcgtcaaggccgcacctgccatgatccagcaacgtcttccacgacgtgaactccttcccgcagttctcgcatgtcctgcagttccttggccgcccgggattggtccgcagcgcgtacatacgtttcgtcgtcgtcgtcgtcgggctcccggctgcctccgacggctcgccaccaccatcgcacggtgacagcgaatgatcatcatcgcggccgtcgtcgtcgtccatcgtgtcgttgtcgtcgccgatgccgtgcgccctcatgtggccgccgagcgcgcgaccgcacatgaaccccttcttgcacaccttgcagtggtgcctgtacgtcagaggaggaggaggaggctgcggcggcggtggcgggaccagccgcagcgactgcggcggcggcggcggccgatggctccccgcgacgaccatcgccatgatcgcgcgcggtcgatcgacgacgctttatttgggcagtgggcaggcatgcggggccggtgcggtcgagatcgatcgctgaaatccaaatggagacggcgagggacgttatatatgggagcccgacacggcgctactaaagatagtggcagtggagcactagaataggcatgcgtccgtggagctaaaccagctacttgaacgggatgccgtggtttcgatcagttgttaccactgcatgcggggccaccactctaatctgtttgctttcttgcgaacgcatcttttgaacccgacagttgcggctggcccgtgaccccgtgtcactcctctccacatgcagataacatggtcaaactttttagatttttaacggcaaagttattccctccgtaccattttaaatgtaatcttgagtctccgtattcaactttaatcatttgtcttatttaattttttaaaaaaattgaaaaacatgggtcacttataaagtactattcatgtgttattatactagtagctgtggacagaagtactatttaaatgtaatctggagtttccgtgttcaactttaattatccgtcttatttaatttttttagaaaaattaaaaaacataagccacttataaagtactattcatgtgttattatactggctgggatgttatattccattatctaaaaaaaatgtgttattatactagtagctgtggacaaaagtactacttctcccccctaatataagtgattttaacatttttcttgcactgtttgaccattcgtcttattaaaaaaattagaattattatttgttttatttgtgacttactttattatccaaattactttaattacaactcttcgtttttttatatttgcataaattttttaataagacaagtgaccaaactattgatgtaaaatgtcaaaatctattattttagactacggagggagtaccataccagtacgataaagtacggtaaagtactactaccagctgtggacagaagaaaataagatgaccaaaatgcggtatgcagaaacacacagagggtagttctgggccaaaattgagggtagttttggcccagataaacctcctccaagaaaaccaagtccagcagcccatatttctcatatcggcccatgaagctagatccagacgcttagtcgagccttcgatcctctcgggtgggtctacggcgcgttcgttctctctccatccattcacgcgattgacgcgagcgagggacgacgactccgacgatcttactccggcgaggcgagacgacggcgactgccgaccggcgagttcgctccatcttccccagagaaccccctcattctccctccggcgagctttcttcgacggagaagacgagacgcggacgagcgacctccctccggcgacgacaacagcctactccggcgagccccctcctccctacggtgagtccccttctcctccctccggtgagccgctaccgcctcgccgcgcgcccttgtccgccgcccaccgccggtccgccgcctcccagaccatccctctaagccccgatcccccacttccccctcccaagcgccaccctccccccacccccacatccccttcgcactcacgcgcagcgcccgttgaccgcgccgctgtcaattcgccgccctcggctgtcgcggggtcgcgcggtcgcgggatcgcgccaccgcccttggccgtcgcggggtcgagccgctgccgtcggccgtcgagctaccccgagaggccgagaaaccctaaggtaattgttgtttgcttcagtggtgctgtgatttaggattattgggaacatcttttccatttgaagccatggatggttgattgattgattgccagtgaatccagttgtagtaaatgtagatcgaaagggcatcactagggaacaatagaaattataaccatatgtttcaccaattgaactttgatttttgaaccttgtgaagctttgtacaattgttcttttgtataattatagtgcatatgtttttaagaaagtatgaaatgactagtactgaatttagatcctccactatatattatccaactagtagtttagaactacatgaaattaaacatattaggctttgggttataaaaaaaaaatcaccccttcccatttcgaatacccaacctcaaaatcctgggtatgccccacctctaacccacaagccacaggcgtagggtgccggccggtggccaccacacgcacgcccagccccagccctgtgatcgaatcaactatggttgtgatttgtgcatgtgaacaacttggtagtttaatgttaaatgttgttgccattgtagaattggtaggacttgatgaatcatttggctttatttttagggcacacttgatgttgatgatttgtcattggatgtacaaatgatctgtctctcagtctttgcaaagcagaccacatgttatttcatggttcatatatggttcatggtcccaatgaaatgattggtgagcttgtcaaagtaaatgtaagaccatcgagagtattgactgatagtttgatgctatgcttcttttttttttttttgctactgtaccagtcacttattttgctatcttttgtgaaagggtacaagcacaactagaatagcttatctgttgatttttttttcctatttgcactataatctagcccatttcttcgtatttttggtaacaaatcttgtcttagtcagtgaatgtctgtgatggtccattcagatattaggatggataaggtgactcaagctgttgagaacctaaaggaggaatggaatcaagctgttgcacagcttgaagggtgcattgctgcaattgaatcatgtgggaagatgggaaaggggacagaggaagcaagttcacttccta

SEQ ID NO: 78901 - DNA, 4568 bp, Oryza sativa
  unsure (1)..(4568): unsure at all n locations
cgcgaatggcaacggcgcggcagcggcnacacggaatgcgagtcgncggcacggggctcgggncaacgcgacgggcgncagtgcnnacgcgcggggcgcgaggcaacgtgacagcgacggcaccggcaacgcgacggcgacggcgacggcgcgcggcagcggcggcgagttagggcaagagaccgcaatcgagcacctatggggcaatgaacagtgacttttcctatttaaccccattttagcctatttattatataaatttgattctataaatcctaaattttgcataaatgaagtatactcgatatttgtgttatcccaaccaatggatccactctagattaattgtacccatattttatttttatataatttacttgattttaattagagttaattctcattccgtcgtatttaaatttaatcgatacaaatataatcgcggtaatattttattcatttctatcctcacctcatctttattttaaattatatcttgattatttcttttgccaatctaacttttcgggtttaatcctaattaatgattctttattcgcgatctatgaactccgaaatcaaaatccaataaaatagtcgaacaaaatcggcatgatgcaatttatttaaaaagtttttgaaggcccatatttttggagtttagatttttgtcggtcgaattttcagggtgttacacctaggcaggcgagcgagctcaagctccactcattgacaaccctaattgaaaccacctactaaaaccagtcggaccgcctggttttttcttgttccaaaaaccagcatggtttttcttggtcaaaaaccaatcaacgagggattagaccgaatcgttcgcttcactctttctacccgacttctcctcggcccgagcacacggcgccatctagcgcctaacgcagctttgctaccaaagccccctttgacgaccaccgagcaccaaagtcgtcacgcccccactgaaaatgccacctccattcccgacgctgctacccatcctagagggccgccatgcacggaagctatcgtcccgcttcattgcctgctaggcctcaccgatgagggtgcgaccatcactgtgggcctcttgctgaatgaggatcccgacgcccacagggcagtcccccgacgcaggagcagcgccgcctctgccgccaatacctgtcgcctcgacctcctggagcctgccacgctgagcaccgccacctaaacatcccgctcacccgaagctatgcaccattgctgtagctcatcactagcacaccacctttgcccacgaaatcaggattgatccgctcttcactctgttgtgtttgattgcaatcccatgaaacctttgatgagcttatttgggaaaaagtgactccaattccagaacgaatcgtactcctcgtccgatcccctctcgtgtgtaacgcggtctccctttctatctcttctgtcgggtgtattgaaaccgaacccgtgcttgactccttctctaccacgacctcttccaagttgagtcctccaccattccaaaccaggtttgctactatcagcactgctttagtctttgccaccggctggtactgtcactgcctccgttcttctgtcctgccttccgttgcatgtacaccgctaagtagcaatacaccgttaagtagcaatcctccatgcagcatcctatcataaacacatccaaactagcctttaggatccacccgccccggcttctgattgaaagccatcaatttagtcgcgaaccgaagccgacaaatcgcatgccatcttcccagccaccgaacgacccgagcacaacgtctagccgtctccatgtcgaacgcagctcaccaaaaggcctgggctaccctactgttggtattttttaatgacattactagaaatattcattccaagcaatggcgcagaaatagtcctggtatatttatggttacagaagtaatccgcaagcgcacggatataccattgtagcatttcagcatttcacccgaaagtattccaaggtatcgtatttatttaatcccaagggaagattgtgaaagagagaaccacgctaacatatacacatatatattacttgcctttatcaaagcctaggcaggggttaatttaatatgagggtagagtgacacgaagtgaagcttatagatttcctcagataaataattctaactaagtagaagaacatatagaaagaactcatttcctatacttctaatagagtaaagtgtacgggcggtccttaaacttgtagtggtgtgtcacctagatccctaaactcccaaaatgcatatctaagtcatagaacttgtcatagtttgtcatctagatcccaaatcaccacaactccttcaggatcctacgtggtgttgatgtggcatgccacacggacatgacgtggcatcattttgactaacaaattaatgggacccatttaaattttttctttttctttttttctctttttttccctttcttctcctttctctatgacccgagcagaagaaagggaaaaaagaagaatgagaagaaaacgaaaaagaaaaaaaatgaaaagaaaaaaaaagaaaggacacgtcacgtccacgtggcatgccacatcagcgccacgaaggataccagaggggatgtgtcgatttgggacctagatgatacactttggcaagttctaggacatgatatgtagtttgagagtttagagacctatatgacacaaccctacaagtttaaggaccgccaatgcactttacttgttcgaatatacactcaactttactctacacttgctagtatacaatcatgtggccattacctcctaacagtgccctcttggtgtttcgagagaccacccagggttgccaagttttttacgataacctgtcatggccgtccaactggggctaaatacagaggagtaccctccccagaaaattgtcttaggaatatatactaacgtggaggaatacccgtactgagctgtcaccatcagcggcccacctctattgtcccgcaacatatataaccagataatgatacttacgaatctaagcaccgtgcttacattaataaatactactctacacctctgcagatgatatagagcaaccgataaatcagacactaaacccacaccgttgcacctatctggtaggctacccacacaattataccaatacaaatgtaaagaacgagtagtactcatactaagtaaagtaccgagaatatataaagaagagtatttcattaattcggagagtattacaaaagagaatagataaactaccagagccataccgaaattcctccgaaagctctgaggactccaagaactattctatactacttccacttagcactaaactactaaataaagtatgaagaggaatcttgagattgcttgagtgcgttgagagagtgaatgagctcctccttttataggacagttatgggggttgtagccatgcgagatgtccattttacccctgcaaccgtcattaagagagcatctggagcgtacacatggagggccaagctggttgggtgctgccagggttcgaccgaatcagggcccaacaggcctccagcttcggtctgctcactgacaggtgggtcctttaggcggttgtggcagttaaagcagtttccaggactgttacacttgacttgtgggccctcttatccttaaacttgcttaggagtgaggtttcttcactttctctttattttatttgctaaattcctgcaacacattattctccaagtataactggaactatattattctgaaataaatatgcattgcaagcatagctaattctctattattttagttatattgacggtcaaaatttatctgtaatgaccgtcaacacctacctagagtgttcgattccactgaccaagaatgatgattgcctctagcttcaatcaacccgagtgtgggcctcacatctccctattgagagcagctcaccagaaagcccgaatcacccgtctgaagtgttcaacccaccgattcgatcgtcaatcacttctaccgctgtcaacccaagaaccacatctggtcatcttcatgttgaaagtagccatcaaatagttcagaccgccgcctgaagtgtttgacccaccgattaaattttattgatcgctgccgtgctccaccttacgcacatgtccctccctggacataaaccgcaagcggcatgtgtggggcaccccatcgcctctatccatggacctcccatagactctgattccacttggtacaaaaccagcccataaattaacatcggaaaccaaacacagaagaaaacattataggagattcaaagtttcaaacacaatgatgacactaaggagcaattgttaacgaggtttagccgaagagctgcaccaactcatatcccacactggcattgcaccctacacgggtgctcctcggtggtcacatcatgcatgggtgacctggtgtgccgccccataacttatgccccacaattttacttggcttgttggggtttagaggtacctttggactgtgtttgggg

SEQ ID NO: 78902 - DNA, 610 bp, Oryza sativa
cattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaatttttttttccttatacatttcctttcctttttttaaaaaaaaaaacactgtgcatgcactgtgggctggcggcctgccttcacgggccgccgtgccccgaacggcccgtgggccgcgggcgtgccgtgccggcacgggcacggcccggccatccacgggccgtgcttgggccggcggctctgcacgtgggccgacacggcacggcccgtttcatcagccgtgcctaacgggccgtgccgaaacgggccgtgccggacc

SEQ ID NO: 78903 - DNA, 1353 bp, Oryza sativa
ctctgcgtgttgcatgatatgttcagtttacatggttgttcattgtgagtatagcatgtggagaagacacagtcacttgttattttaattaaatatttctttttataatctatactaaaaaaacgttttgtttactgcttctattatatgggcaggagtcttgtactgtcaaaatcgaacaaacatttgattttgaagcttgcagaatagtaaatactaactcacctaatgatttaggacaaaggctgggatgacatcggctgcagaaagtataaccgagagcctccgccgatctcgccagttgatggtccaggttagtgcacctgttttcaattgatattttatatgctaatgaatttttgctcttaaattttaatctaactactatacatgtttacaggaagtggaaagaagtgcaaataccttggcaacatttggtatgtttcttgtgttcctaactaaatctgtgtacaagagccaagaggcgcagttgtaattttattctaactattaaggcgaagttgtaagcgaactttaaaattatgcagatgaatcaacaagtgttcttcgtaaggctgaaggtgaatatcaaggacaccgctctttgctgatgcgtactcgtggtttgctatctacaatgcaacggcaagatgttcttgataggtaagtatcttccaccaatctttcgtatggattggagatgtatgatgtgggccatgtggccatgcggtaaaaattatgttttccgatcaataaagatcatacaaaccacatcttcacataatgcatgtgtcaactgccattcaccttttttccacctctggatgaactcctcaccttgttgcagatcatctttcattagatggcaattaaccgttgtaatctagcctactactgcagaaaatacatatcttataagactttattaggatcgcccagttggccagttctctcttatcagactgatactgcaaaatgcattgacccagaaaatgcatttggtgtggccagggtgcattctcttaattatctttgttcgaaggagtacacaagacagtccaataagatcctgtgcatagatattgcattactcattcttaatactttcatttggaaacactagtaaaatacttgtgcgatgcgatgatttatttaacataaaacatgattatgagttctcttggtaaaaaaaaatcctgcctcatgtgtgaaaaagcaatgctcttcatcttaaaaggcaaaagtaaaagagtgaagcttcttgtcttgctcaaatttcaaatggatggtacactgaagagagcaatcaaattgctcatgtggggtcaaccaatcccatgggcccacatgttg

SEQ ID NO: 78904 - DNA, 2416 bp, Oryza sativa
cattattttctgtatacatctcttaaaaagttagggagttggtggtggttcagattcaccactcaccaccaccactattcctttttaaaggagtatagatagaaatgctcttctcttttaaaaaaaggtggaaccaaatgcgcatttgatttaccaattacgttacttgatgattccaattttcttatctgccaaacaagtttctgccggtgcaatacttagtattaatactattttctgggttgtaccaattgctaattggctttctttaccaggatcatccttaccattggttttctcattttctccttggcggtgctatatgttgtctcgagacgtattggcctgttgacactgcaaaggaagctggccgatgccatcagatcaggctcaatatcagctgaagacgttgtagcaaaagtcaagaatgtgcctgtcccagcacctgctgctcctgctcctgctcctcctatttatgatgaactatgatttacttttgtgtattgtttgtacatgtagattcagaagaaaatattcaccatcattgtcagttttatatagtaaactttaaaaattctgattaaggtctctattaactttttttaccgaggaaatgcaggagctgtgtcatgtgtttcaagtaatatttgcaaatggaggatatgattggggacggatgttgttctcagccttcttcggttaaaaaatgtgttgattgcacagttttccaatctcttgaaggaactaattttgactcaaacggtatttactggtattgcgcatccatctgttcgacatgtaataccagcgaatgtaaggctagtttctattgccaaaatgtatttccttctataaccttagcgtgatcagtaaactggagtgaagttttgacaaaagccaaaataaacacggtgtttttcagaacttgtttgactttctattgttgtaggagagtatatatcctgctagcttggtaggtgcagatctcatactgaaattcaggattcaggtcttgcaaaaaattgctgggaataggatgaagcggcagaagtcgtgcaatggatgttgcaacacttagtcagactgctgttgatcaactgatttgattatttcaagcatgaaagctataaaaaaaattctgaaaaagagcaccagttcaagttctgaaataggagtaagagctaattgaatttgagctaaatgctaaaaagttcctagagcattcccgccaccgttccaccaagcagggcctgacaaattaagcaccgatgcatctctgagcctctgaaaacacaacaactactgctgcaaagagcaaattttgctcttccatggcatttgagaattgtttccgatgcatgtcttccatgacacttgagacctgtttcagctgcaagcaccacagaaaactaattttggtaaatcaacacatgagctccactgtctctgatgagatcgtatcgtattcagggattaagagagagtattatatgcatgccagaccatgaccatccatctctgcagttcaccgactcaaaaatactcagggagaccagctactccgaaatggccctgtggcctgggagcaaatgagctactgagttcaattggaactgggacaaatatgacgaatttctagttctctacagttctacttcagcgagacattgagtgaagatgaagattaagtggttgcacgtaaaatgagaaagtattaacacatgattaatttacttcaattattataaacttgataaatagatatattcgatattttaaattaacttatatttagataatttttgcacagaatatatcgcttagcaatttaaaaggcgtgtgctaccgaaaactgagttaaaatcaaaatcttaatcagaaaagaacagggcctgagcgaacgggggaagctagctggcgtgtgcggcacgcacttccgcgttaacgctaatgacagtaatttgaaaaaattgtgaagattttttttcggagatttttttttactaatagattaaaaaattaagttagatttgaaaactttcgacttaatatttaaattttaaagtcaaattttgaaaactttcaactcagattcgaaaactttcaactcgagattcaaaaactttcaagtccagatttgaaaatttgaaaactttcaacttgatgtttgaaaatttttaactcgagatttgaaaactttcaactcaagattcgaaaactttcaatcccaggtttgaaaattttcaactcgagatttgaaaactttcaagtccaaaattaaaaattttacattcagatttaaaatttactagtaaactaatcacttgtaaaaaataggaaactaatggctattaaactaattacgggttttttctcctacccatatggcatcaaaactgcaaaggaatgaaaaaaa

SEQ ID NO: 78905 - DNA, 2767 bp, Oryza sativa
tgtcttaggccctatttgtttcagcttaagattattataatctagattatagaacagattactataagctggattataataagtcgacatagaataagctgctagctgtttgtttctctgaattattatatgtttgttagttgttagtcacccaataatctaaaataagcacatttagagtagcttaccagattatagtaatttggcttatagattataataatctatcataataagctatatgtttgtttcagcttactcctaataatccagattataataatcttaagctgaatcaaacagggccttagacatacgatggggccatattggcattggctggctgggtgcggagcagcgggttctgactcgcggccaaatcgaggtatgccacgtgccatagctcatggtaatgagagcttcgtcacttccttgtgttaaccttaaaatatttcttccacatatatgatatacaataagaatcaaggatcataaatggaacataaaaagtctcataaataaataagttacaaactcattgatcgattctcacaaaacattttattcataaatcaataaacatagtatgtgatacaatcaactctataattagctctagagcatatcgctaacagcggggacttcagggacgacacatctcgttaagatgtttgatcctgttggcgttgtacctgctcctctcttcgctggtgaggagatcgacgatgcaatccatgtcgaggttctgcacgctccgcgcagcatcgcaacatgcagaatgtagatctgggaggatgatgtgggagcccgcagtcacataccccctgcactcgtgcaggatgtcctgcttctgggcctcagtgcatttccttatttttggttgttgatgagggggtttcttcttggtatttggctgcaccacagcactcacactaattaccttctctgcagcttgtgcgctagcttgttgcgcaacaaggaggatgaggaggagtcctccggctggtgccactctccaggagaccattgttgtaagaggactaggatgtagattactctgaaactttttttgtgtttgggactccaagatttttgacgcttttataaggagagtagagcatccatcctgtgatatatagctagtttcatttaatgttggagatggatgctcaaaatgtatccgtgcatttaagtctagtgatagatagatactctttcaaaattaattaattaatcgaagttcagggaaccagcaagtcagatatagtatatctctgcttcatttatgcatgggaatccatttctagagtattagtaattgtccatggtgcttctatatattgtgtattgcaggaagaaaagcatttccattctctaaattaataagatttttcataaccttcatgggtatttatgtgtgttggacagaaacaagatggtgcacatgcatttattatttttgtagagatgaagattactattcctttcttcccacagtttatttggtgcttgtggaaagaatgttgatgttacctagagtcctagagtgggtgtgaacatttgtttcctataattcttcataatgtattagtcttaagctagaacatccggtcttatggatagtcagattaccaatgttttcggcccacacgaaaatagcccatgaagggaaaatcacaataaccacactttccacaaagtagatacaacaaactagcaggaaaatagagcacaagctatcacaaccagccccccataaagagaatagcaacacatcagcaaaatggtttggatccaatgatcttgttgaaaggatactgttatcaccttgggggggtgtaggcattcttcgcagcggattagtctcatgccagaactttcggtcttatggatggaacatctacctcgatcctgaagctctggtcaataggtaaatggctcaccaaagggaaaccatggcaagcatgatttgcctagagtagatacaatagcgtgtcctctaacgctgtagagatgagagatgagtagatgacaagtaacagatagttggaaaggtagagggcaaagagataaaaaaaaagatagaggttcacgctcaaaacagaaagtgggagatatgtaccaaaaaagaactagagtatccaggagatgaacagaagagaagccacatctgtctatcccaaagttgggggattacaagagagagacgtttcgagtctccgatctgtttatcccaaagttgggggattacaagagagagacgtttcgagtctccgttagttacagtttccctcataaaaatgaaacgtcggaaaggagagcaatcgttgcctcgcccgcttgccttggcctcagccacggcccgcacttgtctcagcatgtgcatgtggcattctcaccaccacctcaaccgctcaacatgtgctcttattagcagtctatttaagttgaggtcttttctcattggttttcaatgtggtattgatctcttaacaataattgtgggcccataaaatttactatgattaatttgggtctacccactttaattctaacaaccacatcattcgagttgcaaattgatctctgaatattatgaaactaattgtgtactcaattgctgcacctaggactaacatgtcttggtcgaagcaactatatatacatatgtgtcttacgtgcatatagttttaactgatcgtgtgtactctcttaattgttgttggtaaagtttattggagcaagatcgcttaccatacatttggca

SEQ ID NO: 78906 - DNA, 2112 bp, Oryza sativa
  unsure (1)..(2112): unsure at all n locations
gccacaattggnacctctcttgcatttacgcctgggtagcttccnnnnnnnnnnnnnnnnnnnnnnnnncaaggcaaatccaagagcaaaatatgatctatttttcaaatcatgtgaaacattgatatctctaatttttgaaatttcatgcatcaaaacctcacaatttttacaatcatcatcattaggaataagagatttcaatctagcaatttcagcatttagagattcaatcataaacccttgttttttatacatcttctcacacttcttattttttgcacttaaaacaaaaatagcttctttaagagaactcacctcattgtcttcacactctgaatccgattcaccatgtgccatgaagcaaataccggagatgttctttcccacgtcttcatcttctgcactctctccatatacatcgcttagtggctcaaaagcggcgtagacttgattcaacatctacttgagattctccttggttttccttcccttgaatgtgctcttggacttgggcttgtcgtccttgttcttgtctccaccattatctttcttcttgcctctcccaagcttaggacaatgcgaacgaatgtgatcaagtgctccacaatcaaagcaacaagttagatctcctcttttcttgtacatgacattgttcatagctcgagaaatcttgtagcagccaaagccaaatccctctcctcgaattgttctagttgctcatcggacatggcattaatcaaatcaagagcgatagaatttgacgaagaagcaccaacatccaaagaagtcgagagagaaaccaaagcactagaattagaatcaactttgcgataaagaatattcatctcatgagttttgagttttatataaagtgaatccaaagtcaaagtggacatatcaacagacttttgaatatatgcaatcttcatctcccaaatagacatgttaagaccattcaaaaagtggcgagaaatctcatattgtgagtaattagtgtcataagccgaatcaacagatctaagatcactcaaaattttattaaatctaccaagatagtcatccaaaccctctcctggtttcatctcaaattttacgtactcctttttgaaaagaccttgacgaagttctttaatttttgtagttccttgatgaaagtttttgaaagcattccaaatctcattggcggtttgaagatgtgaaacacgatcaaaatccgaacgagaaattctactcaataaaatattgcgagctttgcaattgttgttaaatttagttttcaaagcaaaagtatcaatttgttcaagaatcacataaggctaagaaaccttttgacaaacatcataatcttcagccataatgtaagattgcatcttatcacaccaataagaaaaatccaatccatcgaaaacatgggacttagttataaacttgttagccatggctaaaactttagatcggtcaaaatctaaagaagaaaacaagactttgataccacttgtaggatcgaatagcaagaagtaagccaaccagagggggtgaatagttgtagtacccaaaaaccaaaacttttagtggaattaaaagttaccctctgatccgatgtagattggtctgaccggagtagatccgccgatctgaccgcacctgtgctgtcggtataaccggtgtagatcgcctggtctaaccgcccagaagtcgcctctgcctcctgtcgccgtcgccagtctgaccgccatgtatccgccggtctgactggtgtgttgccgccggtttgactgccagtgttccgccggttggactgccgaaccagagcagatgacaactttattacttctgtatgtgtttacaaagtgcaacaacaacactcctcacgaaaatatcgattaaactcgaaaccctactattctgtcaactcaatgctctttaaagcgataccgggaggccacactcttcctctctatttatacatgaggtaggcaggctaaaatcttaaaacaaaacttgtccagaaggtcttattccacttagaaaacttcttgtacagaaaacaaattttcaaaactcaaatggtccaaatttgggattcnttcaaattcgaatttgattcca

SEQ ID NO: 78907 - DNA, 1472 bp, Oryza sativa
  unsure (1)..(1472): unsure at all n locations
tacaagaaaccaactttacaaactccaattgtaccaaatttggactccttccaaattcgactctgcatcccatacacacacaatatctccatcgtatgccatatggaatcttcaccaaccacgtgcattcatcgttagcctaagtgtcccgcatgatatctgaccgtccggacgtcaccatatctcaaagttgactcccgatccatcaccggcaacactcccccgagacatcaagattacctacacatgaatcaaacaagaaaccatattcatagaccaagctatctccaacttgactcattattagcaaacaacagtattacatacgcatagtatccatcttgaagttataaacacaaattatccacggatatccaacgaaataacctgaaaccgaaaccgacacagaatcggccggtcagaccgtgggctagccggtctgactgcttgaagcacaacggtctgaccggcaaccactacccggtttgatcggaccaaatctctagcagtacctattcatcacatgtaaagccaataatctccaaatatcaaaaccaataatctcatatgctaattgttcatcacagaataagagtcaaacacactgtgattttgcattatttacaaattatttttcttttgcaaatatgtcgtttcgcttattccctgaatgaggcttggcttcccccctttttcgttcagacgttcagtgatcctgaaacagagcacgaaagtaactacttcaggacctatagatagccataaggcccgaggccctattggcccggcctaggcacgacacagtccaactcgagttgtgcccttgccagcctggcccaatagtgatgtcgtgtctgggctgctatctcggcacgctgggccgacacggcctgacacaaagtttagggatgcgaaacagacttattttcgaccatatgtaagggcacaacatggcatataattggtggaacacatagctatgctctatgtttgtatgtacttgtttatttccttcattgaaactacatttgtaatcgtggacatcatattgtggactctattgttattatgtactctattcattcacttgcatgtggatgtccttaagctttcaaatgtcagattgttgattgttgttgttgaattattatgttatgaactgttgaattgatttgaagtctgtaatacataaaaggtcatgccgattttttctattgtataaccacaagttgtgttttcaagtatcctatatatttttgttattatccccaaattctacagacatttaagtgttcctccatttagttttgcattttattcactttgttcttctgtcagtacagcatcttgtggtaaccgtccatataccgcagtaaccgcaccttactgcgaggttaccgcagccaaaccgcaaaannnnnnnnnnnnnnnnnnnnnnnnnnnnnnnnnacactcaggcgcttcaaaatttg

SEQ ID NO: 78908 - DNA, 505 bp, Oryza sativa
cacaaaacattaacaaatctctgtggaagttcaaggcagccctcaaagttaagattttttacttttgtaattacaccagggtgtagcgtaaacgaaggacaacttagcggaacgtaatttgcaaggatgcaggaaaaagctggttttatcatataaatcagacaactaagaatatctttcactggtggagaagtgctttttagtcccggttcgtaacccccctgtagtcccggttttcaaaccgggactaccaatccgggactaaagatcgttatctttagtccaggttcaaatacccgggactaaagatggtgttaccaaccgggactaaagaaaagggatctttagttccggttggtaacaccaaccgagaccaaagagaggtagcggcggtgagatggtccttttctttttttttcttttttattttctctcgaatcaagtgggatacatatcccaaatcaaaccccaaatacccaaatcaaatcccaaaccaaagtaacat

SEQ ID NO: 78909 - DNA, 5681 bp, Oryza sativa
atggggagagttaataatgattttaatcctttagtcctcttggggacggttgctactaccagttggtctttatggctaagcaggaacaatgtgatttttttaaagaagaaagtctcgtctcctttgcaggttatttatttagttgtgattagctggctccatttacggtctattctccaaaagctgagttaataggatttggttgttgtggctaattattaacatttggaccaagtgatcagggagttttgattataaaaagtaatctagtctaaaaagtgatagtcattagcgtatatgttttgtttataaaatattacgcaggctgtgtgcaaccttgctacgccaggactgatttcaggatggttgtattatcttgaaataagacgatttcattaaaagcttcctttaacaaaaaaaaaggctaaccatgatacaaataggagtggtcaacttggattttgtgtttggaaacaagaataactaacccattattatctagaccaataaattaataatttccatgccttcgattgatttttacttgatctgaaaaaggcacaaaattatatggcatgcagatcattttatagtagactgggaaacctacaagagatctgatcaatgataaaatttgccacttgtaatgtcaactcatctttataattgcactctaaagattggtacaattggcaaggtggtggtggacttcgatagtctgattcctagaactcgaggcccttagagttcacatactcaagatggaggaagagtcaaggattgaggtgttgaaccatctattggagaccatggcgctacgacggtggtgtaactggaggtggggctatgaaaatcatcgggcggtggggaatcagtgaccatgcactgcaggaggattggagtaatggaggaagaagaatgatggttattttattcttaattttttttactagaaaaatatacatgcatgcatgctacgtcagtgcaaaaccacctcaaaccattcttgggctgtttaatttctatctgggttggatacttgataagtgtttctaacccatttttggagttgaataatgaaatctatactttagcaacactagagggtgaaaagtagaccttttcctgtataaaatctacatatatgtgaagtttttagtactaggggttaatctttcttaaacgcggggacaatgttttatatattgtagctccatcatattaaattgctatttttgctacccactaccaccctcacctagggtgtcactttactacctctatccacactcgacttgagaataaagcaatctagaccttacatttgcatctaatggctgaaattatttgaatgacattggaacaattatgcgtcaattgacataatgaaaatgaagttgtatccaatttccgtcatctaagtgaggcctcacactacatcaatctgctgagactatatatgtaccaaatggttacaattgttaactgatctcatattatgaaactgataccctctcatcaagccacttaatgatgtccaaaaatacaatgtcaatgttgcttgcgggctcaccagatgtcagggcgtgacacatccctgggtacagtttcagtgttttgtccttgctctgagctgatgtatacagttcttcacttactgatggatctgtgacggcatcatcaccaccatggacaatgatgaatggtagtgtaacctgcatacattgttgtatattgtagatattttattgaaaagtacttttgacacttgaaagtacggacttatatgttaggcatactcatgtcaaataaacacactcaaaacaatatttttacggacctgacaaagctattttcacaaactcatgtcctactaaaagaattttgctcatggtgattggtgactttcaagcagtatcaacaatctactatacgcaaaccagaccaaattgtaactcatccaggacgtgtacatgtaggaatataattgaatttagttaatgggatggttcctaggtattctgataaatcaacatgaaccaatatattgtagaaccacaccgtaccttgtcaagagtgctttcaatatccaagcttgccataaaaagttcataaccagtctttaacctaggccttcctttatagcaatatggattgtttcttacctgaaagacataacaaaattactgaaaacacaaaaaataaatatgcatacagttcaggtgattccttatcatagagaaaaggtgtctccattatgttccatctttcattagttgaatacacctttcatgtatttttcctatacctcttgacgccactcctcgcttttaattgccttatcaatgacatcttcagtaggaataattttccatgtaggtatcacgttgctaagcttgcttaggattgttatcacaatgggacgaggcttcatatcttctacaatctgaatcgaagttaacatcaacaattatattacataatgatcaacttaatatcgtgtactaatacatatttccaacagtcaattcttgggaacatatcaagctgtgaaatatatcttcaaaatatgaataattaaaagaaatctttagcatttaaccttgcacatgggggcaaccaaaatagccccatcccaatttgtaggttccttcctatgtagcatcagcacaatagcgcctcccattgactcaccaagaaggaacttcttttttcctttgcactctcctctttctagaataaggtgtacacatagaaatatttacaatagaaatctttgtaaacatccaccaatcacatatactaatatagacaacaatttctataaaggtcatatgcaagtgtttacgcttcacaaatgcacaattaagggaccatcttcattattgcaatatgccaatggcctcaagaagtaaaaatatggaaacatggagtacattttacaagtactaaaagtaggaacaaagaaatgttagggttttttttctgctaaagggcaattgtaattgttagataattctaaagatatatcataaaaaacaatcttacatgggagcatcgttctggaaaaggaggcaaaaaatcatagaggataataatggaattgcttatagttttcagtgactcatatatatttgaaccaaatatattatgtgtacgtggttaaagcatgtggttacaaaaaagaaacaaaatatggtgataccaagtaaaattttattcaatatatatactatttggcagtgacaactgacaagtaatttgagataacattttgttgctaatttatatatatatgtttacattttttttgaaacaacatatgtctaaatttaattaaatccacttttataaatacattaattaaaatatacatgagcattgtagcatggttgattttctttctcaaaatacatattttgagtgaccaagcatttgagaaatcaaatactctctccattttttattataagtcgttttgacttttttcttaatcaaactttgttaagtttgaccaagtttataaagaaatatatcaaccattccaacataaacatattcaaaatatattaaatgttagttctgatgaaactaatttggtattgtagatattactacaatttcccacaaatttggacaaagttaaataaatttgactaagaaaaaaaatcaaaacaacacaatatgatatggatggagtacttagtgttctcttgtaattctacaatttacatgaacaaagaaccatatcatttttttgcgcacacaaattgtaatagatcttttttatgccttacaggatgaccgcagagtgatagagactaaacaatgatgcactcaaggactaattaatttttttacaacgatacactcaaggactaattaattttttttacaatgacacaatgtgcaattgtgaagtcatttcaaaattttaaaattcaaaaacaatttcaaccttggacaccatcaccatataagtgagagaaccaccggaaatgattccgcatctaagccgaggttgacaaaaagtgcaaggttttgatagcttatggttaaatagtgcattgtttttaagtttagtatgtctagttttacaactttatgaaacttcatcaggatagcaaaattatttgtttcctaaatcaaataatgagctagctagctagttgattaaattatgctgaacataccacaaacacttgcaaagtagttcgagcaatcaacaacaacatcatcaaaactattgatatagccttgagtccttcggacttcccatggccctgatagtccaatccgtgcactgtaaatccagcctttggcaaccgaacacctgttcctgagagtagcaaatcatcaacatattgtcattaaaatggtgttttcaagtagctaaaagaaactgaatgctaaacaagtacgacatggtattattatttttcaacatgacatataggcatactcttgtggattgtttatttaaagttgtttaacaacattgtgtgatttacctctcattgaaatgctgcattccatggcatatcctaaacattgaaagatatgaaattgtaattaaattagatggtgtaaggaaacaaattgcttatatgttggaataattgtatttgaagttcaaatgtataagagtatcaatagataatgttaccatggcataggaagattagagctttcggttcatggtctaaaggactccattggcatgcaaagagcttcatccctcgtttatttgtaacatattcctacaaccaacataaaatttgaatctcacatcccttgataaaaacaaaataaaatggtgatggtgtttttcaaaattctcttattcagcataatacaagatcgatatcaattgtaacacacaagatgtatcacaagaaaaaaatggcaactggaaacgaactaacctcatgatatttgaaaccatcatctgccattttctctcaatggaagaccatgggaacatatgtagttttatgcaactcagattaggaaatggccaaggaccaatatttttttaatagaacaatcgaagatcattagttactgaataaaaaggatagtttttcaatataatgagaagtcatctttgcgtggtgttccttttgtgcatgtgcaagatcttgaatgtgtggttgaggatgaaattaacctaagtttagtttacattaccttccatagtaaggtcatactaaatttggagcattggccatatacatttttttacaagaaagcattggccatattgaaggcatgtcatacaatcactagcattttcgcaagaatttatagttggaattctaagtaacaacagaggaagttgatggttgcatcccaaatggaacatcaaagaaacaatgcaagttgtatgcataattaccgttaactaattttgtatcaaattctaaattaatagaaaatatagtggcagatccagtattctataattgtcctaataaagtgtttcggattgacctagttacaataagttcttatagtcatcattcttcaagcatgatccaatacaccttttcacaggatagctaattacacctgtggcatcgatgggcccaagacttcccattgagtaacaatgttacaatgtggatgtaaaagtaggttggggcacaccttgaaccaaatacttccgagcaataacctga

SEQ ID NO: 78910 - DNA, 3545 bp, Oryza sativa
catcacagggattggcattagttgactatgaaagttttgaggaagcacaaactgcaatcaaagcaatgatgggactcagctgttaacaaggactgtctatgttgactgggcattcagcagaggtcctatacagaaactcaccagtacaaggtgtgttattaaccatgcttttatcttttgcatttgctgggatagggatttgttgtgttacactggcatagggtttcatttactccacaatctcatcaccaaacaatgtcttgttcttttttctgtttgttctgaatctaaaattctaaatctaaatttcctggcaattgccctttcgtgaaatcttgcatgcaagatctgtaactgtaacatattgtttcatattcagtggctattttttccctatcctagtggcctgtttatttggtttggtttgatctgggatttgcataagcagttcatccagacttgtggaattttgacataattagactcgtgtaaacctgttaacctggaagacattacctatgtttcatactccctccgtcctaaattagatgtcgttttgactttttgcttgcaacgtttgaccattcgttttattttaaaaattattgtaaatataaaaaaggataagtcatatttaaagtacttttgataataaagcaagtcaaaaacaaaataaataataatttcataatcttttgaataagacgaatggccaaaagatacaaccaaaaactcaaaatgacaactattttgggacggaggtagtaagtttttttctgcagaaggtccagtgtttgtgaactcatactatcacatctgatctaggttgagtgttaactttattcgatctttggtgtgcaacttcaaccactatttttctattataatataatgataatatctaataaaattataatattgtaaaagtacttataaagtagtaaagtatacctatatgttttctacgctttcaaactatatatttttagagatgatggtcaaagtttcaaaagtttgaccgaataaagtcaacaatatcatatatttaaatacggagggagtactaaatagtccatcacctctagctctattgctgtatttccaaattccaactacttcgataaattgatggtggaaacaagtagtttatatttgtgggagcagaagtgtttttgttctcttagttccgtgattatgagtaaaccgcaaatgataattcactgtttcaataaccagtctgaggtaatgatatctgagaagaaacaaagtgagtccaaactctgacctatttcttgtgaactcctactacgtacagtattagacagtagcgttgaggaagcgttatctgagcctgatctaaactgcagctagtgcaatgccccattctctagacgtggaacttctgtcttaataatcctctggattaattgagtgcagatttgtattgtgtaacaggaattcagatatggtgctgaccacttctggctagaaattttatactcttactctgtttaacctgctgactagtttgtctccctgacaggccattacatcggcgatctcggactccacctcgcaggcttgctgccttgacatgttgactgggagctactatgtccgcaatcctgaatgttctcggtctgtgttttttgatagatggtacgaacgtagtcttaaccgatgtatggtgtgatatatcttccagatccagcccccctgagtcttgattctgctatccttatatatctgcactaagtttgatcaactttgtttgttgaactatgttctcggttgctggcctgtggtagaggctgttgtactgactgagtacgctagctagaaggtatattgtgtagtgatgacgttgagatggaagtgtctgccgacttaaaagcctactactacattttaaggaaaacaactttcgtagaaagaaaaaatgctctcttttgctattgtttgctattgtctagttcgtgcttgttcattttgacagtaataagttgtgcggtatgcaggcttcatttgcaaggtgcaaccacgtcagtttgcctggttataactgatgctattgttagattcaattgtgcaaaccattaccgtttccttgcagtatgcagacttgctgagattccaccgcgatcctattgttgccgtcttacgatgctgtcaatacttgcggccgtatctatctagttgtcatttgcaggttgcaactataaatacccaccacatttgtgctatctcctcatcactttggtggaatttgagcgttccaaaaagagggtatcatgattgttttaccacgggaagcggcgtggtggttgtccagccagtaatttttgctttctgggtctgtgtctgtctccatccatccatcctctcccctcggatatcggatatgagctactccctccgtctcaaaataagtgcagttttaaactattcacgttcaacgtttgattgttcgtcttatttaaaaatttttatgattagtatttttattgctattagatgataaaacataaatagcactttatgtgtgactaatttttttttatttttttcataattttttttaaataagacgaacggtcaaacattattttgagtaccaaacgtgcaactgtgcgagagtaatgtcctgtgatctgatggtttccactgcagctgcgagcctaaccatccgagtgcgccgtccatgcttccctgcggtattattgccgaccttgaccacggtgcaggtgcatgcccgtctctcagggaattaaatttgaaaatttattgttcattcaatttttttaaaaaatattcgggattcaaaatcttttgcacaaatataccatcggtctcgcacaaccattacgcacgtgaaaatgacgtcgcaaccggtatcgcacaagtgcgagatcacgcggtctcgctcaaacaatcagcgctatcgctcaagcaaacagcgaaaccgttccttcccaatttaattatcctgattaaggattttaataattaattaatccctaatcaggataactaattactaattattaattaattgttaatcaaataattaattactaatcaaaaggagcccattggacagtgtcgctgattgcttgaacggtctcgctctttcagtccgcgaaaccgcgcgggctcgcggtattgccgcgggagaccacccgcgacgtcattcctgcgtcattttcgcgcaatggttgtgcgacaccgacggtatatttctatacaagtttttgcatcccgaatattcttgagaaaaaattgaatgaacagtatattttcaaatttaattctctctcaagtgatctagctgatgcaacttaatatggcctagttagtacctcttccatcctcaaatatactagcaacttttagttacatgtctaaataactaaattgttaaaagttgttaatatcctggggaccgagggagtaggacaaattaaacgctcactttacttatatctcaatttcgagagcagtgttaagaataaacgtgaatcgttcattcctttttatcatattaa

SEQ ID NO: 78911 - DNA, 7487 bp, Oryza sativa
caagtatagagataaaagattgtgttgttttaacctcgaaatctcgtgttcaatctcttacatgtttataattttttcttaaaaatatttggaaggacttcaaatctctaggtagtctttcatttgagttgcttctctcctcccctcccctgcatgagccttctagctactactactatagtaccaccactaccactacggctatgaccactgtgcgttgatgcgtgtgtcctaagtgctttcactttactaatactcctactactactactactaattaaggtaggagtagtctttataagcgtacgtgcttgcctgattgggcagcttagttttgcatatcctcccaaattggggaatatatcgatcgactgtttctatacttgtttctaccaccaaatgtgcttagtgtgtgcttactacctgttggcgccaaccgtactacatggcggttttggcttcgaatgagggatatacgtagtacgatgtaaagtatacttatatatctatatgcctttttttcattagaagcaacccgtcgtcttcttccctgcagccaccggtttcatctcagctcggagattattccgatgaaccggaaagtgatcaagcgcccatgctggcctgccattttaatttgtatcttttctgttggttaatttagttaagaacattgttagtgggacggtgaaggacgtacgtctccctctctctgtcaacattggacgtacgtaattaagattgtcaacaacttagttgatttgttgaatgccatctcggttgatatgaccatgacatgtcaccttccgatctgcccggatatacacatctttatgtacggtacatcgagattttcattgccgaaagacgacgacgacgacaacaaaaagcatccacgcgcggctactaacttctcaatagtatatactttctttcgtcccatacagatatgacacacctgtataatattctctattagatttatttttttttgaaacggagagtatggtcgatggagagagtatggtcctatgtacatatgttatcgactatatacaaaaatcttccgctcatggctactagcttctcattaatatacactttcttcataaaaaaacataatacggaaatgtgacacagttgatatttatgtcacgtcccgtatttaagtttgttttttatgggatagagagagtatacatggtcctatgttgctgtcctctatttctcattcagagtcaaagatacgatctggcatgacatggtgattgttgcacactggcacacataaccgatgacacaaccttaattgagatgtggtaactgttaacatgtagtagtagtatatgccaaaagacctgtcgttgatctgttttctactccatgaaacgacttgactccttttctccagcatctatgaaagatcatgcatcagagaggtcaacgaaattattcctgttttatttgtacgtagcggcttggctgggtttgcataacacttatagctcgtactgactactgtagtacagtatctatttgagccaaaccgaacagttgaaagtgctactccctccatcctataatataagggattttaagtttttgtttacactgtttgaccactcgtcttattaaaaaaattgtgttaatataaaaaacgaaaaattatgcttaaagtactttggataataaagtaagtcaaaaaaataataattccattttttaaataagacgagtggtcaaacagtgaaaaaaaaaactcaaaatccgttgtagtacagtggcagcagtacgtcgtctgttgcctctggtcaactgtaccgttatatataaagtgtcactcactttgagagaaaaagaggcatcatgaacacgggcaccaccatttgtatggatacgtaactaccatccatatatatgcatatcagtgtcgaatgcaatcagctcatctcgatccagtctccaatttcaaaagagaagatgtttgaaattttaacattttggtttcttttttgaaaatttactacacaaatatacttcttaaaaaaactaattctatatacctcgcctcaaaaaaaatctctaaattgatttgtctgctcaagctagtctctttttaaaaaaagaataagacaactccattgttcagatagcccaacacagttgaattgctagctactccctccatcccataatataagagattttgagtttttacttgcaacgtttgatcactcgtcttattcaaatttttttgaaactattatttattttatttgtgacttactttattatctacagaactttaagcacaacttttcgtcttttatatttgcaaaaaaaaaattgaatgagacgagtagttaaacgttgcaatcaaaaactcaaaatctcttatattgtgggacggagggagtaccaaattacaaacaatgtctgggaatccttcaagccaaacaaagtgactttgtagacctagagatgcgtcaattttagcaagctcatgtgtaacacgattatgttctctaggacaattcataacttgatagacaaaaaaaaatcattgtaagcgcataaatttggcctatctaatgataacaacttttactcttgatcagacagcaagagttttttttattgacaaaatttaggcatattatctgaaaaccccaggtggccgcgtgtggccgcgcgcgtccgcggcgtgcttcttctgaatgctcacaatgacgccatcctcatcagccgctgcggagcactccaccaaggtcagcatcctcgacgcacaggcgcagcgtacgtctcatgcatgcatcctttatcgtacaagaactattactccatccggtttcatattcctaacattttaaacaaggttaaggacgttaaggtctcttttagaattttgcactatcaataactacaccagcggcatacatagattactcttaaaaagcactatcaataaagtaaatatttatttattcactgtatatatattataatagaaaactataactaaagaaatgttttggcaatcgtgcatgtggaaaatataatttgttgtattctgttgtattgtagtgactctctcacagatatatatagagtatatgtgagatagagatttagagtacaatacaaattttaaaacaaatttatttctagaactacatttatctataataatattctatctctagaattttatcttatctctataatttatatttaaactttcctccgaacatttattttaagaagaaattattagcgtattgggaattgaacgcgggatttttagggttgaaaccacatacctcttgtcactgcactatcaaatgcatatcagagcactgcagcatgatcactaaactccctctccccctaacgactgcaaggcgccgcgtcctccaacccacagtgtgggtgatcgcccttcacattccagagcgccctctccccccctataaataccccactgccagcctcatcttcctccacagcatccatcgcaaaatccacctcagctagctacccaagcgcacgcgccaccgcccgcgcgcgagctgagctagcgatcaacaccggtcgaacacctagcgagcatcaccaccatcatcaccatgcaggcgtacatggcggtcgccgccgctccggcgccaccggcctcgctgacgctgctgccgcgcaccaccaccgtcatcagggacagggagcgcttcgacgcggccgtcccggtggcgccgctcgtgctgaggcatggcgccggcgtcaagcacaaggccgtcgtggtgatgggcgccacgggcaccgggaagtcacgcctcgccgtcgacctcgccctgcggttcggcggcgaggtcatcaactccgataagatgcagatacattccgggttggatgtggtgacgaacaaggtgaccgaggaggagtgcgccggcgtgccgcaccacctgatcagcgtggcgcgccccgacgacgagttcacggccgccgacttccgccgcgaggcggcgcgcgccgcggcgggggcggttgagagggggaggttgcccatcatcgccggggggtccaactcctacgtcgaggagctcgtcgaaggcgacggccgcgcgttccgggagcggtacgagtgctgcttcctctgggtcgacgtagatctcgaggtgctccgcggtttcgtcgcccgccgcgtcgacgagatgtgccggcgaggcctcgtccgggaggtggccgcagcgttcgacccgcgccgcaccgactactccaggggcatctggcgcgccatcggcgtgccggagctcgacgcgtacctccgctcccgcggcgacggcgccgacgaggaggagcgggcgcgcatgctcgccgcggccgtcgcggagatcaagttgaacacgttccggctcgcgtgccgccagcaccgcaagatcgagaggctggaccgcatgtggcgcgcccgccgcgtcgacgccacggaggtgttcaggaggcgcggccacgccgccgacgacgcgtggcagcggctcgtcgccgcgccgtgcatcgacgccgtccggtcattcctcttcgaggaccaagaacgcagcagcatcgccgccggcaaacctcccctcttcgccgccggcaaggccacttcaggcaacatctccgtcttcgcctccgcggccgccgccatggcggcggccgctgcaatctgagaagcgcaggcgccaacctacttacatacacatacatgaccaaacacaaaaacgcagagcaccatgccactctcaagacattcaggctgctgccaatcgccattgccgatcaaattcagagctcgtcagtcggatcaaacgatgaaggctgctgcttctgcggtcaacatctcgactgacctgccaattgcaatgcaaagcaagattgttcatatactggtaactggttgactcctttttgtttttgctgtgtttctttgtgatatgaggagattgatgaattgcgcgcgagagtgtaacttatgagttttgagttttttttttctttttggtttctcctctgattttgggtgtgtaacagtaggagtaaaaactaaaaagtattgacttggatgttaattgggggattgatgtaatagcctctccttgtaacatagaaatcatgagctgaaataattaaatcgttgagaccttgcaaagaaaaagggggaaaaacaaaataaggaatcttgtgaaaggggaatatttggcagtctttatcataatatatcaactttttcaaggtcttcactgagctttgctattgagaatctcacttgccgcgcacttcaatagtctatgactatgctctacactgtccttgttcttaattcgagaccgcatactttgagtgacatgttgtgggtatgagtaaaactcggtggcgcgcaatactaatttttctttacatgaaaacttataattcgcgcaattttgtgtcaaaaaaaaaattcgcgcaatccttttgcgcattccctataaaaacttataaattgtctgtatttataatttttattttcttactttctctatttcattcagaaaactcctggccaatcaacatgacaggtgatacatgcaacatttggcctggaaaactagtggcagtcagccagtcattcctcttgtgcaatgtgtggctctatgctgtatctgtctgtggatacaagttggcatctgcatcagttctggttgcttctttgacatcatattcccaagtcttgtttcttggtcatggagacactctcgtgcatgattgggaactgggtattagttagggcagtgcttgcatgtcaaaggtcaagcccatcatcttcttgttcaaagtcaacttcacattctgaatgcatatgcacatttttacaaggataagcttgatttaacacatattttagagttcacttgaacattgtcaaactctttcgtagaatgcagtggtgatctctctggatagtatggagaccagaagactcagcaatcatcggttcagaatattatataagattcagaaggtcaacatgaacaaatatttatatgaaatagtaaaattggtcaggtaaatgataactttgacttaatcctactacagttagacagtcaaaatggcatttcttgatgctacattttttttctacatggattaacaaaaacgaatgaacgaatcagagttatttgaccaatttatcaaattatgtcaagtggatgatcagagaataagatctgaatatcgcgataggaatgaaatctttggtcaagggtcaatgtgcagttcctgcatttccttccccaaatcaaacctagaactggttgacacttgacagagaatgcaacgactctgtttttgttttcatttttttggaagattcttctatgaacactggctctttgaccaactgcctacatatctctactgatacatgagtgatcagtaataatttctgttgtacaatgttttctatagcattctgatttgccaataataattaacaaagtcaaaagcttttttttttctgaaggagaaagtcaaactgttcttctcaaatacagagtccaacttgcaacatggtgaacaaaacaaaaggaggaaaatacgaaaggaatcagcaaatagctaacaagctgatcattgagcaatgagaaaaatatcacatttaataaaggtttaaagtcaacatttagagcttgcaaaacttttaggggaatgggtttatttatttcatagtacaccaccaaattataattaagtttagaaaaaaaaaactgcatcaagtggcataagccgaataaccacttaacaattgggccctagcgtcttttgcaataaatattatattaataatattattagttagatggcactaatatttgtgattagagctccaaaatgactaatagcacacagatcaaccaaaaccagtcaacagttttatcatttgccaaacaacttatgttcagttacatcaatgcatttgggtgctttactttatctctttccttttgctttttttgttgaaaagagattatgatatttgttaatgacttgtataaatatggttaccacgaatttcatatatttcctttcatgcaacagtcagccaatcattagctcctccacatcttatctgtttatattatataattgttgagttgttgcccaaaagcttttacctcttcttttcaaagagaaaattcagaatgcctgcaagaaaaccagctgacgtcaactttcaaccctagtccactaatcatttgactgaaggcagtaacttactttagcaatccatggtaagcatatcttagttttgtcttttgtaactgtaataaaggtagttgttctgttcactgaacttatctttcaatggtgatattaaccatgcatgccattgttcatcttccaaggtttgatccttgcttacatctaaactacccaaggaaaattccaagtggaacaattgagtaagttaagct

SEQ ID NO: 78912 - DNA, 40153 bp, Oryza sativa
  unsure (1)..(40153): unsure at all n locations
gactactatagggcgaattcgagctcggtacccatgaagaacttgaaaattttgagagaaacaaagtttggactttagttgaaccaccttctggacataatattattggaaccaagtgggttttcaaaaataaacaaaatgaggatggtttgattgtgagaaataaagctagacttattgctcaaggttttactcaaaatgagggtttggattttgatgaaacttttgctcctgttgctagaattgaggcaattagacttttgttggcttttgctgcttcaaaaggttttaaattgtatcaaatggatgtgaaaattgcttttctaaatggttttatacaggaggaagtttatgtcaaacaaccaccaggttttgaaaatcctgattttcccaaccatgttttgaaattgtctaaagctttgtatggtttgaaacaaactcctagggtatggtatgataggcttaagaactttttgcttgcaaaaggttttacaatgggaaaggttgacaacacactttttgttcttaagcatggtgataatcaactttttgttcagatttatgtggatgatatcatctttggttgttcgactcacgctttggttgtagattttgctgagactatgtgcagggaatttgagatgagcatgatgggtgagttatcgtactttttgggattgcaaattaagcaaacacctcaaggtacttttgtgcatcaaacgaagtatacgaaggatcttttgagacggtttaagatggagaattgcaagccaatttcaacaccaattggttctacagctgtgttggatcctgatgaagatggtgaagctgttgatcaaaaggaatatagaagaatgattggatctttgttgtatctaactgcttctagaccagacatacaatttgctgtgtatttgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgatttcggtggttgtagaattgatagaaaaagtactagtggaacatgtcattttcttggtacatcgttgattgcaaggtcttctaggaaacaatttagtgttgctcaatcaactgctgaatctgaatatgttgctgctgctagttgttgttcacagattctttggcttttatctattttaaaagattatggtcttacttttgagaaagtacctctattttgtgataatactagtgctatcaatattgctaagaatcctgttcaacactcacgcacaaagcacattgatattcgttttcactttttgagggatcatgttgagaagggagatgttgaattgtagtttttggacacaaagttgcaaattgctgatattttcactaaatctttggattctaatcgttttgcttttcttcatggtgaattgggaataattcatccttttggcatggtttgagggggagtttgtacctcatggttttatcaagcaataatatgacaatgaaaaaattgataaaagagagctttggttatacatatggtattttcttgtgcatgctagcaatactttgaaggtttatttgtctctagcatagcttgtatgtattctagtcttttcataagatttagattttgcttttaagggagatgatgcatgacacttaaattctacttgaattaagaaaatatgcaatgttgatgctagcatatggtttgatttataaatgctctatatatatatatgctttattgacttgttattcctcaaatagctttaattgctcattgtgaaaaagagaataaaaaatatgaaaaaaaatgaataccgaatccttggaaacagtcttgacgacaaggacgtattcgatgtgagcaaaataatgggtgccgaatccctggaaacagtcttgacgacagggacgtacccggaataaaagaaaaaaaatatgagcaaaaaggctctagaaaagaaaaagttaaaaaattctcttggttattttgtgctaaaggttatttgagaaagagtgataaatgcaataggtatatatgtttagtgtttattcttcaacctatatgcttgttaagatgttgcattataaatcgtatgaaatcatgaatttcgattgttgattcaagcttaattgtaaaatctttggttcatggttatactagatgggtttatcttctttttattgcaacacatgacttgatatgctatatatatgctaagctcttgaccattaatgaacataattcctatgcttgatgacatcattgtcaaaagggggagaagtaatgtgaaatttttggatttttggagaagcaaggtgaatttttggagagttgttgagaagagcatgtttttggttcaatagggaatttctttcttttaaaaagggtgagaagttttcttttggatttttgagcacgatttttgagcacgatgtgtacatttgtacgaattgtgctttttaccactttcgtttttatttttccaaacaccaaaacattttttatgagtttgccaatgtgttcatcaagggggagattgtaaaatcaaaggtgtttttgattattattctgtgatgaacaattggcattggagataattagttttgttatttgaaatttattcacgaagtggttttggagatgattggatttcacaggtgaatctataggatattgttgttatttcatgtgactggtcagaccgggcaggtgttgccggtcagaccggcggtgatcgagcggtcagaccggctagcccgcggtctgaccggccgacgctgtgtcggtttctgtttcgggttgtttgtttagatatccgtgattattttatgattatggcttctagatggatactatatgtatgtaatactgttgtttgctattaatgagtcaagttggagataacttggtctcggaatatggttttttgtttatttcatgtgtaggtgactcgatgtcttgggagagtatttgcggtgatggaccgggagtcagcttggggataagacaacgttcgtggtggtcaaagatcatgcgggatactaaggctagagttgatgcacgtggttgatggagattccatatggcatacgatggaggtattgtgtgcgtatgggatgcggagtcgaatttggaaggagttcaaatttggtacgattggttatgtaaagtttctttcttgtactagaaggtttcctaaggtgtttaggactcttaatatgagtttggtttgtggctttatgctgcctacctcatgtataaatagagggggagcgtgaggcttcccggtatcgctttagagagcaattgagttgagttttgagttagggtttcgagtttagtcgaaatttttgtaaggagtgctgttggtgcactttgtaaacacagagagaatcaataaagtcgtcatctactttaagagttcttcgatttgtgtttatcgggtttcggtagtctacccagtgatctaccggcggtcagaccggcggcaagcggcagtcagaccggcagcatttgggcggtccgaccggcggccgcgacaggcacgacgaacgacttcggcggtcagaccggttgatctataccataccggtcagaccggcggcatctgagcggtcagaccggcaaggcaacttcggtcagaccgatttccatcgatttcgagagtaacttttatttccgctaaaagttttcggtttttgggtataccaaccattcacccccctctggttggcttagttcttgtgattcgatcctacagacgggccctacatgtcagtagccaagtctttcttcccgccctttgtacctttcttacccatcttttcccaggggacaaccaataaaggataaggaccgcgtgtggtgggcggcaaggagaagggcggtggctaacaagacaacccattcacccccatcttcttcaaggctcccatgacctccgtgtttgtcccccaactcgattcccccatccttgaccggctcgccttcttccgttccgttaggcggctggaggagcacaataggttcccgtgcttcctattcgagaagtccatgtgcagggccatatgcctccttaatcacctccgcatacccccgaaggagtggcccgacacctggtggcgcccatgtgcaggatctcctaccagatccacccaccatggccactatcgcaaatcctcatcttcatcatgcggttcgtgctgacgctccctatcgtgcctgctgccaaccttgacgctcctcgttcgtcaaggtagccaagcgcctcctctctacgtgtaaccccatgcgctacaatgtccggccatggattgggtcgttggtgcacaccgacggccgccaccattaccggcgctgctcaggagagagaagtcgaggaggctggtcgagctaagtgcgctgctcaaggcctttacgttgttcgggccgttcagattggaaatcatcaacccgtcggtttgtcatgcaatttcctcttgtcatggtctcacctggagaaaactatccgtgtgtctgcgtccgtagtgggcctttgaagtaaacacacacacaatcaacgataccaactgaccacaacagttgggcaaatgagtggtcgagggggccatcaaccagaccggctatgtttcagagagtgattggcgaatttcgtaacatatactcttaagagtaaatatatttttacttataatacatatttttttataaaatatatatgatctaaggcgatacaaataatcattactaacatgattaacacctaaaattacgatgtaaattaaacaacaagaacaaaacaaaatcctatcctaattttcaaactaaatagatgtaaatgagaagatgaaaaaaaaaatagaagacctcactttaaacctttgccatgataaatagtgtggtcgggtgggagtcgattgtgaggacggacaatgacatcctcctggcttggttggttagtgatgggttccctaaacccttaaacggtcctgccattaaccgcacgcgcatggttctcggatagcaaattggcagcttgggaaagcagggcgcctcaacactacagacgtgcgattttgagaatctacgagaatctcttcccctctatcgctgtccagctggtatcatttagctttcaggagatgtacggcagtactactaggagaagggtgagtcctggattcctaactgccagtattttagatttttagatgatattttaccgtgcgtctggtatagtctagtccccatatagaagtaaatataagtcttagcaccttatttacgaaaaaaaatatatttaatatttaatgttgaaaaataaaactacgttaaaaggcgtaaaaaattaatcttaaaatcaagttttaaaatttaaatcttaataacgacttctatagtgagttgtgtgtctatattaaaaaaaatactatacaaagatcatatatagatttttaataaagaaaattcgtgcatttattaatgtagctaagttagacatacatgagtggttataggtgtagattgggatacatctagttttgcaaagaagccccttagcaatggaaaaaatacactttcgagctacatgttatagagaaggacttaggaagaattaaaaaaaacaattgggtctttcttcttcaattgcttgcagtgtaaacaatgaagttttggagctcgattccaacaaaatttgaagcaaggtgagctgcatatgatcgaatcaccgcataatctcaaaagaggcctcacacatatggaggttcaagtaatgacatacaaatcgaaatttcagccacactacttaggatttccacataatcatatggcaaagaaagacgcaacaacaacagttcctaagatcaagcctagatctataataccagcatagtatggtgaagaagcatagaagctgcataagaaaccaaagattatatttaaaagaggccttcacacatgggagtttaacgtcagttcagcttgagtcaacaacatcagcctccctatgaagaacttccaccggagctcagaaagaaggcctgcacccttggaacgagctcgtcggatatgacggtgaaggcccgcgtgacctcttcttgtgcagatgtggaagcatcccagctgacgagtaggacactgttgacgctgcgacttgccgacaggactaaacccgacgatgagccccacaatgccaatggtaacgaccacctcaagaaccacaaggacaaaatctacgggaatgactcagacaaatgaaaaaaatccgacaagacctactgctactactacgtctcgtcagggttatttccgtagttttgcccttatggttcaggccaaaaatcaattatataattattttgacctacccagataggtcaaacacatctcgtctcaataattaaataattgatcggacctgttaaagccgaaaatacttttatcacgagctacaattaattttcaacgataaattctatgcactaaaaatatttaattttaaattattgttgtgttcaactagtcgtaaacatatagtgtatattaaagtaggaggaaaaaaaggaaacatgaactgagaaacggggttattcttggagttggagggattctttatgttcttgggaaacggggacaacccctattttatttttagaggttttaaaatagggattgttggttgttgctaaatatgttctaaaagggactctcattgtaatgaagtattgatagggactctaatcaggcctcctataaatcgttattgatttgtcaaaatatctctggaaaagaattgctactacctgacaaaatattgttggtggtcaccatcgtccacatcgttgcatcttctgttgcacacaggtttgtagcaccaacattactatgctaccagcatgcttgcatagtttttgagccctgcagttgctgacacaactagctattcagaatttctcaatgtactgacgttttctttcactgttccttttttttttcatctattccaggatggatgtttgtgcacgaagggttgggaattcggagtcaggatggtagttggtgatctcatgtcatctctttctcaatcatagcaagcattgtttttagttaatgctctcatttctgatcttgcagttacataaatctggttattgaaatccacttcaatcaccaatgtgttcgtgaggtatgtgaaaatactattgtgtttcttggacttccatctaagaaattttttttagcccttgcatatgaagtatcactgtcacatattaggatgtcttgcagattgtctttggattttgggacatgcaattcattcgcttcctaatcctgatcatgctcatgttcacaaatttaggaaatcactgttatgcatttgaaggattttctatacataaatcttagtcttcactctacacatctattgccggttgtacaattctgggagatgatgctttagaaccaatgctttttaactgcaattgccaaaatgctcccaattatgtcccgtagaaaatttaatcttgataaagttataatgcatgccgtagatctgaaatttcagacaaacttctagagatttaaattttaaaaatttgcaaaaacataatggtcaccttggttttggagccgggagtacatttatcaccaacatcactaatgttgtattatagtttgtttaagatatctaaaaaatttctcctaattatctacaccatgtatctgaagcttttattgcagaaggttcaacaacttattacattttatgtgccatgggatattgggatatttctccatttttacacttgaagcaaattttttgtgtttgttttatcaggtacataaaatagatagaaagagaatagaacattaagaaacttgcctggagcaatgcccctgccagtccactccatcacactgtttaattttttattactgagtgttagctatccctgtgttccttattactaaatgctaatacatagacttaatttcagttgttgaactcctttccaacagcctatctgttcacaacaaggaatactaggtgcaaagaagactacctaggacatgtttaggattctattgccttcttagtccaactaggtaattttcattgggaatcatgtgactttctacagcttacaccaaggtaattaaacttcagtgtcattgcacttgtgaagttcatttcattgctttcttggttttaattcccgccatcacattttatacatttagttaggaacgaagcaatgactatcacttttttgtttgtttctatatttatgcaaccgtggatatcaactaaccaagttgtggtatcttatattactacttttagagctgatgatgacctacaactgatatcatgaatttgtgactcaattatattgatgtccctaactttttttaatgttcttgaattgattctctaggaatttcatgaactcagtaactaaaaggtaattcagagcagttatttatatgtcctcaaattttatcatttggctgtagaatatgaatttgttccacaggacgaaatgcatggtataatctgagatgttctgcactaacagccgtgccagtgtcacctaattatctgtcgtttattttatattgttagcagttaaaagaattgattaagccatcatttgatatgattttttttcaattcaaaattttaataagtgagcaatctaaagggcagaagcatactcacaaatttcaaatccgataatggaatatctgtggttttcagttcttttattttataaagttagaatccacgtataacagacctttaggctcttttatcgtagcaattgtctcttactctgatgctcatgcatgtaagagcatgtgacattatcaagtttttgcttttgtaacactaacaaaaccatgttccagtttacattcaaatcggtgaatgtattgattggatttgcgtgttcattgttgagtttgtagtgaatattgaagaaatctgttgatcaaaagattttatgtttatgttgtaaaatggaaataaaaaaatgtgttctatttctttactattattttaataaaaacagaagtgaacgaggtggttttttaaaatgcgaatactaagatttgaaaaacgtgtcttgcatactagtatgttctataagggactctcattgtaatgaagtattgatagggactctaatcaggcctcctataaatcgttattgatttgtcaaaatatctctggaaaagaattactactacctgccggcgatcacaacaccgatttggacaggttttattgtttgagcacgacgcgaaatctaacaaaagctgctccacacgaacactgcttgtagaaaatgacgataaattcacaggctcacagtgcagtggcccatctctttggacggagagggccaccggagacaggaaggcagaaagaaaaaatggcgataggatggcataggtcacagagcctggcgtctgcagggctcgggctgcacgtcctcctctgctcgtcgttgctgctcaacgccgtcttcatcgcgcaccaattcctcggggcctcaccgccggcaacgccggagcggctcggcgacgggctgagctgggcactgcaggcggccaaggaggccgaggacgtggccgccgtcgactgctccggccacgggagcgtgttcctggatggcgtcaccggcgaggacgggcggcccgggtgcgagtgcaacagctgcttctccggtccggactgctccgtccgaatccccaactgcgccgccgacggtcaagggtaatgactggcctctcctcgcttgctcgtgctcttgcgcgctgctccacaacgccttgcatgcacgcagcttccctcctctttgtctttggtgtgaaatacttttgaactctcgagggtatcgaggacagtttgcacttacatcactcaaatagttataaaaaaatcataaaaatatctaacactggtacaatatacatataacgcttcatcacaaaatttaaacataaactcaactcacacataaaaaaaagagagaaatttcaacgtacaaacaatatagtactattaatctctaaatttgtcttttttaaaaaaaactacaagttaaacttgaaattgatttttgctgaagtgatagatgttactatttgtctgtcctatgttataaaaaaatagatttttttgggagtagctatatttatggcgccatatttttcaccaaaaaatagtcggtatatttttacattgtaagtcattaaattacatatataattttagtgtatttacaatgtaagtctcaaaattacatatgtaagttctaaaattacatactaattacatatctaagtggtgtgtaactaccgtgtaaatttgtataaaatatgaaaagtgacatattcgttgcaagaaaactgtcggttaagatatagcaattccgtatataaaaccaaccggaagatcgggtggatacggttgccgcagcgtttgcatgcgaacgaatctaacagacttgaaaaccgactgagattagtgaaaaaaactgtcgccatctttatagcaattccgtttttttttcacaaccattagtgtcctgtcctgatggtgtgttgttgttgcaatggctctgtgcagcggggacccgttgttcctggagccgtattggaagcgccacgccgcggccagcgccgtggtgttctccgggtggcatcgcttgagctacatcaccaccgatggccacttaaagtccgttgagctcgatcgccagatccggcggctccacagggccgtcggcaacgcggtcgtcgacgacaagtacttggtcttcgggaccggctccacccacctgatcaacgcgctggtgtacgcgctctccccggaaggcaacgccgcctcgccgccggccagcgtcgtcgccaccgtgccgtatttcgcggtccgtgatcccaacaccacttcacgatgacacatcctacgagcatctatacgcgacttcactaactagttgtgttgatcgatgatatgtatgtagatgtacaagtcacagaccgtcatgttcgacggccgggagtacagatgggacgggacaaccgctgcgtgggcaaacaacaacagctcacggaaccccaccaggggtttcattgagttcgtcacctcgccgaacaaccccgacagcacgttgcacgagcccatcctcgccggctcgtcggcgatcgtcgaccacgcgtactactggcctcacctgacgcacatcccggcgcccgccgacgaggacgtcatgctcttcaccacgtccaagctctccggccacgccggcagcagattcgggtacacacgggccacagagttcccagctgcatgccatttgcaagcaagacacgtacacaacgacaccaaagctgatcgatatacgccgtgccgtgcattacgcaggtgggcgctggtaagggacgagaaggtcgcgagcagggcgatatcctacatcgaggagagcaccgtgggcacgtcccgggagacccagctccgggtgctgaagatcctcaaggtgatactggccaacctgcacggcaaggaggacatcttcgccttcggctacgacgtgatgagcagccgatggcgaaggctcaacgccgtcgtgtcgcggtccacccggatctcgctgcagaagatgccaccgcagtactgcacttacttcaaccggatcaaagaaccatcgccaggttaaaacggcacattatctctgcagatcatggcatttcaatttctctcgctacctctcaatcgaattctttaaggtgatgcgatggcgtgtttggtctaccctgatctgcagcctacgcttgggtgaaatgcgagtgggtggaagacgacgactgctacgagacgctgctggcggcggggatcaactcgcttaccggcactgttaacgaggccggcactcggtacacgcggctgagcctcatcaagacgcaggacgacttcgacatgctcctggagaggatcaccgaatttgtcgatgccgagaagcacggcagagctcccgctgcctccagctccatgtgaaaatcgtgaattgggaccgggacaaaagctttcgtctagctggcttcgatggccactgtgccggaacgatcagctgctagctgattgtaggcaataaatacaaggcaacgtggaaaatcaagactggaatgatcagctacgcgttaatcgttcattcgttcgctgtcgacctttcgacggacaggtgtaattatgtggatctacacaatcaattaggtggacactatgtgattatgtttgcagtgactaataattgagtatgtaaataaatgaagatcatacatgttactgattcagcactcgtcattcttggaatcaaaagggaaaaagggaaaatgaaagcagatagaggcacttagaactgctaaaataattttaaaaactgcgcatccggggaatcgaaccccggtcagtaccgtgggagggtactatgataccactacaccagatgcgcttacatttaaatttaccaaacatgttcttgatgttagtataaagtaataactcgtataatattgcacggtaaagcgagcaaattgttgagctaatatattcagatttggcgaattggcagccaatttccagaaaataaaatcatctcctacgacattgtcgtgctctgaaaatgtgaggagatgaaagtgatttatgttccacacaagtcaagcactagagcagagctacgagctagtactatgataatgatacttctatcagatgtaaacagcacaataggtaaactctaataatcaattttcaatccctacagattacagatatcatatgatattgcatactccgattagtagcgattctatcatgcacgagaagcaaccatttggttcggccatgacaatgttggtaagactgagcagtagtgggagtggattctaatccctcgaggggatatctccgcgtacatctttttcttctaaattcgatgcaaatagttgtgaaaaaatctgaaaaaaattgacaatgtagagtataatgatacctactagtccaccaaaatttatgttcaaattcgatctacacatcgagaaacaaaaataaacagtatgctactattcatacgctgaatttgtcttttttatatctcgacgtgtgagttgagtttggacttaagattttgtgaagttatatatatgtgttgtatgaatgttgtcaaattttttcagaatttttcataaccacttagatagtttttgagcaaacgaggaaacatcccctcgagggattataatagtttccagcagtagtagcattttcagagcttgtcgaccttgtcggcactgacgacgggattggcgcgggcgatggcatcgcgcccggcgcgcccctgtaatcgtagccacagtcgtgcctgtccgagtagcgggtgcgcgccgcagaacacggcgccgcagcggcactcgaaccccatcagccccactctcctcccgcacgcagcgcacctgctcttcgtcttcgcccgcggcggcggcggcggaggcatcgccccctcgtccacgggaatgccctccggcacggtaccgcgccgtgaagctccgtggacgacgatgacgacggcgcctgggacatcacggtctggcggaggctgtcgcggtagcacttggagcagaggccgcgggtgttggcagagccggagaagccacagccgttcgcgcacgggagcggcagccgctcgtccagcgtctcgctcccctgctccatcgctcgcccgaacgcagaggcttctcttccccggggagtcgacgatcgaggtggttggcagctgcaagaaacgtacaggataacaggaatcggacggggattcgtagggtctgtaccgaacgcgacttggtgcctcaaggcctcgggaaggtgggatgatccgaagcaagttgaatatgatgtgttttacaagggagcgcaaccgcgggcagtggaatcttcggttggtggtgccgagtgactggtgctagtggcgcagccagccgtgcaggaatgccaataaaatttctggtttttgcgggcagccgtttaatctggataggatggagattgttcttctgggtctgatggtaaaccagttaattaaatcaattttgggcttccaggtctacaaccattttttgtgtgtggtgaaggtgaacagagcaaaaagatttcattgttaagttgataggatgggcatcatgcttttatgacgatgctatgccgccgtctacttggagacgtgaatctgtcctctggccttcgctgccacctcctcctcccgatctaccctccttcggtgagtcactaaataacccacagagagggcaggttgcgtacatagcggattcacagaagacgaggaagtcctagtatagtaaaacaaaatgtcgttggcgtttcgtaaaaagaatgacgttggcaaaaaatagagatcacggatgaggttaaatgcgccaagttcatcctaaccgagcacgtgaataaactctattcatatggtgttatcttaactactgtaataaagaactaaaacacccttagagcaatgtcacccccataaaaaaggtccagggtagtgatataatttcccgtcccatatgaataaaaaagagttcataagaggcaaaagggaagggttctccatccattctctccatctccactactatcacacatgtcagatctaaagagagaatggtgtcaaactcattctcatatgcacaaaaacacatttgaatgtttttgagtaatttcgtttttgcgacgcacaaacttttcggtgagccgaccaacgacttatgtaaaaaaattgcaaccaatggtgccaaacatatttccattgatccatccatttgtcagtttgtcaccctcaccaccaagcaccaccgagctccaaggccccaccaccgcccatcaccacatgtagggatgcaagcggggtaggcaagcgggtttttttagcccgcttatctcacttctagttcattttttcttctaaatattgtactatcatataagaaatgaactagtaaacgggtttttatgcgggtagtgggactacctacttgcatccctagccacaacccaacgtcgtccgctccaccatcaagcatgcccctgccgctgagcaccatcttcccgtcgctatgtgcttccccagcccgacaccgctttgtcggttgtcactgcccttaccgccaccgagcgccgcccctcgccacctcattagcgaactccgaggggagccaccgctctcgaagtcaattggtagagagtatgatggcaaagtagcagcagggattgctctcgaagtcaattggtagataagcaaattttgattcgttgtacatgatgtaaatactttgtaatgctctcgtagagggtgcagatggctcccgagtcgggacagtggggacgcagaggcgcccgatggcgagtgcataggcgcgcaacggcaggggcagtaacgcacggtgttgggggcgcaggtgcttggcggtaggtggcgacactcggtgttgggacggcaacgcatgggccaaacaatggatggatcgatcgaccctatctcctctctcttctctctctttggatctgatatgtggggctagctaggggcaaaaatgtctccaaaactgagaaaaataatgaaatggaaaagaaaaccaagaactagagaaaaggaggagaaagtgggtgcttctaatactgtaatacatggtcgatcgctgaacgcgaccagctcgcccccctcgctggcctgtagcacgcgggcccacgtgcagtaaaaatataccaaaaaagaaaggaaattattttaaaccagaaatataatatttctgttttccactgacgcattttcaggtgaacatccacgtgcttatttttctttttagttttagatatactttgtttgtattggtttatgtcagtctgttacccaacatatccctaataagcacatctagttgcttcatattttttttattggttttgggtgacttcaaatcctattgtaagtaggaacttttaacgtacaaacttcacatgtataaactttatacgtagaaattttgtacacatgaactttggcctataaattttatgtatataaaatttagatataaaaagtttctatacatgaatttcaaacgaattaaaaaaatcaaaaagggccaaaaacatgttggcaatagcaaaaaaaactccgatcaaacaccttgctggcagactgttcacgcccggcacggcaagaactgcagcggcaacaacgaacagagcagcaaacagagcagaggagaagtttcagagaaagaattcttgcgagaatgtatggggcaattttttctgggtttttctcattcaactgaatgtaaaccttacaaaaagaataaagagctaagagaactacttatactcaacgcaaaaaaaataggaatccgaggcaaaatcgcgccatcccacgatccgcttttctctgaactccatgcacacacccacgccactgccagcgctagactcggtcacgattaactgattcgcgacttatttgcatctctaacaaactcctgctagactaattcatcctcccgttcagctccgagagaatcggcttgcattgggccacagctgaaattaatcaacaatctcccccttaattctgccgtggccctagtgaacgaacaccaagaaggtgtctcgccgtcgccagcttcgccgccggcaatcctttcgtcagtgcatccgcccgctgctcctcagtccggacgaactccacaacaatttgcccgccatccacacactcccgtatgaagtgataacgggtgtcaatatgcttacttctcccatgaaacaccgggttcttcatcaatgcaattgctgacctattgtcgacgaagagcttcactgctttctcctccactcccgccacttctgctagcaacactcttaaccagagcgcttgacaggccgccgtcgtggctgccatgaactcggcttcacacgacgatagtgccacagttttctgcttttgcgagctccacgccaccagactctgattgatgtagaacgccattccaccagtgctgcgccgatcatccaagtccccggcgaggtcactgtcagtataccctgtaatcttcagtgccctagtgcctgcagcatacacgagaccataatccatcgttcccttgatgtatctgagaatttgcttcacagccttgaaatgcatcacggttggcctctccatgaacctgcttgccaccccgacaacatatgacagatccggcctcgtgtgaagcaaataccgaagactaccgatgatccgccgatactcagttgcatccaccgggtgaccttctggatccttgctcagctgcgatctcggatcgattggaattgaaactgagttgcactccatcatcccaaactgagacagtaatttcttggcatatgcagtctgtttcaatgtggtagcactctcatcttgatcaacctctatcccgagataatatgtgagcaaaccgagatcactcatctcaaactcccccatcatttgttccttgaaaaccttcaattcagagggattttctccggtgacaatgagatcatcaacgtaaacgccgacaattatgccatcacttcctctgcctcgggtgtatactgcctgctcctgcgtacaccgatcaaagccgagctccctcaagcttctgtccaggcgtatattccaggctcgcagtgcctgccggagtccatacaatgccttatgcagcttgagcacaagatgctcttttcctgatctagcaaacccttccggttgtgcaacatacacctcttcttcaagttcaccattaaggaatgccgatttgacatcaagatgatgaacctgccagcggcgatcagccgccactgcaagcacaacacgaacggtatcaagcctcgctaccggagcaaacacctcttcaaaatcgaccccttgtttctgcacatatccttttgcaaccaaccgtgccttgtgcttgattatctcccctgtcgtgttcttcttgagcttatacacccatttcagcccaatcgctcggtgcccggctggcaacatggccaactcccatgttttgttcttctcgattgcctccatctccctctgcattgcttcttcccacgcaggttggccggcagcttctcgatagcttgatggctcttctgactcagctaggagcgcctctccatcacattcgtcctccaccaaatccacacgcggggcctcacgtaggacatctgccagcgatctataccgcctaggcccatcatctgtatcgatgttgtcatctgtgcccggtgacggcaccaccccggcagagtttgtcgatggagaaccgggcgtgggcgttccaggcagagtcggtgatgctgccaccgggcttgccggtgacggtacttcttctgccgccaccactgcttccttcccggcgcgcctgccaggagacggtgcctggtacgacggtaccacgccggccgctgttgccgggctcggcagctgctcaccaggctcctcctccatcgtgaaatccgttggctcctgtcctgcaactgatgtccactcccaaggtacattttcctcaaatacaacgtcacgacttacatgtatgcgcccacgacgcggatcgaacagacgatgagccttgctcccttcctccacaccgagatacacgtacggtgcactcctgtcgtccagcttcttgaggtgcggctgcgtgtttttcgcgtgtgccgtgcagccgaacaccttgagatgtcccagctgtggcttcctccccgtccatgcctcgaacggagtacgatcacccattgccttcgtcgggagccggttaaggagatgcaccgcgtgacgcaccgcctccccccaaaacctgcccggtacgcgcatccccttcagtagtgagcgtgccatggccatcaccgtgcggttgcgcctctccaccgccccgttttgctggggcgagtacggcgctgtcaggtgacgttgaatccccgcctcctcgcacacctgtgcaaactcgcctgacaggaattcaccaccccggtctgaccgcaacgtcttcacgcgccgcccagccgtgttctcggccagtggcttgaactttacgaaagcatcgagcgattgatccttcgtcttgagtacgaacacccacatccaccgggaataatcatcaactataagaaaaaaatagcgattaccagacatcgtactcggtgtaatcgggccgcacagatctatgtgcagcagctcgagcggctcctccgccctgaagtgcgccgccgccgggaacggcgccctggcctgtttcgccaccaggcaagattggcacagctgattcgggtggacgattgccggaacaccccccgccatctccttgtccaccagcagtttcattgcttgaaaatttacgtgtcccagccgcgcatgccacagccaagccgggtcgtcgaggctggacagcagggacacgggatgcgccagcttcaactcaattcggtaaagacgatttacagtgcgcctcaccttcatcaccagccgccatggacttttgtcgaacacttcgagtacatcctcatccatgaccacgcgatgcccggtctctgttagttggcccaaactcaccatgttacattgcagactggggatgtagtagacgtcctgtagcagccattgatcaccgttcttgcatgaaaaaagaatcgaccccttccccttgatctgcactgtggaagcgtcgccgaacttcacccgtccggtgatcgactcgtccagctcccggaatttgcttcgatcgccggtcatgtggttgctggccccattgtccaggaaccagacatcgccagcatgtccaccagcgtctaccagtagcagcttgggccacacgcgctgctcgcgtacgaccaatccgcacgacgcgcgctctggcacatcctccgtcatcgcaagcaacagggcaggcccggcgtcctccgtctgtgcaagatgtgcttctcccttcttcttcttcggatgtgggcattggttagagtagtgcccgtactcctcgcaattgaagcacttgatgtgactcttgtcacggccaccgccgccagagcctgcacctgagtcgccccgcggcgtcccaccgcgtccgcctgcgccacggcctctgccgcgaccgcgaccgccctggccgcgcccagcaccttcacctgaaggtttgttcttctgtggtggcgaggattccccgccgttcttcttgaagtgagcttcccactccgcttgagtgaggagcacctgcccatcggtggtgaccccgccagcggcagccttcttcttccgcatgcgctcctcgtaggccttcggtcgacccactgcctcctcaaatggcatagtatcaatgtcataaaattgctcaatacctgcgacgaggctgacgaatttttccggcaccgtgtcgaacagcttcttcaccatcgcggaatcacccagcgtcgagcccaacgccgagtgacgcacgctcatcgcggtgatgcggcccgcgtactgatccagagtttcccctggctccatcaccatggcaccaaattcacccttcaacgtctgcaagcgcgcttcgcgaacgcggtccgcgcccacgaaccttgtcttcaagcaatcccacacttccttcgccgatctcttctttgccacctgcatcagcaagtcctccggcagggactgcaacagatgggacctcgccttcttgtcccttcttgggtcgacggccaccccggccgccggctcgatggcgtcccagacaccctggtcctccatcatcgcctgaacccgaatgcaccagctggtgtagttcgttgccgtgagttgtgggtaggagaaagcactccccgagctctccctcgccggatccgctcccgctcccgccggaaccaacgccatggtgtcagatcagccctcaacctgagtgctctgataccacttgttggcaatagcaaaaaaactccgatcaaacaccttgctggcagactgttcacgcccggcacggcaagaactgcagcggcaacaacgaacagagcagcaaacagagcagaggaaaagtttcagagaaagaattcttgcaagaatgtatggggcaattttttctgggtttttctcattcaactgaatgtaaaccttacaaaaagaataaagagctaagagaactacttatactcaacgcaaaaaaaaaataggaatccgaggcaaaatcgcgccatcccacgatccgcttttctctgaactccatgcacacacccgcgccactgccagcgctagactcggtcacgattaactgattcgcgacttatttgcatctctaacaaactcctgctagactaattcatcctcccgttcagctccgagagaatcggcttgcattgggccacagctgaaattaatcaacaaaacaggccaagaaggtagctgcatagaaaagtttaggaaaaagtacggattacgcccctaaactatcgcggtcgaacgaattaccccatgaacaacaaaactggacattattcacccccaactatgcaaaccggacgaattaccccctcaacccaatccgcggtggttttggtctacgtggcatacgcgtggcagtccagtcagtgaggcccacctgtcattttctcaccctttctcttctctctctttccctaatccccctctctccctcctctctcccctcacctccattaccaaccgacgacgacgagctgaggactgcggcgcgcgggggcggagccaactggtggcgcgaagggggggccgaggacggcggcgagccacgcgacggcgggtcttcgtcgtgggagcagaggagcagcagccgacgcggcctcaccttccatcgatgcgcgggagggcggcgcgacagcagggggacacggacgtagccccctcctgctaatgcggtggctggcggctgcccgagcagcgtcgtcgccgctgccgtcttgctccatgtcccgacgccgccgccgctgccactggagccggccgagctcgtcgacccgctggctcatgaaataccaagatctggcagtcctctgctggggcctgttcctgttggtgggaagcatctggagcaccagtagcagcaggaacacaccaaatcccttcacagagagaatcaaaattcctcagagacaagaacactagagatgattcctcctgctcaccgccggccacctacagcggcatcgaggaagaaaaggtcgtcaaaaccagcgagaggacaacacacaccacacgcgaccacgcaggaccagcggatccaacaaccacgcaaaaaaaaaaagcagcagcggtggtggcatggatggagcgatgaaattgcagcgaacacgccgctgctaccggagccggccgagctcatcgacccgccgccgccgcccaccacctgcacccgcgcggcgccgtgcgctgacctgcgcccgacggcccgagagcccgagagagagggaaagagagagagagacaggtggaccccaccaacaaaaacaaaaaaagaaaacgctgactggattgccccgtgtacgccacgtaggacaaaatcgatctggattgggtcgagggggtaatttgtccggtattaaaagttcagggtaaacgatgtccgattttcaggtttagggggtaattcgaccaaccgcgatagttcaagacggtaattcgtactttttccaaaagtttaatatgtagttatgcagtacatgcacgtctttgtcagcaacaaaagaaaaaaaagagagatatgcactaacttgcttccatcaaaaccgataacaataaaaaagagaaaacaacaaaattcgaagcaatttctaacagcaaaacggtgaaagtaaagaaagaggaaatggttgcggtgcgcgagcctaggctagaaaagaaaagaaaaaaaacccatcgttccaccaggatcacagcaaacgcccattagcaatttttgagaaaatgctaccaaatactaatgttaaattatactccctccctctctaaatttgacgccgttgacttttttaaatatatatgaccgtttgttttattaaaaaatctaaatttgacgccgttgacttttttaaatatatatgaccgtttgtcttattaaaaaatttaagtaattattaattctttttctatcatttgattcattgataaatatatttttatgtatacgtatagttttacatatttcataaaagtttttgaataagacgaatggtcaaacatatttaaaaaagttaacggcgtcaaacatttagggaaggaaggagtacaatgcattgattagttggtaaaacctaaaaggcgcgctaattgagtggtatattctcaaaattattgtcttgtgagataatatatagaagactattttaatcttattattgttatacgaaattcactgtaagaattcgcttgaatatatatttttctgaaaaaatcatgagctgcaattaggagttcgatcatctcaagttagcatatgaggtttttttaagaaatttcttatataactcatgtattttttaaaagcgaacaaatttaaaacccgacttaaatacggatatgtatcttaaaagcgaacgtacttaacaactgactcaacactgatgacataaaaaaccgttaaaaatatttttatcttttataatagtagaaagagatagagatagagatagagactagtcaagggcggcttcacggccattcggatcggaaagcaacaagcctgcagctttacgtacaatttcctcacgtcacgatgagagacaaggaatcatcaactacgctgtccccgcatagcaactggggaatcagtccatcaaaaaatctcggggaatcagggttataattttctcatcgcaatagactagtgaatataagaatctagtggaatctctctctcttccctctagcagtatttttgtggtgactggtggctcgacttcgatggttcgtggaataagagcagattttagctgacttttccgcgcgtatataggaaacaacaagaagtagaaaaccgttagaacggaccaacaatgaaattgtagcatagatttttttttatataacactgcaaaaaaataaccgtgcgttgcaacgggtaaactaaaattttaccaaatataaaatattatattattagggttgagtttttcatgatatgggcctttaagaaaatatatttctagagaaataatgaaagttcaaaaaaaaaagaagaaaaggcctctttagaggttagacccgccggcctgctagggcattcgcacgcgcggcccagcatcccagcagtgttgcaacccaggaagggaggccggcccgacgcggatcaacctgagctgttcattttcattgacggctcagatcgattctgaatccatcaaaaccgctaaccctaaccctcattcactatctcctttccttccccaccgcgagtccgcgagccgcctctctctctctctcttggtgccgcctctccccctccaccgctcctcctccccttccccagcggcgccgctccccctccacccaccggcggcgccgcttcatctccctctcttcctcccaaccgtcattcccctcgccctctctcacgcctctcgcgtgatgggtccggcgacggcgaccgcaggtggatccggccgcaatggtggcggctgaggacggatcaggcggtggcggctccatccgacccctttcgcctccctcctgtggcggatctgacggcagtggcggtgtcggccccattcctagtgtggcgacgcggccaggagcggcggtgggctcgggagctggtcgcggtggaaggcggtgatgcggacaacggcaatggcaacgacgacggcgatgacgaccacagcggcagacgacgacggcggcggcggcggcgaccacggggaggactgctgtgggaggtggctagggttagggtttggttttttttttatttgggatgttgattttgtaggggattcttgattttgatttgggattgcaattgagtgattttgtgattttgggcaaaggggttgggagcaattggttgatctgctcgtggatttttttttatggtgtatttgagttctcttgtggatctctcttctgattttatttggttggattagagttcgattcttttagttttttgttagaaaaatcgcaaaaaagtgcatgggagggaatcggactgaaaaataaggcaaaaaattgcaaaaaaagaaatgcacggggagggtatcggactgcacatcgcattatactcggacgacgtaccaaaattcttgccaaaaacatcttaaacttttataatactagaaaaatgcccgtgtgttgcaacgggtgaaggatattttaatcttattgttgttgtacggtttagctaaagtgaaattaaccgtaagaattcgcttagatatattttttacaaaatcatgagccgcaattaggggtccgatcgtctcaaattagcatgtaagttttttaaagagatttgtatatgactccttctgtatttctaaaaacgaacacaattaaaaaccgactcaaacacggatatgtatttccaaaagcgattgaacttaaaaaccgattcaaacacaaatggcgtaccaaaagtaccaacaaaaacatctttatttttttataatagtagaggtagagatttcttatacaactccatccatatttccaaaagctaacgaacttaaaacccgactcaaatactgatctatatttccaaaagcgaacgaacttaaaaaccgactcatacacggatgacgtatcaaagtacagacaaaaacatcttcaatttttatattttataatatgtaaagataaagatataatacagtgatatacctgtgcatttcaacggcagatttttcatgggatttaaagtaattttgaccggttaaacagcctgctgcaggtttttctggtctaattgaggagcactgtactaataaagcaatgtgtcagctatctagaggagaaaagaaattgaaaaaaactgagaaaaacggtgagggtaggagggttattaactgatgatacggggtagaggtgggccggttcagtttacaggattttctcgtgctacgcacgctagggaagagagcaggattgtacttttaaagtagttgtagacaaggtaataaatagcgatagtagcggactacatatagcgtattggaacttagcagccgctatagcgtttcgcgaccgctatacagtctgttattgactttgttggatctctataatgctaaaatgatgttctttacatatggatagaataacttagtacaatgtgccttctttatcttatatattaatatgttattccataatttttatgttatgaaatgtagaagtaattaagcatgcagtttaaattttaatttttaagtgaaacttgatgttaatcttgatataaaatctaaatttatggttatttttcttaattttgctattgaaacttagcgtccgcaatagcgcccgctatccgcaatccgctacccagtcactaatccgctaccaatttactatacgctatttattatcttggttgtagataaaacaaatatacatatttaagttgtaatattacgatatgatagttttagcaatcgtgcttattaaaaaccatatgtttggtatttgctactggattttaaatgccttaaaatttattaaaaaaaatacaaattacatattactaagcctaaaatcgtagcgctagactgtgtagttttcgtttattttagttgggattttgttattttatatggttttatttttacgtttatatgcttgagtatttttgcatgttttttttcatgaacagaaaatttattttctattagtctaaagaagggactttgtttaaataaaggatgagaaaggtatgttttttttaaaaaaaaaacatacaagcacctacacttccaatatacttataccttatcatcgtaatatttagcactaattttgtcacaaggctatctttttttaaaaaagagcaaaagctttgccacatatatattgatacagaagagtcacaaggctatcatgagttttatacctcacaatatatcatttcatcaacttttgtttggtcagaatttacttctataacatgatctgtttgcaaataacaaggatatccatctcaagcaaatatatgtttagttctaatttacatcagaatggtcaattttcaattcattctatgtatttcgttatgaccaacaatggttatgtagagataaacaaggtttcgtggaaataatgttgccattaaacatcaatattttcataaggtatttgtaaaaaaattaatggaaaaaaataatgcattgtgggtctagattaaccgtgtagttgtgtacaacatgcaattgtgcctatagaaatactatatattaaagagttatatattaaatcgaactctccttataaaactcatatatgaaatggaagctaaaagtttgtcatgtaaagtgtaacacagcacaaaattacgtgagacaatccactgcctttgttatatctatcctatagaatattattgattaaatatgatatttcacaacaaatgaatagtttcataattttataaagtattattttagttttacgaaatttactccttcccttatacgtactctcgctactttgtgaatggtctgcttgcattaatttcttaaccatcggactgtgatgatgtgtcatgtagtactattttatttagagcgaattataatttgggtcatcttttattattaaagtttcactttagatatatttaaattaattcttttactttggatcgggtaactttgctattttttttgtttggatcaccctaaataacttcttcagcacttattaacaacctcaaacaaatatgttttaatataccagtgagcttccctatccatgtaacgccttatcttcactgtaataaagggtttatatgaatagtaaagagagttgcgtgaagggtggtccaatattaaaaatgataaagttacctgattcacagtgaaaagattggtttaagaatgttttaaagttttattttagcaataaaaagtgatccaaccggtgatttttttaattcatcaatttatatagtgctgcaaatgtagtaattgtttgcatttagtatcgaacattatttgatgtacctgagatcaggggacagcaaataattaagtagttggagtgttcttatcatatggctgctagagggcccgctttaatataatatcatttcacttttcagattaaatcagtatataccgggaagaaaaccaccacggtgattctcccacagcattagtgattagtgtttaatccggcccaataattccatgaatgaggtcagagagtttgatcaactaccctgtcctggtctttttagtataatggtgtgtgtcagtgtgtgcgtacgtatataccgcgtaattagaaaaataaaactacgtcccatccttatagtcaggcgtactatatacatatatatatatatatatatatatatatatatatatatatatatatatatatatatatatatatatatatatatatataatcattgttgatttgtcaaaaaacgcatctcaaacttctcagaaaaacatataattgacggggactgttcaaatcgaaaatattgtactttgtatgaaagaattacctgcacgcgatcacaactccgatttggacaaaatattttataagcacagattttataatcgaaccaaagctggggccacacgcgctgtgctagaaaccgattaataaaccggtaggctcacaggctcacagtgcagtggcccagtggccgacggtgaggtcattggagacaccccgagacaggaaagcaatggagacgggacggcataggtcacagagcctgggatctgcagggctcgcgttccacgcactcctctgctcgtcgttgctgctcaacgccgtcttcttcgcgcaccacctcctcaggtcctcgccgacggcaacgccggagcggctcggcgacgggctgagctgggcgctgcaggcggccagggaggccgaggccgtggccgccgccgactgctccggccacggcaacgtgttcctggatggcgtcaccggcgaggatgggcggcccgggtgcgagtgcaaccgctgcttctccgggccggactgctccgtccggacgcccaactgcaccgccgacgccgacaggtaactaatttggctctcgtgttcttcagatcttcttggccggtgccttggcttggctactgcacacgtacgttggcacatggcgatggctgccgaataggattaattatcaatcatcttgctccgagcctccgagtgttcagggcttcaggcgccatggcaaggggcgcatccgcggccggcggatattcttgtccatgcggaaccggttattttatccctttggcatcccacgatttgttattaaatctcaaatatcatcaataagatagttcaatatatagatgaaatagttgtaaaaaaaaatctgaaaatctttatacgctagccgcctattataccataaaattgtaattccaaacttggtttacatattgaaaagggaaaaaaaaaaccatccttacaaacagaaattgtatgtagtgtctgcgctatttatagtcataattgttcctcatttcaacttgaatctaagctccaaccccagctgcagtaaccactaccagtgcacctctgtttgatagttccactatttattgcatactagttctataaaaaaataggtactcccaaagtttaagttaatgttattgcccaaattaatgtccttgcaagaggtgtttcttgccccaacaatttcacatgaaacatatctaaccatcctgtcaccacaataattaatactacagtctttacctattataataattaaagagttttctgtactcatgcctcttcatccgtcgctccttgagtcctgatctattttatttgtttcttccgttttggtacataatcctgtttatgattcctctaatcaccccgtatcctgattcctagcgactactgattccaatactgttcgcatctctgcatacatgatcccgcttctaaaactgacggtgagtggaagccaatactgttcgcaacaaaagcaatcaacagaatcatgtattttgtggccctgtgttaccgaaccaaactccaaagaaaaatattagaaacagaacgtcagcttatcaaggccacaaagtacacgaggagaagacgagcacaagaaattaagtcataacaacccaataaaatcaactagaaaaaatgtttccaactaaaaagaaccatcggaaattttaactagatatttttcatgatatggtatcagttttgaaccaaagtgggttataatttcgtgtcattattttccctattataagtgatgtgacaatttaggattttttttttatcatgaagcttaaactaacaatttccgtgatcgggtgatggatgtacacaagtcggcgtcacaatcagttgtgaccgaatattaattattcatgcatggtggcataatttcaaattagtatattttctgttgcaacgtacaaatattttttaagtaatagtttaaattaatcttccagcccaaattaatcttcttccatgactacttctagttctagaagtaggattttacgtcatcgctggaaaatatcgagagatcaggttaattttttttttgtttgtctctgcggtctagcattatacaggtcgagtcaaaacaatcgttgcccacacatgtggctgggccgtatctaaacaaggactaaatgtcaatatttgggccgtacaaacctggctcaagtaaaatctgttttaacctgggtcttaccggaaatactgacagaccagcccaatatatcagttttaactggcgcgtgtgagattaagaacatccacaatatataatttacttaaggatcctaaactctaccacatatgcatactaatggaacacacattgaaacatattgctatcacgtatgaaacactaaattttaacaggttgaaatatatatttttttattagaatatacataatcatgtgatatcttgttgtaaaaatttaattacgaagaatacaactcggattatagatcagataagtagtttaaaataaaaattatttaagatgggaacgagggaggaagatgtagcagtagcagcgccgcatttttatttttcttgtctaaccgggcgcgtgtactagtattctcctggtatttgactcgagatcatttcccctctctcctttaggtgtatctatgcaaaaggtccatacaatgtgtagagtcggtcttttattcttctctctggtttggggcccccacattgcaaatgctcaaatgagctatcattccgtacagaatgtgtagcacagccgctggtacgtagcacggcacgtactccctaacactaatcctgcaatggttttgtgcagcgggaacccgttgttcctggagccgtactggagacggcacgcggcagccagcgccgtggtgttctccgggtggcaccgcttgagctacatcaccaccggcggccgcttccattccgtcgagctcgatcgccacatccggctgctgcacagggccgtcggcaacgcggtcgtcgacgacaagtacttggtcttcggggccggctccatgcagctcatcaacgcgttggtgtacgcgctctcccccgacggcaacgccgactcgccgccggcaagcgtcgtcgccaccgtgccgtattacccggtccgtgattccaaacaccaccacacgctgacaacctgcatgcgaaccatgccattgacgatgatctcagttaattaagtcgtgctgaagtgaactgctttgatcgatgatatgtgtaggcgtacaagtcacaaaccgacatgtttgacggccgggagtacagatgggacggcaccaccgctacgtggtcaaacaacggctcgcgaaactccaccaaaggcttcatcgagttcgtcacctcgccgaacaaccccgacaccgcgttgcgcaagcccgtcctcgccggctcgtcggcgatcgtcgaccacgcgtactactggcctcacctgacgcacatcccggcgcccgccgacgaggacgtcatgctcttcaccgcttccaagctctccggccacgccggcagcagattcgggtacacgccctcaaattaagcctgacattgcaagcgacacgtgaacacaacgacgcaaaaacttgtacactacatatacgtcataccgtgctgtgcgttgcgcagatgggcgctgataagggacgagaaggtggcgaaaagagcactttcgtacgtagagcagagcatcatgggcgcgtcccgggacacccagctccggatgctgaagatcctaaaggtgatactggccaacctgcacggcaaggaggacatcttcgccttcggctatgacgtgatgaggagccgatggcgaaggctcaacgccgtcgtgtcgcggtccacccggatctcgctgcagaagataccgccccagtactgcacttacttcaaccggatcaaagagccatcgccaggtgatcagtttgtctcgctcgctaacactcaaaatcaatttctgtcaaccaaaatctttgtgctcatgtgttggcttgtttggtctccccctgatgggcagcctacgcgtgggtgaaatgcgagtgggaggaagacgtcgactgctacgagacgctgctggcggcggggatcatctcgcggtccggcactttatccgaggccgaagctcggtacacgcggatgagcctcctcaaggcgcaggacgacttcgacgtgctcctggagaggatcaccgaattcgtcgatgccgaggagcacggcagagctcccggtggctccagctccatgtgagaaatcgtgaattgagagggtgccaagcttcgtctagctggcttcgatgggcgctgtgccggaacgatcagctctactatctgattgttcttgggtaagttcatgggtacaataatcaaggggaatgatcagctagacgttgattgttccccgtcaatatttggacgaacaggtagatattgatttgtgtgtattgacgaatgatgtagatatacacaagcaattatgtgtttcagtgatcaacaattgaatatgtaattaaatgaatatcatacatgttacatttactacttaaggcagaacactaatttgtgtgcatactccatcagcatgcgtcatccttgaagtttctctaaaaacattaatatgtgcctctaagataaagggagaaggaaaaacttgggcacgagcgggagcaaaaagacttatgaatatgttaccttagtttccataaaaacacttatataattatttccttttcgaactctttgtaaatacttttaatcatactctatacaattatattgatactgttatgtgccggttagtaaaagaaaagatatgcatatggcatggcagggaaaatggtaatgtgatatgcatatggcatgggtgcgagcaaaagggaaaatgtgggcagagatagcacatgcaaaaacgaaaatgcgggctaagatagtacttagttgcattgaaaaaaaatgtgcatccggaaaatagaacctgactcggtatcgtggaagggtactatggccgtgtttaattcaccccaactaccccacacttctaattttccatcacatcatatcacatcaaaaactttcctacacataaacttttaaattttttccaaactcccaacttttcctaaactttcaacttttttcagggactaaacacacctataataccataccactacaccagatgcacaggccctagtagtctctgaatatcgtcatcaagttagaatcacctactaccactgaatcagctaatagcaggatatgcggttagcattatatttttctcacgtaagagcatatatatttttcacattttatttatgaaagattaaaatgtcaacataacttagcgccactaatactaattccaatatccataaattaaacgcgatatatcctctagtgttctgttaataataccatgactactttgttatatttgtttcttttcttctctctatttatctttacctttgaactagtattagtggcatcttcttttactatctttaatgatattttttttacctactaaagatctcattgtcatattgtatggtagttccttgtcctaaaatagttgtcttttcaaagtttaaattccacagtacttgtcacttgagagtaatactagtcacatcagtcacctcaaattcaaatttctacctattctacctttatcactgttttactttcattcaaataaggggtaatatattctttgcgtgttaaatcttaatttgttctaaaaaaatagaaagataactatttttggaaggaggagtacgcccatgatagtttatagccccgtcgcaaataaaaaatggccattgtcctccaggcttcttcattaatgatctgggacaacggtgtcacgtacaccaagggagtagttggcgtgtagtatcatatcataaggctgtcaccgggtccgatttaattaaatgttcatagcatcaattaatttcgtcttaaaacgacataccagtaaaccactacgggtccatggcacttctcccgccgcatttctccttgactaatcccggagtagatagttttttttaacgactcgcacgagacggtgcgaagttctattgatagagcaggaaaaaattataagattataaccctggagggtcataaccaggaaaaaagaaaaaaatatacaaccccacacacctacagcgccaacacacacgaccaggaggatgctagcatcggaccggccgccgctaaaccaacaaaagaacacagacgagatcgccctgaggggtgagacagcacgacaacgccctcaggagggggaattaaccatcgttgtcagcccggcaaggccggactgggttttcacccgccgcacaccacctgcgaatccatggctgacgcaccgatgctccaccaccacacaacctctgcctacatgtgggacccccgcactggcgcccccgccggccagccttcgagcgccgaagatcgtgccacgcccaccggcatctcctcctcgcaccagggtcgcctcctcctctgccggccgcgccgaaccggcctcctccaccggacgcgcctctcgcgccaatccggcctccctccatcggccgcgcctctcgcgccaagccgccctccatctccgccgcccgcgcctctcgcgccgagccggcctccactgccatcggctgcgcctttctgcgccaagccggtctccgacccctcttccgtactctcccgcaccggccagatgcagccgtctgccacctcctcggctagccgaccgaggccaccatgccaactcccaccaccaccacggccgctgctgccgacggccacctcgctgccaaccagccgcagccccatcgccgtcgtccagccgctaccgcaaccgtcgccacgagttccgcgctgctgcctccgccgcgagagccccaatgccacagccaccaacagccgccaaagccgtcgaccagccaccgtgctgtcgccgccgacaagccgctgatgccaccatcgccatgaaatccacgccgttaccaccgtcgccgtcgccccgtgctcccgcaccgttgccgccgccgacgtcgccgcgagctccgcggtgccgccaccgccgcgagcttgctccgccaccgccgtgagcttgccccgcgtcgccatcctcaccggccttcgggcaaacggcctcaaccgccgttggtgacgctcacacgcgcctgaccgcgtcgcccacgacctcagctgcgccgcccgcgcaaccgtcgccgcctcttccccgctgccagcacgcctgcttccctgccgcccgccgtcgcccggcgtcagccccaccaaatctggccaaaatagcgcggatctgggcgggggtttccgccgccgccggccctatacgccaccaccaggcaccgccagtcaccgccgccaccactccgccccgccgccaagcgctgccccgccggatccggccaggcgggcgcggattcggacggtttgccaccgtcgccgcccggccagctccccgggccgccgagcgcgcgctgaggcgaagccccgccgccaccgtccctgcggccgcgcgactttgccggcgcccgctcaggcggcggcgaggcagagaaggaggggaggaggaggaagaagacggtggcggcgtcacctctcgtgtcgcccgtggagagggcgatgcgagagccctttccctggagtagatagttttgcttgtctgctttgtgtccgttctgtttattcattaattagtatctaaaataagatatgtgtccatcctttcattcttataatcgggtctcctataaaatcgttgttgatttgtcaaaacacatcctcatcttttatgcttatcaaccaaaattttaatttataatcttaaatttcgagctgataaggttttttcatcgaagtttattttttagcttttgcttttagatcgctaagctaagaacacgtatatatttttttttcacaaattacttttcgtatgcaaatatgccatttggcttattctaagcgaaacaatgggctcgctatcttcttagaatatatataattgacgggccagttcaagccgaaaatacctccctcaaccgattcttcccctccgctcgcatccgcccgtctcgcccctgcttgagctggctgccgggagtgcgcgcagtggaaggacggtggtgatggggctttttcctcggctcccaggcagatgggctgaggtttgccgccgaagctgggagcacagtggtgaacggcgacggtggcggtgacaggcatctcgctggcttgcgagcggcggctaggttgcgtcggcttgtggatggcagtggcgacggagttactctccacactctattagagtttgtgtcgaatatgcgtacaaagtcggttacaatttaggacttgtagttgtactagttattggagtagagtaagagtcagactctatgctagtatccttttaattagaaggacaaacttgttgtaaccggatatgacgacttagcatagcgagaggtagcgtctgccagcggcgtccggcccagggtagttgtaactctggtatgctgtaatatactgaattgaggagtagcaccccataaactgtgccccggggatgtaggcttcggctgaacctcgttaacaaatatcgtgcctcggtgttgtcatcatgtttagatctcctatggagtttcttccgtgtttggtttctgatggtaatttcggactgattatctaataagtggtaccagaacttaggtttaaaatccgaaacaatttccaaaggtcaaatggtgggggaggccaggtaaaagtcttcggggtcacatgggttgatgtgacggggaagattgttgcttgggtttagtcccacatcaataattgatggtgggggaggacaacttaaaaggtggtggcagttctctttcatcagactagtattttgggttgtgtagactcaggatatatagttgtggtttcggttgggcctgtggtgaagttggcctaatgtgacctaggtgacctacgatacgtggccgggctgcacactcttacaagttcgtggactgcagcggagatagagtttaaatgagaagatctgagtgggctgatgaatgctgcccggctgcacactcttacaagttcgtggactgcagcggagaaagagtttaaatgagaagatctgagtgggctgatgaatgctgcgggggcggggcgtgttcaggcgactggctgggtggtggtgatgcgaggtggcgacggtgttggacggagacggggctgaagttgtgtctggtgtgtttggtctctcctgatgagcagcctacgcgtgggtgaaatgcgagtgggaggaagacgtcgactgccgcgagatcgctgctgctggcggcggggatcatctcgcggtacacgcgggtgaacctcctcaagacacaggacgacttcgacgtgctcctggagaggatcaccgattttgtctacgccgagaagcacagcagagctcccgttgcatccggctgaccggctccatgtgaaatcgtgaattaggacggtgacaactgacaagcttgttgtagctggcctcgattgccactatgccggaacgatcaggcattttggaaaatcaacactggaatgatccgctacttgctgattgatctatgtcgacgtttcgacgaacagatggtgtgcattgagcaatacatacacaagctattctgcaattggacggacattttggatttcagtgacgaaaaattgagtatgcaaataaatgaagatcgtagtaggcatttttgtaatcaaggacgagcatatgacatggtaagcaaaagtaaatgtgagaagagatagcacttggcattcgaaatggcggacaaaagcaacaggtgagcagggatatcacttggcaaatataatggctaaaaaaactgaaagaatgcgcatccagggaatcgaaccttggtcagtaccgtgggagggtactatgataccactacaccagatgcgcatgttgcttaagcatccaaaggaagttttactcattataacaactaacgtctttaatactgcaaaagaaagggagcaaatctgcaaatggttgtgctatagattcagaattggcagctacttccatgaacaataaaattgtatcctgccacggtattgtgctaactgaaagttttagaagatcgaagtgatatgtgcgcaacacaataagccacacagaatcatcaatttccaatctctacatatatcatatctccatacatagatcagtaccgagtaccgactccatctcgcacgagaagcaaatcagcaatcgaccaatcgtttggttcgggcatggcaatgttggcaagatcgagcagttgtagcttttccttttttttcagagcttctccaccttgtcgggtctcacgacggggttggcgcgggcgatggcgtcgcgcccggcgcccctgtaatcgtagccgcagtcgtgcctgtccgagtagcgatgcgcgccgcagaacacggcaccgcagcggcactcgaaccccatcagccccacgctcctcccgcacgcagcgcacctgctcttcgtcttcgccccgtgccgcggcggcggcggcggcatcgccccctcgtccacgggtacgccctccggcgccggcaacaccacctggtcgtgctccgcggactgtgctgcggccgacggcgcggaggcctgggacatcacggtctggcggtagcacttggagcagaggccacgggtgtcggcagagccgaagaagccgcagccgttcgcgcacgggagcggcggccgctcgtcctgcctctcgcttccctgctccatcgctcgcccgaacgcaggcttcccttccccggcgtcgacgaggaggttgagagctgcaagcctgcaagaagcgtacaggaatcggacggggattcgtaggcgatgagctagtgggagaggatgggggtctgtaccgaacgctacttggtgccccgaggcttagggaagatgggatgatccgatggatgatggcgtttgtttgaagcaagttagaatgtgacgtgttttacgcgggagtgcaaccgcacccagtcgccagccgcgcaggtatgtccgtatgtccagaaaatttctggtttttgcgagcagtgttattcttctgggacggatgttaaagcagttcaaccaattttggactccggtcaaaagctattttctgtgtgggaagatactgatgngctnctgcnagagaagctcatcacgggggcgg

SEQ ID NO: 78913 - DNA, 1509 bp, Oryza sativa
  unsure (1)..(1509): unsure at all n locations
atcggctccctctgacttgcttgttccattcgaacccatcccggcttgcacacatcgacctctccccacctcctctcgaacgatccagatggccaggcgaaccccgacgccaagggcggatctactatgggcacggaggggctcaagcccccacaagcatcgttagaactatgtaagccctcactgagtttcttataaaatgagggttaaaattatgtctagtttgttcagccccacgtgttacttcttctatcctccattgtcagtgtttacaactgctctttttgcatcatgggcatcttcccgtccccggtcgtgtgggcagcatttcagcaacacgagtttgtcctggaactggtactcgcccaacatagtcgccggtgatgttcgagtactacactataccgcctgctgacgctggtcgtcgtggtgttattcttggtgatggcacacgcgctctctctctctctctctctctctctctctctctctctctctctctctctctctctctctntcatgaaagcggagtgtgcatccatcaccatttgcgaagatgacctttgattattattttgtgattagaaaaaaaggctcgtgcgttgaaacgggtgaaggctattttaatcgtattattgttattttttttatctaaaaagtatatgagatttctattttgatagtattgatatctaatttagaacctttgttgggattatggtcatatactgtacgttgctttcttagggcctgacaagaattctaaagcaattagcggtactcgttccaagttagctgtgagtgttttaaaaggatttcttatacgactcctggtgcattttcaaaagtgaacgaatttaataaccaactcaaatacggacaacgtacaaagtattggcggaaacattttcaatttttataataatagagaagagatgaacaattgattttgaagataattggttttgaagattttctgatgatgaattgacctgacgatgaacaatgagttttgttagtttgggtctggtcagaccgacgtgtgttgtgcagtcaaatcggccagcccgatggtctgatcggacggctctgtgtcggttctggtttcggattgtttttttatacttgtgattaatttatgtttatgaattctagatgaatattatgcatatgtaatgctgttgtgaactaatgttaagtcaagttggagaggacttgtgctcagatattgtatcttgtttgattcatatgtaggtgtctcttaatgcctggggagagtgttactagtgattgatcgggagtcaacttggaagaagatgatgtccagacgatcaggatatcatggttggtgaagattccatatggtataccatgaagatattgtgtgcgtatggatgcggagtccaaatttggtatgattgtagtttataaagtttgtttattgtatgggaaggtttcctaggagattaggacttcttgtacaagttgggtttgtggttttagactgct

SEQ ID NO: 78914 - DNA, 4337 bp, Oryza sativa
gagggggcctagctagctagaaatgctagagagagctggagtcctagcgcatcaagcaaggaattgtgcttgcaattattcaagtgaaagatacgcttaagggggctaatcatgatcggtcacgagaaagtcgtttataattgggaaaacatgctgatctttcggcggatttcgatggaaaattaaaaaaaacaattaaaggtaacaggaatttttcttgcgctagctttcgcatcatatccacagttgttttttgttttccttcgtacgtaggacggtcgatcgattatcatgagcgaaagaacttaatcatgattcgtcaaatgtctccttttcggccttctaaggacatgcatgcttaagaacataagtagtacttataaaggaccatgcatatgccatatatgattattgatgtgacatcatatatatcttgcatgttttatatatgcaagtgcaagtagtggcagtgtacaacaaaactacatatactgatgatgcatgcgaagaacatattcaaaggatggcttgacctatcgatcttccaaggtacaagtctagattattgtggcagcagtaaattaaaatgtgcgtaccttacatacttaagcacccttcttttgcaaaagaacaaaataataataataataataataatgtgccgtctttcgatttgcatggagactcctacgtctctcttttagtgtgtgttaagaggatgaggtgtgatagtgtatttcaacaaccttgtttgttataaaatgttgggttaattagattcatatcattatattttttatggttttgaaatatattattactattcagctatttagagagatgttattataatttcacaactattggatatgtgccactacttacatcttctagttattttctaaattttaccttatctcaatcttaataaaattagtccgggcttttctttctcaacgatccgacaaaaaaatataatcataaaataatttacctaatatattggcgtgcaattcttttacgcgttcatgaaaaaaaaagtaaaataatttacacactagtaagtacagcggtatagttgcatacatggattcctttgcgtttttcaatatatttcacttgcaaatttgtcatagtccaaacatggagaatggacagattgtaccaaaaaaaattaagaacaatggtacatgctgatgcagagaccattagcacacaaaggggtggtggcgcagttggctagcgcgtaggtctcatagctaaaataagcgagtgatcctgaggtcgagagttcgagcctctctcaccccaccaatttggagcagtgattaatatttgctacgtaatcggttgggtcagtcacatttgcctgatctcttgattagtccatagcacatgatgagctcttccttttcagccagtggatgatactgtactaatacctgatctgacaattgatgcatgacaaattaaaatcaaaagtacttcttttttcccctttcctcagctagcgcccttgtgtggatgctactaactgatatgacaattgatggatgacaaattaaatcagattctactctccaatttgtttttaagggtctcacaattgattacacttaatggcactgattaatagcaaagataaaacaataatggtcagtatgattaaggcgctggatgccaaatgtatagccaccgtggctcattcgagccaagaaataccttttgatttcaggtgtggtcaagttaatacatagcgtatgcagctccgtaatctggagcagtgacgtacaaaatgctcaccaggataaagtaattgagcttgataggtggtgagggaacaatagacacgagaattgacacttaaaagttgtgagaattcccgtcttcgatgagatatactacgctagatagcaatgaagggtcaaagaccacctactagtatcagaacaagtgtacattgtattattgcattctgcaaagttggagcctagggagagttaaaagaagataaacaaaaccagaactcctgtggatgccttctgcaactagagagagtcatagttggtgtcgccaccgccacctttgctccagttgtcatgccagtcagagaagccagtaagcaaagcctcttgcatccactgataccggcactgcgacgtggcttcaggaactgtcaaccaggtcctcctgcgggtgctctgctcaggccatgagtccagctcttccttcacatgcagcgcaaacaccgcggctctgcacataccctcggggcagcacgcatcttgatgcgtcttgcttttgaagtcgtagaaacccagaaattgctggtccagagaaacaatagcattataagctgaagcaaaataaatgccttttgtgatgtatgcatttcacaaccatgtattatcggcagaacaaaatacacaagtgaaacaatttataagcatgtattttcttaattatcaagcagtgataggacaaggaaaacattatctacgctgaagaaacatgttttagagatatttaataaccctcctagaaaagctataatcattctaatttcatagtgcaacaatgttattttgattttggtatccaacactataaaatgctgaacacgttagttgcaactgattcttgactaaaagagtaccaagtcagagaaatcaaagcacataccatattaaactcaaacgatggaaacaacataaccaactaaaccaatgaactagctgcgcatcacatcttatgacccaccaaagcactactaaaatttgcatcttatggtttttccactatgaaagtatgactagtttgcacatcttcataaaatctatgatgatactaattacacacaatgcaaaccaaacaagtatccttttaaccacaagatagtttgtttctcagttgcgccatgtctgtactccgcagtacatgtcacacagcattaacaattagcacctactacaatacttggtgcggatggtgtgtcttgtgagtacaacatatgtcaatgcagcagcaaactaaaaacaatattgtgagtgtggttgtgctctgactaataccgtgaatcacgtgaacaacaatattccaatgcaagtgatatgcaacccaagaaaaaatgatcaagaaaataaatttgatgggttctgaggataatgcataagaactgtagctgccagttcctaagtaattgaattccccccatccattgtttcaaattggatgttaataactaagatggtttgttgcagacagacatctcacgatagccatgaactcaatatttcaggaaaaagcaggttccaaaagagggaggctggttgatctacattagcagtttagaagaatcaagcttaggctcggcttactaagcatatattgaagaagataaatcaaacacagtgaatacgagtctgcatcacaatccaaaacatacggtaccagtttgacggttatgtaagagaaaaacacatgcaaatatgtttctgacacttggcaagcctgaagtagataaaatacatatgtaaaagtagtagaaatttaaaaacaccatctctgatgtatcttaccactatatctccacgaactccagcttcttctacagcctctcgagcagctgcctgctcaacagtttcatcattctcccatcctccctgaaacaagaagacacagataacaaaatttccacctagtactatggtaatgtaacatttatccaacaaacaaaatctgatgttatgcagaatctagaaaagtaggtgaaagaaatttctcagacatactttatgtatgcattgccagcttatcaagctaaatcagtaaaaagtacaaaacataatttgcaatggactttggtatttcttaatatgcaatgtttacacctgcatctcatttcattcaaacttcatatggattcatctgagaggcagaaagaacatgataaatgccaagagcgacactcttccacctatgggctaactgaaatatcaatatgttgctcatagtatagggtatatagtgcagtagcgcttcagtgtagcatgtcaaaacaggcaatttttgtaaatttatagcaattcatatcaagtaaaggccaatccaaatttagatcataaatcatcaaaatttatattcgattttttttcttgcaatttcatgtaaactaaccgcccataaagagtttggcaaacttatgcgtacacaatttataaacatttttttcatcatcatgtatttcttgattctaattcagatgggaacattacctttggaaacaggagacctggaccactttgagagtttatcatgagaacttcaacaattttctt

SEQ ID NO: 78915 - DNA, 560 bp, Oryza sativa
  unsure (1)..(560): unsure at all n locations
atgcatttctttagtcccgagtgaaataacgggaactaaagatggatctttagtcccgcttagtgttaccactaatcgggagtagatattttttttttcctttttttcattaattttaactgcttgcatattgatttcactccatccccaaatcacgaaaaccccaaatcacctccgaatcatagatcaaatgcatcacaaattctaaaagaaacatcacacatacatcacatattcacatcaaaaattcccaaaaacaaattcaacaaaaatatacaaaaacaaattgtaaatccgcccatccgccatcgctccaccacccgccgccggctncccagcccagcacgtgccccccaaccccgcccccgccccgcgcgcgtgccgctttcgctcgctcctcgctgctgcttcaagaaaaggagaggataagagagagagagagacaggaggaaagggaggaggaggaagttaaagatgaagaggagtttgcgatcgaggaggagaggattagtgtgagggattatatacgacgcgttaatttttagtcccagttgataata

SEQ ID NO: 78916 - DNA, 1953 bp, Oryza sativa
aatatgttattagtaacttctacgcacggccacatgattcacaaaggttttttgtccaacataaacaagctaacaagatgtaaaagaaaaatactgaatacatgtgaattgatatagttctccaacatggtaaaatcgtatccagagaagaactaggtctgtcacagaaagagccgaaaccagtagtccttagagtgtgcatatatatattaaggcaacaaatattgcaacactaacctacaacacaataatgtatatacatgtaaaaggtgctacttgagctagttcctgccaataaatgctgtaggtgcacctcccaacctgcatctcaacaagcataagcagaatttttttgtactatgaaaaggaaagatctagggaaggtcaataactaaaatatcaagacatattatcgatgaaaatatggttagctttcattcccccactctatagttatatttcctttgtttagatctgattagctgccccatctgtcatctcctgattaacattttcaggttagctactataattccttaatatttacaaaaatctcatcctgagtactgatccaccagcctaagagaagtgcaacagataatagcaccacaaactcgttagcttgccatgccataatgcacagaaatgcttccctagcttagaaaaacagaagaacttaactaagagtaagcctaaaaacagaaattggtcacctatcaggaacaaacgctttgactaccaataatgattcatgaccttttcgtaaccagcaatatgcagcgacatcgacatacactgagaaatgtatctatcaaactaaactcacatccatcaatcttgacattggaggataaccccattcctaataggcttaacacatgctgctaaaaatcattctcatggatataccgcggaatgggccgcagaataatgatgtcgctatcatcaggtgttgcaactaagattcttagctaagtgctcacacacatcaagctatcttactagttggtgatagtgcttgtttcccagagagagaaaaaaaattaaagcatatgcaaatcgccgcgagaaacattccacacccagggatggcatccccaccgatcacaattcatagaacccaatccgaccaatgccatcgccctcgtacacgcgcattaggttaggtcaagaggcgcaatgaaccgcacgcgcgcgtagccatcgccgcaatccaatccaccccaaatcaaatcaaggagaaaaaaaaattaaaaaaaagcaacaataattcgatggagagggaggaagctgtacccacccggccaccagccgccggccatcctcgtaccgctgctgatgccgacccgttcgggccacaaggtcacacatgctacccacaccgcccgggttggccgccgccgccgctcccctcctcctctgcggccgccctcgccggcggtgagcccacggcggcaatgcgtgcggcgtgggggagcggaggaggagagagatttgtgcgtggagagagaagaggaggaggaggaggagagagataggaggtgggaattcctcgccgtgatgagggcgctctttttttttcgtgcggtttttttttctggattttttttgtgtgtgtgtgtattttggtgtcgttgggttgggcgctcgcttttatttggagggcgtggtgggcggtgactttcctttgctttcttttgttttttttttcatttctctttctgttttctgtttgttattttttggagttagttgccgtttttaaagatatcttttgttgtttgaaggatgtattatttgaagttagttgccgtttttttaagatatcctttgccattttaagatattctttgccgtttggaagctgctattgtttatacagtatcttagatttttcttttttagattatatacgccatattgaaatacttgtagtattgtatgagtgttgtt

SEQ ID NO: 78917 - DNA, 8620 bp, Oryza sativa
atagataactgtataatatggcataaatgttatcaagttgtatattaaaccgtctattaatctttgcaggaaaaatcatctgtttataaaaagtccaacaattaattaatcatctgtttaaccgtttattaatctctcatctttctctctcctcaaaaaagcccaacaaagcatcatggcattctttctcttgtcaggctggcatccctgcctattcaatctcatacttcaattccagtgcaataaaagggaaatgagtctctatccttaaattgctcgaatgtataataacaaggataagccaaatttgttagagttgatatattatactctttctgatatccaagttgagcaaaagcgaaagctaaagctctttcgaaatgaaggtttttcaaatcattcaacctcgatcgttttcagatgatggcaagtaatactccttccgtcccataatataacagattttgagtttttgtttgcactgtttgattactcgtcttattaaaaaaaattatgcaaatataaaaaccaaacaattatgcttaaagtactttgaataataaagtaagtaaaaataaataaataataattctaaaaaagttttgaataagacgagtggtcaaacagtgcaagtaaaaactcaaaatcccttatattataggacgaagggagtactagattaaacaatgcccagtcgtgacgataaagaagaacattaattccaagttgtcttttactaccttctctagaagaaatacagtaaccgcccgggccgtttgtatgatatcgccggccgttggagggagtcactggccggtcgcatgaaattctgataaggcagtactccatggtccgtactattaaatgaaatcgttttggacagcgacacggtctccaaaacataactttaacttcttgtttctataaaaatatttattaaaaagtgatatatgtatacttttataaaagtatttttcaagacaaatatattcatatattttttacatttttaaattcagcaacttgagagttattcatgatttatattcctaagatttgatttaaatattaccctaaataactttctttacgagtacggagggattactacctaccaataaaaattgaacgcagctatatataactaacggttttgacgacgaattgatgatgataatgatacactaccacgcgagcgagctgttgccctgttaccggcagtaggagctaggagtagtaaacggcacaaaaattctccactataccaacattgtttttataaaaaataatatcgttttcgatcgtttttatcccaatgatatgccaaatatcctcgttgatgttgttgctactcgtaaatgaggcgaaagagcaaaaccatggacggggttgggcgccggccggacgtacggccgttgttttgatgggccgtgcgtgcgtgcgtgcagcaaccaagggccgttttggattgaagccaaaacgtgaccctacaaaattttgataactttaatagtaaatatgctagtttagattgtagccaaacaattgatagtgcacacgttcaatttagctatattctagaatcttctttactctcatactaaattttgactttatatcggtattaaaccaaacatagactagctaactttgccttaccaaaaaaattggtagtgccaaaatttacctagattttagcactaccaattaattagtagggtagagaaccaaatagaccccaagtgccaaacttgttcttcccctgctacctaataagctacagttgtagagtacctgttacagagaaatcgattgcgaaatactgtgacgtcgtttataagaaaccgttagttttcaatttttttctttaaacttttaacttttttatcacatcgaaacttttctacacacataaacttttaatttttttatcgcatcgttttaattttaatcaaacttttaattttaaggtgaactgaacacaccctgtaatgtgacgtttcttgcgcaagatcgcatcctcatcgtcgtcgtcacctctgatgcaacagcaacggagaggttgatgggatccgcgaattaaccggtgatttcgtgggataagcccagtgaggcccacgtcaagcccaaactatccacgcggcctgcctgatttgaggggacttttcgcagtgaggcctcctgttttggagcgctacaaatacacaaataatcccttcgtattttaatatatgacgccgttgactttttgactaacatttgactattcgttttattcaaaatttttgtgaaaatgtgaaaatatttatgtcatgcttaaagaacatttaatgatgaatcaagtcacaataaaataaataataattgcataaattttttgaataagatgaatggcaaacgttggacaaaaattcaactacgtccctgtttaattcggaccgcttttgccggcaacagttagccaaggccaaaagattctatactactctctcattttgggtagctgatatttagattctgcagtttgcatgcctacataatcaccatcccacgtcagaggagcttcttcccatagccgtaataaatctaaattttgcttcagtaatataggcgattggtttaaagccattttttcccccaaactatacaatctacactatgttctttttttaaaaaaaaatagcacggttttactagttggagaaggctgggaaagcacccccttcttaattcttaattacgtggtggcttctcctcctccggtgagacggcctcttcttggtgctcgtcggtgacagccaaacacaaactagctctggctgatcaatctctggatatgtgtcatgtgcatttgcctgctctgaatcttcgcaaatcctcacatgttgctgcacggattgtatcacacacacgacatactgtcacaggcatggcgatagctaatgtttttctcttcttatttttttaatcaaacaatcaacgagcatactcctcctatgctgctaagctacttcattcacattgcgtggtgggcactaactgtgctaccgggtcataattccacaattaatgaagtatcatcatcatcatcatcatctcggatcacgccacacataatctcttcgtcttataagagcagatacaatagcatactattagccagctataaacatattttaataagataaaaaataagagagaagagaagcgggctataaatctgtagcccgctgcagcacggactccaagacacagtatgtatgactagtgagaccacatattaatagtatagtaagcaactattgtatgaattggctattagattggctataaataaattggagctagtagtaggctatactattaaacttgctctaaaaacctaaagtatatgataggatatgacataatctactatacaaatctagacaggtactccataaaaacctaatctaaaataggatatgtgctaattcagtacttatgtacatctcgtcctattcattactccatccatttcaaattgacctgtatatttcatagggacaccaagaccaagaaaaactaataactctctcatactatatttactctagcaacaaactctatgcatacactatccccactatttcctagccaatagcaaatcaagatattgcacgtggcatcactgtccatttactccaatgcacaaataacgaatagacttaataaatgaacacaaatatgtagattatttaggaataacctaaaaaaaactatatgtagatcaatttggaatggagggagtatattagattatattatattttatttgtaagttgtttttttaagacggagtgagtatatgtattcttgaatcttcctggggcaatcaattattaattgattaattccatgaatagcacaccatatacggtacatggatcaaacggggtagagaaagttgacaagtaattactcagctgcccctattaaaccccatcttattcaagcaataatattaatacagccggattgattgcgtagctgtgtgcaaggctgggcgatttagataaaatcaaagcctcgaaaggttgttgcttccggggctttgcaattatcagagattattctttttcttgttattgtttcgtatcggccattctcgtgaaaaagggagaaaggcgcgattatcgttttcgcccatttaatcccgtccccatccgagcgacagcagcaaccgccgtgatcttccccggatcacgccggccgcgcggatctcgtggcctacacaaccaccgttcttgctggtccatgcactgaatcgccggagttctcggcgacgacgaggagagaggcggcggcggcggcggcggtggcgggatgtcaatgccgtgggcgatggcggtgtcggtggtggacaaggtgtgggcggtgctggcggcgtgggtgtcgtcgtgcctgacggcggcgaccgccgtcgcgcgagcgctcagggcgggggacatcggagtcctccacgtcggctgatggcggggtccgtcgtcggagtcctccacgtcaggtcagagcttggagatggttaggtttcttgcgggggatgcaaagctttagttctgagcttttctttttttttttttttttgtgatgtgttatgcaactatccatgaagatttatgtgatgggaggtgcttggggttagtgtttcacctgtaattaacatttgttttaggtctctgtattctttggtcttatcagaaaaagatggtttgtgtataaagttttatggctctttctagaaaagaaattgttagctccctcgtcgaggaaggtaaagttggataagatgttcatcagttcataccattgctgaaggcccttcgatttcatttttccgttgcatactttatcctcatccgcaaaatgggtttgagatgaagttcgcggtatgctccatactccacatttgagagagaattgttatgtgctcaggacaagcagattggccacatttcagtttggtctaattagattctgttgagagggaaccttaccgcattttattagattacgtgaagcccgcaaatctattgaagagtttttgcttatgtttggatagaactacgtcctgcattttatttaatctgttcgtatcaagcgttattgcgtttacacagcatagaagctctggtcctatccatcctcaatgccagagccaaaagacaatttggcagattatccctttttttttcacgaacacaatttggcagattatcctcaatgcaaaaattcaaattcatgtttgttataatccaaaattcaagtaaaatttgagtaaaaagacaatctgacatatcattctcaatgccaaaagaatccagggccattaattaaaaaaagaaccgagacatgatatagtaacagcacatttgctaaaagaacaaaattgtacggcagtactaatgttttgccagagctagtttagtcatagcagtttatcagctacataattatagccgcaaaatgcgaaatccaatacgcagaacgattgattgctgaaaacacatctgtacataaaagggttctctggacaaagtttcacgttatgaagctcagaagtaaaaaattatctgaaaagatccggttgatgggcagtgaaaggaggaaagcactttatttcagcactgtccaggagagcttcaagacgatgtgttcttcctagctgcatagactcggtaagcagctattcccacaactgcaacggcagctccaactgcaaattattagtacagtatcagttgagttagaactcgaaggaaatttacactattttatagttttggaaataacttataaaatcatgatcgactgtgcacatgttgctagactgacaacaataaacctttacgtaaacctcttctttcatattgtcatgaactttctagtagccttgttgaacaggtatatctattgctatactaataccagacttcttgctattatagatttatagaatatatttgtacaatacaatgcagtataagagcgtaaatgcgacgagagtaaacacaacaggactgtcgagtgtggaactggctttacctgagacaaccataagggaacggttcagaagttgacggtattgtctgcgtgttttcccagcttcagtctctggaatgctcagatgaggctgctgcgcagcatggactattctacagaaaatattgttcaaatctctcaacctcacgctaataggaattggcatttcgattcccatgtcttggctcacctgaaagtacataattttgttgttaattaaccatagaaagacgactaaaagtaatccatagttgcacagagaacagtgagctaagcaaagttgagagaatcacttgcatatacatcacaaaaaaaaaagccagtaacaataaattaaaaaacaaagccagtaacaataaatatttctgaagaaacacccatttaaagttcttgcagcaggactagatatttgcacaataggaatctataagatcatattgcaattgatttgcataagaaataattgcagtaaggctaaaaacttctatcctagaagatttcctagctcttctccaaactgttgttccttgacttggaacaacaccactgttattgggagttactccctccatcgcaaaacaaataaacctagtataggatgtgacacatcctaacacgacgaatctggacagcgttctaggatgtgtcacatcccgtactactgtactaggtttgctttttgagatggagggagtatgctgcatggcagcagaatcaaacatgcattgttgcttgaatatagaactacagtgtatgaaaaaaatagtagaagcatagcggtaagtaatactatatctccggcattcataaaatagtgatcaaaatgtaaagggaaacagcttccaaaactacctgttatccaattcaaatgtctgggcaagaaaaatcaaatattttagtgccaactatgacacagaacagtggcaaatgattttcagagtaaaaatgacaaatcaataacgaacatgtagtaagcttactctcgttgattcctgcagagccaatggagattggtcaagatcatccttagcagcaacaatcagacaaggaacttcatagccagtattttctccatgtgtagccacttccacaagcaaatcccttgttctttgccaagaaaattcatcacagctgccatttaaacaggcataacatttagtgtacagaaaattatatacaatttgcataaaaagatatatccggaaacaagagcaacattgctgttgtgtgtagcttttgagattgcttcattccagaaaatataatagattgcctgtcatattatattttctatcacctttttaatattatttaaaaaaatcatcctgaattgtcaactgtctggagcaaagctaatagagctaacaaacatcggtccttacaactctccaaaaccatgatgtgtgtagaaatagttcattgtccagactaattcaacccatgtctataaaaaagttgagttgctacagctaataggtaaagaatccagttacttcagacaatgcactgaggatttcttggtcataaataaatagaacaatttggcagaattcatacctatcataaacgaatactgctacatcacagggtgccaaggattccctatcagccagtaatggtctgacatcatcttcaggaatctctcgaaatacaagtgtctttctggaccccttcagaaaaataaaattatttaatcagaccaaatgtttaaaaataacccataaatagcaaacaataaatagccaaactgcgaatatttaaatatgctaatattggaaatgacaatgtttgcgactgatgtactagtactgctaacattttttctgtcaaaaaactatcgttgaaagtaatttctgataggccattaagattcctgtctgttgccatcaaaatgcaatattttttttcacatggtatgttggccagtactatgtttcataaagaacgaagtgaatatatcatagaacatttttaaatttgcaagcaagcaaattttgcactcttataagagaatttatcagaatgtttcaatatgttggaagaactcataaccacttacagatagttcaacagtatttgctgcaaaccgttcaccattcataggcagagcatcagaaggttgcctggaacagggaccgcaagcaaatggtaagaaataaacatggtaataaagatataaagcacatagtgtaagatactaagaaatgcatagagcaccttccaaggaatgattgtagcaatgctgtctttccagcacccctgggaccaaaaacatagcactggaaaacattccgttgcgtttgctgctttttacgatcaactcgtcttttcctcatagtggtaaatgctgagccaaaatcacccgaatagccaacatatataaggttggcaaaactatttgctggatctagaagtgtcataagagcccactgcaattgcagaatagttcatcaacaaaggaagatagtataataagaaaatctaacaccaatgcagcatgcttagttctagatagtgctatcgctgcaattgacacagt

SEQ ID NO: 78918 - DNA, 20015 bp, Oryza sativa
tagcaatagggggtaagtacaaaattaccatcacatcgagatgcagaggggctatatgcaaaatgctacatacgtggagcggtcaactctggccaaatagtggtgtggaccagctatggttgattaaaacatgatcatgaagttcaatgtgcactttcaagtttatagacataagtgacaccttcgctcaagttgaaggaccaaccataaattttactcttgatagagaattaaatgatcttccacaaaatctgtatggaattcggaagcttaaaaaggtatagatcatggatatgtatttggaaattgaatggttttagatgcattgctctaaacttaacacagataagattgataggtattggcaaccttgaatgaaccaagtatcgttgattcaaattttaccacatttattgaaaggtataattattcttgtgcttcaaggtactggttgccaaataaacaggaggggctcgtgttgctagaagtggaagcctctagcatatatctgtttgatttgcaatgttgccttccatgtttcagttttggaggcatgggaatgttaacaaaccaacataagccgtgtgacactattttttcctatcttgagtagaacattattttatcttggacaatagggccgaatggttaatacagtttccacctgaatttcgatattcaagttcgagttttgccgccaagctttctagttggacccttgaccaatatgaaatcatgtgtgtttccagtagaacacagccagcaccgtaacctagtatgaaattttgatgattgcaacgtgcagggtaatataatctcagtagaattttcaaaaaaaaaatgattatgagatgaaattgttagttacagtatactagcataatacccgtgtgttgcaacggattctaaataacattcatcgacataaattaatattctgaaccacatatcaatattggacagaaagaagtatgattaaattaaaatcctaaccatatatcacaattggactgaaggaaatataatcatggaaataacaacatgaaactacaaataactttccagaatcataattcaatatcaggaaaattatgtaactaaatatgccattttttacatttagctgtaaataattcaatattataagttacaacaatttttaatagatcaaatagtgctaaaattaataatgtaaatggaaaaacaactaaaattagcagaaactaaaaatttattttagcacatagatgaaaatttgatccattaattctgaacaggtacccttttaattgacataaattagatttttttctatacataatcctatggtctcaatattaagtaaatggtctagtagcatggttaggctaaaccagaaaagaatagtgcattagttcatagatgttggaggttgataacaaagaaaatcagaacatcatgaacgcggttggcaacgatgtggtaccgatagagagagaaacagtaacggtaagatctggcagtgaacgcgactggatgagtgcgtcaaaacacgttccaggataagaaggttccgttttccttgaacatgcaggagaacgaaagatggagaaaaaatgactaacaatattcatcgtcttccctaaccaaaacaagaaatagaagaggagggaagatgggccccggtccactggcgaccaaatggtgctaagatggccagacgtgtcccaatgtgactatgtcaatagatggtggcggttggcaatgaagaaaaccaaaatagtgggaacaacaatgacgtggtcccaacagagagagaaatggacaattgcgagctcgggtgagtgcgtcaaaacgcattttcggccgacggggttccgttttcattgaatgcgcaggagggaggaaatgcagaggagaaaagggacgctgggaggacaaggcgacggggaggagggggcgacaccacgacgggaaggagaggggcccgcgggggaagggggagtgcgtgcagtggggctggagagatggatgtcgccgggaggaaaggagggagggggatcaggaggaaggaggaatcacgccgccttagccgacatgaggggggacggacgaaaatacacccggaagccttacatcttttttaattagatatagaattgatcagctaccacatacaaggatctgatgttgaactggattttttttgttaatgcagagacttgagaaaactagactagtgccattccaaagtgatgatgggattcaaataaatgtagatagatgttcaatttgatagtttagactttagaatattgttggatggtcagtccagaccatgtgtgcttgatgttgtaaagctgctaacactggcgtttaattgatctgtacccaattttgttttacattaaagcagcgcacaaaataaataggagtctgtttggcttgtggttgcttctcttcatcattcatgctccctctctctgagagctctattaaagtttggtttgggaggcatatggaattttaccaccccttcatttttcttatcgtccaaatgttttattctatttaaatttacaaggattatcaaaggctacaaaaacatttgcaactcatatattttctattgtgagtaatggacgtgaaccactagaagggcctgaaagcttggatttttcttcattagggatgacaggatacattccggtttcatgaccaaacacttgatttggacccttgccatgcataagttatcgaaattagagacctgccgtagagagatgagatgcaggtagacattgttaaagacttaaagtgaaccgttatatatgtatcaagctgcataatcttgtaaggtgactgatgttttgaggaagaatattctttaaataaataagataagcatgttcccaaaagcttgatctacccacggaaaacaacaatgcaatggaacagacttattattatattacagtggagttgtccttctgtcaaaaaaaaatcccgggaaagaatctggacaaacagattcattgtctggtttagacttggatttttatggtacattgtactgtaagaatatactatcagtatatttgatcatcggggcatttgcaaatttgccaccggttatttcaatattgcaaggatgccactcgaatgacagttctagtggtatttttgtaattttctagtggcagttttgcaataacgatttaaagtagtggtaaatttgcaattgccccttgatctaggggctaatggtgcagattcatttgatcttcctcccaattatcatgcagtataaattgaatagggtatatttgtcttttcatctttttgcgtggggataattttgtaaattcgagtttcttcacttagtcagatccgttcaagcgaaatccagtaggagccaatattttctcgaagctgcgcgcatgggcgaccgccgtcgctgaccacctctgcgagcatctcccaccttcctagcttgaaggactcgggatggcggcgctagggccggaggcaagtattccgtgagtcaaggacgccgggggatacgcgatttatccagaagaagcactatcatgaacggatgacgtgatccagacaaactaccacctatggaaataaatctcaatttcaaatgactaaacagctattttcagatttttaatgaataccaaatctacccttgcatatactgcaagtatatacttcaagtagaatgtaccgtaaaagttctcgacttagtatttttacggacaggatagaacgagtatgttgctggtaataatcttaccacaaactccacctttgcatatatttttgtgtttcagcgaacaatgattcgcctcatctaaactctgcatcagataattacgttgctattattgtggactaaatactgaaaaaaattacctctaaattattaatgtaataaatcttgcattcatatgggtttatgtattcatcaaataatacaaattttactacatgacacctaaattttatgtaatttgacatcgaaaaaatatgtcactgctaaaagacacataaaaaactggtaaatttgctagaaggcactttcagctcaattggagagataaactcttaagaaagacgagaatgtccctatgaccacatgcttcaaacatagcattaaagtgaaaatttagcaattatgcaactataaatttaccatcacctcaaatacatcactaggatacattgaattccatcttcactctagtattagctcaaaagcttttgaccctagggacattctcgtctttttaaataatttctctcacgagccgaaaaaatccacaacaaattaccaatttttttaggatgtcttttatttatgacacgtttttgcgatgtctactagcaaattacataaattttaagtgtcatggagcaaattttaccatcaaataaagatgcttttgatatcccatttatggcaataagaaatgagaattcttgcactatgccgtgaaaggactaattttttttctctgcaattataatgccttaaggatagcatgattgctgaagaatgaggctattgatttttacaatattacaactccccctagttaatatttattcttgattagctgagatgtttttggctgtcacttttgtaagtcgtaacgcgtgactgaagcaacaaaaagaatatttttatactcctataattttttaagtgttacggaagtacattattaaaacaaagaagcaattccaaatatttttttaataatggtttaagaatctggcttctacaccaacgcaattccaaatctattatcatggaaatgttggtaagtgaatagtagttgtgatgcattactgtgaacagacagtacatatattggtaggtatttgcaaccttgaatgaaataagtattgttgattcaaatcttgccatactaattaaaagattacaattattcatgtcatggaagatactgggtaccaaataaataggaggccggggctgatgttgctagaagctagaagcctgaacatataccttcgtttttgttttgcaatgttaatgcccttggttccgatatcttcatgtcccagtttaggttcgggagacattggcaatgaaaaagtacaatttagttgtgtgtatctacctttttcctttttgtggtagactaatgttctaaaccttgaattcatatgggtttatgtacacaatcaaagaaagatgctttatgatgacccatttgtagaatcaatgagttgatttatattttgtgatgaaaatattggtggtttgctaatgtttatttggagattttataagacggttgattttgtgaagtggatgttttcggttgaccctagcggtcagaccagctgaatgacgccggtcagaccgtaggtgttgcggcgatctgaccggccggcccgatagtctgaccggcaggatcctgatcgatgtcggtttcgggttgttttgttgtatttggatatttccttcggggatttggcttctagatggtttctatgtgtatggatactgttgttatactaatgtgagtaaagttgggatgaacttgggctcggaatatggtttcttagttgttgcatgtgcaggtgttgcttgaggcctcgggagagtgttgccggtgatagatcggagtcaacttgggagaagttgatgtccagggatcaagagatcatgcgggatactaaaggctagaggacaatgcacgtggtgatgaagaaatccatatggtatacaagagggattgtgtatgtatggaaagaggagtcgaatttggaagggagtccgaattcgggaagtttgattaagataaggaaagagatgagttgtatacttgcaagagagggtttcctatgtgagttaggagtcctaagttgtgttattgcatagcctacctcatgtataagtagagagggagggtgaggcctcccggtatcggttttagagagactagagttgagagaaagtgtttttgtaggatcgaatcacaacaactaagccaaccagaggggggtgaatggttggtatacccaaaaaccaaaacttttacggaaataaaacttaccctcaaattcgacggatcgcggtctgaccgaagtagatgcgctggtctgaccgcctggaacacgtcggtctgaccgatgtagatcaatcggtcgaaccgcccaaatcgcctgcctgtggctgtagccgccgccagtccgaccacaggtcacccgtcagtctgaccgcccccttgccaccggttggaccatcggtttgccactggttagaccgtcgaaacccggtgaaacacaaatcgaagaactcttaaagtggatgacggctttattgattctctctgtgtttacaaagtgcaccaacagcactccttacaaaaatctcgactaaactcgaaaccctaactaaactatcaactcaattgctctcaaaagcaatatcgggaagcctcacactccctctctatttatatccaaggtaggcagcctaaagttacgaaccaaactcatactagaagtcctaatctccataggaaaccctctagtacaagaaacaaactttacataactaatcataccaaatttggactcctcccaaattcgactccgcatcccatacgcatacaatatctctatcatatgtcatatggaatcttcaccaaccacgtgcattgactctagccttagtatcccgcatgatctctaaccaccacagacatcgtcttatccccaagccgactcccggtccttcaccgcaaattctctcccggcatctcgagtcacctacacatagaacaaacaaagaaaccatattccgagaccaagctatccccaacttgactcattagtagcaaacgacagtattacatacgcatagtgtccatctagaagtcataatcatgaaacaatcacgcatatccaaacaaacaacccgaaaccgaaaccgacacagagtcggccggtcagaccacgggctgtgccggtctgaccgcgcaatacacgccggtctgaccggcagcacctgcccagtctgaccgaaccacatccagcagtactgtagattcacatgtgaactccaatcatctccaaaaccacttcgcaaataaattccaaatatcaaaaacaataatctccaatgccaattgttcatcacagaataataatcaaaaacacctttgattttacagtttcgagtttagttcgagattttggtgaggagtgttgttggtgcactttgtaaacactagttgatgcaataaagtcgaaaagtttcaatctacatcttcgaatttgtcatctaccggtgtttctgggtctcgacagtctaaccacaggtgtgcgcgcggtctgaccagtgggatagcggcggtctgaccgcaggtgttcgggcggtctgaccacaactgcggtcagaccggcgaagctacggtggtctgaccggcgacaggagggcagtttgactggcggcgactggatttaatcatcgacttcgttcgagggtaatctttaattccgcaaaagatttttgggtttttggttttccctaccattcacccccctggtaggtttgtttgatcttttgcgatcctacaccatttgtagcattaaaggaaacgagaaattcttccattatgcaccaaaaggactatttttctctctgcaactataatgctttcaggagagcaggatatctgaagcatgagtcaattgattcttacaatctaatggtctactagaacagaaatattacaacatactctcgcatacaaaattacaatgtctgtcttttcaaatgaaagcactggaccggtaaactcatcaacttcaggacaatataagcaaattgatactcatacattaaaatatgatagctataacatttttatacatgggaataatggtacctcaatctcggctgatagcgaaatcatgccaaataaaaaaaagtgtgtcatggaaataacattggtatgattcctgctaaaagtaatagcatacaaattatgaattctctgataacctgcttggagaattatccatattcaaaccgatacacatgtttcgcatgtcttaccatgtcatgtcaggaatacgctgttcaaaaatgcgtatccagcaactaccccaccttcgttcagtgaggcagccttggttctcatcaaataaccacactggtcatttataatgaccctgtctttgttcctgaaattcagaggccaaaatttgaggtatatccaatacataatatggcttcttacttcagttttacgatttattaccgcaggtaggctccaaaaattccaaattcagaaaccgcattttcccgaatgcatgtgccatctcggactagatagcagagtgatgctggtggaaagatcctctgcattaggatgtaggctgcaagttcattgcttccatccttcttcagacttatcagtgtttcacgcagattgtccccataaatgttgtttcctgaatgaaacacaagagtttctcattagataccaatgcagataatttgaaggcaaagtatataagatagcagggtacctccaccctctctttgtggcttcagaacaaacaattctggtgattcaatagcagacatgactatactgtcattctccaagctccatagccctgcaaagcatttccgaactttttctatgtcggctttgttgtcaagaaacctatagtaggaattgtagtaagttcacacaaaatcagattaactgacatgttaaaaatatgagcctttgttaggcataaaaaactatagattttaaagaatatcatgttccccaatgtaaattacctttcgagcacattttcttttgccaattcttgttgaatctttttggttccaacaagatggtgtgctattgatgggcacttaatagcagaggaacactcaatcaagagtcttgctctccattccttagaaaaaatacagagagaagtgagagataggaaggttaatttctggataagtaaaatgaacggatgaagatgattaataacataccgcttctgaagggtaatcatttggtgtataacctgctctgaagtacacaacagcaactggcaatccatctctacatgagaaaataaatcatgttcgatagtctgaaatcgtgtaacgtgacattatatccaaatttctgcaggagaatccttacattgttagtgtaccgtcaggacggagctctccttctgcatctattgcagccattgttttgcgaattgtcgtcaccccatacgtgaaacgaagttaagggaaactattttttgtttaattgctgggtggatattttggttaaatacatggttaaaccagtaaacactgaagcatttttcagctatcaaatcagctttgcccactcaaggatgtcacaaaattggacagttacaaaatttcagaaatcagcaatagttaacagtttctttgattcttgaaagcacccaaggatatatttctctcaaggcgacagttatccaatattggtcatacatgtacctttcttctggttgaacaaccaccagaactactgaactggatgaccaaaactttagttagtaaagagtagtcatgcataagaaaggtcatgcataacagcttacaacctttgattgttgaactcagcccatgctccagctaatgcttcagcatgctgagcaattgctgtgttcccaacaacactctctggatccaaaccgagctccctctcatgctgcctaatcaggtttctgcacattacatccaggttgttctttgttatataaattttggtgtcagtaatttattatacaataatacaataaaagtgggcaaaaggataaatagcatgccaagaatacaacttaagttgccaaacttattaaactacttcgatatattaaattaaatttctttctgcatgcaaaatcgagcaaactggctggtctatatatacatatttgaagtcatgacgcctaaaaatcatagaataatctgggaaaatatgtattggaaacttaaaaactaccataagattacaaaaatggacttctgagatttatccatcacaaatctcaaatgttcatttttgaatgctacaggagtttctaggttttccctaaatatatggtttatactatatattttccatataacccatgggtgcataagaaatgaggaagctactttttcatgactctgaacttccaatcttaacgatgtgtccagattctgttcagggcagcaaacttatatttcaatgttttagcttgtctgaaaaatgtgtgaatgcatggttaataagaagaatcaaatacatttggtgtccatctgtgttttagcttgtctaacctgtgaagttcacatacaccgcaagcaagaccgttggatgatgttgaaatggtgttgagttcaacttgaagaagctggtcagtggccccatcaatcatgtaatctgacctagtaagacccaacctaacatcctgaaagatataatacagttcaattttttttttcaaaaaaattaataaaatcaatgctataataattatcagagtgttgaattcctcattgattagtatatttcaaaataagctgcgtggtcacctctttcttgtttagtttcatcatctttgcatggatatcaagaagccttccagtgaatgaatccacctctttcgttctggaaaatgataaactaaaactgttacaagaataacacgatgaaaacacaaagtactcaagaattgaaaccgatggttcagaacttcaagactagggtaatctgtagtttctaaataatgtagttataacttttttggtgaacttaggtaatataatttttttgttagtatggtttttcccgagagtttgaaaacatataattttatttatgtcaattatttaagaaatcaccttgccaaagtctcctgcaaaaaatccccatccaaactaacacgatcaacaagctcattgaaaaggggagccaattcaaccgcctgatcccagtaaactttcgaaaatgacattggcagtagagcaaatggggcatggagcaaaccaacaccgggagcttttcctgatctctgcagatcacgagatgtacctatgagtgaatttcttcttgacacgatgaaaaaaactatgtgcatttcaattccagagttgcaattcataaaaatgatataaaaatcaaactacaggtaaataaaacaacagctaattaagaactagaaaaatactcagagacgatagcattgaaaatgactttcattgccagtggtaaatccaagaaatgaaatcaggggctgtaaagaagcaacttaaatgatgttacaaattctgatggattatcatcaaattacataaattaaactgatttcttgtattagagggatattcaaatggacatgttacataccactccagctagcgcaaaaaaggtagaaggttggaacttatggtgtgtttaagaggaggggaaaggagaaaattgagaagacacgtaaagtactaaacctactatatatatttattttgatagtatatttattttctatttgtaatactgctacatgtttttctataaatttagtggaacttttaaaaatttgttaatgaaaattagtcaacacactttacattatgaaatggaggagtagaagatgaatatattttttgcttttgatgtcaatctagcctagaactgctgggaaagtttgcccaatgaggctctaccgcgatgacaagaacgaagcccacgcttaaaagctttgtattaagcttggcaaaaactaggtaaaccaaataacgagcattgccttggtgggctacagcccaaattaaatgaggctgggggctggctagatatagataaggaggtggttaaggatcaaatcagacttctttttttttttcatgttgaagacttctttttaagacggctagttaattagtcactttcgtcctttctatttctgtcaacagtgaaagcagctgcttgtatgaaccacgcatgtgctcttgcttttgtgatatgggtgggccatactccaactgttttgagtcctgagtatatatctattttatttttatgatgtggctaatactgatccctacgtcctaatataaatgcacctaaggttgaatgtggtatttcatattacaataaatatggacagtccaatcctagatgcacttattttaggattgagggagtaaccaataagctgatttataagtaaaaaaaaccaatcataaacaaacaaacaacattttatttagatttttaaatccataaaccactcttatcctgttaagccaagcgctaggaatgttgtttaattatgtgaagacgaggtaggactcctctacaaaggcttaaaagccaatgacttttataaatcatataagccaaaaatcgaattaaaacaaagagggcttaagtgtgctactaataatacaaaggcctttgggattggtttttgctggacatcttttacagtttgttactgtatttattttaagtggttttttaccaatagactcctaacaaaagttttactaaatattgggcataattaagcagaaagtcgtgacacttaattagcgactttatagcaaagttgtcacatggtaaatttcgaacttcagttcctgtttgttctttctcaccgaaagagatcaagttgttccctctataaagaaagggccagtaggcgccactcgtgcagaacgtgttgatttgtttttgcatatttgcatatactatattgtttgaaaggcatgtttatatatattttgtctagtttcgtgcatattggcgaccttcagtcccactatctggtcaccccaaccaaatctggccccacttacataatcagtatggttgagctggctgtttccggttgggtcaattaagatgggacagcatctatatataggatgattggatttgtagtttaattaaatctccaaatagcaaaagtggatgctccacaattattggggaagatataatggtcaaataattgtgataaaatattatatcaataaaataaattgaaaaccctgtataatgtgtcacaggaaattaattagctttggttagaggtaattaattttaatgtcgataactagcactgttgcttgctagttcagtctcgagccccattgcatggttgccctagtaagctaaagcaaagctaaattttaaatttttaaacttaattttgaagttgatttaaagatattttctacgtggttattttttagcatgggtttttatgttgctaagaacacatatatgagcaaccgatgagtgcctcgatttctcgggatcaaaccttcaataatcataatttcttcggacttgccataaacttcgtaggcaaattttggccaatatcaccttaattacttgtgacgagatttcttcattaacttttatgtagttcacacattcaatcgattaaaaaagtgacacaaatttcttttacataatttctacttaagtaaaaatctacagaatgttgcaatttgatgggatacgtatgcatgattttcccagcagctagctagctggttctaccaaatgatatggaataattttaatttttaagcctaggaaaaacccggtaaatttaataggagtatccggtagttgcaattgatgggatacatatgtctttgacgaacactaaagtaaatcttaaaaaaaatcactgaaatatgttcatgttaaaaggacaggaagaatctgcacgaataattcatgtgaaaaatatagtacgtaggtcacacattgagctagtcacttcaccgggtggttcttgtcgccaacgacgaggccgtgctgcgacgaccacaccagcgccttctcgaccagctcatccaccagccgcgccggcgccaccgccagctgcccctgctccgacgaccgccgtccgccgccctccaccttgggcgccgccgtcccgacgggggcggcgcacctcgccggagcgagcagcggtgacggcctcggggcacgggccggccgacgcaccaccacgactggaagaaccctgcaccgcccgagcgaggaggcgaacgatggcgaatgcgccccggaacgggcgccggcgccgcccatggtcaattggcctgttcgatcggagttggtggaggtcgcaaggtttcttgataatatgagaaggtgatgaaaggagcaagctaagctagttataaagggaacgagacttcgacatagactagctcggattagtaaggtcaacgtgttttcccctcaaacttccaacttttccatcacatcaaatatttgacacatgcattgagtattaaatgtagacaaaaaaaaccaactgcacagtttgcttgtaaattgcgagacaaatctttcgagcctaattacgccatgatttgacaatgtggtgctacagtaaacatttgctaatgatggattaattaggcttaatagattcgtctcgcaatttacatgcagaatctgtaatttgttttgttactagtctatatttaataattcaaatgtgtgatcgtatacataaaaaaaaatttatcaaaacaactaaacacggcctaagtatgggtatttgggcacaaagagaaaaactattagcattataataaattaagtttaattattttgaattttttaaaataatttatatgatattttaaagtgtagaaagtttttatatagaatgcaccgattaataattttataaacatgctaataaaatctgtgccttaatcagaccctagtccttgcaaattagaaatcgatcccaaccgttggatgataccgtcggttgaatggtcgacgacattcacgcaccggcagcgtataccactaaagatatgttctgtgtgtctgtggatcaccggtgcctgttgatcgtgacgtgaggttgaggttgtcgaggaaatatccctgtgaaaaacctaaaatgcccgtaaatgaagatactccctcaatcctaaaatataaatatttttataattgaatatggttattagttattaagaaagtaggtaaaattaaatgatgagagattatgattggataagaggagggaaaattgaatggtgaagggttgttattggttaggaagaaaatgttaatgcataagttgttatattttagaataaattttaaaggttagaagtttttctattttaagacggatggagtatatttattaatcactaaggatatatgtgcaattgaaccgtagtcgccagtaccgatttaacaaaaccggcattgatgatgttcctgctccacaaaacactcttgcgctatctagagaagatattagtgccaagtcatattaagaaccggtactttggcggataatcagtgccggttataagaatacccggaactaatgattaaccaatcaatgccggtttaggtggattggagcggggtgccagttttagccgattggagtgggaaggttgacctattgatcggttgattggaaaattcatctgtgaccctgaccatattagggcatgttcaatggtagagacgagtatggtctcttaagcaatacaagattatttagagaccgaatctttacaatagtagagacgacaaagtctctaatcattaactcaaaaaatattccttttgttaatattctttccattttttttaccctcatgcaaccatatttctatattatattgattaagagtcgttgttaagctgttgttatgcatgacaacgatgttttatctctcctctttctatttcttccatgtcaacaagtattccaaattaacatcactaagagaccactattgacaaccattgtatatgcccttagcgctaattacggatatatgaacatactcccttcgtcccaaatatagtaactagaaccggatgggacttattctagtaatatgaatttgggcatgccccttgtcagatttatagtactaggatgtgtcccatccagtcctaggttgctatattctgagatgggtgagtaatttttttatatgtactcagattgtgataaagtttatatgaaaatcgtagctcttaatgagatatataattttatagttgataactttttcatttaaattcttttaggtacttgaatccatgattcaaatatcggttaggaacgctcgtaaggaaaaagatgtgcatgtgagggagggatctctagtttgaattcacaagaattatattcgatttttctaggccacatctgtgttgggtccatttctatcaattatactagttacgaatcagcacaatgtctccacaaaatttttcaagttcaaaacgtctaaggatcgtctttctcaacaacatgtgtagcacaatattatatattagtccagatatactagcaccaaaccttttgtgttcaaaacatccaaggaacatgccatgtgttgccttgctctggcggaacttgaagccatcatcactcccacgacatacccatcaccccttctgttcggagcggataattctgagatagttcggacacggatacatatttttttctcatatatgaatatgaatatggtatcgaagttttcgacagatatgaataataatacgtgtatccgatggatactatttggatatccgctaaaggtatgaaacatatacctcatttctttttaactttagaccttacaaccctaatccacactggattatttaattgaaatcgatccgcactgagtcaactcactcccgttctaaatatgtatccttgagatataatagggttgtttgtttttgttgtgacttataacttaattttgaatttaaagagggggggtgtgggtttgggttgtttccattattttttatttgcctttgggccgaagagtaggagtataaaaaattgtactctcagaacttgtttttcgtatatgtctatggtttataagtcactgttcaaaaaattgctttccgtgaaagcctgttatacaatgtcatgaaaccactaagaaaagtatggcatttctataatccaaatgggaatttcatactctccattgtaccttttctcaacaatcaacagccatttttcaatacattcgtcacaaccatacgcggccattcgctgaaccacacaagagggtttaataaaaatgccaaatcccattgcatatccgatactgtgaaatttgttcacaatgattcttcttaatataaagttccttaaataaaatggtcatgttactgttttgacctttatgataagatggataagaacagtaaatcaatgacatgaaaaataccctttactgtagcgtcaatattcctaggatctgcgaaagaggactccatgctgtagtacttactataccgattttatctaaaataatatgtaagacggtatagtatgtaatgcgacacatcttaatacaacgaatttgaacagtctattcagattcattgtactgtaggatgtatcacatcttgtactaagttttttttttatggacggagggagtagatagttctcctttccgtatatacagtactgcaaagttcattcgtgataaataagaattatatcaatcaatcagtctttccaataactcaatttgcaaaagtaataataatctatgcggcatatgccactagccgtaggccagccactacattcatttgcaagtgaagtcctgtgaatcatcattcacgattcattttctatgattctggagatgatatggaaaagatctttgagtgttagtttatgatacctcatggtacgttaaattataaagtaaaggttgcagtagaaaatgtgatgcctcctggcatacttttaggagtgtaaaaatatagagaattcacatatcatagtcatcttgttttccagcattatgtaaaggaaccagtagacctttaggaccgtaaaaattatgaaaagaaaatggagtgattttgacagcattagtcataaaacggacacagcaagataagaaccacaaaatatttgatgcatagaaaattggatcggtcctacattggaaaggatgacattgtcgttagtatgcattgactaagtttagtagaaaatacaacacatcattttcagcaattgagtaactaaggaaaatatccaattatgtggtgaaatggaactggaaaactgatgaaatatgtgtagctgaccatggattgctgtacccaagtgttcagagattggaatacacaacagcaacatacaaacaactatgtatatgtagagcagcatgaatgaacctgagaaaagggttgcatgggctaagcaagcacatcacacaattctcagagattgagagacacaaaaatgaaatgaatcttgttgaagtaaacaacgtcccgcatcaggatggagaatcttcatcttcaacacccttcatgacaacggagcaaagaacctgctttgagatgtgggactcaagctctcttgacacctctgcaagtctcagatcgaagttgctccggtgtctctgtggtttcggagatggtgaaccggagaatcgtcttcttgggcttgacagccttgctgtcggggatcctgacaaccagctcttggtgaaaacaggaacaatctccttccctgtcatgatgtgctttctctcttggttcagaggacctctctttgtctccaccggtaatggtttcatcggtgaggttgttgttgatggcagcttgttcctgattcgctcacgggcacgctcagcggctgccatagccttctccttgctcatcttgatcaacgtccatgggttgatctggatgtcatctttccttcttgttccatcactgggctcattttcaatcctgatggatagctttcgggtactctgtcatgtatgaaatggtattgtcatcaccaagttagattaactgaaactagtactactggcctagtgctgcaatttgtatgtacttacttcacttaattcatcttttctgcagaagatccttgacagaaaggatggcctttctggtgaatcgaagtcgatactctcatcagacgacgaatcagagtcatcgaaagggtcaaatgcttgtgctgcttctctcatagcaaggatgtaatcatatgtcctcattccctgaagtaacaacagttcacaaaaaaaattagctgacatgatttatatcatctttatcctgcacaaaagtatttgttcagcaaagtgcacacctttctaataagcacaacatggaagaagaagagctgacccagtgctacagtactgtataaggtgaagatcacaaaaaccatctgcccagaatatcataatgaacaatgtagccttatgagtattgtacagcagtaatgatgcgtgcctaattgcttattgagagagatgatatgttcttcttggttacatactgataacgctgcatgtgctccttttgggagcctgatgtgaagcctgtgttccatttccattttcaaccctttgctgtcggtaaagcagcgaacgaagatcgcgattgctgttcctccctcaataacaagctgatacagaagatttgcatgctatttagttgtagtaaaagaaatgatttcttggacatagaaagaaaaatgatgcaagccgagagacaaaaaatattggcatttagcacccaccatgagcaggacaaagaacatgagcagaataaatgatgcatagttccttcttccaatgcaattgttcagccactgtgtgaaaaagatagaaaaactcagtcacttgatcattgaaagatcaaccattgatttgggagtgaaaagaatgcacatagcttgggtgcttaccctgcagtggtgatcaaatccatcaacacagcgatcacaggtcttgcagtgcttgctgcgcaatttcacctgcaattcgtacataatcgtttcagattgtttcatcttgacctctgactgactccacattaatgaatttcacaaaccaaaaacgttgaaattcagttgaatttatcctcttctattct

SEQ ID NO: 78919 - DNA, 4636 bp, Oryza sativa
  unsure (1)..(4636): unsure at all n locations
ccatgattttcagtaaaataaaactaccagaaaaaagaagttgactagcattcacattacagtaaaataactgtgcaccaatgcgttaaacttacattatctgtgtcaaacatattgaaaattcctctcaagaaatcaatggcttgacctgtcaactccagggtctgtaaggagaaaagttgatattgacactaaattttatataaaaagtaagtatgataaataccgcagataaatgcttgctgatgttaaacaacaaccaacatactattggaatcaacaattcaagaaactgccttagtggttcctaagagtagagctattctactacagtagtaacctagtaatgttagcaatgaagatatcaaacattgcaagaaacaaaagaacaaacagaacaccaaaagagcaatttctgcacttgctggaatagtaatgctatagagaacactatggttgaagaaacatctgacaggcagttttaatatatgaaggaacagcaactcgcatatcatgggtactaaacagcatacataacaaaaaagcacatataaaaataactagcttcaacatgaaataaaatttgaatagtaaaagcactgagcaacacattacttgatcgggcgctcgtttaattgttggaataaggtcatctctaagcttgatttcattatcataaccaaacttccttaggacagtccatgtagtttctagtcgtcctttctcaataaaaagagcatgaagaaaaaggaatccagtcaaggtaaggccattgtcattcacgccttcaggcatcttctcttgaaccactctcttcacgcctgcaatttcagtaggctggagaggagcattgaagcatttgacctataaagcaccagaagaggttctaatcaacaccataaataacagaatggcaataaaaagcactagagcagaaagcaaggtagactaagtgaatacaaacctgaaagtcattgagctccacatcactgagtgctccatccctgtcatggtcacatagaataaaaatccgcttcaaagccctcacacaccgtggctttagagattgcgcctcttgatcaaatagaggtgctgttgggtgaagcaccgccttctgggcatagtagaagacctcgggaacctgaaagcattcataaattatattctagttaacccaaacctagcacaatatctggaattctatcttagtagggcaccaattaagattatcaagtgcatagtacaatagatgcatgatcaactaagggcattttttatgggtttgggaaattgtatcccaccattcaaaggataattttcaatcttagccatcagtttttgccaccacatttcatcttaaccatccactcatttccatttcccaatctcatatctcataacccatcatataaacatgccctaaatttattttcagaataaaacaacataaggatctggttatggactatgtagtcaaccataaaaggatggcaattgggctagtattttgagcatgcccaattcagattgaccaacaagttgtaatcaacaaaaggatggcaattgggctagtattttgagcatgcccaattcagattgaccaacaagttgtaatcaacaaagaactattgagtgcacgcatttaacctggatctggcgaagcgcagagcactcaatgcaggtctcgatctctctgaatgtctgcatgatgggcgccatcacctgctcaaggctgacctgctgctcgtccctaaggtccagcttacaccccacgacaatcacaggtgcctttaactgtgataggcaaacagcaagcaacacgagatcacatcggaccgcccatgaaaccacccattacgaccgatccaaatcctacgccacgaacctggaggcggcggagctcggggagccagaatgtgctgagccgctccagcgtggcgggcctatcgcaggcgtacgtgagcaccaccgcgtccgccgcctggcactcggcgatcagcttcgccctgtgctccggctgcatccacacagaaatggaatcaaccacacagaaatggaatcaatcaccgagacgaacaaggccaaaatcgcaacggagtccatccacaaatctaccgactaagggaacacccccgattcatcgcgggccgcggcgcgatctagcgcgagggaggtgagcggacctggaggaggtgtcgacgatggtgattgggacgcggtcggggaagtagtcggcggggaggcgggtgggcggcatgacgcgggggacgttctccgggaaggcctcggtggcgacggagacgacgaggctggacttgccggtgccagggtcgccgatgacgacgacccgcacgccctgcttgccggccaagttcgccgctgtcgccgcagccgccatggcgcgcctnctctctctctccctccgctcgccgcgctagggttttgggggatttgggcgcggcgctgcggcgagtggtggcgtggcgtggcgtcgcgcgggggtggggggtggggaggaggcgtcagagagtggggccggctcgctctttatatggagtttggttgcaggttgcttcgccttggaagggaagaaagagagtgtgtctgattgaagactcgatccctgtgtgggttgggctttctcacataggccatgattgaggcccatacaaggaggccttacgtgttactgtgtgatgctgcgagccttttatgcacagtgcaaggccctcatctgcaaatcagcacaaccacatctggggagcgtttgttcggggaaatcactgagttacaaaacgagatttttcgatggtacaactgtcgtggtgcctacgtgacgtagctttcgctgaaatttcaagttgactttggtcaaccatcgtgtgacctcccccattgctggtcaccaagaagagaggaagagaggtggacagaggaggggaatagtcactaccatgtgggtcccgtgtgggtcccgcgttgattcagttgtcacgtcacgtgaaataggggacaaaaacaccgaaggatctagagtgacctaggtttttaagttgagggatgccatatatctggttttcggttcaaggataattttgtaactcggcgactaagataagggatctcaggtgtatattttccttcatttggagaagagatctttagtttttcacgcgtacgcttctcaaacttttgaactgtacctttaatataaaaaaaaactatacgaaaattgctttaaaaaatcgtattaatccattttacaaataataattaatattttaattaattatatgctaatggatcgtctcgttttgtctattctcggtcttctccaatcctctcctcacataaacttctttaaggccctgtttgatttagtttaggattattataatctggattattatgagtaagctaaaacaaacatatagcttattatgatagattattacaatctataagctagattactataatctggtaatccactctaaacgtgctttttttagattattgggtagctaacagctaataatatagagaaacaaacaacaaaccgcttattctatgtctgcttattataatctagtttatagtaatctggctcaataatctagattacaataatcttaagctgaaacaaacaaggcctaaaccacacaccaggacttattctatgtcggcttattataatctagtttataataatctggctcaataatctagattacaataatcttaagctgaaacaaacagggcctaaaccacacaccaggaaatctaaagccatgcgatgaaggcactctaacccacagtggtagttgcccaagcctaatagccacaatttaaccaaaaacgtgaacttttgatgctatataaccaattttgcctttatatttccacatatatgttggcctctagccgtgttgtctttctccgtcgatgctatcttgtcgatggtaataggcatttctttttgcctataaaatttgagagcttagactaaaatagagtgagctcaattttcatatatttttggcctagaaatatttaataactaggtacgtagattgtgaaataaaccgtgggctttgacccattaccacctcacaaagtgaattatgcggtgatctagtacgtgatctttggtgaaatgatttgtgctcctttacttgttactgccttaactgtgtgtcattcaggtagtactgatctctatagttacctatctaaattaataaaactacgctcctgattttactagtaagcagtagcaagagacatgtaaatgcagcaaactttgtgacaaccattttcaaccattcaagtagcattcaacagcgctgaattttaaccagtaccaacttcgcattagaaataccatcaatacaaatagtttctttagaagttgcaccgagatagagtttccccacctgaattatcattaagggagagaaagtacaaattgttttaactaaattacattggaatgtagaggaagaaataactactttccaagaatctattacaactctagctaagaaacctttccaacctttccgcccagagggtatagagacaatcttagcgagagagcaagatattccattgaagacaacatcaataccaataa

SEQ ID NO: 78920 - DNA, 4890 bp, Oryza sativa
aagtacttcatcaaaaagccatgaaccaattcgttatcataaccaaacttcctaagtacggcccatgtagtttcctctcatcctttcgcaataaaaacaacatgaaggtaaaggaatccaatgaaggtaataaggccattatcattcacgcatccaatcatatgttgttgaaccaccctcttcatatctgcaatttcagcaggttggagagagaccttgaagcatctaacctgtaaattagcaaaaataaaaaagaagtccaatgattattatctatataaatactcagtcttatttttaggatatataatttgaaaaaggacatcctaaagataattcggttgcaaaataaaatcatatgtgaggatgacatgtggggactagacacatgtcaatagcacatatgatggtattttttataactccacaattttacaataccaaacaaatcggtatatttttacatgaccataaaaacaactatataatttggtataagtgagtacaaaccagaaatgcattcatctccgcatcactaactgcaccatccttgtcacggtcataaagagaaaatatctgttgaaaagccatcatgcaccgtggctttatagatcgcgttgctttatcaaatagaggagttgttgggcgaagcactgccatttgggcacagtagaagacctcatccacctgcaaatattcaaatattcatttatcacgtgaaaacaacaattattacccaatatctagaatctatacatcagtaaattataagtccaaactacaatagatagacaatacggttatgaattgaatttactacgtggccaaccatgcataaaaaaattatggcaatttatgagctagtattataaacacgcctgaccaattcagattaattaattgatcacgaattaacgaacggcgactcgacactgaagtttgaaaatgcatcatcacatataattttaggtgtgtttagttcacgctaaaattaaaagtttggttgaaattggaacgatgtgtcggaaaagttaaaagtttgtgtgtgtaggaaagttttgatgtgatagaaaagttgaaaatttgaaaaaaaaaaagtttggaactaaactcagcctttaccacacattttacctttatccggtgaagcgccgagcactccagatagatctcaacctctctaaatgtacacatgatgaagtccagcacattttcaaggccggcctgctgctgcttgtcacttaggtcgaccttacaccccgcgagaatcaccggcaccttcgactgtgacaggaaaatcacaacagaaaacaccacgaaaccaacatcgatctcggttaattagcccagaaattaaaaccaacgaccaaccatgacggccggccgcgatccaattaatcgcacatatatacacgaagaacctgcaggaggcgccggatcttggggagccagaatgtggtgatccgctccaacgtgttcggcctgtcgcacgcgtaagtgagcaccaccgcgtccgccgtctggcactcggcgatcatcgatcacacgccgaatcgatcaacaccaccaccagcacaaatcaaatcgacacacgacgatgacacacgattaggggagagaagcgacgaagcggctcgatttggggagagaggcgacgacggcggcgaacgtacctggaggaggtgtcgacgatggtgacggggacgcgggcggggaagtagtcgacggggaggcgggcgggtggcaagacgcgggcgacgccgtcgtcctgatcggggaacctcccggtggcgatggtggcgacgaggctggacttgccggtgccatggtcgccgatgacggcgacccgcacgtccagcttggccgccgctcgcgacgaccacgcgacccccatggcgtctcctccctgacgtctcctcccctccgcccgcggtagggtttttttgtggggggtttgggcgcgtcgcgtggtgcggccgccatcgctggcgtcgactaaaatagagagagcgagagacgaatggtgggcatgtatggacttgaaaggcctgttgggctgggcttttcggtgttcctactccatatgcctaagcgaggcccacaggaatgagggctcacgtagtcgtgatgtcatcgttttttaaagataatggactcagttaaatactacaaaatgatacattctaagagtccaccccggtctctgtaaagaatgcacacagcaaaaaaaacaggatctaagaagaccttctcatcacaaaacagaaaccagtcgctatcaacctggctatcaaccaatagactagatcgcgactcatgcttatggataaaaaactcccacctagtccaaacgttgcgataccaccgtagtagtatcccgaagtcccggtttgtgaaggatggcccaagtgcgtagccaccggataactaaagtagtaatctgcaaatgagaagacacatcatacatcggtcagcgtcagccatcgcccaccgcagtgatcgccgtcgccgtcgtggagtcaatgttaaagagtttttttctaaatttttttaaaccttcttaattttaaaaacaaacaattccaaaatttatttttcagtcttactaacccgtctcgcagttagttaaggtgacgtggcaagacaacacccggaaaggtttgttatcaaaattagaaaatttcaaaaaaaagaaggaaaagctccagtaccagcctgagacgctgatggcatcgctgtgaacgaccccgcccccagcctgagattccgtattatcgctctcagatctcagttgttcgtttcttctgattgtttttcattaattgaagaagcttctttgctcatttggtcattttgatcgcgatccactcaagcacccgggctccactataataatgcaggctagtgtagcagcccagcacacacacactagtgcaagcagctcgagcttgagctccacctcgccatcgccggcgacttctcctgtcctgaccggccggagctccgatcttggcggtgaccaagagacctgacgagacgatgtccgccgccgccgccgccgccgcatcctcccccgctccccggtacgtacctggttctggtcgccgtaatccgatctcctctttttttttttcgcacggtcttcaccggcggcgctgtatgttagtttactcgatctcgaatccccgatgcgtcgccgccggtgaaggtcccgggctttcgccgtttgccatggcgaaatcgagggatctgactgactgactgactgtccctatccccttcccagtaagagtgggctgctcaactgataggttttggtgtgagagtgtttggggcttcttcagattgcccagaggaaaccccatatgttcttgaactgaaaagatgaatggggaatctcaatgttagtcaaagggggaattagtttctaattttcccttcaataacatgttagctggtgtgtcaagtcctgtaatttgtgaattgtgagagttcaggctagcaagattaagcttgtattttgttagaaataatgtggttaaaaatcatgtttgggtggttttatgagaaaaaaactgaaaacattgttcgcgaacaagcaagtaaacaactttgcaatggtgcttgcctggtctttcctcaactaggataatgttcttttcaagttaattagctgtcgcaactcactagtagaagtgcctatagaatttaatcaaaacggcggctcacttatccttcctctgccccttcgcaactgcattctggaatcagcttgaaatcccgcagactatcaccagcgcgagcgacctccatgctctgcgcccaaatggccgcctcccaacaaaacacttcaaggttttcttcttgctttgtctctggggattatggaatcatcgttatgatgttgtcttccgtggagaatccccctctctgcatagactagtttctagatgtattgaggatgcaaccttgtgggcagagagactagtttgtgctgacaggatcgttgtaatcctggaaacaaattctttcctccccccttcgcactatgtaatccaaagtcgtgtactcctatctttcaatgaaaattcaggtggggaagctctcccccccggtgaccagtctaaaaaaaataatttaatcaatggttcatgaaacactggtaattctgatactaaatacaatttgcatatttatcagttctttaaatttgatttgggttctttcctctggagaaaaggttggaaagcaaggttgcgctggttaccggtggtgcttcaggtattggtgaagcaattgttcgcctctttagagagcatggtgcaaaggtatgtattgcagatatccaagatgaagcaggtcagaagctccgggactcccttggaggtgaccaagatgtcttatttgtccactgcgatgtttcggtggaagaggatgtagcccgagcggtcgatgcaacagctgaaaagtttggtactcttgacatcatggtcaacaatgctggctttacaggccagaaaatcacagatatccgaaacatcgacttttctgaagtcaggaaggtaatcgacatcaatttagttggtgtattccacgggatgaaacacgcagcgcgcatcatgatccccaataagaaggggtccatcatctcattgggaagtgtttctagtgtcattggagggttgggacctcattcatacacagcaaccaagcatgctgtggtgggtctaaccaagaatgtagctggggaattggggaagcatgggatacgcgtgaactgcgtatctccctatgcagtgcccacggctctctccatgccgtatctgccccagggcgagcgcaaggatgatgccctgaaagacttttcgcctttgttggtggtgaagcaaa

SEQ ID NO: 78921 - DNA, 2410 bp, Oryza sativa
ggatggtggctttacctctgtgaatcacaatttgagagcatttgaagattaacagaagttgttaggcacaattggtactctagtttcagatgctatgtaccattctgattttagaactttgatcaattacctaaagtaagaatgtcaataaggaatgcaatcttgtatctgtggtattgtatagtactatgattgtattgcggtgcttaaggacaatcattgattattatcagcactattatgttacagttctgaaaactggtatgagttcatatagcatcaattattcaggtgtgttaagtaatgcttctatgtcagcatgcctacagtacagagttgcaaaccagtggattttacagttgaataaaattgatgcccattggtgtatataatcactgatgacatgcacaaaactgaattttcctgaattggcactactgtgctcactctaacagaatcattgacttatctgaagaaaaaaaaatctgcagataaaagggattcttctactgatgaaaattgtattggacgaactttcattgggcccgatccatgaaagaagaaactgacagcatgagattaaactggttgtgccacgtctaaatattcagcatacatgtaaagtgcgaaagaatggcagccaactgatttcactaatgcatgtgtgatgcaacaaacaataattttacagtacatgtatacaccaaacataaacatatcattagcataagacgtatatcatcagtcatcaccatctgcgctacagtttctctataaacggagatactatggctttcccgtacaacattgctgtaataaactatcaccggtaatctttcaaactctagcatctattcatcagctgaagaatgttgtgaagtcacagaatcagtatgagcagctgaaagatcgtttgagtcagctgcatctttgttatctccaggacagtcagaagtgtccaaatttgttgtgtccacatatgattcggtttcagcttcgctttcatgctcaccaaacacactctttcttttgacaacattaattagaattccgttagtactcctttctggttgcagcagttctccttcagaaacagcaatgcttgtagaggtagagggttgactagctatattgttgccagtattgcatgaaccagtttcagatgtgtctgtgcttctatctgtaccttgtgcagtaactccagaattattgtttgggcatgaatctttagaaacggtagatcctgatgaattacctgtattgaactcagactctatctcaagattctgaatgaaattgatgaacatgtcagctgatgaagtcctcattagaggtccaccactccgggtccaagaatttaagtcaatggtttctgattcactctcacttccatcattatgaataacgttcggtgtggcaacaacttgaattccttggtgagtagatgaactagtggttgcaaaacaatcttctgagagagatcctgtagaattctctcgactgatgcagctccacgatggtaccctccttggtgttctgattacagaactgcatgtatatccctgggaagcagaagctaccctttccatgcttctctttagtcttcttttatggtttagaacggcaatggactcatccaacgcaagttcaatagcacagtttgttctgatcgcagagatcttctcccatgtgcacctgcgcccctggttggcagccatttgcagctccgcatatgtagggttttgtataatcttcaagtactgaaaattgggaaaatacagcaaagaaaaagaattatgaccaaagaattagcactcgcccatataaccaaaaattaatttatcgacaaaaatacctgggctgctgttgccggcataaccatggtgacatcaccctcccaatcctgagcaaacaatttcgctagtcctcccagtgggaggccaatttctaggatttggttacatctgtacttaacctccatttcagccagacgagcaagctacacaaatgagattaaacacagcacttaggaatcaagattttaaagagaacttgtctgggaacatataacacggcatttgcagagtaggaatctaaattttaaagataattttttgtctagtgttaagggaacataaatcaggtgcatatgtatttataaattaactttatttgcatactgaataaaaccctcgatctaccagatattgcattatttccatgaataatcatgcatgcgcagcagcatgtggaaaattgacgaaataatgccgaagaacatgaaaacaattaactacctacaaggttacctacaggctgcatgctaggataagccatacaagccatgaagctaatgccattaaggtgcctattccatagggtagggttttagacaaacctttccagcgaa

SEQ ID NO: 78922 - DNA, 65584 bp, Oryza sativa
cgtcccgttggatgacggcgccagccactccggcgccccaaaaaggaccatttctgggataagttttttcaggagtctatttgcgaaataagtttttcaaaaggatcaaaatgtgaaaaatccagtgtaatcgtgttgcctacttgccagcccccacgagaaaacgtcgtcttgccctatttctgggcgcagaatcgcagatagcgtggtgccgtggtggcacagggcaggcacatcaagtcatcgaggaggtcaagtcatcaaagacagagtccagctcgctctcctccatccaacgggggaggttgactgatcgcccttgtccaggtccaggctgcagtgtgccatcggagctactacgcagcttcacactcagcagtcagcacatgtaagttcacaaaacttgcagccttctgaagcaaaaactacaccgtactccctccgtcccataaaaaattaacctaatgctaaatgtagcacatcctagtactacgaatctggacatacctctgtccagatttattgtactagaatatgtgttcagttttagttttagattcgtttttctctggacgaagggagtatgtccatatatcagggtcaagcaatcctaataactgaactaaactgcacatagattttaatattttacttgcactgtttgatcacttaaaaaattgtgcaaatataaaaatgaaaagttgtgcttaaggtattttggataataaagtaagtcaaaaaaaataaataataattctaatattttttaaataagacgaatggtcaaacagtacaagcaaaatatcaaagatcccttatattaggagacggagagagtactaattaatgtacactggtttgcttccttactggtagcaatagattcaaaactgcacataggagtataggtcaaaccccaactgaactgcacaatcggtctgcctaggaatctacagtattcaaatgtttaattacaaaatcagatcgtcacggaggccattattgcgtacaaactcctcatagtcagaagaggcacacaagagtaaagctaaaaaaaaaaaaacatgccacgccctggtctccaaatacagagtgtggaaggaatgtacatgatggccgatgctaattgcgagtaggatggatactggaaatagcggatgaaatgtgagaacaataattcctcggagacttcagaaaagcatcgcaattcattacataaattccccgatgtacttggtgctcatcctagtcaaaagctaaagattccagaagtgctctcttcctcaaatgagaattggtcctcaacctctgcatcggtgaaggtaagagctctctgcaactttttgggacagaaaacctcaacatcggaagtgtacacagctgtcacagggcggtgatcggatagcctgatatcaactgtcctgtaggcctgcagcctcattcccttgccaaaggaaagaattcggtcacacctacaaagttaaacaatatttttttttgttagcacgcatcgctcatcgcaacttagagatttcctcatacacaacctcaattcttacaatacctcttattaaatagtagtaatgaggtgattaatcgtgagttatgaggaccaattctttcctcttacacaatacctcttacaatacctcttacaccttcatgagttatgaggtgattaatcgtgtaaacaacgaggaaaaatgttactacctccgtcccattctaggttgtttagcatgtattagggttagaaaaaaaatactacaatacctcttattaaatagtagtaatgtataggtggatctgagattatagttgaggggtagaatggtgagaaatttgaattgtaagtggttgatgtcacaagtaatacttcaaagtgataactattttaggacaacttttgaatgctagaaagacaagtattttatgacggagggagtattaagaaaggacaggataaaaaaaaatgaagagcgtatgcagatcaagttacgaatgatcagattagcataccaggcaggtgttctccttccagattttggctcatcactcgtgtatttctctgagttaaccttgtacttgtatgtcgggggaaagctgataactccttcagtccacccatcaaataaatgccctttcttaaattctcgttttagctatcatagagtagaaaacagtgaggtactatgtatttataaagtagtaggagtatgtcacaagatgctgcactgctgccaaaactttacctggtcattctggaacaaaccattccagtccttcatggatatgaattcatgtgttttttcatatgataagttgatcctataattgagatctcctaaccatattatccttctgaaatattcaagaaaataaaaatattagacaaactgataagatttatataaactaataagcaatgtttcctgcaattcttgatcaaataaaactaaaatgaacaaaagaagtataagaaaaatttcaaatgtgtgcaaccctcgaacacatgcttcattatgtgatttttgccactaatatgcacagattcacttcaaccatttatcccttgttataccatcatatttaaacaagtaaacagtgacgccaaacacaatctaaactgaaattgagccatcatctgcttcattatgtgatttttgccactaatatgcacagattcactttaatcatttatcccttgttatcccatcatatttaaacaagtaaacagtgacgccaaacacaatctaaactgaaattgagccatcatctccaaaagagtatcaaatggcatggataaaaaacatgcttagtttagctagagctttaggaattgcgtactgagcttctagtgttttagagttgcaagtttacgtacttactcatggtcatatatagtcttaggcatgctaactctggaaaccggattaaatattgtccttcgatggatttcttgcacatcagcattccttttcagttcatctccatccttttctccagaggtcaggtggcaacatataaagcaaaagagtgtttgataaatggacatgcttactgctattgatccctggagcatgtcaagtaagaaaaattagcccattgttttctaaatagcacattgacttaccagcgcatagtaaatgtacatgagatggtacgaccaaagtgcacaaaactaggtgctaaaacgaaagtgtaatatgatcattaagaaaacaaatatagtataaaagaatgctaattttggctgtgcctaacagtagaggccggagatgtaaaccatttctattatccaaaaaaaggaatgctaattgttttctacatatttggaattgctaaaggaattgagaatgatgtgcttcacgggaacttgccttattaccaatataacccatagcaccgacacctacggttgatactttcaaattttgaatatgcttccgcaggcttcttcgtacccatattgaaataaaaactccaaccatctgcttgcttattatccttacgaagtatggtcttttcgttttgactagtgcacttttgatgttaaaatcatgaactaaacaatcatctggaaaagcattggaatctccatgtgctgatttgaaagacaaacatgacctcagtgccttctctgaaataaatggtttcgtgctgtctggaagacgctgggccaatatatccaacggttgttcaggccaaatcattccaagcctctctgagtagctgagtgttttagttaacattttttgatggattggctcttccaaactagatacatagtctttaaaacttaagttgtgtgatctatcgaaaatcttcattgaaggcaccctgctgaagttgtttccatttacggtagtttcagtaggaccagaagtagagtgctcatatttattactatgaacactgtcatcatcaacggtaaaatcttgttcattccatgggtgcacttccccgccactttcgctgtcagattcactaacaagttcatcttccacatcgtcagaaggcttgaaccttgatggagaaggaggatcactgtgacatttatattttggtttatcaggactaatcttattcaatgtttcacgaatgatatgttcccacattgcgacaggacggttgtcttcagcaccaaatatattcccagcatttaatggaacaatttcttgaaatctaaaagataataagttcaatttgtttaataggtgaaaaaaataaaaaggagaaatatcagtcatagtgtaatatgaataagtaacaagatgggatgcaacaatttacccaagaacataaatatcagctggctcctccatatccaaccaatcttgaatatccaagtcatcaggtggaagtcttcctgcaacattccatgttcctacgcagaccctgcatatcaaaccaacattttaaggaatagtgacagaacggcagtagattttataggtttcagctgcaattaggcttgatcttaaggggttattcttgtgctaggaaagataaatatattgaggaacaaaccaagtcatttagcttatctgaagcaaattcttacggaaaatactgtgaacaaacaactaggcaagtccagataatctgaagggagaacaaatgcatgcctgagttccttaatgtcgatatattgggcacgaagggtctctgacttgcgccttctattaagcttgtagggagcaccctccatttggctatctgaagatttgatagtcttcgtcagtgcacaaggaagctacctgggttttctctgataggatgtgtatgccagaggtgcttaagaggtagtactagttcccatcgaaaattggtgaaagggtggactagtatgtaccatgtagtatctcttagtttggcagaatcaacaccgtatttcacaattttcagtgtgtggcaaaacaaagaagaaaacatactattaaacaaaacctggaaataagcatccagaaaaaaagaagtttgctactgtgattaatatagtaacttatttcgttggtgatatgtagttcaaatttttcatgtgatgctttgtcaataacccttttgccgatgaatgtgttgaacacaataattatgcgaatcaaataaataccaattgtctcagcgcccaaaccacgcagtctcctctcctcatcatatagttggcgctcccaatggcacatttctgcacaaatcccattataagttcaactattattagaaccaatttttgaaaaagaactgaacatacatatgccgtagccaacaaatttaagtgcaaaatttacacttgttttcccttttttaaagctgcctcctttttgtcagcatacatgtgcggcaaatgtatttatggccgtcagattcagatgtcctttcattttttttccttatttcctttagaaagattgtactagtatactatcttaggaataggatgggagagcttgtcgttttgaaattcactaaacaaaagaaacattggttttaacattctttgaattcaacgtctaattttgtttttttgttctaggtaaacggaggaataaacaaaccaaaggaatagcctaggagttgggaatacaccaccacaagaaaccaaaagaacaatacagtccacctctactttttttaagagcgaggatagtagtgagttataaaaaagctatatgcttaagtggaagagagagaaaaaattgagtgactctcatagaaaagctagctctaaacatgctccaaaaatatgcattaacttcgtggtgagggaaagaaagaggaggaaaacaaatagagctaacctcgtagctaatatattatacatgttagttctacaatgaatttagtaaggagtaagctctactattaaacttgctctaatgagcaaggttagaaaggcatctccaaatttcgttaactccccttccacttcctatcctttttcccccctgaaataccagaatcttacggttgtgctaagtgctaactggaccagctcaagttgaaagaagcaaccgtcaaagctctcatctttattggttgtaagcaaaaacatccacctaccaaaccaatcgatgcattcttctggtccacaacttttcttttccaaagaattatgatggacaaaaagatcaattctggagacgagggaccagtggttgaaccaaaacccgaatgcatttcccgatccattgagcttcacagcgaattttggtttcgatttttttttatttttattttgcaataatgaagcccatgtggtagagagagggagagggtctagatcaccttcgtactcgaactcgctatcggtgtcgtcgtcgccggtggcttcgccctcgtcggcgctgaagtcggattccggcgacctgatgttgagccatttccgaagcaccgtcttcggccacagctgtgtgcatgccccgcgtcgcgtccgaccaaacgtatcagttagcccccgagcaacgaaactccgatccgagagagagagagagagagagagagagcgagcgagctttagctagcgcggcgctcacctgcttctgcttccttcccttgcgccgcatcggcctggacgaggcgccggcgccggcggcgtggtggctcgcagtggcagccggctcctgctggctccccgacgcgccgagcggaggcaatgagcgagccggtggcgtggcccgcgccgacgcggaggtggaggaggcgccggccattcgcgccctcgtcacagcccaccaacacagcgcacacagcaaaaggcaacttctccgtccgccttccctttccggttcccttttttatcgagtccggtgcgaagctataaaacggcaaatttattagcgcttggacttggacttggacttggactgcacggcagctggcctagagggaccctagagtagagccgcagcccgcagcaagcaaagcacccccccctacttgtaccagcgccgctggtggcggtggaatggtggatggatcacggccgcgacgtgcaggctcacgatgtggcgccacgcggcgcgtgggttggctgtgtcgtggtctctccccaagttgcacgtacgcgcgcgaccaatcgcccgcggcgcccgcccgtgccttgaccaccccggcttgggccaccgtcgtcccggctggctctcggtgactggaagaacagctatcgcggtgaccaaaccaagctccgcgttctcctcgtgccgacctgtgctggtgctgtgccccgctgcgcaccgtacgtccattgctatacttgaactggacggagacccggtttatcctcctatcacggtcacggggattccctactcctgtactacagctaccgctgccgctaccacttgctcttcttcctcgcagcgaacgaagcttctttcgacgcgaaaaaacctgtagctatctttcttcgctcgtctcgtcgccgttgtacgtgacctgtatcgcggaccagggttaattagttcgatgtgactgaaatcttgacatgggcttggtttagttctcaactttttctttaagcttataacttttttatcatatcaaaactttcaattttagtcaaactttcaactttttttttaacttttaattttagtcaaactttcaattttaacatggaactaaacacacccatgtttgtgcagtttgccgaccaccgcgcgtgtcaaagttacattcttcgtgtaccacactacctcggtacctatccgaatactacggatttgtcgctagagtcttaacggttgttgcatcgtcatttcatccggtgggagtttcacacttcttcaggttccaacttggagcgtatggccgagtgaaaaaaatggacggtgcgtatgcacggcggtgggccggtggctgccatggcatgggcacagcgtatgcgcggagagatttccaagcaaatccgcatgcacgtgttttccacgcaaagcagcttggtttggaggctgtttcaccagtagcttgacagcgatcagccggattagctagggcaattgatgttgcttgcctggctgccgcctgcagatctcccttcctacttcgctttatctcaccttttgggtgcactcctcatctgggccagcataaccattgcactagtttttgtttcgttataaaagtttctcctcttcttcttttttttttctttcttacacaggaaaaacaactgccatgttcacacaaatttgtttgggcattcctgcatctcttcatttttctctagtgttttacgtgtgacttcagctagtctacagttatgctgttatatggggcactctcaaatattaatactgatcacgcagaacttgtggttggtagcatattgttactttacacaaatgatgtaaaagaaggcgtgttgtctggcccagagcacaacaggtcgaagaagaatcctcttgaagatcgtaaacaacaggcatgctagccaaccaagaaagatcgaatggggcaatgctcaaccatgattgacttgtaaaaagatcaggagctcatctttcctcgtctgagattattcagctgtatcaatactaggattgacatttggtacaagcatagctggttcgtattgcttctggattccgtgggcaatgatttttcttaagcaaaactgttctctatgttggtattaggtgtgtgctttgactagattacgttctgaaacaaaatacctactatacatgattcaggggaaggaaacgctatgccacgatggatcacgtacagagaaatgtttccaacttctttaacattttattatctaagtcggtgtcactgtcttccatcaaacaaggagtataatacattaaattgtactggaatatatttgtttaccaattcatggcatgacaggtcgaagcactgtaccagacagtggtcatatgttttcctcaatacaaaggacggtggtcatcatgcccactgctcctattatcatcactgcaattttgttgttctctatatttttcgaaccatattgaaagtttgcatatttttctagtgaggcatcacctggtcagtttgagacaatagaatccaatcaagtctgctgataggggaataaaccatcatggcacctctttctccctcttttctgaagggagacaaaccatgttctctagtaccgggcgtctgattaaaattctttagtgcaatttatgcaactaaatctgccccatttgcagtacacgcaccactcatcttctctagagagagctagtgcttgcacatgaaagcagagcatgaacagatcaggccatggatgttggtcgtttggagatgccccattcgtccaacagctgcattattggcaacctgacataaccgcactacaaatcaatccaatgcatccgaattttagaggctgtttatttcgtgaaaagaaaatttttggttgtcacatcagatgtttgaccggatgtcggaaaaggtttttggacacgaataaaaaaaactaatttcaaaactcgtctggaaaccgcgagacgaatcttttgagcctaattaaactgtcattagcacatgcgagttactgtagcacttttatggctaatcatggactaactaggcttaaaatatccgtctcgcgatttccatgcaaactgtgcaattagttttagtttttatctatatttaatgctctatgcatgtatcaaagattcgacgtgatgtttttaggggaaaaattggaactaaaccaagccagttcacgttttataacctcattggcattgttctatcgatcggcgatgggctgatggcgacggagagctagtacttaagggataagcaaaaacagggccttgtgcagctttcacagtttgcgtctagcatgacgccatatgcaccactatactcccattcgcagatgatgcgaaacaaaagcaccaaaatccgtcatcccactggcaattcagcatctgtgcaaagcatataatgtgcggataattgagcggtcgtcatgtcagccgaaatggatggtgagatcaacaacaccggttctccgtggtaaatggtgatacgtgcccatacatgcgtgctgtcttttcacctcgcggcctcttgcggaatactcctgctgcaccgctaacttcaccttcgtcttatcccccccccccccccccctgaagcgctcaccacttcactgcgtggaccgcgacgcgcgacgcagcgagtggccacggcgcgttcggccgcatcggttccacgcgcggaaccgtacaagtctcaacgtgacaaacgccggggttgtagagcagccgggtgatatctggggtcgcattccctgttcgctttttacctttcgattcggttggaaaccgtagcgcgcgcgcgcaggggcggagtcgcggttgacgcctgtacgtacgcgtcgctgtcgcgtaccacctgctcggagtacatgactacattacgcacgggccggccggtataccgaaagctagtacgggggcagtagatttttgatgccgcagaagagacggagcgagcgggggtgtggtggagacgtcgacacgcggccgcgagtggtgcgcgcggtgtggttttgactcccgggtgacatatgtacacggattagattatgttatcttcagatgggcgcgcgtacgttgcagaaagcgtgaggtaccgagatggcatgaatgggatgggagccagtcagtttttttatatcagaaagatcataggtaaaggtgcaagcagaccgatccacgaacctatgtatgatacaaataataaacagacaaccttttgggttatctattaatttgaattataaatgggtttgcgaatctttccacttgcacctttaatcatgggagtgcacatactacttgtgcttgacacataatttcctttttatctcatatctgaaagagattaagggtgtgttcgaagagaaggggattgaggagattgagaagatacgtaaaacgaggtgagccattagctcatgattaattaaatattaactattttaaatttcaaaaatagattaatatgattttttaaagcaacattcctatagaacttttttacaaaaaacgcatcgtttagtagtttaaaaagtgtgcgcgcggaaaacgagacttaatctcccctatcaccctggaatgaacagagcctaagggtctctctgaatcgcaggaatggaaaaacgagggaataagaaaaacatagaattttgataggaatataagtacaaaacaaaaaaaaagaagaattagactgcagaaaaatcacaggaattagataaaagagattttcagttgaagctctagctaaaattcctttaaaatctctatagaattgtctattccatatgaattttaaaagatcaacatatgatccaatcatttgtttaaaaacattcacaggaattttttcctataatattgaaatctttcaaatttttttatgttttttcttcgaattaaagatgccctaactttttttttaagatgaaatgaaagagaactaatcactcggcaggaagagccgcacagggcagggatagcctcgtgagagcgactcatccgagacgtgacagagaacccggttccaatagggctatatgccgcgaagtgggagcataaacagaagcaaccaaacgctcgcattctcgcactacagctctgcagcctttcctccccttcccaatgcattactgctagaacaggagacggacggacagcgaaactttggttacaatagcaggctataagccagctgcaaacatattttaaagagataaataaggagaaaaaggagcagcgggctacagatttatagctagctgtagcacggactccaagacgcggtatgtgtatgataggtaggaccagatatttatagtatagtatgtaactattgtatgaatgagctattagattggctatagatgaattggaggctagtagttgactatactattaaacttgctctaagaaaaagtatcatatacggcgaaaacgagactccagtagcagccacaaaaggagctatctccattctgtatcacttgactttcgaatgttgaagaagatgtgttacatttacagagagattgcacgcaagcatggccttgaacccatcttcgtgcactcgtgtgctgtgtattccacggtgctcctgcgtgtgactcaagcactgggatcattttgtatgtgcgttcgccgatcgatgtgttcttcgatcgaaccataccgatcacggggaaaaggagtaatcgaggcgcaccgggggcaccgagcccgtaatctttcaatcctgctttttgtgaaagtagcacgtacggatcgagcggctccgacgttgcctcggctgccaggaacggaacgtgattcctcgagtatagatactctttttttttaagtagctatacaactgttgacagtttttgggatgaaaaacttttaaatataactactatgtaattacattgtaactactatgtaactactatataactaatatataactcgagtgtaactaaaaaaacccgatgggagaattggttaggtgaacaatccctactgcacgcgtctgaattttttaaaccgttttccctcactagcacaaatctcaaagcatattagacggcttaaaatttaaaagtttttaccccctattaactgtcgccagttgtatagcaaatccatttttttttaaacctccaaggtagatactcgacggacgtcataagatttgctttcgtttgtttactcactgtttacatggtgcagcatcgtgcttgtcgatactagtagatatttgggcgtacaacacgacaaagaaggttccgaggcttgggaggctggcccccggcgtccgaggccttgagggtagtagggtggctccggcggtctgcttcgctgttccatggttctgaattaaacgggcctctgatgggcgatgtcgcatattttttgggccagaatcctaaggcctactgttgaagtggacgtgcgggtttgtttaggtgggctcgttatccacatacatgggttggaccgtccaagtaaatcgattcttttaggaaaaagtacaccggaggtccctcaacttgtcatcgagttacaaaatcgtgctccaaccacaaaagcagatatagcacatcaatcattttacaaaaatcaatcattttacaaaaaaacattcactttaggtcattcggtggttttgaccacagttttattctacgtggcagttgagtcagcgtggaacccacgtgggctccacatgtcagcatggccacgtcgggctcattctctgttttcctcctcccctctctctctctcacattcttctctcttctctgggcaagccgaccgacgactggggcggaggccaccggggcgaggcaggagagcaggaggcggctgcggctgcggcgggcgttgcgagccggggtggagaagtcgcgggcgctcaaccacgcactagcagggcggggcccaagcttggggagatccaggcgaggttcccggtgatggagacggcgttgtgcccgatcacgccccgcgggacacactcgagggcgctggggagtacatcaaccgcgctgtggggccggccgtcgccgtgcgcggcctcgagccgccgttcctcgcggcctccgccgtcgccgacgacctcctcggatacctcgtcgtgttgtcccgcctcgaggaggtgctccacttcctctccgacaactgcggcatcgcctcccagtggctcagcttcgccgagtacctcggggaccgcagcctcgccgacccctgcttcgtgtccgacctcgccgaggtgctctctcacctcaagaccccctccgcaaacctggacggcggcctcctcgtcgctgccttggacattcttgaggacgagttctgtcgccttctcaaggaacactcagcttcgctcgccatgaaagaacccaactatagccggccccgcctccaccttcgtgcccactgccgcgggcgttcggccccgcctccgcctccgcgcccaacaccgcggtgcccgcctgcacggggccgcttcaccggcggtggcgacacagcgcgacgacgccattcgcaaccggccgccgccctcgccttctcctgcatcgcagctgccgccgtcacctcctctcccgcctcactctagcggcatccgccccagccgccgtccggcttgcccagagaagagagaagggtgagagagagagaggaggaagggagagaataagggaaagagaggaggccgacgtgccacgctgatatgtggggtccacgtgggtcccacactaactcagctacgtaacgaaaacgggtcaaaaccaccgaaggatctaaagtgaacgatttttataaattgagggatgtgctatatctagtttcacagttaggggacgattttgtaactcagatgacaagttgagggaccttcggtgtactttttccactcttttagctttattaggactgtgttcttccctttctttttcaactcatcttcattttttttacgtgtatgtttttcaaattactaaacagtgtgtttttttcgcgccgaggttgaagaagctggtgagcaggaccgaaacaaagtttgtttcaaactggcaatgccaactataccgtcccattaccacactaatcttttaggccctacttgcctgatgcatctgccgaatttaaaccccggaaacgatattatttgctgatgacgctggcgaaaattcccttgttttaggcatataaaatgcagaattgcagataccgtgcagtatatccaataccagctcgaacttattcggcaaaaaggggtgcccagcatcgcagtgcaatgggctgcgacaaagcggcaaacataaagcaacatcacaaccgtgcacaaccccgaagcagtcaggtggtgtttagatccagggacttaactttagtccctgtctttagacactaatttagagtattaaatatagactacttacaaaactaattacataaataaaagctaattcacaagataaattttttaagcctaattaatctataattagagaatgtttactgtagcatcacataggctaatcatggattaattaggctcattagatttgtctcgcaaattagtccaagattatggatgagttttattaatagtctacgtttaatatttataattaattttcaaacatccgatatgatagggacttaaaaatagtttcatctaaacagggcctcagtcgtctctccggaatttattctggtgaagtcaccaatctatcgcaacgaaacaagacgcggttgaccaatgatcagcaatcagcggttcagcgtacgtttcagttcagcactttgggcttcccggcgagcatgaaggccttgaacacgagcttcctcgccaccgccgggtctccccactccgcctccacccccttcatcacgtccttggtcaccgcctccaggtctactcccttctccctcgccgtcgtcacgacggagccggtcttcaggaacccgacgaggtcgtccagcgtcatgtccacctctatgtcgacgtcggccggctcgccctcgcggcccacgccgacgggctcgaacgggaacggcaggtcgcggtacctgtccatggccagcctcgtcctcgggtccatatacgggcgcatggccgggtacagctggccgtgcagcttgtcctcgaacgggtggatctcgtagttgtagccccacaccgcgaggacgccgccgggcctcttgaggacgcggttggccacggcgtagaagagcgggatgtcgaaccagtggatggaggtcgccaccacgacgaggtccagcgagccctcgccgccgaccatggcgacgaggtcgtcctcggagaggtccaccggggtgtgcaggtaccgcaccttggggtgcgcgacggcgtggcggatctgcccctcgctcgcgtccgtcgcgaccacgctgtcgtagtgctccgcgatctgaacgcacacggagaaacactgatgataaagacggtcgatcgccggcgaaatttttcgttttttttcagagttcagaagatgatgaagcggcgagagtggttcagagattgggcgcttacgctgatggaggcctggccggtgccgcagccggcgtcccaggcgcggtggtggccggctgtgagggcggcgagcttggagaaccaagcgtcagggtaccgaggccgcttcttggtgtacgtctccgacggtctctcatacagcccagccattcttgctctctgcttcttctctataacctccaccggaccacagctccagtcctggactgtgaagagcgcgaattgttggggtggatctggatggaatttatagatcaccgaagatgacagattcagagtcaaagtcaaaatcagcagttgtcatctgatccatctcagtgaacaactttgcatttgcattatccactagtgtattctagtggcggttacaccatttttctcctcctaatagtacaccaccacatgctgaaactgctgcaacaaaaattatgcacaagataaaataattttcaaaggcaatcaggaaagtagaagcatgctgctaacaggacaaggaaaaatatggggtaaaaggtaggtaaaaacaggcaatgcatcaaatctgaaagatgtggattgtagaaagatgaggtaaagacaggaatagcaatctgaaacctgtagattgaaaaatagcctgggtcttgcaagtcaaccagacgtgggcaagttgcttacttcgatttgtggctaagatggccctccacattagtcctgcgctgaactaactgaacccaaaaagatgcttcagcagccgtatatgggaaaacaataagatgctttataacatggatcatctgccagatgaaggcttttacggttaggtcttgattacatcttcacagtaaaaacagatatctttggtttcatcagcatggatataaacatctctgcacaaatcagagtgttgcaacctactataataacgctacaacttaggaaatagaggattctgaataacaagacaactatacaacaataacatgggaattccagagtctgtgactgggaattttagactggcacagcatatgcagggactggaggtgtgcctctgccaacttcagctgaggtttggaggtttaggtaagtgccttggtcactacatgtaaatatttagcttaggtacagcaatatttaaccaaatacacttaagtatttaaccgtgtcttatttgttcttttagataagggttaagtccgatttatttgttagcacttgaagacatggtgacagtaaaaaaggcatgacattagatgataactatataagataaagaaccgctcattttacataattactcttttcagcgatacctgaatgttattcttacatatttgtagtctagtgggtgcaacagtgcaagcaattcctgcactggatcaagtccgcagtatccacagaccacagtccacactgcctgacttagaggtgcaaccgtgcaagtcatctgggaaccttctgtgccgttagaacacatcaccctgtctgcaaaatacctgattcttttccaggagcaatctgataatgcagctttgcatctccaggagttcccaaaggtgcaccagtgcaggaacagttatcaaccatataaagctcccacttcttgatcccacacttatctaaagcagatgccagtcttgggtcatccaaatctggacaagagccatctgggctaacgagcactgctccagtgtatgctagtccagcggcctgagcggctccgtgataatggaacagaccccagctgaaatcatctgaaacatcaacgattgtccaaaactcctttgaaaccacaccattatccagcacactgaagtaaaatgtaccagggatgagagctcttcttactcggtactttctgcgcctccaaaccagttccccttccagggttctgacttgaaaaattggctcataccaaaatgaacctttagcttttcccctgtaaaataattgatactgacatgggaattgatcatatgctggattttgtccagctacaactctccaactccattccaagttgtccaaccatccaacaaacatgtcttctgcaagttcatggcttagcatttgttctctgaacatggttagtgggggtacagagggcttactggggatctcggcattgagatcaagacaattgttcttctgcaaaacacataaagaaaaggcctccagatgcggactctcatacgacgcaatgcagcgatagttgcaaacttgatcagttggagaacatgaatttaaacactgaagggctttcctacagttgggatcgaacagacaattcagtatctgaggaccacaatttcttatcatacagcttagggtagacagaccttttgccctaaggttttgcagcatatcaacaggtcttatgtacgcattaaccacaacaagtaagcaaaatctaatgtcatctgaattatgcctttcccaggcattagatacagccttaaggacttcagcagattccttcatgccacctgtttctccaatatttgttagcttgcaaaacatgtcctgacgtccagtgtattgaacatacctgccacctaacttgttttctaaggttggagatgattgaaagcagattatattgggaatgtcctcactgttatttataagccactgaacagtctcctgactcgttattgcaacattgactagcatatcacactgtgccagctctttcctaagttcatcatggccaattgacttgtctgtgaagacaagcatttcaaatccttcgtcaacccacttcatcctattagcctaaaaagacagaaaaaacgagatgcatggttactggcagtaaatttatgcagagagatattctgcatattcatattaagtacgacaataaatcagaggacctgtttcttgctttctgaatgaacaaatgtgtcatcttgtaatcctcagatgcacaaataagcttggactctacatgtttttccttatgtgcatgctaactcaaaaaacaaaaagttaaacaatttcgatgatactactatattagattgagttcacatgagtggcatcttgggtttgatcgtcatccacaagaccacaaatgggaaaacaaaggaaaccaacttacaacatatttcccatgaatggctctgcaagggttgcagttttgtacactatcactaaataaatgatggccaggaaagactgaaatatatgtgcggattttttttgggtgattccacgcacatgccccttttcataagcccacaggtatgacacacaattgtattatggaaattatgtaaatcctacacaaaccatggtatcatatatggacatatcaatccacaaaacttgaacagaaattccacacttgcattgtatagcgtcacatcttacagaatctaagattgtggcatcgataggtttattaaatcacaaggcaaacaaggtaaaataagcgatacaaaattataatcaagtactaaaacaaggtaaaataagcgatacaaaattataatcaagtactaagtactaacacattttggaggtaccagaaatttagaatgttcgtgcccatataatcacatatacttgaatacttctacaactagttctccaagtgagcgtgcgaaatggttctgtgtgagtgtgcaattgaccaatcgcgtatttgcatgtgctttgccgttacaacattctatctatagaagttcttcagttatcagcatattccgaatcggcttattgcaatactgtcgagttctcctttgcactgcgactccgcactagcatttgatagcggtgaatcggtgctaggttcagagctcagagcggaagcataccgtgtggcgcataacctcctcccatggcgtgtccttcagcgggctgatgctcccgtcgcctactatggagactatgcggacggcgcccttcccggtgatggttccgccggccccgccgccaagctcgcccgcggcggcgcgcggtggcccgagagagcggacgccgccggagtagcggcgggcgatggtgcgcgaaggggcaggcacggaagcggtttcatggaggtggcggcgagtaggtaggaagaggcgagtggtggccgccgcggaggcggacgtggtgggcgtggctgccatgggagtctgggaagaggaggtggacgaagcggctggacctcgagtctcgagccttcgagaacctttcgactcatccctaccgttcgatcagaaaatcgacggtggatactaatctcagggaaaaaaattctggaaaacgtttttctacacaaacaaaatacgagttataaaaactagctggtggcccgcgcaattgcgcggcaaaccccaaacaaaattatatatttttaagtatgattttacttaaaaaatttattaaatagctatctcattgtcttaagacattgaaaggccaaaccttatcatcatcgtgtttctaaatatatagtttttaaaagtcacaccagttgctatccattatgtcatcctcttctttatttgcttgctcgattatcactatttctattcattcttcttggaatcattaaaaattggattttatagttttagagtttattgtcatgttgtgtttcgtttttacaattcctagatgtcccgtcaaatgttgccattatacacctctacggccagtccactgtctcttctctttattatcattgagattttaaaaatcgaaaataattatcgtttggtttattttttactttctaaaagtcctgccaaaccatcagcggctttgccattatactcctatatgactcgcccgttgcctcccttttttattgtcattgagatttcaaaatcgaacatgattatcattggttttttttactttttaaattggacttgtagtttcattttttataatttttagaaattccatcaaacgatgccactatgcccctctacagcccatccgccccctactcattattgtcattgtgattctaaaaatcgaacataattatcgttggaatttattttttattttctagaagtctcgtcaaccgtcggcggctctgcaactatactcttatacaccccgtccgctgcttctctttttattgtcattgagattttaaaaatcaaatatgattatcaatgtggtttattttttttactttctagaagtcccgataaccgtcttactcgtttgcttcacggcctgcctgacatccctccttttaatcgtcattaggattctatttggtgttttattaacattttttatatgtcgtatcaaccgccaacactctactctgttttagatggtattttctttcaatagtctttatttttatcacaaattttagttatttataaattgtattcctaattgaaatcttatttttctttttctaatttcagaattttttttaaaaaaaattagttagtaccgtattgtgttatcttaatgtttttattttttattttcaatttcagttgttttaaaaattgtatttctacttgaactctctttaatttttctaattttagatattattttattttttactctaaattttaattaatctcatattgggttcttatatggattattctttcaatgttgcttatttttaattccgaatttcagctaattttaaattgtattactacttgagctcttcttttattttcttttactaatttcggatttatttctatttttattctgaatttaattaatctcgtattgagttcttatatggactcttcttttaatattccttatttttaattttgaatttcagctatttttaaattgtattcctacttggaatctcctttccttttctaattttggattttattttatttttatttcgaattttgattaatctcgtattgtgttcttatatggaaacttctttcaatattgcttatttttaattccgaatttcagttaattttaaattgtattcctacttggactctccttttattttcttttgctaattttggttttatttttatttttattctgaattttaattaatctcgtattcggttcttctatggactatcttttaatattccttatttttagttccgaattttagctatttttaaattgtattcctacttggactctcctttccttttcttattttggattttattttatttttatttttatttttaattaatctcgtattgggttcttatatggaaacttcttttaatattgcttatttttaatttcgaatttcaactattttaaaattgtattcctacttacactctcctttcctttaataattttggattttattttatttttatttcggattttgattaatctcgtattgggttcttatatggaaatttctttcaatattgcttatttttaattccgaatttcagctattttaaaattgtatttctacttggactctccttttctttttctccgattaatgtgggaatttctaacccccacagcgaacgtggtgtctcctttcaaagctgttttaataacataatagatagatacccgcgcaattgcgcggctagcaccgatataaaattatctaatttttaatatagttttacttaaaattttgttaaatagatatctcgttgtcttaagactttgaaaaaccaaaccttatcatccctgtgtttctagttttattttttaaaaagttatatcagttgcaaatcctaaattctttgtcacccctcatttatttgctttctcgatcaccactacgtctatttgttctcactaaaaacctctaaaaattagacttatagtttttagagtttattgtctcgtttgggttttgtttttataattttcagaagtctcatcaaatgctgccactatactactctacggtccatccactgcctcttctctttattttcattgggattttaaaaatcaaacgtaattaccatttgggttctttttttactttctagaagttccaccaagctgtcagcacctttaccactgtacacatgtactgctcgcccgctgccccctctttattgtctttgagattttaaaattcgaacatgattatcattggggtttatttttttactttttagaagtcccgtcaaccgttgtaaccatgctacttaatgacccatccatcgtccctccttttaatcatcattgggattctatttggggttttgtttatagtttttagatattccatcaaccgccaccactctaatcctttacatgcatgttgcttctcctatatttgttgtcatttgtcatagttttataatttttagaagtcatatcaaaccctgtcaccatacttctcttcggcctatccactgcctcttctctttattgtcattgggattttaaaaatcgaacataattattatttgggttcatattttactttctataagtcccgccaaccgccatgaccaggctgcttaacggcccatccatcgtccctccttttaatcatcattgggattctatttgaggttttgttaatagtttttagatgtcctatcaatcgccaccattctacttctttataaacttgttgcttctccccctctttattgttgtttgttatcatttgtgttctagatgaagttttttagaagtccatatttttcagtccgatattttatttacaaattatattcctacttaaactcttataattatttttctattttcagtatttatttttttgttatttcaaattttagttaatctcgtcacatgttctagatggtatcttatttcaatagtttttatttttttatgacgaatttaagttatttataaattttattcctaggtgaactattattttttctttttctatttttggaatttattttaattttgatttagaattttggttaatatcgtattatgtcttatatgaattattttttaatgtttttttattttcaattttatagttgttttatcctactcaaactatcttttttatttctctaattccggattttattttatttttattctgaattttaattaatctcgtactggattcttatatatactcttcttttaatattccttatttttaattccgaattccagttatttctagattgtattcctatatggactcttcttttttcaatttcagattttattttatttttattccgaattttaattaatctcgtattggattcttatacgaactctatattgcttatttgtaattccgaatttcagctatttttaaattgtatttctatttggactcttctttttttcttctccgattaatgtgggaatttctaacccccataacgaacgtgatgcttttttttcgagcagttttaataatataatagatagatagatatcttcgaaactcccgcccgccaccgagcgggatacgcaaaaatctccaaaattttccccaacccgcgcgcccccagttttcctctcctccgaatcccaatctctcgcagttcgttcgaggagctgagacgctgcgacggccatggcgacgagtctcttcctcgcgctgcagtgcgtccagtgctccactatgcaggtgcgcgtcctcgcccaaatccctcccccgaaaaccccgcgagtttcttcaatagctcacccggtttcgttcttgcggcttcggtttgatttcccaggtgaagccgcagaagaagagcagcaacaagtgggtgtgcgtggtgtgcaaccagcgccagtccgtgatgcgcgtccacgcccgcgggcaccgcgccgccgacctccgccgcttcgtccaggaagccaacctctcgcgcggccgcgccgcgcatgtgcccgtgcccgaggaagactgggtccctgcggtgccgggggagcagcgggatgagttcccgaaggagaggaagaggcggatggactggtccgactatctggaagatccgggggagtacgatggcggcggccaccacgaggaagctcgagatgaaggtatgcgcgaaacctgtttgatgtgatgtcgcaatgtatgtgtatcacagtatcagtatgatattgggtagcgtgtaaaatgatatgctcattaggaccaatggtaagttgattttgctaggggcctagtgttactacttaaaatcaacttgcttgccgcatggtttagtatcgtgttttcaagcttggacgcagtgagtacgggtaatgatacttgtggttcaaggcttaacaaaggcattgctgaactaaaattataagcacctgtttgtgaatagtcttgtatttcatattccatgcatgaatataaatgttattggggcaagctatacattgcttatgcagcgctagcatgatcacaggtctgttacgcagttacaatggctagtacctgaatgctcggctataaaaaagttgaatatctgcattatgtttcaggatgaggttgtattatgtatagcacttctaagtcttgagttagttctcttcatctttgtttatctgcacttatctgggaaggaatgaccagtctttaatgcatgatctaattgttttcatacctcaatttacaaatagatgtagggattcaagtaacaactgaattacctgaaaagaggcctaaagtcacttccttgaagagggcccccaaagcccaattgggattaggtggaaagaggcccaagacaccagtcacttccactttacccaagaggcaaccgatcgaagaaggttcactcccatgttctgcagctcctactgctgaaggcacattcaaatcctaacacatattgtacttgtcattaacaaaacatgtaagttaaacgggttgtatgttttctgcagcacaaagatcaaaatggagcaattatttggatacaagtttctctgaagggggaagtgggtttgaagactctgagcgacattgcagtgaactggaatgctccattactgatgttgtggtggatgatgaggtacaccctgattttgtgtgatatatatgtgtcttgtcttggtctgtagcattttatgctttgaatagtgcagtagttagaaaagatctgatgtgcagttggcaaaatattatcatataggatgggcactttattatgcactgaatcgcaacttgctatgttaaaattgaggagaaattaagatgcatgctaaccttttgaaacaatgatgttaacagtgcatctgcttaacctactttcagagttctctgaacttagtcctttgagtttaaaatgtatatgtataaggtgacaggcttatgtcacaacaagagtttcagttagttgtatactccacttaacaatacccccacccctgtaatttcaaaaaaatccctggcaaaaagagagaggatgggaaaacacaagtggtgactcttttcttcattttggaactccacaaagttatcctaaaaggtaccccgtataaaatcttctgcagtacttcaactggaagtagggatatgtaattccgagttaactgaagattttgttggatgtatatggggattatgcactactaaataactactgattgcatgcttcatttgttatgcttgtgtctggctgagtgcatcactgcatcttccaaacataaactgatattccgaaacaataatccctacacgaagcctgaatcacaatgaacaaatttgaaacttgctgatgtctgaacaattcaacaacttctgatttctgaaaccattgttagtttaaacaattttgatcattgaccatgatgaagatgtgcactcttctgacatgaacctatcaccgatcactgtttcgctgccatcaacctgctaagttatgttataacctattaacttggtaagttcatacgtctcaacatctttctaaatccagaagagggacttgaacaaatggtcattatggtagggcagtctgaagctcaagcgggaatataaagcatcatatctgtgtcctgctactttgtagagaggggttggataaagaataccttacattgctttcaacccagttccaccatttccttttcatcattaaccctcttttgcatttataatcaagtgaaagttcacatacctcccttatttggcgatacaagccacataatgctttttctgagccctgccgccagacacgcaaagaaccaaacaaaatacttattgcccttctaatctggagcaatagctccttcggttagccagtcaaccactttttggtccagtcaatcatttcgtttctccctgaatctgttgagtggtcacacagtattttaacctcgaattcaatttggcatattatttatttgctatttagagtacattggttttagattattaccgtgtaagttattgcaatatatttaccgtaatccttgcttccaattatgcataatttcaattttttgttttcatgactcaaaaactgtaccaaatccagatcattcaatcttgtactctaagagaaaaagaccattccatcgttaatacgctactaacaagtcatgcatttggtcatacatatgttaaatttcattagacaactaccagatgcaattacattctcctattatatcctcaccacagttcactggcaagcacatagttgtgcctgtggggtggcgtgctctgaagtgcgcctataaagttagcaagagccgacagctctgcttgcggtgataatctccgtttggtagcgaacaattttgtacgacctcccgcagacccactgcttgccgtagccagcacgacggcaacgtctcaactgcatttcctagtaattcatcacttgtactggccatgtcttcctggtgtttgtttacagtctgtcagtggcagtcagatgaacctgccatttggtgttctgtgtgtcgttacggctttacgcgatctgggtggatttggtggtagttggaagtataacggactgaatatcttgacatgtcagcctgtttattcagtaattctagaaccgtgggagtcagtgcagcattgatggaatttctatcccgcaacttgaggcacttggccatgtgtggtactagcataatcagtactacatcttgagcacttgaatatctttatattgtggcctgtgggagtctgggagatctatacaacatagttacacagtagtgccaacatacactgatattatcctattactgtattgcttaactgggctcgtgtcattctgacctgacgcttcgcgtcacagcctgtgaacaaatatgttttgccgtctcatggtcatgggcgataggtcatataatgatataaagctgtgcaatgtgccaaacttgtgtgatggcacgggctggcggcgtaagcggcagccgacaccgtcagccaggttgccccaaatcgtcgcggcccgcccgtgctcggggcagtggctatcgcgacgccgcggccgcgcgggcgatcaggcgccgtgccgcgcgagatgccaaccgcgaagcgcgtcgcgcgcgtcgcatgcggctggggcgaaatcatagccaacaacgacactcccagcaatggtacggcacaatcatggagcatcaactggtgcgtccaaggatctcaccccatgatgaccccgccgcagcagctgggtatcgcgtgttgtgggctcgagtacctcgtatacggtctctagtctcagttaattgttgccacctacgtacggccctataggccattactgccctcaacaacgcgcgacgtcatcatgtttattgctacgcataatcgttgaaatcaaccatgttgccgcgctgttccgcccgtgcgtgccggcggaggtcaggtcgatcgagctcgcgagctagccgaccggggttggtagttggctggtccttttggcccatccggtcggcgtgataattaggtatttggatgtgtattaaatcacgatgcgatgcccttatccgtctcttccctgttgcctccggatctttggactttggaattggaaaagagctaagggagatgtcatgcttttgttgatgctcctaactaccgaagcttcggtgtttcttttcttttggcatcgtcgcaagtgatggtgactcgacttaacactcatcatcctgctgattgatgccttactttaccgttaacacgtcgatgcgttcgacgaggtgcacgcgccaccgaacgcccgcactatcacggcggatggcaatggctgtacttccatactaatcatattgttctccccgtattcttgtgctaaaaaaaaccggctgtagtaagtatccttaccaacctagctcaaaactgtctgtctgtctgtctgtctgttgtagtggagcatttgctccgttcatcttgccctcccattccgtcgtcgtcgatgttaccgtgaatactttttatgtagtagggggcaagattggaacggggaatcttctaaatcacgtcattaccataactatgtaggctcacataggcatgctagacagcacggcactggtcctcattgcctcagggcaagtataatagtaggttataagccggctaaatgctgagttggaagaagaagcgggctgtaaattaacagccggcttgaacacaggaactaagaaactttgtgagagagacaagtgggtcctgtattaattgtgaagagctaactattatatggataggatgagaaaaggctataaagaaccttatagtcagcaggtcggctgtattattagccttgctctcactggctccaaagcgaagccaatttctaatcttcttttaagcgcgcggattaggatgctttaaaccttaaccagtaacacgatgcaggggtcccaccacccgacaccagctttcactgacaggcggtcccagaggcagcgcatgtagtagtactattactactccggaaaaagagtcctggcagccgttggaaacgttcgttaccaaccgtaaaattttgcatgtgtcactgacagcttgtccccgaagtattctggccccaccagccggcgtcaggggctcatcggatgtcggtgttggattccttttcctgtgggcccccgcgctgcactgttcctctgtctgtcagtcacttgcgctgtgtgcttctgctcgggctcaaagtcgtcagctttttctgtgtcttcccctcgccgtctcgcgcctgagccctgaactagacagaccaagcctctgtctaccaatggaggcctgagtcttagaggccggatttggtcgttggagagagagagagagagagagagagagcgagccgagcctgtgcggtgcggcgacgcctgctcctcttcgctcgcgcgcggcattccggtcgtgtttctgaggtgattttcctcgttagatttttggcgtagtgtttggtgccttgttgatggcttcgtgtggaatggtgtagtttggtcgtcagattcgtgtctgctcatacttggccccgttctgctcggcttctggtggttctctaagttttcttcgttgtcctcggcctctggtggtttcttgtgctggttgtttgctcgggcagtcgggcctgtgtgattttctgccgctgcattcgcatcaccttctcccagtctgtgccctgtgctagtgtgctactctctctactgagctctctcgcctttccgcgttcgacattctcttccagctttgtctcacgctcgcaactggttttcccggttatttcgggtgcgttgttgcctttttgttttgttcaggaaggggaaaaagaaatgttgtttgaggtttggatctgcgtactgatgtctgatgagctgctctgtaacaggatccggattgcacggtgttcgggctgtttcgtcaaccatggggaagtctccggcgaagtggatcaagtctgtgctcctcgggaagaaatcagccaagtccaactctaccaaggccaaggatttggcggtaagtacttctttgtgtttgctgctccgaattcgtggtaaaagatgatatctgtttcctcgcaaaaaagaaaaaagatgatatctgtttccctgtaaaaaagaattatctgttggtagcacgaaaagagaagtcagaagtgtatctatttaaatttttcaaagaagtaatcgacttaaagtaagatactaaggcttgaaattgccattacggctcctggactggattgtacaatgaaaaagttgcgtatgggtatgggtgccttttatatgaagcattgcagcattcttttttgttttatccatgttgtaggtctgtagcatactttgattcttcctcctactttcactgattggttggttgaatcacaattttgttgctgatatatagaaggctgcaaataacaagcctgtgctttctgaggatccccctgtgatttctgagccagctcttgttaattctcacaacgatggaaatgctgaaaattgcaagttaccaaacggagttgcagttgaagccatgggtcaaggagtggagaaccaaaacattgttggctccaaggcaccaactagtccagagaaactaagcgaagagctagctgcagtgaaggcacaagcggccttccgaggttacctggtaacaccttttgcttggactgatccattttgttcctgccatcttgcctcttgttaatgcacttttgatctggagctctctgcaaatgttgctgctagcttgtcccaaacctttctatagttttatggggtcatcgtttttaaaagtttcagaaaaggaaacataaacagccagccctgcagaaagaaaatttgtgtcctaaaaaactgatgagttggctgtctgatctatacctaaacattagtaactgctgacacattagcacctcttcgttttcttttggaagttatagaagaactgatcagataatatgtcccaggctttttgaagttatataatttgccattgttttggacctttggtgcaggcacgtagggcattccgtgcattaaaaggtatcataagactccaggcactgatccgaggacatcttgtaaggagacaagctgcatcaacccttcgtgtgacatggttgatcgtgaaacttcaagctttagttcgtggaagaaatgttagactctccggtgcttccattcaatttgttgtgaagtccggccaacataagtttctggtaagtatcttgacatgtggcagttcaaatatttgatttcttgtatccttccctgcttttctacctgttctatttgtattatgttaaacctctgtttcaaagaatgaatgtatgcaatattgaaagcaatgtaattagtctggcaaactgaaactttttttttgtcgggacggccaaaggtaggccggccaatttcattaagattgggggaaacaaagttttaattacaacgaggcaaactgaaacttttcacacacacttcagacatctcttcagtgctgcataaaatcagtaatgacacatgttcagaactacagatcttttggctaaaccccaagatggacatatcagccaagtaacattcagtacgccccagaaaatagagaattagctagatactagtatttactggtggttgatgattattattatgtacctggatttttataaatagcatggcaataatgttaattctgtgcatatctctatcatattggtacttggtacaatgtttcgtcattgttgtgggagcaagttctggtgtattattgtattgtactaggttgccctttattctttaacttaattttctacttgatttgtggtttgttctcacagatcattaactaccttcatgtggtcatattgcaactgaaaacaatactccctccgttgcatattataaggtgttttagttttaccctaaatcaaagttctctaaatttgaccaagtttatagaaaaataattaatgtctacaataccaaataaatagactatcaagaaatatttcatggcggattttgttgaaaccaatttgatgttgtagatgttggtgcatttttctattaacttggtcaaaatagaaaagtttgacttggacaaaactcaaagccttacaatatggaacggagtgaatacacactttcttttggtattcttttattcaaacattaaatacctccctaactatcctatcgaataacccacaccgttcccttcaacacaatatagaaatgcaaactgtcttttcaaaactataaatgtcgaagcttttcatcagataggtgtctttcatactcaaaagtttacaattaaatatttaccttgttatcctgattgagtatggaggtaaatctgctgaactacagtataacttaaattgcatacatcatggagcatgcatttatattttcttttcatgattcctactaaatgtatgacccatatgcaatattttctgcttgatgtctttatgtggccaaaaatctaaaacatgttctgtttgcaattattagagtgataaaccatcggacgcttggaaagagaaggtatcttcaaacgcatatgttcgaaaggtatgccatttgttttaaaaaaacaagacttaccagtgagatttgctgtatgtctaaaaaaggtgtcatgatcctgctcatttcatctatgagaaatgcatgagcccaaatcaaatcgctcaccatttatacatttcagaggtgtgctcactcacttttgtacattttgtagcttctatcttcatcaattgggttagaagctcttcacttgcagtatgacaagagggaccccaattcattgtacaactggttggagagatggactataagccagatttggaagtcctcttcccaaccaaaaaaagttgctgatggcaaaccacaagtaaggaaggccagttatgcaatggaaactgagtcagccaaattaaagcgcaatgttcggaagagttctgctgtcactgttgatagcttccaaactaatatgacagttgaacctgaaaaaattaaacgaaattcaagaaaattctctagttccgctgctgattcagtaccagatagccagttatctgaacttgagaaggttaagaggaaccttcggaaggtaactaattccatggctgaagcatcaaagatatctagctccagggcagatgcctcaaaggtatctagctccatggctgatgcctcaaaggtgtctagctccacggctgatgcctcaaaggtatctgattccgtggctcaaatcccacctagtctcgtgaatgggatctctgatcatcaagacaaccaatgtgaggaagcacaacagaatgcatgcgtgtcatttcctcctgaaactcaggagttgcacagtggcattctgttggaggacaattcacatatgaatctgttggaacctgatttaatatctaacccggaaactcctttcacttcgattttaacctgggaaaaatttaatgattctactgctgatgctcaagaagttgaagttctgccactgcagaacattgataatgaagataatttcccagaaaatggtgtcttaggaaagaaagagaagccaaggtccaaggaagaacctctgtctaatggaaaccttaaaactagcaagaggaggtcttcgttctccaccaaatcagattacccggaaaatggagcccagaatacgccagttccacgaaggaagccaagctatatggctgcaacagaatctgcaaaggcaaagttgcgaggacagaattcaccaagactggattctgattcaccagcagacatgaatggcttcacacgccgccagtctctaccttcttctacaaacagtaagttgaacccacactcacctcatacacaaggaccaatctatttcaaatttgactaagtccatagacaaattagtttcatcaaatcaataattgaatatatttctaaaactaaattagttttatcaaatcaataattgaatatattttcataataaatttgttttgggttgaaaatgttactacttttttctacaaacttggtcaaacttaaagcagtttgactttgaccaaagttaaaacgtcttataacctgaaacggaggaagtaacagttatgaactaaaaagtgataaatccatgttaccagaaaaaaaatgtcgctgttaaacattaagcaaaggtaaccatctgaaaagataagatgatgttctaggctatcagaatgtgacaaattttgagtaatgatagcaaaaatgttcacagggagttcatggtattattctattgatcccagaagaaacacaactgtttattccatgtttaaaatactcccttttttctagtacaacaggggctttttgggtaatattaaatctgagaataaataaaaatggttgcacacattgtatttacattcatattctgaagtattgcatggattataaatctgtcgccttgactatgcatctttctgaagttctgcaactaccatattctacatagtcgcaccgggtggcctattgccacatttgttagcattgtatgtacttgtgttatttaggcttttactgacgttagaatggatctgtttgcatctgatcagtttaaaattcagacttcacagctcatgagccaacattcagtttttccttttcgtttctgaattctgatgtcccattttgcttgtttattttttatttttaccatctatcagacagagcgatcagagctgaatggagacggtggtgaggacaaccaacttccatttgaacggtgcaacgttgtggtggatgaagtgccctgctgtccgtgagattgtcgccattgttttgttcaagatgtaaaaatatgttggccctgtgttgatctattatctgttgcatatttgagttgttaatttattatccattgtttcttgtgcaatgtcttgttcatagctacatcttactagtttcgggcatatgctctcgtttccacccaaggcaccctgcctgataaatggtcagggggctgatgccctaagcgtgttttaatagaacggcttcatcctactttcatgctttcccaagttccctttgtgctaacacgtactctatccgttcctataaaatataagatgtacttattttatggaaaatcaatattttaaaattctaagtaaagagtaaactatgtgttgacagaaaacacgaggcctgggagatttgcttaactccagtgcaggtccaaagctcgcctttgactccaccttgatctaatctctttttccgatgctgatattaccaaatttggtcgttaacacatgtcccccaagtccgggatatttgataatgttccggatttgctgtgtaccgactccgagcaagtttcgcactctgccgtttttttgaccgttattctatcgctttaaataccaaccgttgccctcaaaaaatctcacgccgtgacttccgttttcaccgctcaagtgaaactttgtcctttctctatccggcgattcctccgacgtaaaagcaatccccaggcgatttcgcttttgatcagatctccgtctgcggcgatgtcgtcttccactagcccatctactgcgccatcggccaagtacgctgaggtaagttctcaccggctagatcccttttcctcgcatgaaatcgatttctccttttctcattatgttttatgctccccgattcctttggatttgcagcaccttttcaacctagttgcgattcccagcctatcgcacaaaaaccactattttcttggcccaatcggcaatcttgaccccactgatttcatcattggtgaaaccaatagaatcccctttagactagccaaccctaacttgggtcactggaagaataccttcaagtcttggccatctctcgaaaagcctacccctgataagagctggaccacctggtaccaacgcatatcggctagtaagaaagcccactgggatgagattgggatcggccaagcgcttgctctcaccatagccaattcttctaaggatgaacctctgatggctgccgccacctatttctggtccaacaccatcaatgccttcttatttaaccaagggccgatgactccaactttgatcgacatcatcatgattactggattagatgtaacttcatcggctaaccctatgagtatgaataccaagaaccaatttgacttcaagaccaaaagcataggagggtggtctggttatgtagcggcatacatgggcaaagggcctgtcactcctcgggagcacgtagctttcttgctaatgtggctagaaaagtttctcttctgtggatccagctgtggtcccacaaccaattggcaatttgtagccgaagccttaggatcaaagaaacaatttcccttgggcaaaatccttctcagctatctataccaaatgttgaacaatgcatcggctaagatagccgtcggctcaatagttggagcaggtggaccatggtggctactgcagacctggctaaacctggtagtcatgaaagttgtcaatcggccatctgtaacagacgctgaattcccacggttggaaccaattgtagaagacgatggagaagaacgcacccatcgcggatgcatgtcatatggagaatatgcatccacaccagccgatgctggggcaaaactatcggctgagctgctcaaagattggttctgtagcttttatgaaggcttccagaaagatgcccgggtttggtttctttatgaagactcagcaaaccttgagctcccattagacttcagatttgaagacatcaatcatgaaagatatcaaacgcccagggaagtctttatagctgcaatcagcccatgcatcctacctgtcggtattcaccaaggaagaaatatccaagtctcctacgaattctatcaccctataagttcagttagacaacttggatttggccaactcccaatcggcttagtctttgctgacaagatccaatgccgaggagaaatttcttcaactctaatgatggatcgactgcttaacctccaaggaccccccttaggcagtatcgacaatattgagttagcaggattcaggagcaggaactttgacagatggtggggtgaatggaagttgcatctatttcatcaatcggccacaatgtacatgacagatctattccctgacatcataccccaggtaaactttgtcatcactaaatttcataacggttagctaattcattacttgactaatcttttgttcctgttttgcagacaacaaagtcctcccctccacatcagagcaatagtggtagaaacattgaatatgccccaggtctgattcctaatggaggcgaattgtctcccccaaggtctcaaccctcctccaaggcgccattagggaaccaaccgatgtaaccaagaaaagaaaaactagatcatcggctatgaacaccttgactctagttccaaagaaaaaaggccaaatctaagaaaaccaagccaaccgacgacctgcctgctttggatccatccattgaacatgctctggatgaagaagatattgaggatgatgttgatcaggctacagccgaagcaagtgatactgaaaaaacaccatcggcttcgcctaagcagataccttcaactccttctgcccccactcacttcttcagagtaaaacatctttccttgcaaacccttttataatcattatttttcagctgactactcataggttttgtagttgcagaagaagaaaactgctataaagaagaaatcggcagcaccaattctcaaaccagctccaccagtaagacactctcaattttactagttgatttcagccgattttgtctaacacttgtctttttacagcctcctcctcctccttcttctcctgtacaacaatcattgagtgactgaactccatcggccgtggggagtcatcatattgtggaagaagaacaaccggctgctcctgctatcccagtaagctttcctttaatgcaagaatttagatcgactatattgacttagctctcaaactttctgaacttatacctgcaagttctagccgatctcttttcttttgatatcaaagattatcttgatgaggcagaaaaagatacttcaagcaaagctctagctcccttatctgatgatgcaaagaaaacactggaagatatctcgcgtcggctagaggcctcttctctggatagcttagtggtcgactatggatcgattaggacacgattgcacgaagttcaagctctaattcctgaagaactggccgatgtcctaactctagccacttatcttgagcaacatcaatttaaactagaaaaagccaagctaagattagccgaacgccgtgagcgcaaggagattgaagccacaatccaagtcaatcggcagcttgtgcatgaagaaaaagtcaaactcgatcaactatccgaaggtccgatcaaatccaatatcgatcggcttgaagcccgcaagatcaaatccaatattctcttggcacagcttgaagaatgcaatgctgaattggatatggagcacaaaaaactagccgatctcccaaaatttgtcgaatagcaaaaagcaaggctcaaatcggctatcaagaatgttgctgacctaaccaagttcctgaagatcatttctgggactgatgctcaagatgcccaagccattgaagaagtcgaacaaattaggcaaagaactatttcggctatccagcagtacttgtctcaataacttttgtgtaatcggctaagataccttaataacaatcctttgtgccgattaacataacttctaattttcactttcatttttgtatttatgtgcccaagccattgaagaagtcgaacaaattaggcaaagagctatttcggctatccagcagtacttgtctcaataacttttgtgtaataggacttagaaattcttgtaatcggctaagataccttaatgacaatcctttgtgccgattaacataacttctaattttcactttcatttttttttgtatatatgtgcctcccaattttataatgtcaacagcattgataaaattagaaaaacaactaagggcgatataacaatattggccgttatatatcggcaaaccataactgcttacaattggaaaaacgactaagggcgatataacaatatcgaccatctcaagactatgtaaaacacatcggctgtcatgcattagcaacactagccgattatgcgtcaacccaaacacttcggtaatacttcttcaagtatttgccattgagcgctcatccataaacctcaccatcaagcccttgcaacatatatgcccctttagacacaactttatagatttgaaacgttccttcccaatttggtgaccacttgccgaacttgttatcccgagttccaatcgacaaaatcaacttccatacaagttcaccttccgaaaaatccttaggcactattttcttgttatgatgcctagctactcgttccttatctttggtaaccttagcaagggctcgtaaacgccattgaaccaagtcctccctctcatcggccataaggttataatactcatcggctgtcaaaccgtcttgcaattctatccttctagagccgattctaacttcccatggcaaaacaacttcatgtccataaacaagcttataaggaggaacttgaattgatccatgacaagccatccgataagaccacaatgctttggccaaccgagtatgccattgccgaggataattagaaatcttccgcttaattaatttgatcaagctcttgttagatgcctcggcctgcccattagcttgtgcataatatggtgaagaattcaacaatttgatacccacgctatcggcaaaccgaacaaactcatcggacacgaagattgaaccttgatcagttgtaatagtttgaggaataccaaatcggtagattatatgttcttgaacaaattgaattgcatccacagaatcaactttcttcaaaggaatggcctccacccacttggtgaaataatcagtcgccaccatactgatggtggctttatcatactgatcatatcaattccccaacctctaaatggccatggtttaataataggattcatagccgacgccggcactcgttgaattgccccaaacttctgacaatcttgacaccccttataatatctgaagcaatcctccagcattgtcggccaaaaataccctgcacgccgaagtaaccacttcattttatgggccgattggtgagtgccacaaattccttcatgaacttcgccgattgaaactttagcctgatcggcactcaaacacttaagtaacactccatcaatcgtccgataataaagctcattatccaatagagtgtacttcaacgccttatattttaatttcctagaagccgattgatggattatgtaaatattgatgcacatcatacctccaatcatcggctgttattgctgcaatttcaaccttaacatctttgatcatcggcttataccccgatgccccttgggctaaataattagtttcaatattttgttctcgagatacatgccttaaagtaaccagccgaaattccttcatcagttcttgacacttctcattataaactattaacgtatcattcttgcattcatactcccctgccaattgactgattaccagcaaagaatctcccatgatttcaatagcatcggcttcaacttccttaagcaattgcaaccctttaagcactgcttcatactcagcttgattattagtcgcataaggtttaatagtataagcaaactcgaaacatgcccccctaggggaaattataactaggccgataccacaaccatgagtacacaccgatccatcaaagaataaagtccatggcaccatttcaaccgagccgattgaatcatcacgatgttccacaataaaatcggctatagcttgtcccttaatcgtcttcggagactcataccaaagatcaaactcagttaaggaaaatatccactttccaacccttcctttcaatattggagccgataacatgtacctaacaacgtcggccttgcatataatagcacattcattggacagtaaataatgccttaaccttgtgcatgaaaaatataaacataagcataacttctccacaggagaatatctagtctctgcatccaagagccgacgactgagataaaatacaactcgttcttttccatccaactcctgaatcaggactgagccgattgacttctcaccggccgacagatacaatctaaaaggtatccctttctgtggaggaatcaaaacaggaggggaacttaggtatcctttaatatcatccaaagccttttgctgctctgccccccaagtaaactgctgatcggccttcaatctcaacaatggtgtaaaaggttctaattttccggacaaattagaaataaaccttcgaacaaaattagtcttgccgatcatctcctgcaatttggtcttgttttccggaggcttaatctttttgatcgcattgatacttctctgagttatctcaattcccctctcatggacaagaaattccaagaactggccagccgatacaccaaaagcacactttgtcggattcatcttcaagccatatttcctggtcccctcgaaaacttttcttaaatcggctatgtggtcttttacttccttagatttaacaaccacatcatcaatatagacctcaaccagccagccgattagatcatgataaatataattcatggcccgttgatatgtagctccagcactcttcaagccgaaagtcataacaacccattcaaataagacgattgcaccaggacatctaaaagctgtcttatggatatcttcttcagccataaaaatttgattatacattgtgtttccatccataaaactcaaaattctgttccctgacgtagcatcaaccagctgaacggctactggcattggatattcatctttcggtttagctttattcagatctctaaaatcaatgcataccctcaccttgccgttcttcttgatgacaggaactatgctagaaacccactcagcatatcggcaaggacgaataaaaccagcatcatataaatgtttaatctcagctttgacaggttcaagcatatcggctttgcatctccttggaggctgctggtgcggcctaacccctaacttgataggtagccgatgttctacaattgatcggctgagtccaggcatctcgtaatactcccaagcgaagcaatctctaaactcttttaagagctctatcagcttggttctaaattctggagacaaattcttactaataaatgttggccttggccgatcgcttggacctatatatatttcttccaaatcatcggccgacataaaaccttgaccttgcttgtcatcgagatcatctaccgtatccttagtgtagatacttaaaccctccacgacgccctcaaaataatagcttgggttctccatcttcaactgcctgtatatcagaatcggacacttttagaaaatctccattccaaacttttccagataaacaatcaaggccatccatctcccaaagagctaaatcggcactggcaacattaactgacctgtcggctggtacgatctctattttgtcgccttgccactgagtcaagcattgatgcatagttgaaggaatacaacaattggcgtgaatccaatcccttccaagcaacaagctgtaagaacccttcctatcgatgacaaaaaacgtggtaggaatagtcttactgccgactgtcagctccacatttagaacacctttggtttccgatggattgccaccaaagtccttgagcaccatatttttcttgatgagatcctcggcatttctacccagcttcctgaacgtagcataaggcatcaaattcaccgcggtcccaccatcaaccatcattttagacatcggcttcccattgacataaccatttatatacaatggtttaagatgccgattctctgtcccctcaggcttctcgaacaccgcctgctctggtgatagaaccaacttagccgattcctcttccacctcgtcgacatcggcttgatcgatcccgaattcggctggcaaggtaaaaaccatgttaactggtgccgtcacaacactctttccttttgccaacctctttgcctcatcagttgcaacatcgtcggctacaggagcctgattcttaacacgccactcctgcctcggttttgctttcttcagccgatgattaatttcttgctcgacctcctggaagcgttccctactcctcaatctttgaacccttcttttctgattcttcgtaaaaataccaggaggacaccattgagtcttcttattttcgtcatcttccaaatcaccatgttggtttactgggcccaatctctgatggacatgcactcttgtctgttttggccaattgcctccatcgtataatcggcttgaaccccctgcaacatcactgcatccaggacaatcctcgatagatggtaacctcataccttcattccaacagaacctaaagaactcacagccccaatgaggatcaaagccaccattatcttcttcatgatgcctttcctgttgcttgtcgtatttcctttgatatttgtttataattctagccgaacttacttgataacccctcatgcgccccgtatcggttgttcggccagctgtgtgtaccatgttaacgggaaatgggttaccatcgaccctcatcggctttttggaatcatcaaacttaatcttgcctccctcaatggccacctgaatctgttgtctaaacaccttgcaatcgttagtagaatgggacccagaattatgccatttgcaatatctctttttgcctaattcctcagccgatggaatcgtatgaccagcagggagttgaatttgcttctctcggagtagcagatcaaaaatcttgtcaactttaataatatcaaaatcatacttctcttcctttccagaactctttacccattggcacggtatgacctttttactcctcacccattcggctgtagctatctcagagtcatcctcatcatcatctgacccatacatgtaagggcaaacatgattaaccttttagagcttttcctagcctccgcagacctatgctcgtgcaaggttaccttttatatcagatgtgacaagctatcaaagtcttcagatgagaatttctccgtaatcggagcaatcataccctgaaaggctagatcggctaactgagcgtcagttaaactcaagctgaagcacttgttcctcatctccctgaatctctgaatatactcgtgcacgggttcatcatgccgctgcttaatcgctgtcaagtcagataacttcatctcatgaaccccactgtagaaatagctgtggaattgcttctccaaatcggcccaactattgatcgacccatacagcaaagaagaaaaccaagtaaaagccgatccagacaaagataaccggaacaacctaaccctcagagcgtccacagccgatgcttcaccacactgagctaaaaatcggctaatgtgctcataagttgacataccatcttgtcccgaaaatttggagaagtctggaactttgaaccgattggggagaggaactctcttaaaccactcagggtaaggctgccgatataagcttccagtctcttttggtttaagcccaaactgttccctcattacatcagcaatcacatcggcccacggtcgttgctgagctgctccctatgactgttgttgcatgggctcgaactgactgtactgagacgcaaactgaggttgagccagtccccctagctgatattgggcttgcggggaaggatgctgatattgataattcaagttgcccctctggtaattatgaaggttcagctgcatattacgtgccaaatgctcgggaacaacttgaggcattattgtgccatccggctgtacatggtgaaccaagtgttctgggacgacttgatttaaaaattgttgtacaggctgtccaccaggcgtcacaaacccagccgatgcgcaggcttggtgctgaatcggctgaacgatttgctgtcttaacggcgtttgctgaatcggccgcggaggctgttgccttggtggcgtttgctggactggttgcacaacttgttgctggactggttgtacaacctgctgaatcgggagtgtctgttgaatcggctgctgctgtattggatcaacagcaggttgaggcggcagaaacatggcagcaacctgatcttgcgtcggccgattcacaacctgcccactatgctgtggctgctctctcattaacaactgagggttcaccagctggcctggtgccaatgctgacggagcaggtaagggagtcgatgccggcgccgtcggctgagctaatggtgcgacgggggaaactacctgaatagatggctgggcatcagtgatcaaaggccgataatttggaaagacacctccttgcaaataaactgggcctgcagcctgatgctcagctattgatccatcggctattgacttcatcatgtttgataaggtattgactaacaccccagactgattgatcaaagcatggtgcacagcatagtcgacctggtcttggaaattattgaaaaaatcttgtgccgcatcactattctgattaagatttcccccttgcaacccctgagcaccatcaccttgaactccatgcactccatcgccttgaactccatggaccccttgagagttgtcaccttgacttcctagagaaccgccggtagcacctttgtcactcagttgagccgagccatctggagcttgtttcccgtcttcacctttggaagaactggtcctaggatcattggcaactacctttactttatacttctgaactaatgttcccttgcgggtctgcatgaatgagtttaagaactgatcccgggctttctgcaacattgcttcaaaatccttcttctgctcaggtgtgaatttctctggatcgatgggcacgacgtttccttcattgacgtcagtcaaccccaacttctggatcttttctttaacaaggcttgggctagtcgaggatggcgacagcggtggcttctcggccatgaggaagaattgcttgctgacttctaatcggtcccaccaggagtgccaaaagcgtgttgaaagaaaacacggggcctgtgagatctgcttaactccagtgcaggtccaaagctcgccttcgactccaccttgatctaatctcctttttcgatgctaatattaccaaatttggtcgttaacactatgacaatacatgtcatgcatatatcatcgttactttcgtatttgaaaatatttttatatgatgttaagtcatagctgataatatgttagaaatgaaagttgttgataatatgtcatgaataaaaccaatgggtcaaggtatactcttagacaccgtgtagaaaaaactaatacttctatgttttacgcaatttagaacggaggaagtaaccagaaatccatggcgcagcgaagtggccgaccttcatgaatcgtcaaatttgaatgatgctaacctgttctaaaggagaattttgctgtgagcctgtgatacgagaattttgctccagttctaaaggagattgaactattttcttggaaattccacataaattaagtgaaatcaggcgaaaaatgtgcgtgatgtgttctttcttgtgggtttccaacaaggtaataaatagcgtatagcgggttgttagcggattagtgtctgtatagcggattgcgaatagcggacgctattacggacgctaagttccaatagcaaatataagaaaataaccataaatatatctatattaacatcaatttcacgtaaaaattagaatttataatacattttttattactcatatatttcataacataaaaaatataaaataacatatagatatataagataaataagataaataatgaaaagttctacaatccatatatgaaaaacaacatttaagcgttatagcggtccaacaaagtcaatagcggactgttatagctatcgtgaagcgctataatagactaatatagcgggcgctaagttacaacatgctatcttcagtccgctaccttgtagcagcagcggtagaggtccgctaccgctattgtggccgctactgcggccgctacgaacgttatttattagcttggtttctaacccatttccctcgttttccgcgtgcatatttttcaaacggttaaacggtatgcgttttgctaaaattttatataggaaagttgcttttaaaaaaatcatattaatccagttttatgcgttttgtgaaaagtttatatatgaaagttgctttaaaaatcatattaatcaagttttcaagtctttttatagctaatacttagagcaggtacaatagcaggctataatccagctataaatatattttaaaaagataaaggaagagagagaaaagcagcgggctacagatctatagccagttgtagcacgggctccaagacgtaatatgtgatattaatagtataacaaaaaactatgatatgaattggttattacattggttatagatgatttggagttaatagtaagctatactattaaacttgctcttaattaatcatgtgttaatctatggctcttttttttttccgccggaacggttccaagtcccaacccctcagaaggctggtactgggctactagtcatcttctgcctcttcctcatgcaaacacaacaaactgccgtaatcagactatcagaggaaagcgttccgcggcgccgccgtggcgtccggcgtccggcctgtcacctgtgagtcgaggccgcactttggcgcccgcggcagagcccgcgacatgccttgccgcaccgcgccgaggcgtccaaacacacgctccgcccagcccagagagcccactcccgccgccgcgcgtcccatccaaacctccctccgcctccgcgtcccgccggccgccgccaatggaggcgccgccaagcctcccctaccgccacctgccgcagcatctcgccggcctcctcaagacccggccgctccacgacctactctccgacgcgtccacctcccgcgccgcacgccacctgttcgacgctgtgccgcgcccgacccccgccctctgcggcacgctcatctccgctctctcaaggctctgctcgcaccaggagcttctcgacgccttctcatcgcttcaccgcaggggctccgacgtcccgcccggctgtgtgcccctcgttgtgaagtcgtgcgcgatcttggccgcgtcacgtcagggaaagcaggtgcactgtcacgccattgtccgtggtctccttggggatatctttgtgcagactgctctggtggatttctatgcaaagaacggggacatggattgtgctgtgaaggtgtttgacgagatgccggtgaaggacccgataccgatgaactgcttgatcactgggtattccaagtccggtgatgtggtgaaggcgaggaggctatttgatggcatggtaagaaggacatctgcatcctggaattcaatgatcgcctgttatgcgcatggtggggaataccaggaagctttgaggttgttccgtaggatgttgagtgagggtgcaaggccaaatgcgatcactattgcgacgatgttttccatttgtgccaagactggtgatcttgaaacaggaaagtgggcaaggtctttgatcgcagagcaggatttgcagaacatgatagtgcacactgccttgatggaaatgtatgtcaagtgtcgggctattgacgaggcacgccgtgagtttgatcggatgcagcagagagatgtcgtggcatggagcactatgatcgctggttatgcacagaatgggaggccacatgaatctctagagctgtttgagaggatgaaggcaaccagttgcaagccaaatgaggtgactcttgttggtgtactatctgcctgtgctcagctgggctctgatgaattaggaggacagattggtagccatgtcgagagccagaacctaccactcaccagctacctcggatccgcactaattgacatgtacacaaagtgtgggcacgttggcagagctcgcagtgtcttcaaccggatggaacacaaggttgtcataacctggaactccatgatgagaggcctagcactgaatggctttgcgcaagatgcaatcaccttgtacaaagagatgacagaggaggacgtccagccaaacgagattactttcgttgcgctgttaacggcgtgcacccatgctggattggtagaccaaggtatgtcctttttcaaagagatgaagacaattcaccatgtttcccctcaagtggagcactgcgcgtgcatagtggacctcctctgcaaatctggaaggctgcgggaagcgtacaagttcatctgcgacatggaggtcgaaccaaacgcggtgatctggagcacgctgctgagcgcctgcagggctcacgccgacgtcgagctggccaagctcgccgcgagcaagctcctggttcttgagccggacaactcctccatctatgtcctgctgtccaacatctacgcggatgccggcctctggggcgacgtgagggagatcagggacctgatgaggagcaagaacgtgcagaagctgtctgcttatagttggatagagctggacggtgaagtgcacaagttcctggtgcaggatacgtaccacccgaaatcagctgagattttcaacgtcgtcgacggcatggggttgcatctggacgacgttgattctgaccccgatttatttgttctagagcactattgaacatttgaacatgctaacaaacaattgcagcagggcatccttcgttcactgcagattgattgtactttgcataatttatatacatgcatgatccatcgattcgattattattagttagtactagaaagtatgtagaaagtataattggtaagtgttgaattgttgggccttcttgcctagcccaataagaacaatgactaccagtaggccttattgatgatgagcccagttctgagttatcccgagtcctgcctgataaagcaagcagtccaaagcaggagacggcagaacaccaggttgtcagatcccttcgcctctgaaccctgagtcgccgatcgaaacaatccgatggagtccgaagctgacaaggccgccgcgccggcgccggcagcggcggcgtcggtagcggagacgagcgacgacgcgattcaagaggagtcaccggcaccggctcccagcgggaagcctggatcggaggcggcggccaagccggaggtcgaggtgcagctgttccggcgtgggcgggggccggtggccgtgttccggtcgccgctgggcgggtacacgcaggaccagctggaggtgggggacatcctggagcagcacggcctcaagtccgtcttcgtcttccaccccgcctcccgcacccgcggcgtcgccatccgcttccacccccgcaacggccgctccctcctcacctacgtcgctggttccaccatcttcctcgacggcgagcccaaggtaagccttacggatcggttggctctctctggctcgctcaattttaggtagtcgaagtgatgtgatcatgtgagtacttgatggattggtctgtttggttggttggttaggattctttgctgaagcccgtcacgaaggtgatgattggtgtggcagctatgacagcagttgctgcagtattgctgaaggagggcaagatgcccgagtggcttaaggaatccaagctcggcaatctgaacttcccaccatgggtactggcttgcatggtcattgtgttcatgaggctccggaagagaaccaaggatgccatgaaaaagtttggctggtcttcatgaggtaccaaaagttttaccccttttccccagatttgtgatcgaacagtttccaatttggttttaatctcttgtgagtatagcatgatgcacaaacggttactaccaaaactcagtgctgttctatatgtgcagtagtataatgaatgaaacttgtaggtagttgtgacatggttattctagaatgttaagtgtgctttaaggtttcttgtactataacagcatagtttattaatcgtcgtatcatggcagtgttattttttctattctacaaagcatatatagacaaaaatacccactactcctgagttttgattattaaacagaataactatccgctcctagttacccctctccagtctccaaagcgtgtcgttttggacatatatctcatcaaacttttgaaactttgaatatcaatacatttttaatatttagatttgatacatggaaataatgtgcatatttgtctcttaagtactctatgatactataatatctatcaacatttgtaaatatattcaaaatttgcaatagaaattagtggtgaaagatgcattttgataccatgtcaatgttccaaacatgttttcgcaaccagacggagcattacaacacaaaacctccgtagagtactaattagtctattcaaaacattattcatgtatcatgagttcttggcgaaagggcatgtagtctagtagttacagtgacctgagtaacaccccaaggtcctgagttcaaattttaataggagcgaatttcagattgggttgtttgaggagctaagttcccaatttaaatggttgcatatatctggttggatgtagaggccgggtaaaaaatacccatctctaaaaaaagagtatcatgagttcttgtcattcataatttctgctgaaatatacttataggctgttcctagaggaaccaaagtaagtatgtcacgcatgtgcttccgcctcattcattgtattattaggatatgggaaactaactgcatctctgagttcttttactgaattttatctaagctgtatttcaatattccacaggttcgtaatgacaaatgtgtgtttttggctgctgcttcaaatttgttgccaatactggagatgtaccaagcgggtgacacgctaagtgaagaactattacacaaaaaacactagttttaccctttatttgcatactcgatgccggaaactcgatagatttttacttgtacttatgttcatgaataaaaaatagcaaaacaatccttatcatatctcttcctgctcgctaattggtttatccatttttctggaaggcttcccaggtactccctccgtcccataaaaaaccaacctagatgtgacacatcctagtactacaaatctggacattctagattcattatactagaatatgtcaaatccagtactagattcgttttttttttggacggagggagtattccttatatgctggtagattcatagttcatatcctgtagcaaacatggagtttcagtttacaaaacaatgatccttgatatatgctattgatgatttttgcatctgtgcattggcacacttcgatgtgcccatcttgcttcgcccttaataaagagctattggataccacaaactgtattttcttgtgcctaagctagatctcggcttaccattatctataggatttaaacactggatttactataaaatgtcatcctgaaaattgtgattgtttcaattatcatacagagaaatcatcaagtaatccccgcatgagaatgctttaggttttgtcacatagtcgaggggcacacttacattgtcatttgctactggcagaatgtcacaaagttctgtgcccatttgccagccatgtgagaatggcaaagttgcccatatctccttccgatctatctatccgctaatctctaccttcgaccatcaccgtgccttggctccagagtgatgctattctcgcgcatttatatgttagaatggatgcgctagaatagcatcaaaattgatcaccagtaatccttacaggagcatgctccatccttgaaatggtgaaacctattcctatctctcataacaatctccctgttgaagaccttggatatcatcttggtataatcatggcagtcctcacatactctcaggttcttcactatcctaatctccatgtcttccggcaacgcgactaggccaaatgcaatggccagcttctcactatgcaaggagattgcatcttctttgtcctcttcctcgatatcaaacaacacctcttttgtgttcgcaatgtacccttgcagcctcagcctctgattcatctctgcaagcatcatctcgatctccttgtgtcttgggtgtgtcttgcctccaacaaagaactcatgcaccttgccaccaacctcaatggcactacacccaggcacctttttcactcccttggccttcatcatgttccgaacattgctgacacccttccagttctgcgagtctgcatagatgttagagagcaggacatgggcggcatcattcttggactcgatcgccatgagcttatccattgcatatttccccagttcaacgtttttgtggatccgtgacgcattgagtagtgctccccacacgccttcgtgtggctccaatggcatgccattgatgaagttcacggcatcatccagacgcccagctcgaccatacaaatcaaccatgcaaccgtagtgttcaagccaaggatcaattccatgattgctcttcatcgaatcgaagcatgctcgtccctcatctaccaacccagccatggagcatccacggaggaccacgacaaaggtgacaccgttaggctcaacccctgtgctctccatgcgcttgaacagcgcaaggcagtctctccccatgccattcatcgcaaggccactcactgcactggtccaagtgtaaacgttcctttcgcccatgctgtcaaacacctccatggctgccgccaccgcgccacacttggaatacatatcaatcaacgcggtgccgagcgtgaccgacagccgcatcccacggctatgtgcacacgagtgcacccacttgcctcgttccagcgcgcccaattgcgcacaggcagtgagcgctgacaccagcgtcacctcccccacggcagcgccagcatgacgcatttcgtcgaacagcctcaaggcctcccttgaccggcccgtgtgcacatacccggcgatcatggcgttccacgcgacatggtccctctgaggcattccgtcaaacagctcgcgcgcagcgtccgcttcgccgccagtggcgagagcccccaccatcgcggtgacgcacaccacgtccgggctcgcgatctccgcgaacgcggcccgcgcggcacccacatccccggccgcggcgtacatggagacggccccgctctgcacgtgcgggtcgcccgcgtgtccgtggcggagcgccgacgcgtgcacgctccccgcgatcagggccgcgtccagcgcggacgccgcggcggcggccagggcggtcgcggcgcggacgaggaaggtgaaggagtagttgtcgggcgcgagcggcaggtcgcggaacgcgccgaaggcgaggtgcgggcgccggccgcgagcgagggcgcggaggagggagttgtgcgcgaggagcgtggcggggcgccgcggcaggaggaggcgcgcgtaggagaggtcgccatcgtcgtcgtcgtcggaggaggaggaggcgagggaggcgaggaaagcggccaggtgggacggggacgcgatgcggcccgagacgaggaggtgcgcgtggatctcgcggaggtgccgctgcgaggaggccgccgctgccagcttcgccgggtcgcggagcggtcgcatttggtttgacacgctacggcctacggcttgtgagctactctgacgaaaggacttcccgtttcgagcattcgccgcgcgcgggctgacgaggccgaacgcgactacgaaccctggcccgcgtgggagtggcccgttccatggaaattgctatacgtacgagatacaactcaattattggaactgagtttgatcgacggcagccatgcgttgaacatctgctcctttcattgatcagtggttgcatttgcatatgattgcgcccgtccataccactacactcgcagggctaaccgacgaaggaagagtgaaaaccagtggattatcggggaaggctcggcagagcctgcaagcaagacagtaacattttcacgttgccacggcgaatagcggcacctcgctttaggcctggtttagttctcgaaactttggatacatgtatggagcattagatatagattaaaaataaactaattgtgcagttaggggggaaatcgcgagacgagtcttttgatcctaattagtccatgattagccataagtgctacagtaacccacatgtgctaatgagggattaattaggctcaaaagattcgtctcgcagtttccacgcgagttatgaaattagtttttttattcgtgtccgaaaaccccttccgacatccagtcaaacatccgatgtgacaccaaaaattttcttttcgcgaactaaacgtgcccttactctgaagattgatgtgcctttcagcaagcctcctggaagggaccaagttcactgaatcacggtcacagacatgcaaagtagaggggagtaaaaaagccaaggagatactctgtgaagccttgcaaaatcagatcagaatggtaacctgcaaacttgcaagggctgctgcctactccagctctttggcgtgtgtaaaacaaacctgacaaaagtcctggacagatgttttgctgtcggattaatcttacttcctccgttcaagaatccttctgaagagacccccttttacaagcatcttggcctagagtttgatccatgcaaagaagtgataggttttacaagcatcttagctgcaggatagagtttgatccatgcaaagaagtgataggatgggcggtggtaaagttaaaaagatgcaaaactggggaacctgctagcttgcaaggattgacggccacaaattcttcagagaacagctgatgaagagcataaagagaagtcgtaaatgcaaaccctgagcaaagatgatgcaatgttgctatttatggggaaaacgcaaagcaagtttcaccgaagcactcattccagtcttttgccatatttggagaaacatggaaaatctggtgaactgtaaatgtacatctcttcgttgcttgattgcttcctccacaattaacttctttattcttgccttcgacctatcagctttgtaggactggtacattgcaggaacctggagcaaagttttttttttcccgagaaaatgacagcaaacctgaaaggacaataaacagcacaattatcttttgaacagcatactttcaaaggaatgagcccgtcactgcactccaaatggcaatttgatcaatttacgaggatgtgaaaacaattgatatattcatacataggatcagtacaagtaaggtattgtagtcgaaatatcagaattttttaacagcatgtaaacagagaggtgaggccgccatacggtctagaaaccaatgcacaacaactcaaatataaacttgtgtaaaagtacaaatcaagtgagtgctgttcacggtcaagtgagaccgtgaggaccacaatgccactactaaaatttaacgctgatgatcagtgaaacaccaaaccgacaagctatgccaaagcttctgtgttatttgctggaattgtcacccaatttctttttctcaagtcttgttctgctgactagaaacaaaaagaaaaagaaaaagaaatgctattctgactttaaactgttggagcacatgctttggtcattctactgcttagcatgctgcataatgtttccctactgataaatcatggggaaacaaactggctgcagaatgtagaagagacatagtccattaaacacggcctgatttcgcacatcatcaagacatctttgccgtgatacgtcagtccagacaggcaatgcaacatgtaactctgtcaaagtcacgaaaacagtttctttgccctaaaaaaatcttaaagagtataaaacatcgagagtctcttttatgcaagctctacctgaaggccactacaaagattgaaaggttcataaaaaatacatcagattttctctgttatggcattaatgttaataaatatagaggtctaaaggcccactgagtcaacaacataaagagaagaatatcaaaacttcacacactttttgcactgggttttcaccattattctgaactgggtttcactgttattatgtctaataacataagaaaacaccaggagactttttgcagattgaaaacaatgaatcaggatttagtccaagcagtgttttacttctttagaattccacataaatatggtcaaatcattatcattattcactcaaacagatgtccttactgcacacataggaacgataacggaactggcatttatccagcatgggcaatttggacaatttttccaaagactctgctaatgctaaaacctgcatggaaaagtttgcacaaaacctggcttctgtctgtggtctatataagacagctacagtatgcccaaaactttctacatcccagttgggcaggagagttggagtgttcttcaggttcatccattatggtgtcctggaaggacatctacctcgttcttgaagcgacagttccactatatgtagctatgatactggcctacctatccataaaatggtggaagctgttcaccccagagcagtgctctgggatcaacaagtttgtggcgaagttttctattcctctgctctcttttcaggtcatttccacaaccgatccttatgacatgaatatcaagctcatatactcggatatcctacaaaagtcgcttgccttgctgggatttgcagccatttccaaagcatgctgtgcagagaagtttgactggctgattactggtttttctttatcaacacttcccaatacactgattgttggcatcccgttgctgaaaggaatgtatggtgagcaagccggcaaactactaagtcagatagtagtcctccagagcctaatttggtacactcttcttctatttttgtttgaacttcgggctgctaatggaatggccaccactacatcatctgaaactacaggtacgtacctaaactgactgactcgatttaggatgaaatttgaagttgcttcctcgaaacagcatggcttaaacacatttacatctttatttaagattagaaatccaagatcctggctccaattcgaaataacattgttcaagtaatgaactagtatttgagcatcgtttcctagtaccaactatatttcttctgattttcattattttttttgtgtgtgcgcccatgctaaccttcacaaatagttgcaaaaatgaaaaactcctgcaaatgttatagatcttactttccaaacgaaagaagcctgctagatactcaaataaatgtcgtttaagtgaccaatgtaagaaaatatgcattctatgatggtagctcaaactgatcttatagatgtcgtataatgcaatcatattattgtgaactgagaatacactaagcaaagagaacatagctaattctccgtttaatagaagaaccaatgaagtgaaatactgttctacttgcatcacttctattttaatctgcagtagcaactatagtgtcatactaacaggaactggcctactctgcacaaatatacaactaagtaactatattgtctagaaaccacctgtagtatttaaagttcagaatgaaacagagatttgaatcgctacagcccaatttaaagttgcctgtacaatcatttaaattacttcatttttttagataatccagcctctatatccaaaagtggatatacacagccaaggagaaattgcttcatactttttcattgtaatgcagttcactttacgcaatagatttgtctgaaacattgtacatgaacttgcttgaattatccagtgattgaagtatattttgaacttctttttcatatacgcctcaccagcaagcagcttaacttatcttctgggaatttaacttattattctttattaaattagttcgatggtttttatcccatgtcatgtttcaaaattgaagcagaatcaggtactagaggacctacacagcaaagatatggagatgttcaggcaaaaggtgtatcagcaagatgttcttgtgcttttcgctttttgttggtggttggtaagaagctagtgatgaaccccaacatgtatgcatgcctgataggtttaatttgggcactggtcggcttcaggtatgttaatgagtttatatgaatcaatttggcttcaagcagaaatgcagctgttattgacttacttcatacaactccataacatacccacaggtggcacataagattaccgttgattgtcagcaattctataaggatgctctcggatggagggctgggaatggcaatgttcagcctaggtaagaatagcaggatatctgattcagcttgatgcaatgcagataaacttctaaatacgtctaaactttgcgaaaaccaattatgttattataaattctaaatacttctaatcacaggccttttcactgctctacaaactaaaattatagcctgtggagctaaaaggatgctactagcattagccatcaggttctttctaggaccagcactaatgggtatgtcttcttatgctattggaatgcgtggagtattgctgaagatagccattgtacaggtatattctagttctttctttggacgagctattatttgtaactttgaacaattcaaccacagaaattacgattaacctgtcaaaatcacattcaggcagctctacctcaaggaatagttccgtttgtgtttgcaaaggagtacaatgtccaagcagatattctgagcactgcgtaagtagatcacctaccacgatacgatcctatgcttgtatatatgaagaagcagggaagcatcattaaccaacaccttacactgatctctcttatggcaggataattgttggcatgatggttgcagttcctgtggcgctggcttactactttgcaatgatcatcccagctatcaaataactatttgcagaagctagcctgattgtgttcatttgagaaaacaatgacggctcgctgtggagaataagttcagttatgagtgaatattttgctagactgtatatatatgtgcccttgggtttgtggtgaaccataataaggatatctgatttgtatcttagtgcatagtggccatacataattcttaccgtttcaactatgaacaactctaatgaacagaacatgtagagaaagctcacattccccggcgacgcggcgtgctctgttcctgtcaggcgctccgtccaacagacggtgcaccgtgcaccccgcccatgagctgctggcacccctgtggggcattctgccgaacatcttgcaggcgtacccagggctgaatagcagattatctggctcagcttgatgcaatgcaacagcagccaagagcttcatgtgcatcaaccatttcttggcctcattttttcctctccggagaacaattacatggcaatatggcattcacacaccgttcccttccaactgtggtgtggaagaacaaacagttcgcttcaccggcagcgtggaacttgcaactgttcgacattttgtagttgggaataagttcactttattaccctcaaaactgatcgaaatcgaccctaaaccacaaaaccggatatctcgacccccaaacttttaaaatcggtgtaatttgactctctaggcggttttggagggcggtttcgctgacgtggcgcctacgtggcagtattgactcggtattctttccacgtggcattgacgtggcgcttagttggcattagaaataaaaaaattatgcatgggacccattagtcattcacacacaaaaaattgtggggctcactgacatgtggaccccacatgtcatcctctctctgcctttcttcttcctcccctcttcctcccttctctctttctttctctctcttctctccccttcggctggccgcagggagcacgggcgactgaagctggagtggcggcggtcgggggccagagcggcggcgaccgcgggagctgaagcggcggcggcggcctcgccatcggcctcaccaagtggagagaggagaggagaggagaccaggtgagggaagaacggaggtggtgggtatgacgtccggggcggcggccgcggcggcggggaggaagccgacgtggaaggagagggagaacaacaagaggcgggagcggcggcggcgggccatcgccgccaagatcttcatggggctccgagcactcgggaactgtcgtcgttgtcgatctggtctcgaactggtactcggcgtggtcggagaggtcggcggtgacgactacgaggaggagatggagggggcgggcagcagccggacggtccagcccaccgccgacgcgtacagcaacctgacaaacgcgtcgttattcccctcttcaaccttcctcgattgtatacatggcagcagcgcagcacgtcgtcgtccggccatggacgtcacgggagctggtcaggccatggaggagcagtgagcggaggggtcgatggcggcgttgggacggggcgatgcgctcggagccgagggcgccgtggggagcaacgcggcggagggggcccggcgacgctggccgtggacctcggcgcagagggcggccgtggacctcgacgcaaagggcgccagggcggaggagatccagcggagaccgaataagggaaggagatcaaatcagagcaaagggggagagagaagggagagaaagggagaagatgacacgtgggaccaacatgccagtggggcccacaatttttttattttgtgtgtgaatgacatatgggtcccacgcatattttttatttctaatgccacgtcaacgccatgtggaaagaagactgagtcaatactatcacgtagacgccacgtcagcgaaaccgccctccgaaactaactagggagtcaaattacactggttttaagagtttggtggtcgaaatattcgattttgtggtttagggtaatggattagatttcaatcgcttttgatttgagggtcatgaagtgaacttattccttgtagttgcgcaagataaaagcccaatgggttaaaccaagcccagtgtcacccacggctcaccagtattgtggcccactggtttgtggtcttcggattagcacaaaagtgggcccagtttagtctagaacttttcttttttcttttttttttcttttgcgaaagtttggtactacaatctttgagttctggacacgtataggtaataattaactgtaagtaaagttttgtactgtaacttaatactagtaattcgtggggaatctgtattactgtagacaaaagggggagaggggatgtgataatgacacggattaactcagtataatgccattttaccaagccaccaactcactccccaagaaagcacaaagccacatcaacctcaccttcttgcccccgaagaaaaagaaggccacggaagccacgggagagtgatctgggccgtccatctcacaacaagccacggcggggagagatctgtgccgtccatctcacaaccagctcctcccccacggccccacccccgccgctataaatagacgcttcctcttcctccccccctcttccccaccactccaaagttccaaaccccacaccaccaccgcgcgcccgcatttctccccgctcctcgcgccgccgccgccgccgcgtagtcatcgagtcgagcagaagcgttcctcctgccatggaggcggagacggagtgcaaggtccccggcgtctactccgagaccggcattcccgtggaggatccggctcccggcctcaactccgacgtcagcaagaaggacgcccctcctgccgttgcggcgccgggtcccggcctctacttcgagatcggcaagaaggccagaggtgtacacgcgctcttcatcttgtttggttctcttttttctgggtggtttttgaggggggggggattggtggtggcggttgctggcttgagcaaattttagtggagtggtttgctgatttctgctgcttttcctggtgtttttgcagatcttctgtacaaggacttccacacggaccagaagtttaccctgaccacctacaccaacaatggagttgtgagcattaccgatttccgcatgctttttactggttcctttcttgtggacatcttggctcgcttgctttcgattgtttgtgtgtatgtggtggtttggaatggtttgagtaggaggatctcggtggctgtgtgatgtgcgtgtcggagttgtgttggttagcggggctcggtgtggtccgagcttgtgtgtgtggcgggttgcggccagtgtgtttgtggaattgacctgcgggtttactgagttttggtctgatttgattttgagttgagttgggttgaagagttgatggatagtgcattttactttttctccttcctggtgttggatgagatggtgaatcggtgatcgaagcgtcgattgggtttttctgttcgattgacaggtggtcaatctgtcaggttgatgtttgttacgatgtttccactgggttttttgttcgttggatggttggtaaatctgtcaggtttcggtttggtgatcgaagaattgactgggtttatttgttcggtccatgggtggtcaatctgtcagtgtcaggtttcggtttgtgatggaagagtcgattgagttttttctgttcgatcaacaggtgatcaatctgtcgggtttcagtttgtgatcgaagattcactgggttttttgttggatgaatgggtggtcaatccgtcatgtttcggtttgtgatggaagggtcgattggggtttttgtgttcgatcgacaggtggctaatcagtcaggtttcggtttgtgatcgaagagtgctttggattttttatgtatttctgttagatcgatgggtggtcaatctgtcagcgtcaggtttcactttgttatagtaagatgcttccattccgttgccagtttagtgggtttctttttgttagaatttactactaatttcgtagttcttaaattgtgcaacgagttgacttgttgataattttgggtttcagtcgagaggttcccagtgataattttttatggtttagcttatacgagtactgctttgtttgatctttccttcagtagatgctgcatgtcaacgtcaacttgtgtgtgtttgtacggatcagaggatctcaatccgtgtttgtactgatgctttgtatcatgggtgtcaattgcagattgcgttggatatcttgttgtctactaatataataatcaaatatgactcttattatttgatttctgtgattctgtctataggtaatcactgctgcaagcacaatgaaagatgaagctatctttagcgagatccagaccaagctgaagagcaataatgtgatgctggatgtgaaagctacttccgattctcaggcaagtttctccttgaaaatgcccttcatctatcaaatgttatctgattattacttcctgattaaactcgctggtgatggactataaattg

SEQ ID NO: 78923 - DNA, 5689 bp, Oryza sativa
cagagcagtggacctcgcaatcacagacggggcagtaggagatgtcgtggccggcggcggcgtgcggcgagacgatgtcgtcgaggctggtgaaggcgaaggggagcatggggtcgagctggacgctggagttccactgctcgaggtagctccgccgcacccaccggttcatcacgcggacctccacccgccggagcagccgcacgacgtaccgccacaggatgtacccgtacctcagcctcggcaacctcccccctcctccgccgccgcggcggcctgcgcgggccctcgccagctgccgccgcctcttcatcttcttcgcgtgcgtccggtccgacgggtccaccgccgtgcaccgcacgtagagcgccgccgcgcccgccgcctggtgtttgatcccgtcaccgtcagcaaccaacaacgcgacgcgaggagaagccagccaagaaggttaccgtaccgaggaggagaagagggcgaggagggtgttccccgcgacggtgctgccgaggtacggcccgaggacgacgtagaacgcggcgacgaggacggcgaacaccgccatgcccaccagctgcatcgcatatccaaccacacaccgtcacctcaaagaatccaatccggggggaagaaaggtgggagagaagcggcggggggacctggagagggtggagggggagctgccagccgtggcggcggcgccagcgcggccacgccatcgtcgccgccgccgccgccgtggattcgccgctgcccatcggtggcggtagaaagatctgcggctcgatgcggacgcgtcgttcaactctgctgctgtgtgactcgaacgcgagagtgaagcgaagcggcggtggggttgtctgacaggtggggtaggggaggcagccaacggtcggctcgagccaacggcttttccatccaccgctttgtcgttccccggctgtttgaatttcgaatcggcggttgggcgctcgaggccgagtcctcgagcgcatctgctccgtcggatggcataccgtcggccagatcggaaacaagagtggggcatccactccctagcccccaaggcctattgacctaatgccatcttcggtgtattttcttagtcccataaaaaaacaaatcaaatcaacggcgtcgagttaaattgctactccctccatctatgtttgatagtcatatttcatcttggcacacagaccaatgataagtaattctacttatcatctatttaaacatgctactagtcatttctcgtaaacaagcgattcattaatatttacatttttcaatgcccatgtagccaatcatgtgtggaagaatgaagagtcatgcattaaatccgagaaagtcattaagatgataggttgttggattgaaatatgcctatcaaaaataattttttcagatttggaaatatgactatcaaaagcagatggagggactactgtttaatgaaaaattatagtactaccatattttcgagtggaatcatctgaattggaaattattttattgtctttttctttcttgaaattattctattaatgatgtctgtctattagactctgctccatctgaataagaaatgaaatttttactccctccatcacaaaatataaagaatttaggttggataggacatattatagtactacgaatctagactaagagtttatccagattcgtagtactaggagtaggagtatgtcttagtagtatattttaggatgaagatagtagttcttttttccttgtcattgtgtcccatgatcaatttatacattgtttgtctcgacttgtggtgaatacttcgattgcacattagagttggactatggctaagggtatccatacttcaggccccgttcacaacacacgtaaaaaaaacatttcaaaattaataaactgttgcagtaatactcgagtgaatatttcatgccattttctcggtgtgcacgattcacaggtattatctttgtatcccttatagcaatgtagcaattgcgtgtcgtagaaatatcagaaaattcaataatgttcgcaatcaagtgtgaacatgaacatgataattagctctcatttgaactttccacgtacccgatcaacttgataattgtaattagtaaaacagagtatatttaagctggcttgtgtgctgtacaaataccataaattcaaacaagcatggtgttattgaattctcacatatagagagaattcgactaagcaaagcaagctgccaaaccataaaccaacataaatatttataaaatttaggtatactccgttacagatagcgtttcaggaattcatcaatgcgggtgtactgaacctctgggtacagtatagttgcttcggctccattgtcaccaatgtcaaagtttgttaagcaaccctcgtagaaaatgtggtagaaatgtgttattcccacttgaaaagcaaattgcatatctgcttgcattaaaaaaattgcatatcaatgatagttaggtcaataattgtttgaaattgaaccccatgagtaatggtatttaaaaaaaagaaaatagctaaaagtgcacattatcaatttggtaatcaatggaaaacaacatcattggtggggtgctgaagctgtaattgtacggctccaaccatcaagagcacttaaatcaagtacgtcttggtgttcatgattagatgtgtgtgtatatatatatatatatatatatatatatatatatatatcggtaagcagtttatttttacctttcattggagccaaaaattcttcagcaggtatgtggaatttcgtaagactttttccagagagtttttcccacattgcgatcagctcgttatgagtgaggcaattatcttgtggtcttatgtatattgtcttgttcaaggtgcgaggatcatcgattgatttgattgtatatgttcccacatcatcttcatccacaaaaaacgctgcatataacattgcagcttaattggttagtatagttgaaaatcaaaactgattgtaatattactgaagaatggttttcaatgccctaaattatttcctatagtttcatcaaataatgagtagtgaaaaggaaggtgtacaaattgatgtattattatttttcacagaaaatcatgcaaaaatatcttaataagacatgatattttcactagctagctacacataaaaaacataactatttacaatagagtaaattgcgctagtggtaaacgaacttggcatgtgtatacaatttattacaagaacttaaaaaatgatcgtctgggtgcaacaacttatctacttcgtacgttttctagaaaaaaaatactaccaaagattttgtttgttgatatacacgaatgattcatccaagcgaggatagggtgtttggtaaacatactagtatggctgtatccacatgccattacccaagttgctatactaccagcatgtcggtttttgaatgattcattttttaggtgtttggttttggtatagatgaaattggatgaactctgaaagaaaatattcccctaaaattcagattagcttggtatctcaaaaattggtggaccaattaaacctattttcctctttctctgaacccttaaaaaatagaaccatgtcttttctcatgccgaatggacggttgtgaccatctcatcctaaatttggatgagtccaacccatctcatcccgtcatcaaaccaaacaaatgttaactactctcttcatttcattcatttcatattataagtcgttttgacttttctaatgttaaactccttgaaagtttgactaagttatagaaaaaatatagcaacatatatttatctatacaaatcgattttattgaatctaaattaaattattttgataatgttggaggcatgtcatgagaaccttcggctagactgtcgaaacaactatcaaatcgcgtagccgacaccgaaggacgtaggtcgcaggaaacgccgaaggcgagcgaggggagtacctacgcgaggacggcggcaagcaccttcgccaagcatgtagcaagagggcttcgaaaagacgaagaaggttgagcccctctgtggggccttcgcccagcaagctccgacaaatagcccagtaagggcctctttagagcccatgagccagtaagatgggccataagacaattattaccccctattttaatgctaactaagtcgatttcgagtaaacaatacccctagggttgtaatgggatctaatttttgagaaattaatactccctccattccaaaatataaggcacaaccactcttaatccaaagaccaagaaaataattattatcatcttgtagtttggatcatcctaataaatataatgcatgcatccaataggattagatagtggaggatttaaaaacgtaataatttaatggagaagatgtcatagttaattgcatgcttgcatgtatgccttatattatggaacatataagaaaagtggttgtgccttatattatggaatgaagggagtacgattttactactttactttcaacctgccgagtgaagcatgcctttcggcagaaacatttgtcaatcgataacatatactttctttctttcttttttgaaaatattgctatattttttttataaatttagtccaatctaaccaagtttaaattaaaaaaaatgtcaaagcgacttataaaataaaaaacagaggtagtacattacacctgtacaccaagttcttggaacatgagcgtaatttactctttatagcaagaaaagttaccaaggggaaaaaagatgaatggattaaatggtggagaaacaaaagacgctcatcaggaatcttgtcatgctctaataaattggtacattaaaatatggataaattatatttttaaaatgaaaagtcgatagatgaacagacacgtgcaactgaacatgcctgaggaaaaaaaaggaaatgccaatcatgaaaaattgaaggtaggggatttgcagttttgtaccacagaatctgtatcgaatgggaccactgaccatgattaaaaaaaagctggacgcatgcttggatccaaagataaatctcaattttataaatagagagaaaaataactacaaatctatcttttcaggagaaaaagacaagccatctcctaaaaattaaagcaatgaagcaacaacttagctaactactccctccgtccaaaagaaccaacctcatactcgaagataacacatcatagttcaataaatctagacatactagtataataaatatacttcctctgtcccaaaatataaacatttttagtatagtgacaagtcaaacatttttaactttgaccattaataaaataaataaataaataaataactatcataatatgcaactctttttatttaaaacatcttacttttatatcttacttttatatatattgttgatcaaagtaatatcttggagaccgtaacatagtccaaacatgcttatattttgggatggaaggaatagtatgtctagattcgttgaattaggatatgtcacatcttagtagtaatttttggaacaaggagtaattaacttttttacctttgacgttaccatccccatacacattaactctctctttgggagggaggaaggaggtcagctggctgagattaggacagaagtaagcagcaaagcagttggaa

SEQ ID NO: 78924 - DNA, 15927 bp, Oryza sativa
aaaaaaatcgaacggattagtgttgtttagtaggacgtatgtatctattgaaatcttattgtgctgctcattggaaatggaattgaataacttgtttttatgtctgtcgttttattactatacagaagataaaaccttttactcctgtcgttcacatttattgatttatatcataaagatcagtaaaaattgccataattttactcaagttattatatatatatatatatatatatatatatatatatatatatatatagtaaatttgtttggtgctccatggtgcccgggcaccattgttgaaattgagtatatacccaattcaaatgagtatgaatctttttcaattacttaggtattaacattaaccactttactaactagttcaaagcaagtttgaactgaatttgaacttgtttttgttagattttgattctaggtatatagcatccatacatatatttagctaggtatgtaatcatggattgtgaaataaagttaaatttgagttgttttgttgataggtataggtatgaatcgaattattataactaggtatatactcataatttgaaaattttgaaaaatttgagtgattttttgcatttgataccatggtgcccgggcaccatggtgccccatatgagtgtcctatatatatatatatatatatatatatatatatatatatgtatgtatatatatacataagttataatatatatatatatatataccaaattttttatttttcaagataatggacagaaataagatatacacagccaaatcaagttcttttaattatgtactaatttgtggagctgattgaaaaataaattaccttgacatttccagcttctttgatggcctcgacaagcttgagctggagcatgaggttgtggctgcggaggtggacgccggacatggcggagacgacgacgtccacctgccggaccgcggcgacgaggccatcgtggtcgtcgagcgacgcctcgaggagccgcgcgccttgcgccttgaaggccagcagtatctggagcttgtcgatgtcgaggccgatctccggccggagcaggacgaaggtggggtggccctccgccaagctcgccgccacgatccgccggccgatgtagccggtgccgccgacgatgaggacccggctcttctccatggccatgtatggctctgctcgatctgatgagtcacacaacggacgacgctatcgtgcacttcacaaagcttactgcgatttgtggcctatatgaacgagcgcgtcgtcctgttctactgttgtcgtaccaagggtctcaatcgtactccaataaataatcactgttgactgggtaagggctacttctcggtaaaaagaaacaaaatataagtagtactgaacatgacattgatatatctcagtagaacaaatctgcacagacgatatgtcacatccaggacgatatgtcacatccagtttctagcatcgttgtttgagatggagggagtaggtaaagaacaatgtttgatacatcatcttttcgcttatgtttatacttatcagccaaaatttgaattttgaacctaaaatttggagttgattttggtgttttttaatatttttcagtctttgcttttagatcgctaagaacacgtatataaaagttttattcacaaattattttttatttgtgaatatgctggggccgttggatttgcatggccgatgaggctcttttaacttatataagataaaagtgtgtctatgtgagagtatcactaagtacatcctaaaattttatccccaaacttttagttttacgaatcctaaacaaaatttgaagtgttaaaattttcattcctccaaaagattagctaaaataggcttcctaaatattaaaaggtgggcccctaggaaacttccaaccccaccctcccgcgagatcatgttcgcccgctcgaccctgccctcaccgctcggtcatctctagatctgtaatcacttgctttctcactgattggcagagccaatggctggcctgaaaactctgtttcttttgccacaacaatttgttacataactttctttattatctactgaattttcccctaattgccctaaatactaacatcagagaacaaactaaattgttgctttgcagtaatagaatttgaattacctcatcttttaatagttcctcctaaacacaatcgctaagaaactcgaagagacaagcttttcattctcaatttaatataacagaaagaggaccaagaaccgtaatagctatatctagctagatgcacccaacaaaatttgccacacaaacaaatctgaaaactacaatcatcattagtcactggatggtgaagatgtcctttgctttttctttacacatttacagagcttggatgaatcatgttctgtaaaagatgttgatcaaaggcctttggtcgcccatatcaatgggatcacacgcattgctaaaactatcttcaacacaaagagcttctatcgaataagtgttgtaactacaaaagtaaatgcaaaatttgctacaggacactcaaagattgtggcatttgctgtgagacacccaaaaattgtgtatttgcttgtggacactgtaaaaatatggtaattagctgctggacactcgaggcattattttattattttcggtgaaaacagagagagaaagagtgttgaaagtaccaaaatgcccctgacactgttcttctttcttctctctttcctgcccctgacacgggtcgcgttcttcgctgcaggtggcggcgccatgcgggaggtgctgctcacgcggtgggaggggcgggacgaccaggtgctgctgtacggtctcctcccggcaggggtggaccacggcgagctcatgggcagagcgcggttctgcctgtgcccgaccggtgacaaccagggcgcggccgcggcgagccgccgcgtcgtggaggccatcacggtgggttgctgcgctgtggacagcgccgtctccttcctgcgccgccgtcaccggtgagctccaaggccaaagccttcttcccctcgcgccactgcctctctctctcttccccaattccggccaatgccgtccgttgccgcagcgccacctccacgccatcacagagccccgtgccgtgccaccgggttcgcctccatctcctcttgccgacgccgacgctcgtcgcagcagccatgcgctgtcaccgacgaacgccgccgcgccgccgccatggcagagcacggccagggagccatggctgctctgccttggagccatggccggacctggtcggcttatacaaatggcccacgggcaaaattgtcttttatgaaagtttctctcaccgtttcagccggaaataataaaataatgggaggagtgtccaccagcaaattaccacattttttcggtgtccaagagcaaatacacgatcttcgggtgtctcacagcaaagaccacaatctttaagtgtcctgtagcaaattttgctaaaagtaaattacctcagctttgtctaagcttccaagcctcttcccagttgttagattagttatgactacagacacccgtgcggcgggaggggcggtggctgacggcccatgcggcgggagggcagtggccggtgacacccacgcggcggggcgacgcccgcgcagcgggagtgcggtggccggcgccactgcacggcgtgacgaaggctggacgacggcgcgtggccggagggcggcaggatggcgcgttcggtcggaggacggtgggacgatggctcgcgcggcaggagggcggcgggatgccggcgcgggactgcaggccggtggcgcgcagaggctgctcgcgtggagaggatgcgggagaaggaaaggggattgaaactttagttaggattggcatgggcattttggtattttctaaaaatactaacaatacaacacacggtttgagtaacatatctaacggaaacctatcgggaggggcatggaagggatcaaagcgaaatttcaggggtacacaggggattgggtaaaattcgagggtatagaaggcattaggtgagtttttatggtacacaagggattttctctacattatttgtctgacattgtacttaaatagtttgattatacattagagatggacaacggctaagggtaaccatacttcaggccccgttcacaacacacgaaaaaaaacatttcaacattacacaaactgtacagatatactcgagtgaatatttcatgccattttcacggtctgcacgattcacatatagtatctttgtaccccctatagcattgtcgaagttgcgtatcacagaaatatgagaaaattcaataatgttcgcaaaaaagtctgaacatgaacatgataattaactcatttgaactttccacgtacctgatcaacttgatagtaattagtaaaacagagtatattcgagctgggttgtgaacagtacaaataccatatattcaaacaagcatggtgttattgaattctcatatctagagagaatttgacttagtgaagcaagctgccaaaccgtaaaccaacatgaatatttataaaattttcatatactccgttacagatagcgttttataacttcattaatgcgggtgtactgaacatctgggtagagcagagttgcttcggctccattgtcaccaatgtcgaagtttgttaagcaaccttcgtagaaaatgtggtagaaatgtgttactcccacttgatgagcaaaatctgtatctgcttgcataaaaaattgcatatcaatgataagttaggttaatcattgtttgaaatttaaccccttgagtaatgatattaaaaaaggagcatagccaaaagtgtacattatcaatttggtaatcaaccgaaaacaatatgattggtgtggtgctgaagttgcaggtgtactactccaaccatcaagagtacttaaattaagtcttggtgttcatgattaaataaatatatatatcgataaacagtttatttttacctttcattgaagccaaaaattcatcaccctgtatatggaatttggtaagactttttccagagagtttttcccacatcgcgatcagctcgttctgagtgaggcaattatcttgtggtcttatgtatattgtcttgttcaaggtgcggggatcatcgattgatttgattgtatatgttcccacatcatcttcatccacaaaaaacactggatataacattgcagcttaattggttagtatagttgaaattctaaactgagtgtaatattactaaagaatggttttcaatagccctaacttagttcttatggtttcatcaaataatgagtagtgaaaaggatggtgagtaatgcattattatttttcacagaaaatcatgccaaaaaaatcttaaaaggacatgatattttcactagctagctacagatgaaaaacataattatttacaatagagtacattgcgcttgtgataaacgaacttggcatgtgaatgcaatttatcacgggaacttaaaaaatgatcatgttagtgcaacaacttatctactttgtacgttttgtaaaaaaaaaatactaccattgattttgtttgttgatatgcacacatgattaatctaagcaagggatagggtgttttgttaaaacatattagttttattgtatccacatgccactacccaagttgctatactaccagcacgtggtttttgaatgacttttttttaaggtgtttggttttgggataggtgaaattagattaagaaagaaaatgttcccctaaaatttggattggcttggtctctcaaaaactggtggaacaatgggacctatttttctctttgtcgacatatataccatcacttaaaaaaatagaaccatctcattttatctcgccgaacagatggttgcgaccatctcatcccaaatttggataagtccaacccatctccaaaccaaacaagtgttaactactccattcgttttcatattgtaagtcgttttgaattttttaatgctaaacttcttgaaattagtttcattgaatataaattaattatattttataatttccttttttaaattgaaaatattgccatagttttttataaatctggtcggagcttaaaaaaggttcacttagaaaaaagttaaagcgacttataatataaaatagaggtagtatatcacacccatacagcaagaaaaagttaataagtgaaaaaatgataaatggattaaataatggagaaacaaaagacgttcattaggaatcttgtcctgctctaataaatttgtacattaaaatatcaataaattaatatttttaaatgaaaagtcggtagatgaaatgaactttacgaagtggaaacaaaacgtgcaactaaaaatggctgaaaatgaaaaggaaataccaataatgaagaattgaaaacaggttatttgcagcacagaatctggatcgaatgggaccactgacaatgagaaaaaaaaaagatggacgtacgcttcgatccaaagataaatcaactttgtaaaaagagaagaaaaggtacaaatctaactttccatgagaaaaagacccaaccatctcctgaaaattaaagaaatgaagcaacagtttatagctaagtaattaacttttttacctttgacgttaccatccccgtacacaccaactctctttgggagggaggtgagttttcatctgacagaggttaggactgaatttagctgcaaagcaatttgcagaaacatatgtgtgagggatgtttgcattctcaattgctctccttgtctccatcttctcatcaaactagatgatggggcgcgccaatggcgcgcctcctgtatataacttgttgattattagtgccatgtcatattagtgattagataatacaaaaaagggcatgacagaactgaaggtaaactatgcatcctgatgccacaaactccattagaccattaccaaaaaccttagtaagccatatattggcagcactacaaagctggttccagagcagtagcttcaggcattgacaaggctgatgctgcctcggaatgtgtcacatctccaccatggactctcttctgcaggctctccaagctggtggcgcctcacatcgacggcgaccttgaggccattgccgcactgggcacaggaattgcttcatctgggaggctgcagtttgcctagtcgtcttcgatgagagcaacagaagctgcgtcagatacacccgaggaaaagggcgtgctgcttgcaggcatttctgtgaacaattgaagtcctattccagttactgtcctcacgccttaatctgctatattcacctgaacacaaaagtgctccatgacaacgtaaacaatatgaaatcatgagatttaacaacaaccacaacttacaataatataaatacttcttgaaaagaacaataatataaatcagtgtctgaattgtacctccaatagagatatatttcaataaacattattcagaaggcaagttatgttttggagacagaataagcttatatacaaagggatagaacaataggttcaggttgttcctttcaatatctccctgtgtactgttgttggaaacaggattgaaaattctagactaccaataggcctactttgcagcaacagtcatcattgtactgaatgctttgaaaaaaagaacaccttaccatgcagatcaaatagagttgtccatatactcacatacggtttgtatgaatgtgcggttgtgccctgtttggactcctcatctgaaggtttttgttcttctcaagagataaaagttcttccataggcagcaaaccatagacgccgagaacagtgttattcttaacaacaaaactaaaacaagaaaatacaaaaatacacgactaatctcttctgttccacatatagaagaaccagaaaaacaaaactatttaagcattttaattattgaaagaatactatttaagtggatagcttcaggactataatcaacaaattcatagcccttcaatgggaataaataagtgctggatgtagtcaaatgctcataacaacaataacaaaaaatacctttcttctcatagtgttcacgtcatctcaaagattgccattttctatcgtagactgcttatatttctgagtcatctcagccaggcacttttgcagagatgcattctcagatcttaactggaagacctggatgatagtgcagtaattagaattgccttcccagttacaccataagtaaacaaaatttaaatgatatttattgagtaatccatttcctcagttcccacagtaaatttccttgtgtcaaacatgtagaatcaagcaagcagcaagtgaaaaatgccgaaggcctgagcttattggacatggactcaaatcattcataaaactaattgaatcaagttacatgaagataaggtggaggggtatgacgattgctatcaaaatctgaaccagagaatccagcattaggttactttcaacctaggctgatgcacaactggttcatcagtcattgcaccagcgtcctatatcctccacccgaagagttgcaagcaacaaactaatatatagaggagcagtcagtagaaagttacatctaaagaacatgaaaagatacatgctcatgcaagtcataagttacgtctaaagaacatgaaaagatacatgctcatgcaagtcatactgcctcgacgttagctcattcaacatcatacttcacaacataccggtatctactatttgtcttcacgctatatgatcttatctcctaattttctcatatgaatcaagcatcccaaatccatcaggtattgaattagtactaacaactaacagtacatacatagtatatactctaatgttacttttgaccgctgaaaagtgcaatcaccatgagatcctctaaattaagctgtcctaaccaataaaaaagcagagatcattgaaacagataagggattataaacaacaaaatgaatatataaaaatattatttgtttaaaacaagtacataatgatgagtcaaagttgagcattcacatttctgtcaacctcccattagaataggaaattccatcctagttgcttttagtttctccacataaagtttctctccacataaagaattatttctgacagttagtttttttctccaaaatgtcttgcagttgaaaatgcagcaataaaataatttaaaaaacatgcatctaatacaagagacacgcaaacaacagatagaatagggaaaaaatgatatttgttaaatcccacaatcattgaagagctgcttacagtgggttgggatcaattaaaacatgtcaaaggcaaaatcctatttaacccatcgcagaagcatggtgttcaaatagaaataatgaatttgcaatatcagaaaagacgagatgagttacaaactactcacaaagttggtaaggaagtgcacacgatgcaacatcagcaattgcaaaataccactcacgatcatcaccaaggaggcctagattttgataagcaacttgatatttaaatggtccatttgcggagaactcaatatggtttgttccagtaagttgatctctattcataaatctgtaagttgtcaaaataaacagaaccattaattgtgatgtaccttactaagtccatttgatatccagtttttatgtcatcagacaactcacaaggtggttagggatgttactattggaaacccatcacccggtgctggtgagctcatgaagttattcttgcttaggtccctgtaaaaggggagaaattttaccacaactcaaagaatcattaaccttaaattttcctatattacaaactttggttcatcaaaattgtaaaccctggacatgattgctagagtaaatgagtaatgaaatatcacaacaaatgtgcagttgctacaactaacctgtcataacggtggacaggcatctctggtatagatggggtagttccaaacgacgactatagaggacaaatcacgagtcgaaattgactctaacaaagtggttatcccttgctttcactaaatcatgcaccattgggaaggcgcctacaccaccggtgcactaattagttggttaagaaagcatgcttggaacatctaacaattttgcatacattatgctccctttactcccaaaatatagcaacttctggctatgtatcttgacaaaacattatagagtcaactccctctcctttgtcccaaaagttgtaatgttttcagatggagatatatagtattatacagcaacaaattacacatattgtaaatgaggactaaaagtgaataaaaagaattgagtcatagcatatgagcaatgaggaaaatattttgcagcccagcattgatcatgattagttgtcatcgacagaagatatatatgaaagaacgaaatctatcagttgtcaagtgtaaggaaaatcatgaacagtgcatgatctgttctttgacacttggttcttaatttctgaaatgttaaataatgcagttaaacaattaagtactggattatatcaaagtactttactaactacctcatcaaacatgtcacaaagcttgttcttcttaatctggagctcgtaccactctgacgtggacatctcggtagctgataaaagaaaaaaaaaggcagaaaaataactatcctctatcatttttctcaaacaaataaaagagagcagagaattgtcatacttatcaataatcactctggtactactgaagcctgaactcacattgcctattgagacaaaatttggtttgatgtcatacatatcacaccgaaacatggttcccattcttccaaatgctataatgacctataaatgaataatgatataataaattttacaccaagtaaatattgcaccattcagaatctctctaccagaaagaaatattcgagtacctcatatgatattaacaatatgtcatcttaaggacaaaccaatggcgcgcctcctgtatataattcgattgatgacataacttaaaggtacatcgatctcttaaaaacatcatttttaagatattcagaatagccagtgcacccttagcaagcaaatttttcaccaatttcctcatttgtcgcgtaacacaatactcagtgtaccctaagctaaatttggatttgtcaataatcataagtatattccttaaattgcaaaataaatgtcaaaaaaagaagataaccgaatatttaactgaagatataaaaagaactgcttcaatccaaggagctaaaacattttccctttcagaactctagaaaattgcttccatccatggatataaatctttcatgtgtcatgtccagctaagatatggcagcatacaaaaaaacgcaatttatcatttcttagatagcataaaaggaataaaggcttcttaatgtatataacataacatactaatgcttgttttaactgcagttgactccattaattcaataaacaatgtgtgatagggtcgaatgattccatgtctattagtttggctaggaaactcccatctgacgcaagcaccattgtactgctaagatttgggacatatttttggaaaattttaacacaaacagtcagaagcaaccggttaaattacagcattgaaaaaaaaggaaaatgcttctaaaatgaaggcatgcatgccctcacatcagatagggcaatcaatgataattcaatgggtttgtgagatccaaaatacagttacaacatatttaaacttagtaagataagcatggctgaaacatgataacaattcagttcaataaaagtgagcgcacttcacaaaattgatcataaaaactaaaaaaaatatataaatctttcaacattgaagcttttctttcattgacaaattgcatatttaggacccgggaattccaaacaaacaaaataaagcatgaaagtgtgcaatgaacatgtagccaatgttttatgaatataattacctaatttttgtaacactttatttatccaaaagtgcaagtggttagttgaagctaaaactataaatacaaatctttgttaggtacaatagcaaaacacttgacatcttcctgtaaatgtttttatcctagactatatatgatttgtgaagacacaaagcaaaatttgtagtgtctacactattattagtcatagatgttgtgatgtgagtttgcataaatatgtcacatgtcatgcaccgctgataacaacataaagagaaagatgtaaatttgaaaaatgtttaaattctcaatggcaccatacatcatgagaggtaattggtagaactaatatgaacctgacatcagcccatgggttaaatggctaaacatcatccaagtttttacaactaaagttgtatacatgtccaagtagaaatatccttattcttgatctgtgtaaattcaacaactatagaaaaggacttttgtccacattttggtcagtaaatacttatggctaatggctagtcctaatcacgggtttggcatcagaaaatgaacatgcttactatatttcctaggtggaaatatggatctttttccccaccaagaagataggtttgaaatacaaagtatactatatggacaaaacattattggagaaacaattgtaagagcaaagaattcaattaccttggccccaagaaccgccatgatactatcagcagcacatggcatgttgttgatccaaaccaacacaaatggaccatcaagagatcttcactctgatccttaaaactcaacagaaagaccttgataagaacacaaatactttccattttgtttttgacattttacagtgcaattcttgagttggttgatggcatatccatacaccttgttgcctagggcagcaatgaagagaagactcccataatattttctcagtttattatgcgaaccaaagcctgaaacagtgcaagagtattctaaggattgaagaaaccattttccaacaaatattcagatattcttgaacttcctgctgagcaatcacattatttgttgtaactaacacgtctagaatatgagtaatgttgagaaaattgagaacaaccccagggaaataatagtaagcaatttttaggtgaaggctaaaggagtaagttcatagctaaaaattttgcctaagcttgcatatacaccatattgttaaatacatttttatccctgaggcctacacactacatatttgcatgtatggcaaaaaggtgcatgaagacaggtaatccaccaatgacaggtgattgagtcaatttcgaagagaatcaagctcccaaaggaatatataaaccacagctttacaaataacgcaaagattcatgagccacagcaaaatagcactcggcttgattaaaagaattaagaattacacgccttataaatataggattatctattccatgatagtcttgtgtgtctttcttcagaataatggtactacactgaaatagaaaggaaaggaaagcatcttgattctactctaattccgatgctatgtttaaaagagggcatgattatctaccattccagcaacttctgcctatgacatgctaaaacacttaataataccttcacagagtagaaattataaatatatttacttcttgtatgtcctacctacaaataatgcctactcttatccggacacacaatatccccatattgtccaagccaagaataaataatcaataggttagttaaaaggagtgtcagcctactgcgttaaaccaccaaaaatgaaaaatctatagtgcaatcaaaaggatcttacaccactgatgggacaatgcgtagcaagtccaagttcgattatatccgctccattaatttttcaccaatcaaagccaaatattcacctgcaaagggtcaatggtgaaatacacaagttgaataaaagactcaggtatcacaaagaaaaggtgggaagggatatcaattatttttggaatccaactaaagggaaaactggatagcaaccaacatgcccggtcagatggaacaaataaaatgaggaaacaacaccagggcgcattaggaaacaatagtagggagaaatgatacatatccgatccccacaaatcttgcacatgagcagactacttggtcatagccaatggtgccttggccaatatggaatgcataagaaaaacaccataactacaaataatttgcagcttttcagaacagaggtttctgtgcaaggaactctatagaaggtgatagcgataatctaatgagttaaaaaggagtgagatgaattagattatattttgcgaggattgacccttattgagcaaaaagcccaaaagtacacaaataatttaagaaaaagagcagcttgcaatgaatggaccagactaccaatatatcatagcactatagatcatgttgtcttaacacacaggtacctcatctccaatagctattttctgaaatccgagaccaagaatgtcatcgaattttgcaaccatgaaagtatatggcttggctcctttataacttcaatgaattcctaaagcggtgaagcaattcctaaagcggtgaagcaacagtgctaaaatattttggagtatatgatcagagatagtcagtgactgagatatatagtgcatacctgatctttcacaaccagatcacctactgtaacactatcctcgttgaaaaacccatcaactgaaccagtgccatattgaatggcagctggttttcctggagggatcaaacaacagaaaacaggtctgtaatccaaatttgtgatataaaatgattttccctttcatcttaaataactaaacaattcataaggactaacagtataactgccaagcaaatgtgtaattttcaatgcatatctgcaaatcaaatatatatctttttggtagattattttatagaaaaactttaacttgaacaaaaccacttagcttcaacctcctaatttgattcacactgtaatccaaataacataccatctagcatcatttcgaccaaatgcaattttgctttaaaaggttacatttcaacatgacatataagatatcccaccagttgtagagtaaataacaaaaaaaaaatacaggaggaagttttcagtgcattcaagtagtagtatatacagataggcagacagttgcaaactcacaacacaaatgcacggtttgggaaagttttaagacacggaccattcttgcgataagtgcttggctgctcggacttgtagcgagtggaaaaagcacgcgatctgcatcaatcgtcaccaggaaaaatccatcattagcacaactgcacaagtcacaacacagagcatgcatttcaacaaacacttgtagggcaatgagtgattagcatcacctcactcagcagagggtggagtcagtctagcgcagaaggatgacgttgcacagtgctgacggcgagtccgtggtactggcaacctcacatagaaggaacagcatgtcagcgaaccaaagggcaaaggctgcagcactccatcgtcgatggcccggcttagctcgaaggctgttaccacatctgcatccatccagtacgtctgtaggaacctcagtgacacaccaccaagcagtttgcactatacaaaaatctaaatagaaaaaaaagaacttcaacaagctcagtaatatgacatgaaagcaactaatcagcttatctcaggaaaaaaggggaaaacactcacgcccttcttgaagctcgacttggtgtcttgatggcagcggcaagaaagcaacataggtggtcagattccttagcatcgacctgggacgaacagaccttggggcccttgtagaagagcagatatggcgctcatcgaactgcctcaccgtcggtcatcatctccgccccgagctccacccg

SEQ ID NO: 78925 - DNA, 5719 bp, Oryza sativa
  unsure (1)..(5719): unsure at all n locations
caccgatagagagagagagcgttgtctctctcttccttccctctctcgggcgttctctcgctctctcgttctctttctctctcgcgcgccgacgccgcttcccgccgtcgccgcccaaaacccgccaccgccttcactctctcccgcgctcgcgcgtggccgaccggccggtcgttgccgccgtcagccctgctgcgcctgcgccgcgcagccgcccggttgccgccgcgtcaagccctggcgtcgcctgcgtcgtgcgctgccgctccgccgctccacgccgcacccgtccaagagtgggagaagcagctgctctccctctcctccccctgtctcacacccctctccctcctccttttcccgtttcggcaagggtcaagccctcctttccctcttcctttttccttttgcccgaccaccatcggcgtcaccgcctgccaccgcctgggccacgggcgcgaccgccagctcgccgcccccaccttgaccgcgccagcctgcgctccagcggttcgattccagccgcccgatccaccgccttcgccgctccttgcatcctcggcatccgccgggcttgcatcgcccgtgaccgccggccgagcgctcgaccgctctatgtcggttccccctcccaaaccgacattcctccactataaaaccaagccaccccaaacccctcctctctcgttttcactcgcctcggtcctcacacccaccgcgccattgccgccgaaccaccgtcgccgccttgttgctgctcgtcccgctctcgccgttgccgtccgttgccgagcaccggaggagccggtgcgtgctggacgcgtgacgaggagctccgggcaccacctctccctcccttcttccccggccgcgccctctcggtgccgtgccgcctcggcgtcgcgaccacctcgccgcgacaccgaccgcgccgccaacgctgcctcctcttcgttggtgagctccctaccataatcctcctcctgccgcacgatgcgccgcgcccgccgccgcccgccataggcttgccaccgtcgccgctcgctcccggaggccgccgctcgtcgccagatctccacggcgtcgctctgccccatccgacgccggagatgaactccttgaaccccggagatactcccaccgccttgaattgatccctcgtcgaccgccgccgtttaacccctttgcttgccagcggcgcgcgtcgccgcaatccgccgcctccggcctctttccggcgaatccgagccgtcggctcgcttctctcgtcccttccctcccccggtgcgctttcttttccattgaggtagcgccttgctccggtgaactcggccgccgtccgccgtccattcggccgcgcccccttcttcctcctcccgccggcccgcgtggctgccacgtaggcgccacgtcggcgccacctcggctttgaccgagccgagccggtcagccgcctccttccttcccccctcctcgcgcgcacggtccacggtgcaccaaccggctgcgcgtgggcccgccacatccttggtccatccggtgctcgcgcgtgaaccgcgctcacccgaaacccttgcgccgcacctcgcgtgcgcccatccctccgtgaaccatgtcgcagacatgcgggccccacccgggacctcgcatggtgggttcggtccacccggaccgccccctctcccttccgcgcgtccctaatgggccgcctccttgcgcccgcgccggcccaatggctcggccgagcctccttcaacccattgggccgcgcctcacgctcggcctaaaagtccatatttcctccctccgtccaagtcagtgtccatctctcatgagctacaagtccaaatttgctccctctcaattttattctctctcaccttcttgttgaccccacttgtcaatgagtcaaagatattcttgagaatgtcttttccaatattccacaaatatttctcttttctataaattcaataaatcattttcccctctttcagaaatcaattccttattccaaaattccatgaatcattttccttggtcagtgactgtcaataatattcttgagaatattatttccataaattccgacaaaacatttccttgcccagaaaatccacttagacctccaaaattcatatccctcgattcgcaactccgattgaccccgttccacttccagaattcccgtaaaatcgagatctatttaatggcactattatttagtctaaataggatccttttcttggtcttttgtttaggttttcgattgtttgcgtatagttgcggttaccggattttcgtcgatcgcgggttttctcgaagattcgtgaagcttcgtgaagaccttgagcaaggcaagtcaccctttgaccaattgctcctataattggaaaatcattattattttgtttgcaacttgcattattagaatcacacacttaacttgcttggcctcggtttgcatgccaaaccgacggacctacccagtagtcgcactaatttccgtaggtcgtactactctgattccttgtcgctccacccttgtggtacctcgatattcgtgctctctgagcgcgtataccaaatatcccacatacaccgttgtttgtcgaagacttgggaaatgggtttgtgaagccttcaaaacccgacatgtggtgtcggtgtgtttgaaaaccaaatgaattgtgaaaactcgcgatgcgggggttgtgccgatgtggcactgtcccgtattcgcatataaggaccgattcctgtgggaaactcatcgaacataatcaaagtgcaaccacaaggtggaatgggacaccctggctaagtagtagtcggttcagggaaacctcgcatgccaatagttgggaacgccggggcggggtcggttggagccaaaccgggttcctggtaatgcaagaacgagaagcttgctgaattaccgatcgaggtggttggagtttgatttgtgaacgcctaaaatggcctatgtttatgtgaggatttgatccttctatatggcatgaggtaaccctgggtcggcttgggaaaggcttggtcgcgaacctctgacaccggccagtgtctggagtaagttcgtgtcttgtgggtanagtgtacccctctgcagaggttaactaactgttcgaacagccgtgcccacggttatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcccgagtggaggcggattgctttgctgctgggcagctggactctgggagtccgagaaaatgaaaaaggctctgggagccgattaatcaagtggaatggctctgggagccgagaagtaatgatctgacccgggaggtcggtacattaccaaaggagctgttgaaaaacatctcttaaagtcgaatcgagatgcaagtctcttttcggccccaaacttagaaagaaataaatcacatagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgccctgaagagaagataaagtgaagtgaagattagggtttcgtcctggttcccagccgtcgcctgtggtgttgggtgttagttcgttggttccgctgctgctgctgttgttggtgtttcctcgtccgtgtcgtcggttgcattctcgggttgttctgagctgcaacctaagttaaggtaaataagtcctctatctattttaaggatttgcaatgattcatatttgtcaccgtgggtaccagcactatgtcctgggactggtaccgagatcgcggtttcgtaggaagcgattcgcgccgtttttcctacgacacgctcctatcaggtgccgttgtgcggcggtgccggattggggtgtgacatattctagcaacaaatttgtaaagacaaaaatatacttttttaatatagctatgtgctaaagacgtcttttttaatatatgacgttattactttttaataaacatttgattactcttcttattcaaaacttttatgtaaatataaaaaaattaagccatacttaaatgaacatttgacgataaatcaagtcacaatagaatttaaatgatactaccattatgttggagctataaacattatagttttgtgattaaattgacactaaacctatagttttgtgataaattgtcacctagggctggtttggttngnnnnctanntngnncttaccantttttgtnantgttaaattttgncaacttttggcatggctaattttggcaaaggaaaaattgtgtttggattgaagccgaaatagcctaaattaactgttgaaatggcctattttcttacgcatgccaaaatttggctccaaaccaaatagaaaataaacactattaaaattgccaaatattagtaaggccaatataggctcaaaccaaacccaacccctaatatctatttttgacattatgttttaaatttttagcctttgtaagaaatctcatgttaaatttatagttgtgtgataacacgataattccttaggtcctgtttgtttcagcttaacattattgtaatttagattattgagacagattactataagctggattataataagctgacatataataagttgttagttgtttgtttctctagattattagctggttgttaggtgttagcaacccaataatctaaaaaaaacacttttagagtggattactatattatactaatatgtcttatagattgtaataatctatcaaataagctatatgtatgtttcagtttactcctaaatatcccgattataataatcctaagctaaaacaaacaggggcttagttttgcgataatttgatcaaagcatatgtagttaaatttactcttacaatatattacaattatacttcactcgcattacaattatggtatagttacactaatattatgttatagtcacctaaaaactctgggacagtttttcttaaagcaattatcgtactccctccgtactcgtaaaggaagtcgtttaggacaatgtttaagtcaaaccttgggaatataaataatgggtaactctcaagttgtcgagtttgaaaatataaaaaaattatatgaatagatttgtcctgaaaaatactttcataaaaatatacatatatcacttttcaataaatatttttatataaacaaaaagtcaaagttgtgttttggagaccgtgtcgctgtccaaaacaacttccttttcgagtacggagggagtaatttaattcaattcccaatttcccatgttgacattgaattttgggcgtctttattactctttgacattgaggtttgggtagtactctttaacacaccaatcgggttagggcaagtgctatgatatatgtgactaccacatctaaatttatctattatattcactcatgaactcagaggtaacccatactatgtatcatctctagtacacaaataccaatatactcccttcgttttaaaatgtttgactacgttgacttttt

SEQ ID NO: 78926 - DNA, 5878 bp, Oryza sativa
ctttaatgtctgacattttttagtttaaacattaagaaaaacaaacagagtagttatttaggtaaaaaataatcttattgtactgctcattgaaaatgtaattgagcccactatggtgctctatactataaaagtagaaatcaatatgatctattatctattttgatcgatgggttatctattcgtactattatcctaattaacggtaatagaaacatggaggaacattattataaaaaatcgtaatttagtagtgactaaacattttttttctcttttatatatatatatatgggggaaaaggtaaattaacttgtgctacatggagtatgggatccaagattcaaattgagtatatacccaatttgaatgagtatgaattttttttaaatgtttagatatgaacattaacttctttactaacaaggagtttgaacttttttttttgttagattttgattctaggtatataacatccaaacatataatttgttaggtatgtaataatgaattgtgaaacaaagttgagtttgagttgttttgttgttaggtatttgtatgaatcaaattcatatacctgatatctacttacaatttgtaaatttttaaaaatttgagagaatttgtgtgttttataccttggagcctgggcaccatgtctcccaggtgtacgtactcccggttgcatccatcgtccatctgtagcaggcgacgatcgaggcatcgagccaattatcggatccatccaccgaacccgttttgattttttttcacgaaaaaatattcagtaatcgttaatttttccaagactaatcggtgaaattcagcaagaaaccgatatatatccctgattcccagcaagaaatggcaacaactcgttctccccacccaatttacggatctagcgcgatttactggcggctcagaggtagggatgaaactggtttggatagtttccgtccgtccggatcatttttcggattcggatagtttcagtcggaattatccggaaattctcggattcggaaacgaattcagatattttttcttggaaacgaaaatgaatacagtaagggtactatccgtcggaatccgaaaacggtcggaaactatccggaattttttcggatatccgcagacattgagtaaattatataaaaaacacgtatatatatatataacttttttatacggaatcagacgaagacaaactttatattaacattgtagagctcgatgatatttacaactttattattgactattttattattttaggtcatttatgggtctaaatattcattataatataccatattaatttttacaaaatctcagatctacaattcaacgacatctaatggagatgtgttccataccaaagttgtagagctcaacgggatctaccactttttagtttataacatttgtatttaaaagcatttaaagtataatacaaagaatacaagttttaaagtaaaataaataaaatctccaatttatacaatagtaagttatatatcaagtaaaaggtcttgggaatagaaaacgataatcatatttgcatatggatctcttagaggaacagccatgaaaatcgattttcacatacggttgtgagaccgtctataaaattgacgatataaatgttggagatgttgaactaaaataataagcgatatctcttccttgatcaagaaactcaatttgaggggttttttatataccggtaaatattcgctaccgtattcgttccgtctcgtattcgctccgtatctgtattcgataatattcgattttatttccgtatccgagttttcgattccgattccgatcaaaaagaatatgaaaacgaatatgataaagctagtttccgatccgttttcatcctactcggaggcggcagcataataaattggtgattcgacgatggcggcggccggccggatgcctggagccattaatgatttggtggtatagggcgatccatcggcagggacaacaaatttatctcggttgtgggtgccatcgcccatcccacccttctcgggtctggatcacctggagttgcaggcaaatccaccgggtggatttcacctaatctgagccattcttttacttctatggctgagatcatcttttctaattaacaacccttataatcagtttaaatcgcagtgatgaccgacaccagtggcatcgctaccgtgataatcatgttcgtgcactgtcatgcatacacgtacgcgtcacggcggtgttgctccagtgaactgcatgtccaaaaatgcagtaactttgccggtcgtccattccagccggcggctgaaccacttgtcaaccaaatagacacatcggcaccacaccgccgagcgcttgctcatgttctgctagtgatctcagccaccaccattatttgccgctcctgtgctccactaccactgcaaggtgatctcagctcaaccgtgtcttctccgttttgtaattggccctgaattcttgatcgatgtcctgatgtgtgctcgagctcgacgcgcggttcttgttaacaattcgggatagtgtaacaaacgagtaaggtactacagaataagaaccaccctggcttaatcatgaccctagaaaaagacaaacggtccagattaggtgaaatccactcggtggagttgagtccaactccaggggatccaccgttcccacatcccacggcgtcttcagatttggtttctccgccggctattcaggaacccatgcatgtaacagtgttttttaccgttcttaattcttgattcattgtgtaatcacctttcttaatcacaccgtcccatcttaattaattgcctttgatgcagatcgatgattctcttgtatatttcttatgatccctatgagtggtctgctgcatttttttttcataattctgtatattctttagtctgtggaatgatgaagctccctaactccttgtagaagcgacacgtatataatggttgagctctgtttttctatgtatagatgttgcctgtggtctgacggctggccggtggctgttcatgccgacccaaagaaagcaatccggcggcatcagtaaatggtgaatattagggaagggtctttgtttagaaactgtaattaggattgtacgttctttttaatcagcgtataatgtttcaatgttagcctaaattactacacatctttcatggaaattctgtttttactaatgtcaatgacgactagttcttctgttggaaatgtacatgttgccttctcgtatctttgagaacatactgatacttgaatcatcatacttgcatgtagcagctgttatatgttactccctctgtttcataatgtaagtcattctaacatttcccatattcatgttgatgttaatgaatctagacaatatgaatgtgaaaaatgctaaaataacttacattgtgaaacagagaaagtatgtatattatgtaaaagtaagtatatactgctactaattgaaaaagacagtagatacttgtacgaactaattaaaatgagtacatatactatctactaacttaaaaaataagtatgtactactaacgaaaaatcagtatatactactaactaaaaaagataagataagtatgtagtactagctaaaattcagtatgtactactatctaaaaaaatatatactgctattgactgaatataagtatataccactcctaattgaaaaataagtatatactgctattgactgaaaaataagtatatactactcctaactaaaaataagtatatactgctattaaataaaaaaaaggatatactactgctatactactaagcaaaaaggtatattctagtactaactgaaaatatatactactatactggatccttaaaataattacatgtctcatggattgcatgctacaatgtgcacatgcaccttgaattttagggatgtatcgttcagtacctacctggtaatcttaagtggtatatactgaactagtagtatatgctttcgtttatatctagattagaaccgcggctcattcaaatatttttctattctagatattctcatctcaatatatgataccttctgcatcttataggatgtactgatacttttggatcatcatatcaagtccccaacaaaaacacaattataaaaaaaaaagtatatactgctactggatattaaaaaaaaacgcatatagttcaacaaccaaaaaatctaatacgtagcacatactaagtcatacaaaaaaacacagtatgtgccgtatactgaaaaaggaaaggcatatgctctttcaacgttggttctggtacataccgaatattatgaagaacaaaaatcgttctgcatatctaactactttgcatgcaacaggcggactaatttacgagttgcatgcatgcatgaattgttacatcatctatttattaatcattttgttttttcaatccggttaatattggatgatccactatcaggtatatatataaaatacacaaatccactcaaaaattttaaaaattttcaaattgtgagtatatatctagacataaaaatttgattcatacctatacttagcgacaaaacatctcaaattcaactttattttatattcaattattacatacctaactaattatatatttggatgctactccctctgtcccataatataaaggattttgatattttggttgcattgtttgaccactcgttttattcaaaaaaatttgtgcaaatataaaaaacgaaaagttatgcttaaagcactttggataataaagtaagtcccaaaaaataataattccaaaattttttgaataagacaaatggtcaaacagtgcaagcaaaacgtcaaaatcccttatattaggggacggagggagtatatagctagaatcaaaatctaacaaaaagatgttcaaattcagttcaaatttgtttgaactagttagtaaataagttaatgtttatacctatatattttttaaaaaattcatactcaattgaattaagtatatactcaatttaaaacttggtgcccggtcaccataaagctccagttaatgaaaaaatgtttcaattcttgaaaaacagtgaaacacagtcaaatcagtagatgaaacaaatgattttaaggactgaaacactaaaaattcacaacgcacacatccactattctgatgctcctcccttgtgcgctcccgacagtgaagcgacgatgtcgtccttgagcatgctagtcttcttgatcgtgagaaaagaagatcaaggatggccgctacctagttctcgagctcaagacaaaaaaaatcacataacaccagatcaacatcatgttctccaacactggctcaacatcagcgccagacctcccccttccacaactacctccttcactcgtgcgccacagagataaatctagccatccccaggtcacaggctccactgtgacctcgacctcatcccaccgctgcaacgtcacctccgacgcctgcttgtgctcatcgtctagtcatggaagaggggaagaggagagagtgggagaagagagggagacggagaggggccttgcctcccaagctgccatcgctcaccatccgcggccatggaaaagggaagagagggagagggagattgagataaaaaaaatgagtggctgagaattgaggagctcatgttatttctgtttttgttgggtatattggcacagacaaatcatgttcttttaattaattatgtattaatttgttgagcagatagaaaataaattaccttgacatttccagcttctttgatggccttgacgagcttgagctgcagcaagatgttgtggctgcggtggtggacgccggacat

SEQ ID NO: 78927 - DNA, 10168 bp, Oryza sativa
catgttcttttaattaattatgtattaatttgttgagcagatagaaaatttaccttgacatttccagcttctttgatggccttgacgagcttgagctgcagcaagatgttgtggctgcggtggtggacgccggacatggcggagacgacgacgtccacctgccggacggcggcgacgaggccatcgtggtcgtcgagcgacgcctcgaggagccgcgcgccctgcgccttgaaggccagcagtatctggagcttgtcgatgttgaggccgatctccggccgcagcaggacgaaggtggggtggccctccgccaagctcgccgcaacgatccgccggccgatgtagccgctgccgccgacgatgaggacccggctcttctccatggccatggctcccagctctgatgagtgccacaactgaccacgctaccgtgcagtcgactcgacaaagctttactgccgattgcggcctatatgtattagcgtgtggtcctgttgtcgtaccaactgtgtcagcgattataatttatcaatctgactgtggtagagaggtttgggggtacgtaaataacaaagcttgaatctgttggtttggatcggcttgtttcagctccgcgttcatataaaagtactgccccctaatactgttaggatgcgataagcaagcaaacgtaaaaaacaatagatcaatcacagaagacacgagatttaacgtggaaaaccctcccaaagcagaagagaaaaaaccacggacgccagccagcaaaatatctttactatatctggggtgaggttacaatgccgcacggcggtttacaagaggtatatatatggtggaaccctaaaagggatgacgatccgtacgctccggcccaagcctccctgcgacgggcgtccgctccactacggcagaagctagcctttattaagtgcaaatgaatttggatcacaactcaacaaatacaccattatagtatttctactatacacgcttaagaatcaccctattctaatgtcaagttacaatcacaattcacaagtaggagctaaaacatgatgggtattttcctcccacacgcccgtccatattaattcgggataaaaaaaatagatacttaggggtatatatattcagatatatatgcgagtcgaatctgggtattttttcaatgcataagtgatcgggttagaaaagatgatacccaatggataaagaggatgtgataaaacatacggataatacctgctaagctattcgggtattagccggatagcgggcccaatagcaaccatagcacatctgcacatatatagcttcaagtctaccctaattaaacaaaatactaaaaggcctaaaaggcacactcctcaaggctctagcagtccaggcagcaaaaattttcacaatttgaccctttgcaaaaactatttttacaaataaatcgccaccaaaacttatttaaaaaatgacccttttttcagcgtcaaatcacctagtgctgaatttagacacctcagcgccacgtcaactggcgctgaatgccgtgccaccgcaaatgggagactaagtcagcttgccaactcatattcagcaccacgctatttagcgctgaggtgtctaatttcagcgccacataatttggcgctgaacataagggtcatttttgaaataagttttggcggcggttcatttgtaataatagtttttgcaaagtgtcaaattgtgaaaatttttggtccaggcagtggcaaaactctgcctagtgatgctgttgttttggtatctatactatctatatagttgataaccactaactactaaaactaatcatgcaagtgtgtcacatgatcatccactagcaattattattaagagtattttaaatcgtatataagtgtgccacatcatcacccactagtaattattatctagagtattttaaatatcatgcaaacataacatatcattcataattttattgtatttttagagctcaatatgtaaataatgtcaaatcattatcttacattatttaaacatatacatctaccatttctataatatataacatgcattcattcacatatcccgtagcaaagagcagagtatcaactagttattagacattagtatgccctaagctcttaacaagttagcatagctttggtccatgtggcataggtcgttgctttaactcagtatccgaataagtattccagtcgaatagtatttgcatctgtcttagtacgtattcgctgccgatgatatttgtgtttgtatttatacccgatactatccgtatccgtcctaattttaattacggttagaatatgggaagggtaaaatccaacccaacccaatttctcccgtcatcacgagggctgaatcctcaccctcgcgacacgactatggcgattactacggaaacagtttcgacaaaaggctatgtggcccacctctatccaggtgtgtgcgcgtggaaaatgaccatttttgtgtatggggcacttagccgagtggggaaatagattattcccgacagaccgcttaagatatctgattgcgataataaagtttgcaggcttctacgttaagcggtccacctaggatgatgtttttcccatgcggccatgccaaattagggcctcctgagaagatgcttcttagatatatatatttctcagctatttttaatcaaaatatttttttaactgaaatttcccagttttatattggcacaattctgtagtattactatagactctagtacttgtcaatatataaatattgaatatgtacaagacatataaatattgttttgtgaacttgattacaaattatcattctcagaccgcgtaatagtaaagtttcattacatgtgttttctttcccactatataaacagaagataaactttttactcatacgtgcacaaatttatatcagtttgtcctaagtttattcaatttatgatatatatcgagttcttttaattaatgtttttaataataaatagaaatacggtctctatatacaaccaaattaaaatcaagttttcttaaattatttactaaatggtcgtgtttctagaaaacaaattacatttccagattctttgatggcctccacgagcttcagctggaacatgaggttgtgtctgcagaagtggacgcgggacatgacatctccggccggagcaggacgtagatgtggtggatccagttcctctctacagcacagcagagaagactgtagctacagcctccacctccgtcgccaccgtcgccgcctgtttgtaccataatttggcttaaaattagtttatctgagcaggccaaattatttagaggagttggtacatttatctagaggtttgctcgagagttctgaaatatatatgtgtgcaggaatttgtgatgccctgcttggatgatttgtgtataatgctgggtgcagcagcaatttatttggtttggacttgtcacatggatgcagcctaggagagatttggcgacggggatcaatgcttgattgatgattaatttgccgagatgtgctgctgttgccgcacgggactggaggactggcattagtagattgcatgagaactatatattccgtttgttaatatttagatggagtcggattctgttagctaatttgttggagtttccatgtacgctcaagcggtgcggctgggggttctggtgctcctataaatattagtgtattaggttagttttgaagggccccgaacaaaattaccaatctattattttcctgttctttactttcatgttattttctattttgtttttatggctaagttctggcatccctagaatttagttaatctttgccgttttgcgctgaaaaacggtcgtgcttctccacgaaagcgagaagattatcctttgctagtttgctcggaaactagtcgttcgtcgtcacgtaagtacgatatttatcctctttgctaatttgcttgtaaattagtcatgtgattccgcgaaagtgaattaatctcgaaatcggtttcactagccgattttgatctatcgattttggcgactctattgtttacaccgcaagtcgttaggtgatcttgtgttggccatgaaaaagcgtcaacaccgccatcgcgtcgccgtgtccaacacctccgcctccctctcccgccgccagtccaccgttcgccgcctccgtttccgaccaccgccgtcgccgtctccatctccgctccgtgtccgcctcgcgccactgccgcctccgctgttaccggccacctcccgtgcggcacgccgttaccgtcgctgagcgcacaacctccgctgctgtcgaccgccttatcgggctgccggcgttcggatccggcgagggggcggtcagatccgtgtcccccgaccacatggaaggggcggcctcgggtggagcagatcgacgctggccacgaaggtgcgagcacggatggagcagttcgagcagccaccgtcgtccctcgaagccacaggtaataaacgagacaagccgcgcttccaggtttgtcgcccgcaccacctctcaacctacttatctccatcaatggagaacccccggaggcggagatcgggcacagggtggaggacctgtgggaggtggcagagccgcagctgtcaccgtccgagaagctcaactcctgcttcgaggacatcgtcgtcgcctccttcccctgcccccttggctcgcaaggtatgtaactaacgcctctccatgctgctctgtgaacgaacatgtttctgcgtattctctgatttgatcagatcactgctacaatagctatttttccgtgcggttgttttgatttttgcgtgcggttgttttgcccgtctggaacattgcgtcttgaaaaatcgtgattttcttgtgcgggtggtgaaaccgcacgcgaaaatccgactttcgcgtgcggctacttacgccgcccacacgggaaaataaaaatccgaaaaaaaaataaattttcaaaaaacacaaaccctaaccctagatccggatccggcaccccaccaccgtgccggccaccaccaccgccggatctgggcgggaggcagccgccgccaccggatctgggcgtggggagggcggcgccgctcccggccgcttcctcgtcgtcgtcgttgtcagccgcgcgcacgttgccggccgtcggctcctcccgctcccggcacacgtcgttggtccgctcctgaccgctgccttgccgtcgtcgttgccgtcgtgagcacgccacttccggccgctgccttgtcatcgtcgtcggccgcgcgcacgctgctcccggccaccgcctcaccgccgtcgtcgtcattgtcggccgggcgcacgctgctcccggccgccgcctcgccgtctttgtcgtcgtcggccacgcgcacacttctcttggctgcctccccacgtccgcccgccgccgcgagccctccgtgcccgccaaccgccgtcgacccctccgccgagagccgcccggaggagaggaggagaaggtgagacagagagaggaaaatgagaggagaggaaagtgagaagatatgggggagagagaggagagaagggggcgggggagagagaagaaaagtccaattttttttgaataggatgcgagggaagtgctattttccctgtgctgttagattaggaggcccgcacgcgaaaatagagttatttttgcttgcgggcctgttaagtgacccgcacacgaaaattgatttttgtgtgcgggtgacgacccggcttcgctccccccatttttccatgcggtccaacttacggatcgcatggaaataaaatggggtggcgtccaggaaaatcaatcacgtagtagtggatgattttagttcttcatgtgaaaactgacgtgaagcatttctgtcttgagttggagtcacctgcttattggctgtttgggaaacaaggacttattccaagtccctatcacatcggatgtttggatactaatttagaatattaaacatagactaattacaaaacccattccataaccttggactaattcgcgagacaaatcttctgagcctaattacgccatgatttgacaatgtgatactacagtaaacttttaataattatggattaattaggcttaaaaaattcatctcgcggattagccctcattataaaattagtttttttattagtctaaatttaatactcccgattagcgtcaaagattcgatgtgacagggactaaaactccccatctaaacggccctagttggatgatgaaatttgctgatggagatggtgaaacaaattaaaacattcggtgttccttgttgaaattgatacagccagttagttaattcattgattgaagaatgcgtttgctgtttctcctgattggattaaactggtggcattagtaccttgtcattattgtgggtctcctgtcctatatatatatgtattttctttcagcttcttgatgtaatggaggtggccactactttatactagtcttttcatttcctttgtgtgattgctggggccatatttgcattcttttctaaagcaaatgcgcatttccacttcgtgcatgtcagtgctgatggcctacatcctacctccagtctgcccaatttttgttctggttgaaaagggtggcactgttttatgcaaccagtgacaatgcaataggggattgtaggacttcagccttatctgaatgatgaagttttgttttagacaaattaagacctgtatgattgagtcaggggggagcatggtgattgctcttgttgaagggtccttttcatttcttagacacgctaaagaagaacctttctcccgtaaaaaaaaaaaacctttctggacttcctttttctttatgccaatatgtcgtatgttattaatatagatatgttctagaaccgtgagggtccatattaccgtctgaaagatcgtattgattaagtctgataattttcaagtccccaccatcctctgttagtaattctcacaaaaacaataactaagtacaggtttatctaaatcatatatgtacaaggaagtgaatatttcaatttaggtggcttggattgattaaactaaaagcagtaaagcaagcaactaattcaaacttaatattattattagggacccttattattattccacttacagtaatgtatctaagagagcaatatatttagctttattcaaccatatgttatgaacatcaccaacagaaagtgattcaacggaataataggtaaacatattactcactgaggcatgcgttaataacttgtgtagaagctcggtcattttcagctactcaatgctaagccgttgttgctgattcatcggctatttgtactctctcagccgctcaaggtagtagaaaaaggaatgattcatggagcggtatttatctgaattacttcggatgaaaactctgcctcccttagccattcatcgctcattatggattataactcccggacagtttctcgtagaaacccgagttccataggatcgggaggtgacaaaggaatgagtggtgtcttcttgctaaaatagttcagggtattaccgtagtcttcgtcaatgccgtccctgaacaggattgtggcacgatccggagtctgaatttcttcgttctcgacggacggctgctcaggaaccttctcatcattcgagctagcagaagtggttggttcagcaagtggctcaatcgttagaggttcctctatcttggacacggatgcctctggctggagttcattggactgcgtcatgaaggaagtattttctagaatgcgatccaaaattgttcttccttctgacggcgttttgtgcatgaacgatcctccagtggttatgtccagatagaatgcagactccttatccaaactcgtatggaaatgttggagaaacacatactcaggtaaggacaggattggtccggattgcactaaattagtaaatctggaccaggctgcaccgattgattcattttcgatctgcttaaaactgagaatttctacttgaagggcagtaatacgagtaactggaaagaaggcaagacagaatctgtctcgcaacttttcccaactactgtttacacatccaacggtagaggtgtaccattgctttgctatttcttgaagagagaatgggaacaatttccaccgcacagtttcttgtcttatgccacgaatcttaaggcatgagcagacttgtccaacgtctcgcagatgatggtagggattttctagatcaaagccaataaaaggtttttccctaaccatactgattagttcggggcggatttcatagccagttgtataaatgggctccgatgaaggaggtggctcatagaattcgccttgaggggaagacagctaaaaaagaggttgctcgatggtcgagaagagtttgacaggaatacttctctaggatagcaggcgtagaggtagaataaaaaagcaaaaaggatatgaggatgaacaaggtccggaaataatcagcaaccgttccctggcaacggcgccagaaatgcttgttggtatttcttacgatcacagacaaaatccgtaagcgcacggatataccgatgtagcacttcccctacagagtattccaagggtatcgaatccaagggaacgtgtgtgataagaccttcctccagttcatccaaggacaccaagcaaatgataggccaggatagagaggatttactagtgagaaacagtgtttagggaaagctgaactttaatcctaatgcaatacttcaggcactggcaacacgctattcccagatgtcgctctactacgtacccggatagggaggacttaagtgatcttgagggttgtcaccacctctacacccacctcaaacgtattgtgggatacgcagcaattactggataacaattacctaaacaccacgtctaagcaattactatctactttagtgtttataactcaccaaagcaatcactatattttagttgattatagtgaacaataatcccgtatgctacttaggaactaaccaagagataattctcacaagataaatctaaattactcaagaagaatattatattgaattcagagtaataaacagaataaaagaaataggagaagattaccgacaactccggaattcttccgactccttctactctactctcttcctattctagtatacaatatagtacaatagagcctcttataattcagctcaagctcgaaagtgtgtgtgtgaagtgagggagtgatgtctttatataggggtaggtatgacggttggcgaagaggaaatgtccgaaatgccccgcaaccgccattaggagatgatcaggatcgtccacgccaaaccccagcctggatggctgagattgtggttcggccgaactagggggttcggccgaacctgggctgggcccatctggcctggcctttagcccatgttctcccctggtcctcctctattcattcttcggtattttgggctgattcactgatgttttgatgaagttcacaacccatccttgtatggagacagaattctcctcacttaagtctagatttcctcccaacatcgaggtttatcaccagcatataaatatataccaacatttgtggaatatgtgagatttaagcacctatcactatattggatgttttattatccaaactttatgcagatgttggcggtatagaatcggcatttaacagctgccaacaccaaccctgttaacgaccaaatttggtaatctgagtatcaaggatagagatcagatcgaagcggatcaaatcaactggcacgctcacacacccaaaggcatgttttggacctgcactggagttaagcagatctctcagtcctcgtgttttacatcaacaaaccctagccgccttcgtgtgcctctcctccttcccctcgtcccgtgccctcctctccttctcacgtcgccgtcgcctcctcctcgcgccgccaccatcgcgtccccatactcatcgcctccgtctccacctccgtcgctgccgtcgtgtcgccgtgtccgacacctacgccttcctctcccgccgccgtcaccaccagtccaccattcaccgcctccgtttccgactgccaccgtcgctgtctccatctccgctc

SEQ ID NO: 78928 - DNA, 2597 bp, Oryza sativa
tgcatcagaatgtcagtataaattgtcctatatgcatgcaaaatcaacttgaccccaactgcaaagcctgatcttcaccatcatcagcagttcagtacatgtacggatatcgtggtttgcagtaaacaatatactagtacatttctgaattttgcaaactggtcagtatattaattaatcattatacaccatgattagaagtcctttgggaggacagaaactcacaagaattgcaagaaaggctgcccctgtggctatgcacagtactacgttgtttgttccaatcttttttcagacgagcaacaggaggcacatgttcctacgtcgaggtaacaggggaaaaaaatcgacggtgctcccttcgtcccaaaataagtgtagccatgattttccgtgtctaactttgactgttcgtcttatttgaaaaaattttaaaaaaaataaaaacataagtcatgagtaaaatattatttatgttttatcatcttataacaacaaaaatgttaattataaaaaaattcaaataagacggatgattaaagttggacgcggaaacttgtggctgcacttattttagaacggaggtagtaatatgtgtgccgatctgtcagtggggctccgcatggctgaagttttggtgatttgatccgacctcgtatgcaatgcttcaaagcttttatatatatatatatatataaacctgattaaatttaaagaaaattttgattcagttcagaacaaactaaaatatctttacattttaaaacagagtaagtattggcttattggaggcagtgaatgtaagtaggagtatcgtataaatgcttatgacgagaggcggaaccagaaaatggccaatccttcgctgaattatattagtcaattttaattagacgttatatatttttaaaattttatgcactttgtaaaggatttaaatggagcttttgagccacgtatagggctccaatcaagccctaaatatgccatatgcctagctagctccgcacgatctgcatatatgggcagattcaaacaacatgaaatcaaaaaaaaaatcatgctcccatgtttttttctaattaagaaatctgacagattttcaaaaatcagtggagctctatcaaacaaaccattatatatattgtacatgcatatggagtataacaaaagataacatatcgaacaacaacatatatatataaagaatcatttcgtttaaactactcgattgcatccatgttggcctggttgctgtccaattcgatcggcgttaacagatgttgatgaccattttagatacgcaaagaccgaaagagatcaagatacactagtgttacagtactgttcgtatatactccatatcttactgatattaattaagacgtgtgtgctactgttcaatgcactttgaaaatatccaatctgtattgatgtgacatgcatatatatgaagcaacctagaatcgaatcctgctattgtgctgatcattttcagcgtatcgtgttctaagttgtagtcaccgtaaaagtccagtcatgtatacgtctgcatgttctcttggattattaatttagatctcttcgcaatcaaatattgtgcaaacgtatttatatagaagagaaagaagcaaattaaattccttgtgatcatgcccacaccacgcataaaacgacagtgattgttatcaatcaaaactagttcacccaaattaaagcaaaggggttttgcaccgacttcagttcagcgcggctaattaatgagtactccgtactctacagtattgcatactgtatatatcctcttgtgaatgagcagaagttaaacaagttagcaggtaattaactacagagttaaattatgccccttaattaatttcagcttcgttatttaattaacagttgccaggtttttttcttaactatcagttagctgtgcacgtacttttacaagctgtagactaaggccatgtttagatcctatctaaattttttcaccctgtaatatcaaatgtttgaacatctgtatgaaggattaaatataggctaaaaaaataattaacggcacagattgcgactaatttatgagacgaatcttttaagcctaattgctctatgatttgacaatgtggtgctacagtaaacatttgctaatgacggattaattaggcttaataaattcgtctcgcgttttactgacggattctgttattagtttttttattagtgtccgaacatcctatgtaacaccctatataatacctgatgtgacacgccaaaactttactcccgtggatctaaacacccctaaggctgtgttcttttcccctctttcgcaattcactcttctcgttttccgcgcgcatgcatttcaaactactaaatggtgtattttttttgcaaaagttttataaatgaaagttgcttaaaaaactatattcatccatttttcacgttttgctcgctaatacttaattaatctcactataatcgtgtgctttgttttccgtgtcgggagggcctcccgaacgcagcctaaattgacttaaacgcaagctgtacactgatcttacgtaatactataaaaaagatgaact

SEQ ID NO: 78929 - DNA, 1076 bp, Oryza sativa
gtactggcgaagaaattgacaaatagacaacccaaaatacaattaattggggctggatggtagtaggtgcatgcgttggctacacttggggtgggtcggtgtattggaggtggggatagtactgtgtgtaggaaggacaaaagaagcgtgcatgcgtggggatcaatgtattgaaacaagtatctagaatacagcaagtacatactacggggtgggtgtatgtatcatccctgcataccatcaccaccacaccacgttctacccggagccctgcctatctatcaaccttagccataggtatcgccatcgtctcgtctcctccggggaccatgcatgcaagtttgcaacctccatcgatggaggtatcgcttctctctctctctctctatctatctatctatctatctctctaagctataagcttaggagtatagtgtgtactatggctaatatacggggtatatatcatcgcaaaacatagcatgtattattgcatgattaattaagtaataactaatatttttaaaaaaatagattaatatgtttttaaacaactttcgtatattttttttataaattaaaaacacattgtttagtagattgaaaaacatgcgcgtggaaaatgatcgagagaggtgagttggaaaaactaagagaagaacactagtagagcaagtttaatagtatagcccactaatagctctaattcatctatagccaatctaatagcactggtggagaaactgtctttactcccggtttataacccccctatagtcccggtttcctaaccgagactacgaatccgggaccaaagatcgctatctttagtcccgggcgaaataaccgggagtaaagatctatctttagtcccggttgataacaccaaccgggactaaagagagggatctttagtcccggttggtaacaccaacctagactaaagagaggatagggacaatcccagatagtccttttttttgttacttttttattttctcccgaatcggatggcatgcacatcccaaatcaaaccccaaatctcaaataaagtaacatctcaaatccacatcaca

SEQ ID NO: 78930 - DNA, 6009 bp, Oryza sativa
attgcttggatcactgaaatccaggcatacctcgcagataagactctacccgaggaccgcgaatggagtgaacgcgtccagcgcatctccaagcgctacgtgctggtggaagggaccctctatcggcgcgcggctaacggagtccttctgaagtgcattcctcgggaacaaggtgtcgagcttcttgccgatatccatgaaggcgagtgcggagcccactccgcctcccactccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcgtggccgtttgctgtctgggggctcgatatcctgggtccattcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcgaaaatcctcaagggcctcaaaaccaaaaccttcaacatcctcaagaagcacggcgactcgtggatcgaggagttgccagcggtgctttgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggcccttcgagccgcgcgctaccagcagagcctgcggcgctaccatcagcgtcacgtccgggcccgtcactctgcgtcgacgacctcgtcctacgccgcgtctaaacgcgtgctggactgagcaagctctcaccaatgtgggagggtccgtatcgagtgatcggcgtcccccggccgggctccgttcggctggccacgggcgacggcacagagctgcctaatccgtggaacatcgaacaccttcgtcgcttctacccctagtgggggtcgggtgtcaggtctcgggctcgggccaaccccgcgcccccccgggcgtgcagggttggccgggggctaccacatgcatatccttatcttttttctcttccgtatttcagtaaaagcattttcgatttcctgaggattgtgtctgtgccatcgtttccttttgaagaatcttggcttgaattagcacgctcgtgcccgaccctgccctcggtggcccgggccggctaaaatcgccaaacggggcccagaaccgagccgtgccccggggcgtggtgaactccgggggggaatcggcataggcccacaatcgggtcatccataaccctcggtcaccacgctcccgcctggccagtctcgacacgcggatctccccaggcactagccccgacccgcgccacttgaggttgggacctgggcacgagccctcgtttaagccaagacacagaaggaccgcggcacggaccatcctcgtctcatacacacaacaaacttaactgacgcagaaatttcctctttacttgattacagattaaatcagtctatacaagaagggggcccgaaggcctcggaagaagaaggaaaagttattaagattggcgggggcctgggggctcactccgacgcccccgggccgtcggcctcgtcgtcgctgtcgtccgcgccgtcgtcaccgccctcctcgtcggagtcgagcgcgaacgcgagtcgaggggccgtaccctcgaagctgtggacgatgtggtcggcggcgtcccggaccctcgcacgtgcgccatcctcggttctgggagggaactcttccagcgctgcccacggggagaagtcagggtccctggcctggtagcttgccagtacgagctccgccgccccccgggcgaggtccctcgaggatgacttgatcgcctcctcaagctcctcggggagccgctggagggtcccggccatctctgagaggcgctgggcgaggcccccctggttggcggcgtatttcgcggaccgcccgccccagaggcccacctgccgcccggcacggtctagacgggagacggcgtcccgaagcatgccaggccctacctcgcccgccaagcggagggcttcgacctccccggcggacgagtccagcgcgccctgcagctcggtgatggtgtgttcggcggctgcaaggcgggcggctaggtcgccgtcgcccgcggtcgccccgccgctgcgcgctctcgcgtccagctccttcgcccgtgcctcgaattcagcggcccgctgatccagtgcggccctctcggcgcgggcgccttccagattgaggcgcgcctgctcctcccgccgctgcgccgcggcctcggcctcctcgagagctcgctcccgctcagtgagctcgtcctcgcggaggcggagtgcggactcctcttcggcgcaggcggcctcgtgcgccgccagcgttgcctcccggatggcgatggcggcctcgcgacccgccagttccctctccttcgtgtccaaggcgcgggcgcgctcctccagcaccgtggcgcgagcctcaagggcctcttcgcgctgccgggacgcgtcgagcttcttctctagctccgccgcccggctcccgtatgggaggcagaggtcgtcccgcgccgcgttgaacacggcggtggcgatgagggcagtctcccgctcctcctccacctccctggcgatctccgccaggtccctacgacgggcctcgagctctgaggcatgccggcggtgtgccttgcggcccgcctccaccatggcttccaccgagcgccgcccctcttcgacgcgcgcccacgccgcatcgacctccgcccgctctgcctgcaggacctccatctgggcgcttaacccgtccaacaccgtggtgttcgcagcggccaaggcctgcaggaggggttctgcgctcagtggggcagcggaaggcagaggggagagccgcctcggtgtgggcgccgcgcggctcggcccgccgatggacatgccggactcgggggcgttccccgaagctggctcgccccaagcattgcccgaggggtcgggcccgagcggcgcgcccgcggcctcgtcgtgggcggcctcagaagtcgtcgtcgcctcgggcggagtcgggtcgggggctcggcaggccgcccggcgtacacgcgccgcctccgtctcccggacggactcctcggcccggcggagtctggcctcctcccaagcggcttcctcagcctggcgagcccggacggcctcctgggcagcttcttcggcttcccggaggcggtctgcggcttctcgccggtcagctccccgcctccgggcctccgcggtcgccgtctcctcggcctcagaccggccagacttggaatggcgggaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttgggggggagatgaggtttccccggcatggttcggtcccccccatcttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctcccggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccaaggagctgagattcagcacccgttggatcaccatcttgaagtcttcagggacccaatcccatttgaccccctggtggatcctcatgtagtcctcggacccggtgtactcccaggcgccccgggcgcgccgctggagcggcgcgatccggcgacgaaggtaatcgccgtacaccatggcccccgtgagcccctgggatcgcaaaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacgtcttgcgaaggacgcagggaatgtagcggttcagcaccggcccccgcggctggaagtagcagccaccgactaccgacggtggcgacaccggctgtacggtgaagaaccaccggacagccggagagatgggcgtaccccgatgaacatctcgcataggtgcgcgaagatggccaacgtcattaccgcgttaggggtgaggtgcgccatctggagattataaagctccagaacatccatgaagaaagaagagaatggcgggaccagccctgccattgcgaaggaaaggaagaatacggaccgccccgggtagtgtggtgccgggcgtccctcacccagcgcgaccacctcccggccagtggcagattccggcatgaatcggcgcggcagcccggcctgcctctcgctcacgatgcgagaaggcggcagcacgctaccatcgagcggtgcggagccccgtgccatgacgccggcggaggaggggcttgagagcgagtgagtgcggcgaaggtagggcacaggaaacgagaagttagaacgcaagcggcgaaggcaaggggaataatggcgagaggaaggaaacgaatctcttcctcggcgtctttatacccttaccaacgctatgcccggctcctcgcttccctcgcccactatctcgccccctcgtttctcgcgcccactcctccactaatcccgctcgcccgtttgcggcgcacgaggcggatgtgcggccgtggtagtcgagatggcacatatcgtgcgcgcgttaactacgctcgccgaccgatgcaccatcatcacatctccaggcgaaacgaaccggctcgtcccaattcgcgcgctactcaagtaatgtagcggtcttgaagaaagccgctcattattatcggtcggtttttcccttgccgatgcgcgcgatttgcgaccactggattcctgcccgcctgtagagaccggccccacctgtcaccaggcctaaggagtggcgtcacgcccgagcgctttcctcgaggagggcgatcgccctggcataacgccgggggctactgtcggtgacatgggaccgggggtatcttgactataggtttggggcagctgcagtcacccacgtggcctgaccccctcgggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccgcatttaatgcagcgcaacacactcgttcggtcgtgacaggtccagtgtgtgccggtcacagaccggtcagatcgcgggttaggtggcaacaggcggcctttcgcacgcctcgccccgtcccgtcggaatgatgagagcctctaggcactcgtccctagcc

SEQ ID NO: 78931 - DNA, 27482 bp, Oryza sativa
aaaaaaaagaatggtcacttacgattgctatagacaagcactgatcgtataaatttcttcgtcggccaccttccgcaacaatgttgggcctgagctggcctgttatttttttgtttatgtcttctctttcttttctatatggtatataagggtagaatggtcatttcatccataccgctgcatgcaaggatgacttggcatgatcacgtggcattttttgtgggtccaaggactatattaactcaaatgattaatttggaggacttatttagacgatttgaaaccttaaggattaaaatgagcccgaagcaaaacttcaggaaccatattagctattcaccctttcatttatgtgtcacttttaatatattaaatgggtgaaatggaagtatggaacccctgtttgtgggggaaccacaagctttttccatcttacaggggtaccccttcacctaccatactccatgtcatggaacgtattgttgtttgtgcttatgttatgttacaaaggctatgctacacgtagggttggtaactcagaagcttgagtttagctgtcatagtgtgacatcaccagctacatgcaagatatcgacatgttatagcgaggccacgatgtagctcttgagctaggctgatcttaatcggtgtttggtgggttgaaaatttacttgtctttttttaagttattcaaatctaaaatttggttttcttatttcgctgtttcttttttgttcttcagatccttgaaccatggtccatgttttttcattatctcagtgagagccaatagatgttttatttgaacgaattaaaatgtgtgggtaatagtaataggtattgttctgtaatagctaattgttttgtcttttcgtatttgaagaaaaattgaatcgaattagatttattatggaaaaactggtcttagtagtagtggagagtttgtgtgaaaatgactttcagctaccacttttttcatgaaatgatcaatttgtaatacaaaattttcatagtaattcaacataaattattttgaaatgagcagacaaccatatcgttcctgtacatccagaattggctcgattgctacttaaaaacatgtgcaattttttaagtcattgtagaatgtattgattttagaggattaagaaatacccaagctcacaatatggctagttagttctgaacgcgcaaagatgtagcctagaggggggggatgaataggctttcctgaaaattacaaacaaatcgcagcggtaaaattcaacaggctcggaacctccaggtgtagaacaccggaacttccgggttgtctgaacagaccggaacttccgaaaaacctaataaactaacagggacttgagctgattttgacgagatgaactacgtgataatagagcagtagcacaatcacagtagcatgcacagaaacatcacagaggagaaaaagacgattttttcccgaagttcagattttgcaatcctactcttcgttgaggtgctccaaggagccgggtctcgattaaccctttgcttcacttatgcaaagatcctagaagaagtccacggccttcaactcaacacccctagcttattttcaagaattgagtgaccaccaagatccaactcacaattccttctagagaagaccacaagtacaagttgctctacctaggacaacctctgaaaactcagcacaagaatctttactcacttacctcgtttccttgcggaggtgaggagtaccttcacaaactttcctgggacatccacaagatctttggaagctcagggtgacacctaaccgtctaggagaagatctccaagagtaataagcccaagtcacagcccacaagatatccaaagtgctcaatcaaacctaatcttcaaaccttctccaaatcactcatgcactctcatctattctctcaatctcacaagataggctctagatttgagtggaggaagcaaatggatcttgggagaggctagaaaaccctagggcatgaaagaactgaagtgaaatggccaaagggtgagctggggacgatctggatatatataatggctaggtgatgtcatctagccgttactcacatttttgaactggaaagggtccggaacttcctgaccaccggaagttccggtcaacacttaggaaaatttcgccacacaaggtccggaacttccggctagccatctctgtccggggtagggctatttccaaaaatagcccccaaaaatattttagcacttggatctcactaagagcacttgttgtatcccagaaccacaccttgaacccctcttaatagtacggtttttcctaaaactcgattgcaaatattacactatcctatgcacccttcgagctccaactccgcttgcatgtttgttgggggggggggggtctcgatcacttacaaacatcttgggactaaacacctgagtatcctcaataaaactcattagtcccttaaccctatttgtcattaatcaccaaaacccactagggggataaatgcaacttcaagttctaataaaaaacaatataggatggtcttaggaagataaaatggatcatctaacaaagtgtccaagaactgaaactagaatcgattgtcaagttcgcatgggtgttgtactagatcaagagaaggggaaatataaagtggctgatctagttttggaacacaatcacatccttcagttgttagaaacctcgcacttgatggtgtctcaaagaaaaattttagagttacaagattttgaaattgagatagccaacgatgcaggaattgggcccaaagcaacacataagttggctagtatccaagttggtggttcacttaatctcagttatactctccgtgaccataaaaattatttgcgtgtaagcgtcaacgagagatggcatatggtcaagcaagaagcatgctcatgcattttcaagacaaaattgctgagaacccgtcattccaatatgcattgcagatggattgggaggaacaaatagcaaacatattttgggttgatgctaaaatgatcaccacatattttggtgatattgtctgttttgacactaattttggaacaaacaaggaaagcaggcattttagtgtatttgatgggttcaatcagttcagggaaacaatggtttttggtgttgttctcatgtacaatgagacatagaccctcctaaaagcacataatggcaagcaacctaaaacaatctatactgatcaagatgctgcaatgggaaaataggtaaggaagtgtttttagaagcatggcatggtttgtgcacttttcatattatgcataatgttgtcaaacatctagctgaagccgacgatgaagaatctagtacttctcccaaacaaacaaccgaagacaatgagaaagaaccaagtattcttgcagattttagtgcatgtatatttgagtacgaagaagaggaaacatttgaacaagcatttaacaccataagagcaaaggcgagcaagcaaagttggttggatagtatatacaaggtgaaagaaaaataggctgaatgttacatgaaggatgtgttcacattaggtatgagaagaacaattgagtgagtctaaatagtgaattgcagaggcatttcaaatctgattttgatatcattcgatttcttaagcattttaaaagggtggtggaagataagtgaaaaaaaaaagctaaatgctggatttgaatcaaggaagaaaatacccagaatcaaaatgaggacacctatgctaatccaagctagcaagctatacacaccaattatatttgaagcttttcagggtgaatatgataggtccatggtagcatgcaccacggcattggacagcaacaattgctatcttgtggcagttggcagtcttgaagaaaatttagctttgagaaggagtacagagtttttgatgatcctttagggcaaactagtacatgcagctgtaggctattcaatagaactggaatattgtgtggccatgctttgaaagtccttgatctgataaatatcaaatctctcccatcacaatatgtactgaagcgatggacacgtggagcatgtagtgggacagtacaagacaaccatggacgaaatataatagagaacccaagattaaatgatttgcttcgctacaaagatatgacccgcaaatttctcaatttggcacttcgagctgccagccatccggagtcatccttgttagtaaacaacacacttgacatccttagcaagcaagttgaagaacaaatcaatgcatgtactgatacaactgttccagtcattgctcccacaagtgttactcctccaaatgatttggtgagtatagcatgccggaagaaaaaggaggtgcaaacaaaaagctcgaagcgaaaaaaaattggcttgataagatgcactccacaaagaagggaagtaagaagggaggtaagaaaaaggaaaatggttcaaaggtatgtgataacacaacatatatttgattctctttcaccgtgctcaatgggaacatgttcagttttatttcttttatttgaaggaacaagaaactgcaaagaagggaggtaagaaaaaggaaaaagaagcagcaggggcagaaacaacagcaatacaagacactgcagcagtgcaagatatttatcctagtacttctttgctcatggaagaaatatctcaaccatacatggccatcaataccttctctcggatattgacgataatatttcaaactaatacaccattttaatatactatacatggccatcaatacattctctcaattgttcatctgatccttttattttgcagggggcaatcacagatgatgttattgctgatttctagtagtatggatatttcctgtaatctgaatgtctttttgcaaatatgtatcaatgccttttggagaatagattgtttatgagaatagcttttggagaatagctattgtcaatctctgaacagaccattttatgcatctctgaacttgcaacaatcagcattactttttattcaattccaagaaaatttacaacacaatatcaatctatacaatttgcatgatttttgctgctttggatacaatcacaagttacacagtcttgttcccgtgctcctagcctactatttcttcaactttgtcggctgcaccacctgttggcaagaccttgaggcagagcagagcagaccacttgttccgtgagatacatgacgattatccctcctacgctcctctgatttgggacgcacagcaagctcttgctccctgataatcagaacatagatgtgtcactacaataaccacaacgaacagcaaacttcaatgaaccaaatgatgtgacataacatacattcattcatctgtaaatggacttcaggtcggagtttcaatttgatgatagaatttctgagtcacttactgatcaatgcctttgttagctatctatgtaaccccctaatgtaaaccggcttgcttcctctctttgaatgaaatcggcagtgctcctacaacaaggtaatgcacagacgccagcaacatacttcctccgtttctaaatatttgccgtcgttgactttttaaaatatgtttgaccgtttatattatttaaaaaaattaagtaattattaattcttttttatcatttgattcattgttaaatatatttatatgtatacatatagttttacatatttcacaaaagttttttgtagaattgaatcacaagaactaagccaaccagaggggggcgtgaatggttggtatacccaaaaacccaaacttttagcggaaataaaagttaccctcaaattcgatgtagatcggtctgaccgaagttgatccgccggtctaaccgcgctcgcgccgccggtctaaccggtgttgatcactcggtccaaccgcctgaaaatcgtctgccgcatgtgaagtcgccgccggtctgaccgcctcgctctagccggtctgaccgctggtgcgtcgccggtctgaccgccgatgagtcgccggttagaccaccgaaaacccggtgaaacacaaatcgaagaactctcaaagtagatgacaactttattacttctctctgtgtttacaaagtgcaccaacaacactcctcataaaaatctcgactaaactcgaaaccctaactaaactagcaactcaattgctctcaaaagcgataccgggaagccccacgctccccctctatttatacatgaggtaggtagcctaaagccacgaaccaaactcatactaggagtcctaaacaccttaggaaaccctctagtacaagacacaaactttacataaccaatcgtaccaaattttgactccttccaaattcaactccgcatgccatacgcacacaatacctccatcgtatgccatatggaatctccatcaaccacgtgcatcaactctagccttagtatcccgtatgatatctgaccatcacggacatcgtcttaccaccaagccgattcccggtccatcaccgcaaatactctcccgaggcatcaagtcacctacacatgaaataaacaaagaaaccatattccgagaccaagctatctccaacttgactcattagtagcaaacaacagtattacatacgtatagtatccatctagaagccataaccatgaaacaatcacggatatccaaagaaacaatccgaaaccaaaactgacgcagcatcggccggtcagaccgcgggctgcgccggtcagaccgcgggccgcgccggtctgaccacgcaatacacgccggtctgaccggccacactagcctggtctgaccggaccacaattcaacagtatcctcctgtagatcacctgtgaaatccaatcatctccaaaaccacttcgtgaataaattccaaatatcaaaatcaataatcacagatgccaattgttcatcacagaataagaatcaaaacacacattgatcttatatttttaaataagataaacggtcaaacatatgttaaaaagtcaacagtatcaaaatatttagaaacggagcgagtacaaaatatcttgatcaatcaaatatagctgccacattcagcacggcatgggcgctgggccgcacgcctccgatgtaatctgatgttgcgcccggccgtggttgctacggtgagcaaactgctgacctttcttggcacaaatttatcccgttggtcttcgacatcgatgagatgccgccctccaacctcctctattacgacgaccatagatacaggtcagttatggtcgctcatctccacaaaatcccaaatggaaatcgaaatttagggaaaaaattgcagtcattgggagtgtgttcgattcttcaattgagatactcacatgtgtatattgtggaattttttattttttaattttattaatagacctttctaaaaaaatatttttaaatccgaaccttttgaccacgccagcccgtctggcgtagccaaaaaactatatcactccagccggtgtggcaggcctttgccacgccaacggttggcgtggccaaacaacactgccaagccagccactcggccggcgcggccaaaaggttcaggttttgaaaatattctttggaaatgtgtaataataaaattataaactaaaaagatctaaaaaataaaaaaaatcttgattgtgggaagatcaggtcttcagaaaagaattattgatatcaaagcttgaggtgaaggaggaagtcactgaccaggctcttgatctgctgatttcaagttgaacctgtggcagcggccgcagtagctgttctagaaccgagcggcaccgactgtagactgtagtacaagcgagcggactgcggggacggctgtacaagtagtaagcagtatttggtacttctccgttctaaaatgttggacgccgttaacttttttaaaaatgtttgaccgttcgtcttattcaaaaaatttaagtaattgttaattctttttctatcatttaatttattgttaaatatacttttatgtatacatatagttttacaacggtcaaacatgtttaaaaaatttaacggtgtcaaacatttagggaaggagggagtattttggtttagttcaggtggttgcctaacttgccagtacttggtttttagcttcttgttcagtaaagaaaatattatatatactagagatataaatatagattctaaccacactgttgctgtaaaaaatgtttcgtaaaatatttttgatttttcaggttgcagtcggaatctagctgcaagaaatcagctcagatttcctagggctatcaagaagacactatactaccaagttgctcgacagtatttgtttgcaagatcaatcccaaatatatcttaggtgatttcttgccctctcagaatactgcaaaagaaaataaaatttaagattgttgtcttgtctttgtgcctttgactggagaagaggctgtgcctccatgatcaatattccttccttctacatttttaacaattgagttatattgaatggattgtccgtaccatcaagatccagagattgattaagagcgaggataatagtatagctcacttcatactattagtccatcttaaaatcaacatacatatataatatattagctataaggttgggtataatttccttctcctgtctctatctctcacttatacatttaatgtatttatcttagagattgtgttaagctagctcttgcatgagagccaacccccttaatttttttgttacatctcttctccacataagcttatagtgggcttatagctcagtattatacttgctctaaaacagttcaaaactggaattggtgaaatcaatgagagtctttatgatttgatggctgcatatcaatgagttttttgtaattcgccacctcagatcagattgaatctaggatgtcacccaaaattcagagtctgcttcacctagaaagtcacccctaattcgtagtgtaggttttttttgaataaaaatttgatgacattattagctaatgtctaattgaattgatacgtacaattcccatatagttctttgtcactgaattttctatttttttcctcaggaatgaatatgatcagggtagaacataattagtgctctttaactccaaaagaagccagaaaacaaagggaagctcaatttgtggtatgtcatacatgtactctttgtccattgcatcacaatgttaacatgatcaaatttgacaagaccaacccatgtttcaggctgttcttccaagtttaaggcagatatacctgcatttgcactgtttgaggaattgagaaaggaggctgaggctgtgcaaccagtgccagtcaactactaccttctagcatttcacttctggtcaaaggggtcaaatattcagaaagacatcagtgcttctgttgactacttcactccacttacaaagtagtagtatattgtacaatataccaaaatgggacagagggagtagtgtgaaaatgggacggagggagtatgaaagtattgctctttacttcactttattattgtacttagactctcagcatggggaacacaagttagataacaggaaatcacaaggacggtttatacagtttagtgctatgatttttctgttaacgcagtgcttgcaaaatgtggctaataagcttgtgctaaaattggtttcctatatttcaaactgattatctagacaattttatcacaagcagggcatgcttcctctcctttttttaagcaacccaacattgctggttttatactaaagagagggtagcactgtacaacaaattataattaggaacctagagaaaaacagaaaaatgtaggcttcagcatagtgccacgccgcacctactgtatatcctatccttgaaaaagaagggtaaaagcctaaaatgtttgccaaattattctatgtagatttgaatgttatagttagatttattttacatgtggtggatctgtattgcccccataaccatgtcctccctatcaacaatcactgacaagatttcctcgttatgttggtggtttctatggtacctttctttacatcggacaacattatgacttgctatgcttttgaattctctcttctgaaccttgtttagttttaaaacaaggcagctctagaatgactatttgatactgaagataacctatacaacttggttttcagagaaggtaagtttcctcatgtcccttaaatcaggttgtttcatgcagctaaatgattctacaaaatagaatcttgcaactggaacctggctttgcatccctcgaagtttactctgtaactgatatgttttctttaactgacaacaaatgatactgatagctacccaacattccaagattttcaacttcatgctttttaatggattttccatggtgtgaattgaccttttgtaggatcattctttatacaatgaatttgtgtggatggagaaattttggagatctagagaatgatggctttcaggcttgccaacgaagagatcctgcccttcaattgtttatcatacacagttgaacttgaggtatcgctacaatgccaccatatttccagtagtgtctgttgattgcaaagcctatgggtagagagaaaccttgttcatttccttcttttgactgaactcacaaggttcctctctgtccatattatgattgtgtttatcacaggcatatacaaaggtagcagatattagaatgaagttaatggaacagccatcagatgctctccacggcacaatgcaatcacagctctgaatatagcagcaatgaaagtaaatggagagaaagggtaattgtatactagatgatctcattagggaggcttgtttcattttgacttgaaagatgatactgttggatgtaattttgatgaagaaaatggtttatctattttaccttggttcaaatgaataatataatagaagaacgtcactcacaatcacattgtatgatgtacttactgattattatgtttatatagaaaaaaaatatataaataacacgcttcttccaaacatagcacacccgtagcgatagcacgggtattttactagtaaggaaaaatgaatgacaattcaagccacaagaaagtgaaaagaaataataggcaactttcaaatagataaccgaataacctatgctatatatgtagttgcgttgcacaagcaaagtagttttgagtgacaatcacttgatttgctcaccaactgctagtattttagaaagaattgagcacatctttcaatcttccatcagacacgtctataagtataagcttaattaagtgctactccctctgtctcattttaagtgcagctataagttttcgtgcctttcttcctatcttaattacattgaatgacctccttcagttattccggcataagtttccgtgcctaactttaatcgtccgtcttatttaaaatattttttaaaaaaattaaaaacataagtcatgcataaagtaatattcatgttttatcatttcttaacaacaaaaatactaattataaaaaaatttaaataagacagatgattaaaattgggcacggaaactagttgcacttaaaataggacggagagagtacaaaattgtgcacttctgcaaaaccaaacacaaacagaattaccagtgggcaacaagcttccggatggaggcggcggcggtgagcgcgtccaccggggcgctgaacaccctcctccccaagctcgccgacctcctcctcctcgtcgccggcgagcaccacagcagcaggcgcgcggtcgaggacggcgtcgagcacctcgagagcgagctgaccagcatgcgcgccgccctcgagaaggtgtcggcggcggcggcgccgcccgaccagctcgacgggcaggtcaggctctgggcgagggacgtccgcgacatgtcctaccacatcgaggacgccatcgacacctacctgctccgcgaggccgccgccgccggacgacgaccaccaccaccaccgtgctgctccttcgtcgtcggcttgaccagctcggctcgccgccggagccgagccatcgccgccgagatcgagcgcatcaagaaggaggtggaggaggtgagcaggcgccgggaaaggtacaggatcgacgaccacgtcgtcgccgtcgtcgatgacgctccggtggaccgccggctgccggcgctgtacgcgaacttcgcaagcctcgtcggcgtcgacgcctcagtggaggaggtgatcaagctgttatccatggaaggatatcaaggtgcagtgatgatgaggcgaaagctcaagctgatcgccattgttgggccaggaggaatcggaaagacaaccctagctaatcttgtgtatcagaagctccatggccaattcgaatgccaagctttcgtctcggtttctcaaaagccaaacgtcaaggctgttcttagcagcatactctgtcaagtgagccaactcaaatatgaaaatttcagttcttggggtgagaaggaaatcatcgacaaaatcagggatgttctcaaggatatcaggtatgtaaaccatcactgaatttttgggtgtctttggaagttttagatatggaaaatgaattgcatccccggcatctgcatctataaaatgcactgagtcaaggtgtctttggagtggctaaaaaggtcaatttcgaatccctgggcttttgtggaaattggaaaaaaaaatgaacctgaatttctaaaccaaacattaattcaatctaatctactgaaatcattcaccttttaactttggttacaatttaattggaatgttttctgggtgacatgtcagcctctggaaaaattattgaatttttaaaatagtaaatgcttttcagaacatacttgaaaaattctagaattgcacttgaaatatttacattacatatattatgttccattttttagacactgtttttcatgggccaactatttttaaatttatgtactaatgttctaagttcagatgtggttacaaagtgggccacatcagtgacacttacccaaaactaatctgtgtttgggacaatgtggaaacgaatgattgtttctagcttaaggtttaatatactcctctttctatgtttattattgtttatcatatttgtacaatttaggttacaactaaatcactacaagtatatgtatgtaacccatgcaaccatttatctaagtcactacaatgcaaagctctcctgcacgttcgaaaaataaatattaatccttcttcaactaacatactttgaaattataggtacttcattattattgatgatatatgggataaaccaacatggcaacttctaaaatgtgttctcatcgacaatgatcatggtagcaaaataatcaccactactcgcaacatggatgttgcaaagttgtgttgctattctgatgatgttgatggtaccatacaaatacaacagcctctttcagttgctgactctgaaaaactactatatcacaaagtattccataatgaaagatgccctcctcagcttaagggcatatctcagaaaattttgaaaagatgtggtggcttaccattagctataattactattgctagcttatttgcaaataggcagacacaaactgaggaccactggaactcggtatgcagttctttccatagcggacttgaaagtagtactgatgtgaaggacatgcgctggataatatctcttagttattgtgatatgccttctcctcttaaaacttgttttatgtatctcagtatatttccggaggattatatcatcgacagagatgacctgatatggagatggatagctgaaggttttatccagccaaaacaaggtacaattctatatgaaaaagagagagatactttgatgaactcattaatagaaacttgatccaaccgatatgcattgatgtgcatggtaaggcacaagcttgtcgtgtgcatgataccatattggaatttatcgccggtttatcaattgaagaaaattttgttgcaattttaaatggtcagtgttcgacgtcggatctaccgaaaaggatctaccggttatccctacaaaacagcaaggatgatattacaatacctgatgcaaccgagagattttcccatgtgaggtcactttggcaaggtattgatttgaagatgcccctttcgggctttcgagttttgcgtgccttggatttaggagattgcagcagtcaaaatattgataatataggtaatttggttcacctgaggtatctaaggttgcgtggtacacattataataagcttccaaaagaaattggaaacctaagatttttgcaaacattagatattaagcagacaagaataaaagaattgccatcaactgttgtacatcttacacaacttatgcgtcttatggtggacacatggacaaagttgccaaatgggattgggaatatggaatgtctagaacaactgtcagagattgataccagcatgtatccaagtcttatgaaagagctaagcgatctgcccaatctacgggttctagaaattttgataagcacatgggagcagaccaaagaggaacaatttcttgattgtttaggctctatgaagaaacttcaaattgtccatatttttgctccagatatatcccttgatttcatgttgaataaagattggacccttcatgaactccaaaaacttacagttggtgttcgccgagaaagcgaagacatatttaagctcaacccattgtctgggtgggctgagtttagcccattctctatcctaccaaggtggatcaattcatcactcaccaatctctcatacttatcgatcattgtcaagatactacaacaaaaagatcttggagttcttggggacttgcctgcactttgttctctatacttgagcgtgacaggcgctttaaaggaaagattgatgataataggtcatagtagaggtaatggtcaggcaatagcattccaatgtctggctaacttcaactttacaagtcctgcaatgatgctagtttttagacatggagccatgcagaggcttcaaatgctttccttttgttttcaactaaaggagacaaaagtttttcacagtgatttggacatgggcttggagaatctcacctccctcaagactgtacattttcagattgactgtcgttacgctaggctctgggaggtgcaggctgcagaggttgcactaagaagtgcaaccaacttgaatctcaactccccaacccttgacttgagcaaacattttgaaagattgatgtattgggatggaatggaagagatccctgagatgaaaatattcaaagaagaaaatgtatttttttttgcagcaatcccttaaatttatttccttctcattttactgtagaattattggtttatcggtttgttgttaggttgggattgtcaagattggaccatggggtggaaatagagggaggcgttatgatattgaggtggctcctcaccatctagaaagcatcagagttcacagcgatttggctgtacattcatttgaatttgaatatagcgaccgtaatggacagaaacatgttgcgggtccttggggaggatatggtggtagtaatgttcatatggtgagcatgaatatttaccaagaaaaatttcttttgttagttaattagtacatgtttcccaatcatatgtacttgaataagtgagactagtcttggtaaaacgcagattcaacttgaatcttcagaggttcttgtggaggtttctggaacatttggtcgatttgctggatttcaaaatatcataacctctcttacatttgttacaaatactcaaagctatggaccttttggacaaagagagggaacccctttccacataccagtgcagtgtggtggccgcattgttggattcttcgggcgtgcagggtggtgttttgatgcaattggtatctatgtgaaccctgatctccaaacaataaaagacaagggcaaagtactgaactaagctcggattgtttcatttcatttattttcttttagctatgattccttttcgtgactgttgtttgcacttaggttgtgcttgccaagattgggccatgtggtggaaagggaggggaggcttgtgacatcatggtgcctccccatcatttggaaagtgtgacaatttgcagtaacattgtgatacactcactcacattttcttacaatgaccataatggagatcatcacttggcaggtttgtggggcagccatggtgggagtaatcagacggtatgtgtgtattccaaacaaaattaattctcaaaatatatgtacattttatgtttttctcttaatcatgataatgattaatgaattgttggggaaaaataatgaacttccctattcattatttacttgggaaaaaaatcaagataatgaattgttgtaagaaataagattgaagaaaaaaaatatatggtgcaattgtctcatagagaaatttagagaacttatcatgatagaaagacttcgagtaaattccaaaaaaaaactacaaatactttgaccaaattataaaaaaaactacatatttaagatgatctatcacaaaactacagatttaataataaatttatcgcaaaactacaagtttaaggctaagtatatcaaaaatacagatttaataataaattatcacaatactgtagattttggggtttaaatccttaacactaatgttatgtttgagttataaatgtctaatttttgtgattaaattggcattacgtgcagtttactctatctaaaaagagcattgggacacctacacaaaaactcttatttgttctagttagcagacgcatgaaactaacatgagttgcatactgtgtaactaatattgtataatgtctaactagtttttagacaaaatggcattaatttagtgatcatatctcatccatgtatccaaaaattataggaattacatgaatattccgtctgagcacaagctggtgacatttttcgacatgaatccatgttataccgttctaaagcatgtcatgtttttctgagtcatcttattatagtaattatttttgctttcctgcagattcaatttggcccttcagagttcataactagagtttatggaacaattggttcatacaatacaccatctgatgttgtaacatctattacattggttactaatgctggctgctatggaccttttggtcaagaaaatgggatccctttcgactttccagtccagggtaatggcagcattgttggcttctttggacatgcgaacctttatgttgatgcaataggtgtctatgtgacaccttccatgggaacaaggaaagaagaagaaaatgtattgatttatcagcaatttgtttgtgctctttattgtgtagaactttcttacatattgcattattttccccttttgttctcttttctttcttggtctatgtttaggttgggcttaccaagattggaccattcggccgacgtggagggaacccttttgacatcaaggtcacaccacaccagttggaaagcataacaattagtagtaacattgtaatcaattcacttgcattttcatacataagccatgacaaacaacaacacattgtaggtccatggggcagtggtggtgagagcaattatacggtgagtgtgtactgtatataaaagctactcctcctagttgtaaatgagtgactagctaggatttatatcagtcatgaaagtggtaagtattaaaaagtgctacatatatatcagatatccctcttggttatgggagggacaactctaaatataatcaagcatgcacccttgctacatatttatcagatatccctcttggttatgggagggacaactctaaatataatcaagcatgcaccctttggttataggagggagcaatttaaagataatcaagcatgtatagggtgtcttttctccttcttccattaataatatctgttgacaattaataatctccttgtgcatacagttgatttggtaacattttttttatccttcctgtttgttgtagatccagcttggtccttcagaattttttgtcaaagtttcaggaacatttggtccatttggtgaattccccaatgtcataacctctcttacctttgtcaccaatactcatcatcagtatggaccttttggacaaggaggaggcactccattccatgctccaatgtcgggcaatggcagcattgttggcttttttggccgtgaagggttatgtattgaagcagttggtttttatttttgcgcattatgacaacagtttgttctatgttgcatgtcaaaggttttagtagatttgtttgtgtgtgtgtcctttttttttgtttcctatgcagtgaagattcactagttccatgccccacaccatgatcctcactagttgttccggcaagctccatctagacatgtcatgtttgggggaatttctagaaactgcggattctcccagaatctacagcttcctaaaaaatcctgattctcgcacatgttataaaaaaatctatagttatagaatctaaaaaatgaacacaaaaaactgggaaacccaaattttcgacaattctcaccaactatttagtcattagatgtttctcagaatctcaagattggttttggttgacatggcattgatgtgaaaatatggcctccgcttaaccaaatcatatttttttaaaaaaaattgtaaatgaattgaaaaaaagtattacacaaaaaattatatccaatataaaaatattcgggccataaaatagttttgtgaactcactaaatgatttctagtagaaaaacttgaattgttttactataagcaaatttatttaggttgtaaattctctagtatacaaccatgatttgctcattaataatttaagtaaaaagaattgaaacttttgacatctacaaaataattaggagttatctaaaacacattactttggtatggttacatgtgaaagaaatatctaaagtgtgatattgtgaagaagattctataaatgatatatagtatttttgcagtagatctttcaggatcttggcaagtggacaagacagaattccatggaggaaataatttgcgatgatctttccaagtggcaaagattgaatagtagaaatagagggtgccctcctcccaaatgctacaaactagctactcaggtatatagcggttaaaatgctattgtctataaacaattttgtggttgtcaatttagttgtcgatgaaaaactccatacaattgtatagatggcataaagttgcaacacagcacagacaagatagcaccttggtcaactctctaccatcaccactacacttgttgtcgacgagtgcttgtcagcaagatggagcaccctcaccacactaatatggagcaaatagagaccggggatggcatacaggctatcacaccctgattttcgctttaggatttataaattatttaataaaatatttctagaacttgtattaaagttcaactaatttacaagtgaagttaatgtgggaaataaaatttcccaaataatacctgggttaatttaatttttattaaattctccatgattacactctctaaaattttcttagattttttagagataaaaaactaatttaataatacaaacatcatttcagcaattaatttaaatgaaaaacttattaaaatcatccagcatccgccgaggtacaagagaggaaagagtgtcgacaacttcggcactcctccaaaacttcccctaattctctacctatattctcaacactactaaagttacgcctaaagtatgaaagtgagttgtatgccactttgttgcgtgttgtgaaatgagaactttcttccttttatagcctgcttatgacggttgattaggtcggcaactcccacaaccgccattaagaggcatgaatcatggatatccacgtggaatgtggagatgaggggctgatggcggttcccttgaatttttcttttatttaaaaatctcatcatttaaaaatttggagttaaaatttggatcttattttattttgtgccaattagatctcaaatcctctcttagacatccctttgaatttctgtcaaaccctaggtcaaaattcaaatttaaatatttccaaaaattccttaaaatatcaactccaaaatcctagagaaaatcagaaaagtcactgttcattgggcctccttttctttttcattccctctccccaactccctttcactctctcctccacccacacctctctttctcaccgagcaggccggcccatggccttcccgcaccggcccagcccaccttcttcatcttcttcctcgaggcaaccacacacacgcaaacaaacagttcgacaaaatgtctcgcccaacgttgcacggccctcgcatcgtgtctgtgctgtgttgtgccgttcttcaccctcctgtgcaccgtgcctcacgccagggccgcgtcatgccaaacccacattgagccaaggtcgcgccgcaccaaaaccgtgccgcgccaagccatggatcccggcaaaatctgaccacgtccctcgctccggattccctccgggagacatggtgccacgccatcccacgtcaccctccgttccatcacgccgtcctatcccgaactcccgcggacgcgcgtctcctcactcgtcgcaccaccgttttgtcatccatctcctcccgggaaactgcctccgcatctccctctctctctctctctctctctctctctttcgcgtcgcgttgccaccgccgcatgatgccgctcgcgtccccttgctctgaggatgctatcgagctaatcccgaccgtagccgccatcggccgcacgtcacccatgtcccgtcactaatcccactcatttcctgctacccttcattgatgaaatgttggaacgtctagcaaatgattcctttttctatttccttgatgggtatttcgggtatcatcaaattcctatccatctggaggaccaaagtaagactatgttcacatgtccgtatggcacctatgcataccgtaggatgtccttcggactatgtaactctcctgcatctttccaaagatgtatgatgtctattttctcggacatgatcgaagatatcatggaagtcttcatggatgacttctcggtttatggaaagactttcggtcattgtctgcagaatttagacaaagttttacaacgatgccaagaaaaggacctggtgaagggatagttcttgggcatcgagtgtccaaacgaggaatcgaagttgatcacgctaaaatcaatgttatagatcagcttcctccccctgtaaacatcaaaggaatccgcagcttcttgggtcatgccagtttttatagaaggttcatcaaggacttctctacaatcgccagacctctgaccaatttgctagccaaggatgcgccctttgagttcgatgacgcgtgcctaaaatcttttgaaattctcaaaaaggcactcgtctatgctccaatcattcaacctcctgattggactctgcccttcgagattatgtgtgatgcaagtgactttgctgttggtgcggtcttaggccaaaccaaggataaaaagcatcatgcaatctgttacgctagcaaaactctaaccggagctcagttgaatactgaaaaagagctgctcgtggttgtttttgctatcgataagttcaggtattacttagtgggagccaaggtgataatttatactgatcatgctgctttgaaatacctgctcactaagaaagatgctaaaccacgtctcttaagatggattttgctgctccaagaatttgacttagaaattaaagataaaaagggagtagaaaattccgtagcagatcatttgtccaggctgcagatcactgacatgcaggaacaaccaataaatgatttcttgagagatgacatgctgatgacggttcgcgactccaacctgtggtatgccaacatagtaaactacatggtatccaagtacattccaccaggggaaaatcaatgaaaactgaagtatgaaagtcgccgtcatatatgggatgagccatacctatatcgggtctgctccgatggcctactacgaagatgtgtgctgactgatgaaggacttaagatcatagaacgatgccacgcctcaccctatggtggccattacggtgcattccgcacctaggccaaaatctggcaaagtggtttcttctggccaacaatgtatgaagactcaaaagaattcgttagaagatgcactagctgccagaggcaaggaggaatcactgctcgcgatgcaaagccccttacatacaatttgcaagtcgagatattcgatgtttggggtatagactttacgggaccttttcctaagtctcgcaactgcgagtacattctggtggcagtcgactatgtctccaagtgggttgaggctatgtcgtgcagtgctgcggatgcgaggcatgccaagaagatgttcacagaaaccatcttaccaagatttggtacccccagaatggtcataagtgatggaggttctcatttcattgacaaaaccttccgagacctcctacgagagatgggagccaaacacaatatggccactccttaccatccacagaccagtggtcaagcagaaacatcgaacaaacaaatcaagaatattctgcaaaagacggtcaacaaaatgggaacaggatggaaggatagattgccgtacgcgctgtgggcataccgaacagcgtacaagacacccattggaatgtccccatatcagatagtctacgggaagtcatgtcgactacccgtagaacttgagcatagagcatactgggccatcaggaattggaacatggattttgagggagcgggagaatggagaaaaatgcagattgctgaacttgaagaatggaaagagaaggcctactacaacgcgaaaatatacaaagaaaggacgaagcgctggcatgaaaaaagaatcaaaatcaagaaattcaagccaggagacaaagtactgatattcaactccagggttaagcttttcggccacgaaaaactgcgcagcaaatgggaaggaccgttcgacgtcatcgacacctcttcgcacggggcaatcacactctgcgacgactcaggtaacatatttaaggtaaacggtcaacgcttaaaaattttccttgagccaaatgaaactttagaagaagtggatgttattgaattagttgattatgaatagggatgaaaacggagcggatagtttccgtccgctccggacaaaaacggatacggatacctttcggatcggataattctcggatatttcggatacggatacggatattttctcccggatacgaatacgaatatggtatcagggtttccgtcggatacggataataattcggatatccggtgaacagtgctattcggatatccgcaggacccatgagacataccccatttctttctaactctataactttcaatatacctttatagattttaatagtagtttatctcttaacactagtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtccgatcatattcgattcttattcgtattcgagataatccgtatttgtttccgtattctagctatccatattcgttttcgtatccggtaaaaaatatgaaaacgaatatggtatgagcattatccgtccgtatctgctccgttttcatccctaattatgaaccatgatgatctcatctattgcatgcttaaaaccctgtatagttgccatttctgcgctttgtttaggttttagtcatagctattaggaccggaccggaccggcggtccgaccgggaaaaaccggaaccagggcctcggccggtccggtccccttaaaagatcggctgtgcaactgaaccggggaaaaccgattgaaccgggtggtttttatgaaaaccgggctttaaaccggagtggtcagaccgggctagcttttggtgatgggctcaggcgagggccgctgagcaaagtccaccaaaaatcgctggaaaaggatgtgggagtggggatttgaccatgggttgcgcggttgagagctgcacgcactagccaccacaccatctcgttgcttctgttggtttaagacatttaatcctataatactttgaactgcggttggaccggcctaaccagtggtcgaaccgacaaaccattgaaccgagagctcgaccggttcattctccggtccggtcttaataactatggttttagtgggcctagaaaaaaaatggaggccagccggacccaccagggttcggccgaaccagggcggcgtccgaccgctcctatttttgaatgatagtctcccccgctcgttcccagtttgtttagatgcgcgtttggaggtagaatgttcggatctcaccagaacacttcttcttcctccttttctccacctttgcacattctcctctccaattcaacccaattcctcgaatttccactcatacccaccaatggctggcaaatcattgatcccattcatcggctcttcatccaattccatgtacaacctcaccggagagccaacaccggtgaatcgactcatcccggtggaaaactacacagtagaaggggtgaatgcactgtgggtgcagccccttgcaatagtgccgggctcccctgcaaatttggagcccgtcgacgagctccctggtttggccgaaccaggggttcggccgaacccttctcggccccgttcggcaacgcgatccctctcccctcgccatgtcacgaagacaacaatctggcgggattcgcctgcgcgacggcctacaacgggagagctcggtcttttgaaggcacgaatcctttttcaagatgacgagaaggctgcgccgcctcccgccgagcgctatgtgggcaccctgttcactaaggcaggggatgaggttctccacaaatatgtcacacccaccgctactccatccactccgaaggaggagcgattccgcattcaggggttgcgaactcccggcggtgggtatggcaaaggattgctctggcctttgacggcatcggagaaggagggggcagcagaatcccgtagccctccacctatgaaggtgaagcgtcatttgacgccccctccagttgtgagggctcccggccaattccaagaagatgaggtgaaattgccggagccctcgatccataagctcgctgcgcaagtgaagaaactccgcaaggagaacatagagcttagggatcgcaacacggagctaggggtagagtttgctgaaactagaaataattttgatacccttagtcgcggtttgcgcgctaaaatcaagtgtgcattcatagagatgtggaaggaaaataagtattatgctaattagatgtttcctttcccatgaataaaatagtagtaggtgtttggttttatctttccaatcatacaagcacttgctatgaataatgtggctcattggtgttaaccccaatgtttgccaaaatttgttttgtttcatgtttaataaagttcaggttttgaataagtgtgggggagatatcccagcttctgacgtgcatatactctgaaaactgttgaaatctctgaacacctggaagcactgaactctacagaaagttgcagagggatcatgcgccagagtggtaccaggttcggccgaaccagtgttggccccaatccctctcaactttcacaggtaagcaggtgagcacgtccgtcatctatatatctctaccatggtatagtactagagctgaaaattcagaaaacaactggttcgagcataagaaagataaaatttcccactaatgaaattcttcatatgattgatcttgtatattcattattctcagctgaacttgtgcttgtgaacaatcatccatgtttagggaaccctatgcatctaagtaaatgctatatgagagatgattaaagatgaaaggaactcttgtaactcttgttatgactcttgggaatttgttttcaaaatgaaattgttttaaaagcttaatcctccaattgacttcaccttatgcctaccaaggccatatgcaagtacatcaatgatcaaccttatcatgcatatgactgctggacattatattgagctttgtcaaatttgtgtgactcatgttagatatcttttatactctcatgattaagaggtcattatcatatctacttcccatttccacatataaaatttagctaagcttctacactagaagttggctttccacaaaaatatctattcaaaaaaattcctagtgtatactatgctttcttctcctaaaaaaaaactcttggaaaaaataaaatgagaaaaggagggaaaggcatggccaaagaaaaaaaaagaagaaaaagaagatggaaataaagcttgctctcaaaacattgagcaaagttgaaaagaaaatatagccatgccccttccatgatcatgccaagaaaacaaaatggagagaaagtataggaaaaaggagaatcatttctttattccaccattccacaaaaatattttattcattttccaccataaagaccctggatctaagagtatgattgatgatcttcttgagtccatatttttggctttgcaatatatatgatgcaggtatgtcacgatttatccctaccaagctccacatattagccttagaatagggatgaaatctggcacgttttaccttggtgaggatccaaaaagaaaaagtacatctttgagagacaagagagaaagtcaatatgaggaaaagagctggtttgcgaaaatttataaaaaacccatgagtctgacagagaagaaagaaggactggaatcgagatcatgccatttatcaattactcgagatggtaagatagctacttataaagttcacaggtacaggtatggttgtgaatgatttatatgcttgattcatatcttgaagaaattcattctacactaacatttactcagggacgagtaaagggctaagtgtggggggttttgttggcggctgttaaatgccgattctataccgccaacatctgcataaagttcggataataaaacatccaacatagtgataggtgctcaatctcacatattccacaagtgttggtgtatatttgtatgcagaagataagcccgatgttggaggaaatctagactaaagtgaggagaattatgtatccatacaaggatgggttgtgaacttcatcaaaatatcaaagactcagcccaaaactctgcgaaatggatagaggaggatcaggggaggacatgagccaaaggacatgct

SEQ ID NO: 78932 - DNA, 10521 bp, Oryza sativa
cctcgcaggtgccgttgaccccttccggctagccggcgaggcgggcggcggcgcggtggggtggtggcggcggggatcgcgcgaggacggggtggcggcggcgtgcgatatgaatcggtggggaggaggagaggagttaggttaaaagggtctgcacgaatcttaaagcatatccaatggtccaaaattcgaatgatatggggtgggattttctgtcacaatatgtataaacagcccaaaaaaaatagcagccgaacagaagcttaatttaaaacaaaagaatgcaactacgtggcgctcgttaaattcttagcatacatgagttctggaggaaaacaacaccaaaaacactattcatctcttaaggaagtaatttgataatttctatgttttttcgcatggagctagcatccaaatagttgttcattgtttgctatcggtcgggcgcctacaatattgcaatttgtcagtctatcatcgttggatacgcatcaagatccatgcacaaaaccaggcttggcctgatgcaatgagtaacgggctgcatctgccctggcccgttaagccgtgggccatcaatttttttggataatggatttttcattaatttggcctctatatccatatatatccgtaaagaatatacatagccaaaaacatacacaagggcaatacacacaaacacacacaaaaaaaaaaaagctagaagacttagcttcaaccttcatcgatgacttattctattcatcccagcatgagaggggtatgaggagaaacaaaactagtttgtgctactcgtcgccgcaccatctccacctctatggaactcaaccataaactgctgcaaactgctatgtccgctttccaccgtcgccatccaaaaacccccttatgcagttgttgcattttgaacgcctatagagtaccacgaagccgcttgccgtcccaccaccatcttccgtggactatcaaactcaccgtagctcctagagcatcatggaaccatccagcatgatatacaccttgtctttactgtcatgagctttgccgaagatgcaccgctaccattcacatctatccgcagccagaccttgacgccgtcactcacatgacagctgctgcctctaggattactccgtcaagagcctccattgccatcatccttatatgcatcaggaaagtcgacggccatcgcacaccatcagcccagccatcgacgaccatcgtccactgccctcgcctgaccgtggtcagaacggggcactggagctcacctaagtcgtcggtgcctctaggacgttaccattgagaaccttcgccgccatcgtctcaacttgtcatggttgaaccaacaatcaacaagaaccttcgccgccatcgtctcaatctgtcatggctgaaccaaccaaccgtcgacagtcatcaccatgctattgtcccaccatcacaggtggagggctagatccctccactgttgttatcgccggtggcagagccgtcactgcccaacaccaccaccagcgcgctccctaccgcctagcaggttgccagcgtgcgctgccgctgccaccaccgcctggccggctgccagcatgtgccgtcaatgaggtatgcacactcagatgtggcaagaaatttgagattaagccatcgtccaaaacaggtttcgtcaaaatgccatcgtctaaaacgggtttcaccaaaatgcaatcctgcacgtaatttggtttcatccaaataccattctcaaacaggccacacgctaatgtcatttctcccttttattgattgttcgcccatcatgcagaacatataaattccttatcactatgtaggaaaattgaactgtatgctaagtagcaataaaatgtggcatgaagcatgtcagaacttcaaataggtttccatcacttgaacagatgaagttacaacattgttgaaacgcaggcatacatgagagcaatggtatttgcaactggcagaaacaacactttctacacacaaaatcattagcttctagtttcagtgtggcagttactgcagggctcaataacctttaagctaacactcgagggtactctcccctcaacatagatcctaatagcgaggagagccttctcagcttccaagagagcttccttgctcatttgtaaacattgacatgggtcaatcttgtcatttctcctgtcatagccacgggtggtgtccaatgtaaggtactctagagacgaagccttctcgagaatgtggttggcaagatcgatcatgctctttgcagaggaaaaaccggttatcatcatgttcttgagattgtcatggcggtattctgaagcacgcattggatgcatggagtcaccactcaatgcttcaaggatcgaatcatgtcttttagctggccgttcaatctgcaaaggattacgtcaatgtctgctttttttttaatgagcaaaaggtactgaataaaagttagccatattaattctctccctcttttatttagctactactttataggaataggatagtgatcaaggcaagtaatttagttgcaaagtttatcaaggccatcaatagtgtcaatatttattactagagttgcaacgtttttatttttttaaagaaagctcatcacatatattttaaagcccataaaaattatattatcatcatgccaattttgctgccactttgtaggtgtcagttgagttagccataggggtcagataaagatagggatgcaagcggggcgggcaagcgggtgtttttagcccgcttatctcacttgtagttcattttttcttctaaattttgtgctaccatatgaaaaatgaagtagtaagcgggtttttatgcgggtagtgagactacccacttgcatccctagacaaagtcttgtctgattgttcgtggaccacatggtaattgggtggcaaccaccaccagtaagcgtcttttaagatagtacatatgagatcagttgcatcatttgcagaacaaagaaatgttacatttgtccaattcaagaaataacaaaaaacatttgcatgaaacatcataacaaataattctttaagagaaaacaataaaatcttgaacataagtggtacctgataaatgatagatagctttgacatataaataataacttacacgcaggataaaagtctccaaggcaggagaagcatcaatgaaggaaaccagagaacaaaaatcatagcccggggacaaatctggtgtaagcagcagtatctccaagcacttgagctgcaggaatttgccaagtacctttggtgtattgactgtctgaagaaaaagaggccgcaaaaattaattgagtacagtagtatacagtgcaaatctagtgatatactccctccgtttctaaatatttgatgccgttgacttttttaaatatgtttgaccgttcgtcttattcaaaaaaattaagtaattattaatttttttctatcatttgattcattgttaaatatacttatatgtatacatatagttttacatattttttaaaagtttttaaataaaacgaacggtcaaacatgtgcttaaaaagccaacggtgtcaaatatttagaaacggaggaagtaacatgctattattatggtgtgttgagtgacaagtgcaattgagctaataagtaaggctaaaaccgacctcattacgtgttgatagataaagcttctgtatgtttggcgcaatggatggaagcttcttgctaccataatgtagcgcgtcagggcttccgtcacaaaacatttgcattttcttcacttgtaataatgcttctccaagtgagatttgtattggggggccagcatagatgaaagtagagagctttggagcactactgtcaatcacctccaattttctaaaatgcaacacttccaggtaattaagctccagcagatgggggatcttcaggacaacaatattatggcagtctgaaagtaacaatcgctgcaaagcacaggatttggatagaaagccgcataattcctcctcagtaatttttactgatcttaaacgcaaacttgtcaaggtactcatctgaccaatttgtatgccagggtggaaagaacagccaccaagtaaaaaagactgaattgagcttgctacccttgatagaagtgagcatgggaaatcataatccatcttgctaactcgggtcatttctagttcaaattctttgattcctggtgcaaacgcaatttgaagccagcggtcaacataactaggatgcagactgaaacaagggtgggttgtaagtttaaacatcttcactcctgtgccagcatgattcagcataatggggtcgactctactgatgaaatcaattgttagtttatcattgctaggtgctctcttatctatgcgtagtgtattaacattaagattgagcctggggtagaatctccaagaacgcagaaaacaacgagatgcacaggcggcacgagctgcatcctgcataggcatgagagtgtgtatgtgataaaggatgtcctgcacaagccaacaggagaggataaaaacattagaaaatgttttattaccactataataataactggcatactgctttttgggaatgaatagtagaggaaactatcaatatgctaaaagaacattttcaaattgaacatggatgcactgctgagttccgtacctctggaagctgcatcttggattccactgtactggcagattgagaatcatcgccacattgacaaggggagttgtctatttcagaagctgaagaagtagctccattacctgcaactaactaggtcatgatgcagaagggagcattttgtttgcacgcatataccaaagatggatagttggacataatttaaagataactataatacaacaaagacatatttttgtgcttgagattactaaatatgaagattaagtacgggcacttaaaacaagaaaaccattagctcatgattaattaagttttaattattttaaaattaaaaaaatatttatctgatattaatgcaacttctattctgcataaaaagtttcagtacgaaatataatagtttgaaaagcgtgcccaacggaaatatcttaatcggaaaaagaaggagaagggacctaattaaataagggttttcaactaacatagaaaatcagagaatcatcattgaaatcaaaatttgagcaaagtcacttgagatttaggccacctgatgatgcagagaagtgcagaacaaatgtgcacttgagatttgaacctagctagttagaagaatccgccgaagcggctgaatccaaccagtttgattgattttacccaccagggaagccgtgggagcccttccaaaggaacaacaggtaatcgaacctaaatctagcgggtgatttgatcagctacgaggggtgggggacaggaggaggcttacctattcgcggcggcggctggacgggcacctccagtatctccatatggccgctgcttagtacaaaacgatgaatctcccaagagggggaaggagcctggggcgatcgaggctctcgagaagtatcaggcgcgacgttcgccgggaacggcgggagcggcggcgcgcgagatcggcggcggcgtcggcggcggcggcgcggggaaattaagatcgcagagccgagacggatcggaggaggagcggctaaaggctaaagtgctaaacccaccgctcgtttgttttaagtgggtcccaccgagtccgactgttcttcgtacgagttcaccggattacggaaaacccaagagaaaaaggtaaaacccgatgaattttcaatcaataccatacagaaaccgactaataccagttaccgtacagtaacacatgtattataagatgttttgactttagccaaaatcaaatagcttcaagtttgactaacaccgtgtttagttccaaactttttttttcaaactttcaacttttccatcacatcaaaacttttctacacacataaacttccaactttttcatcacatcgttccaatttcaatcaaacttccaattttagcgtgaactaattacacccttaagtttataaaaaaaatagtaatattttcgacctaagataaatttattataaaaatatatttaattattaatctctatctctatctctactattataaaaattgaaaatgtttttgccagtactttggtaagtcatccgtgtatgagtcagtttttaaattcgatcgcttttggaaatacatagtgtatttaaataggtttttaagttcgttcgcttttgaaaatatagtaagagccgtataagaattctctttaaaaaaaactcgcatgctaacttaagacgatcggacttctaattatagctcatgatttacattattgtatttgtatataaacttagctaaacttaaagcaatttgactttaaccaaagtcaaaacatcttataacctgaaacagagggagtggtacgtattggtctcgcttttacaaaattcaaagactcttatcacattatcccatatcatattattggacttgtttggtgtgacataaattggccataccaatatttggcaattttaatagtgttttgtgggtgtggctatttggcgcgcgcactagctctccctccacgtgttttttttttccattttttcgctttttctttttttatccccctcctccccttgcgcgtttccttttttcatgttttttcccaatctttttaatcgttagcacatgtattttcaaaatatttgagtcgaaagttttcaaattttaatttgaaagtttttcaatctaaagaaacttttcaaatcttgacttgaaagttttcaaatctcgagtttaaagttttcaaatgtgagtcgaaagtttttaaatccaagttaaaagttttcaaaatttatcttacaaatttaaattttaagtttaaatttttcaaagtttgagttgaaagtttttaaatttgacttcaaagtttaaatcttagtcaaaagttttcaaatttaacttgaaagtttaaattttaagttgaaaatttaaaaattgagtttagagtttcaaattctgagttgaaagttttaaattctacgtatggcttttaatttttcgatagaaagtttaaaattttacatgaaagtttcttttagatatagatttctatcaatatgttagtaaaaaaaactaaggaaaaaaaggaaaacattcccttaattatcgtcattatcctaaactaactcggttagttatgggagaagataaaacgcgcgccgccactcgctttctcagtgttttgtgtcttttggtttgaagccaacttttgataagcctagaaaaatagaccatttcaatagttaacttaagctattttgggttttttttttttgcagggaggctattttggttttaatccagacacaatattgccttatcaagattagccatgctaaaactagacaaaatttagtgttgacaaaattggtaagatcaagttagactacaaaccaaaccagccctataattcataagccgaagaaaatttcacaagggaaaaatggaagataaaggtaccagcacattgctactccagcttgctaccagacttttaagagaagtcaagattcaagaataatataaaagagagaacacaaaagaaacacgtaagagagataagaaaacatagaaaataagcaaaaatcctgccatctaaggctaataataggcttttgctagagaatgcatatgctacagtctcatgcctgagtttacaggaagcagatttcatctgaacacaactgatttctgatctgacactcacagaaggttatccacggcaaaagaggtgagaaaatttacttaatataatctcagaaaagctgagagttcgacgcaattatgcctcaatatatttatctgtcttcctgtttgtacatttcatggcctgcaccacatctttacttgattacttctcactgtgcagaatcgaccaatctgcaatagaatagaacaattagcaggagtggtggaatagattagagagtcaaggtttcgcttcatttcatcatgccatctcatgctgcaagagacatccctgatccatatagctgacttatttgaatgcatgctttgcttatgatgatcagtgagcaaagctggaggcttccagaggacagcgtttcccacagcacagatgtggaatagatggagggaaggcattaaagcaaatggtgcttggggaccagttaaagtcatgcaattgcaagcagcatttagcaccgaggacatccttctattataggagacaacaatactaacacttgctatctaatggtaaccatttataaagcactaatagaacttaactaacgtggctaaaccaccaaccaacccaggatacttatgacattatagtagtcaataattaaagagacaaggagtcatgaatttgattatcagtgttaattacactatattaattcaaaagtaaaaatcagatagcatcggttagacatcagacaagttaactgacatcagagcagctcttctagcatgtctttgtgcccccctaaaggagcttaagttgtatgaaaacatttgccatacatagcttttgcaatcagttctggtggagagaatgttagacttctcccagttcctatatgttcaggacataaagtaagttccaaaatgataaaacttgaattgtccatggcattgctccatttcaccagcaaggtgctacagacaagcaatggcatggtgtacaacaaactagcaggccaatgttggactcagtacatgtgccaccaaggtacttcatgccataggctctgttgtttaactcaacatggaactaaaaaggaattgtgtagaaatattaactggcacaatgtacatggttgcccgtcatccaagccaactctatgtgctcgaaatgtgctcctgtattgtgacagccctcctgtattgtgacagctctaacacatgttgcatatcgtctatcatcctgtttgtgataaaatatcagtaattgctcgagtttggaggttttatacaacaggtcatttgatttcacaattttctcctttaaaccagtgaaatacataatttaggacaaaaatacatgctggaattcaaggaactccaaaactaaacatatgtttgaactctagataacacgtaagatcctagtccctagaaatgcaaattcacatttcctttgctaaacttggccttgctgaggattatggacttagattacaatgaggcaacgtgtatacgaggcaactatacaaaatatgcagaaaccatcctatattacgaggacacaaacacaggtagataaggcctctagcaggtgccacagaagaactccagaagggtaattttaccatcctttataaagtacctagaggtaccatattttctagtgtaaaaatttggtacctctaggtactaagtacctcaatgtaccaaaaagtttagtgtaaaatttaggtaccttaaggtactttatcaaggactgtaaaattcctcactccagaaacactagagcaaccataaaaagagtatgggaaaaaataacagtatttgtgcagcttaacaataaatttcggactatcttaaatcaccgtactacatgattgcatcatgtgacaagttgagcatagaactacagctcaaattcccaatttccattaaccataatcctgtgataattacattggcaaaaaaagatcctaattaaccatgtcagaacatatcacagtatcagtgaactacagtcacaagacaactccattcccactgcagattaaatggatcgagtgtgattgtggcaagttacctgggctggaaagcaccgccaaaaggcattggggaatggggacagcgtgatatcatgccttctccaggacaaggcagcatgaattcccagtggcaaatccaacggtcaacctttgcgctgagtcaaaatggtcatccagtggcttaattgaacagcctttagcccacaaaatcagaagattttcatttatggtaaaggattcctcactgtcatgttgtctgttgatgaatggagtccttaccttcaaatcagggtattcactatcaaaactggccatcaaaaaattttataacttaagagatcaggttcttcactctgaacttcaatgcaaagcaaggactaaatattggctttcagaacaagttccagtacaggaaagccctgattcctatctagagttggtcatttgttagtggtccatgcagtctctataatgcaaccagtttggattcaggaaatatccaatccctatggggtggatctgcatgctcagcagtactacatcagttggcaattgttggtattcatgacaagggatatattctcaaggatgctctcattcagttcaaaggaatatactggaatggtgccaatgattctcctcagacttaatctacttcatacttcctctgtttcacaatgtaagtcattctaggggctgcaggaatt

SEQ ID NO: 78933 - DNA, 19367 bp, Oryza sativa
agagagagagagaggaaaatgagagaggaggaaagtgagaagataagggggagagagagaggagagaagggggcggggggagagagaagaaaagtccaaattttttttaatattatgggagggaagtgctattttcctgcgcttttagattaggaggctcgcacgtgaaaatagagttatttttgcgtgcgggcctgttaagtgacccacacacgaaaatcgcgggtgatgacccggcttcgctcctcctatttttccgtgcagtccaacttacggaccacatggaaacaaaatggggtgacgtccaggaaaatcaatcatgtagtagtgaatgattttagttcttcatgtgaaagctgacatgaagcatttctgtcttgagttggagtcaccggtttagttcagttgggtgatgaaatttgctgatggagatggtgaaacaaattaaaacattcggtgttccatgttggaattgatacagccagttagttaattcattgattgaagaatgcgtttgctgtttctcctgattggattaaactggtgacattagtaccttgtcattgttatgggtttcctgtcctatgtttatacattttttttcagcttcttgatgtaatggaggtggccactactttatattagtcttttcatttcctttgtgtgattgctggggccatattagcattcttttctaaagcaaatgcgcatttccacttcgtgcatgttagtgctgatggcctacatcctacctccagtctgcccaatttttgttcttgacaggttgaaaaaggtggcactgttttatgcaaccagtgacaatgcaataggggatagtaggacttcagccttatctgtatgatgaagttttgttttagacaaagcctgtatgattgagtcagggggagcatggtgattgctcttgttgaagagtccttttcatttctgagacacgctaaagaagaatctttctcccgtcaaaaaaaaaaacctttctggacttcctttttctttatgccaatatgtcgtatgttattaatatagatatctgcttagtgacaagtgccttcgctctcatgattccaagatatgttctagaaccgtgagggtccatattaccgtctgatttcttaattgtgataattgctataggactgagcagcaagttatttgggaaaatagaacctgtttagacttgtccttggattaatttggtacgtcattatatgccccttggacatgaaagatcgtattgatcaagtctgataattttcaagtccccaccatcctctgttagtaattctcacaaaaacaataactaagtgtgtacaggtttatctaaatcatataggtacaaggaagtgaatatttcaatttaggtggcttggattgattaaattaaaagcagtaaagcaagcaactaattcaaacttaacattattattagggacccttattattattccactcacagtaatgtatctaagagagcaatatatttagctttattcaaccatatgttatgaacatcagcaacagaaagtgattcaacggaatgatagataaacatattactcactgaggcatgcgttaattacttgtgtagaagctcggtcatcttcagctactcaatgctaagctgttgttgctgattcatcagctatgtgtactctctctcagccgctcaaggcagtagcaaaaggagcaagcgcggaagaccagcgattgccagattggtctcactatggaccagatctggtttcttctaagagaaacttcctctgctactgtagacaggtgtttttggcctttatatacatgccacaaaatgatctttactttaatcatgaactcagtgccatgtatgattagttatattgttcaaattatgctttctagaagttaggcaaggtgctttgggaatattttcctccatcgaggaaattaaacttgggtggtgtacatattaaatgattaaactgttaatctataagtttccgttcctatagtttgttagttgctaccatttttcttggtttcttcggttcatcaaattgtctatttcctataaatttcaattctcaccagtcaccgtgtgactgcataacatttctatagttacatagccaactatttaatttcaaatcagcatctagcaaccattcttgatacctagaatttatttgcgatcattctatctgttcactatatggtgcgttacttcactatcatttcttccatttccttttcttttacaattcttttttttttgacaccttcttttacaattcttttgagaacaataaacttgattagtgccctttttttattaaagatgggcatatatctatacatcgttttgtgttttatcataagaaaactaatatgacgacatctcactatcaatcagattttttccttcatacatattctaggatgaaaatttcacaggaagatctcgactgttttgctattatacctagaaaaaattgcatattatagtagtagcttgactatttgattgcttttttggtcaatcagagtgttacaaatatgtaactacactcataatctctatttgccacatatccattgcacaccttccttttttttttttagaattctgaagaaaaaacatgaaatttttcagtgggacatcgccgcattgccaatcatctatcctgattgttaggctaatggtggggcatcaggtataggttcatgttgttaggtgctctcagaccatatacgttctttcatccatttttggttccagccattgttttatacttttgatgctaataatggtcacatatacccatcttcaactcaagcgatgaaaggtgtttacttttgcattgctactgtattttatttagcgctttccactaacagaatatcatcttcacattgacagtcaatttgatttacacacattttctttgctttagtgtaggaaaaaggaaaacataattattacttaattatcctgtaaatttcttacccttcatgcttaatttcgtatcaatctaaattctagggttcttttactctcgctgcattcccatgtaataaacacaaatctgtaatatcgtgttgtatcacttgatataactatcctcattgtgaaatggtgtacatgctggtttttgaatctcaataatttgggttgctttttcacatgattttgttgaccttgctggaagtgaacgagctgcacaaacacatgcagttggcgcaagactgaaagaaggctgccatataaatcgcagcttactgactcttactactgtcatcagggaactaaggtctgattttcttaaaaaagagaaaaaaaaactctgggtctgttatctcttatctgcactaatattataaagtagtcgctgggttacctcattgcactcatgggttagtctcagttctaatgtcatcagactgttatagatcattggatcatatggattagatccttctttacaatttttatgctcttagctggtagatcattggatggttagtatggtcaattatgggttgtatgttaatacggtgccatcaaagcgacactccaagagaagcagtcgagaagtagctagcgatacaagaaagacaccaccaataacaccagccataaagatcgcaaggttaagagcatctccagcaatggaccttattttaaagcccctaaaagttaaatgagggctgcccccatttcttaaggactaaaaaatgtctccaactccagcagtagcccctatttcttagtccctactcatgtttatcttgtattttaaaatacaatccatatacagtacgtttaacaccacaaaaattcgaacacaattatttctaactcacataatataaccatacttaaattcactatttcaaacactacaattcgaattcaaaattaaaatttttaaacatgtaaatatggtatgggtacagtgccatatacaacaacaagatgcaaccaagattcgtaattcaccaatgaaaatgaaaattcaccaagtttccttccatctctcttctttcaatttcgcttctttctctttagcgtcaagcaaatctttcatcgcctctttgtatggtccatcttctcctccgttcttcaacttctcctttgcttgcttcctacctattggtctctttttagcactcggctgagataaatcaggagctgtactcttgctagcatcatctccttcatcttcttcaccagctctgtcaattggggtcgaagacttcctagaccgtggcctcttgtgggattctagtgtttgaaactttggagaattcctcaacttgtgctaacaatgattaaactgaaatgccctattctttggtgcattggacgagtataatgcctcagcttcaagaacttgcaacataatttaagttttagttcacatacatacaagattgttattaataataataaataaacaatttaacttacaagctcttgatgtggtatgccactgggatgtcgacgctcaatttgattgtagcaaccctgaaacttgcttacttccttctgaatgttaccccaacggtgctcaagagagtttgcattcctatcagactcaaaatcacggttagcatggtagtgctctgcgatcctctgccaatatgccttccctagttgctcattaccaataataggatctgagctaatgctctgccatgaaatgcacaattgaatgtcctccttatgagcatagttgcttgatcttttggcacttccttttgcaccatttgttgaagtatgaaggtcttcatttggcattagcacttcgacatcagtatccttggacatcatgcgcacaaaggaatcacctccacttgtcattgcaatctagtcactgcaataaatatataaattgacaacatttccaatctatctcagaaacatcaacaaatgattgtaatgtacatcaggttatactgtttgcaatatgtatttttttagataataatatgtatttatttagcatatatattggttccgcagtactaaggactcagtgcaaacacaaatttatttcttcaatattatatatgctccacaagattagctctctgacatagaacaagacactgcatataaaatatgaatgatgacaatgtacattttgctatgcgaatgattttgatgggcctagacgcctagtaagcccataaagatcacaatcaaacaaggagactcagacatacgaaactgaactttactattgtgatttgttttaatcaccatcatctctgaatttttttactgcagcatgtgtgcagccggtgatagatagctgtcgatggtcggcgctaggccttgtggacagcgggtgagcagctagttcggggacaacgtcgagactcacctaggcgtgatcaatctgtgacgacgcgcgttggccggagatgcaaggaggtcggcgacagtgagtgacggagtaaaaccgatgattgtgatggcttgaggcggcacactgtgggatctcgccaaagtttcttgcagagggatgtcgggtggtcgccggctggagcaaaacgacctggcggcttgctcgctgggaggttgtgggaggatggcgatgatgcgggagggaggatgacgatggcgcgcgatcagaaatttcccccgccaaaaaaaaagaggatggggctgtggggttgagccccccggactgggggctaggagtgatctaggggcctccctagattgggggctctagtagggactctgctggacctatattttttgcatcaactctcaaaacttatttagccacactacgtaccaccacaggatataccagtacctcagcctcggcagactcctacctccgctgccaccacaggtggccggcgcgtgccctcgctcgctagctgccgtcgcctcttcatctttttgtcgtgcgtcctgtccgacgcatccaccttccaccgccgtgtaccgcacgtagagctccggtgctgctgccgcttggtgctcgatggcaaacggcatcgatcccatcggcaaccaataacacgacgcgaggagaagccaagaaggtttaaaggcgacgcgtctgtatgtaccgaggaggaggagagggcgaggagggtgttgccggcaatggtgctgccgaggtatatggcccgacaacaacgtagaaggcggtccattaaaaaaaaacaacgtagaaggcggcgatgaggacagcgaacaccccatgcccaccacctttggaaccatgaaatgagaaccgtgagggcataatccagggatagaaaattcgacgggggaggacggtggcaacttggagggaatggagggggagctgccagctgcctagccgtggcggcggcgccaccgtggccgagccatcgccaccgtggtggattggccgtcgcccattggtgatgccacggtgagatcagcgactcgatgcagatggacacacaccgtcgttgtcaactctgttctactccctccgtcccaaaaaaaaaggcaaaccctgggtttccgtgctaatgtttgactgtctgtcttatatgaaatatttttataattagtatttttattgttgttagatgataaaacatgattaatactttatgcacgacttatctttttaacttttttcataattttttcaaataagacggacgatgaaacattggacacggaaaccagtgtttgtctttttttctgacggagggagtatgtgcaaagcgtttttttttttgggggggggggggggcatgtgaatgtgggggttgtgaggtgtgtctgagaggtggggtaggggacgcagccaacggtcggctccagccattagtattccggctgtttgaatttcgaattggaggtttggggctcgggggcatctggaccgttggatggtatactgtcggccagatcggaaacaaagtggggctttgactccctaggccccagtcctgttctattcacctattccatctatttcattaaaaccaacataaaataaatagaatatgaagttttaatgaatctggacaggcttctcaagtaacggctatatgtggcatatgaaaatatatcgaacatgtgacgcttaaaatcgaaccaacaacaccgtaggcaggagccaaatcggtgtaaggcaaaattaaactatattttcgagttgaatcatctgaataaaattttttttaacattgtccaatggactcaactccatctgaatagaaaatggagaagcttttagttctttttttttctgtcagtgcggcccatcatcaatttatacaattgacaaggactaagatcctgatcttccattagatactagataagtcgattatggagactcaacattgatgatcgaacctctcgcaaccattgcaccacgattatggagactcgacattgatgatcgaacctctcgcaaccattgcaccattcctccgttggttatcgcccgaaccgaaacacagatgacctcgctgataaagctatttcctgcaagcgaatcgagaacacaagcaatagagtagaatatgcaatatgaatatattgcgaatttaagatgaatctcacaagttggggttccacaaaccgatgaagggaaaaactgcaatatcagaataatctaagcaaaaccccccctaatccgatgatgtctactaattaagtaggttctagggtcgacctaggacgtggatgcatccctaatggactccaacacaatacacaacccaacgggcctaaagatggtgacacaacaccctgacaaattctggacgctctcttgtttcgaccatttccgttgactcagaagaaattttgacgtgagacctggcctattggaaagatggtcttattggctttccatataaatgcacggacgtcaataaagaatccgaataaggtctgaccgatgatcttagtgcaaccttctcctggataacgaggtggactcaatatgaattgggcctccacctcctagtctcgtgcgtatctaaagtagtgatgtcctcgtcaacaatacaataacactcaatgaatcaaactatacactacattgcgctgaatggctcgattgtacattagagttggacactgggtatccatacttgaggccccgtctgcaacacagagaaacaaaacacttaaaaaaattgacgtttgtgaatactcgagtgaatattaatttcaagcaattttcacggtttgcacgattcacaaatattatcgttgtaatttgtaaacacattttatagcaatgtaggagttgtgtatagcagaaatatgatataatacaatgttcggaaacaggtctgaacgtgaacatgataattaagtttcatttgaactttccacgtaccccgatcaacttgatggtaaaacagagtatatttgaactggcttgcgtacagtacaaataccatcaagcatggtgttattgaattctcatatctagagagaatttgatttatcgaagcaagctgccaaactgtaaacccaacataattacttataagatttaggtttactccgttagagatagcgtttcaggaattcgtccatgcaggtgtactgaacctctgggtagagcagagttgcttcggcaccatggtccccaatgtcgaagtttgtcaagcaaccgtcatagaaaatgtggtagtaatgtgttactgccacttgaatagcaaaattcaaatctgcttgcatcaaaaattgcttatcaacgacaagttaggttaatactatgatatatgtagtttgaaatttaacccctagagtaatggtattaaagaaacatagttaaaaattggcaatatcaatttgaaaattgatagaaaacagcatcgtttgtggggtggtgttggagttgtagatctacgattccaaccaccaaaaatacttaagtcttggttccatgatatatacatatcaataagcagtttatggttacctttcattgcagccaaaaattcatcgctgggtatgtggactttctcaagacttttccctgtaagttcttcctacttcgctatcagctcgttttgggtgaggcaattatcttgtggtcttatgtagattgtcttgttcaaggtgcgaggatcatcgattgatttgattgtgtatgttccaatatcatcttcatccaaaaaaacgctgcatataatattgcagcttttggttagtatagttgaaattcatcaaaactaatattctgcactctacagtatatgcaatatatgtatactcggacacaattactgttagtaatattactgaagaataatgagtagtgaaaaggtagctatacaaattatttattattatttttttcaaaaaagcatgcaaataccttcataggacatgctatttttcactagctatacactaaaaaaaatcattatttacaacagattaaattgtgctcatggtataggaatctggcatgtggatgcaacaaattggctagttttttgtgtgtgtgtgttttaagaaaagtactccctctacttatacttacgtgctagtttaatgataatacataattcttataggaaaatagatctatttgcaaaacaaacaaaggggatataattatttgacaacaaatttttttaaaaaaactattttttttaaatttgaacccaataaataaataattttggttcataatttctagctaaaactcttacatggattttgtcaaaaaaataaatttgttcaataatttaaattttatttttcaaattttacaatcaataattatgccccatttgatttttatcatgaattataatttttcacattgtgaattatgaagtagatagcatgtaagtatgagaaatgggcgatatggtcattttagaaaaatctaacagtcaaactcatggtcaactaacggaatagggatagaagagatcgaaataaaaactaaagggcatgtagagggtgaggcaaaattcaggggtatagaagaaattgcgaaacttttcagaagtacgtatggaattttctctaaaataaactagtagtcctagtactatataacaccgcccatgtcataaagtaaattatcttgcttatagctgttgtgcaactactgattgccctgaaactatgatttttttcggagaaaactacccatctgtaaacgccaaaatttggtatgcccctaggagaattatctcatcgtaaatagtcggattcgtgctatattcggttaaggaaattaatctatcgaagaaagcttatccacaagtgacagagttcaaggaggatgcggcatggcaagttatctattaattaggaataatttgttagtttccttttatctttagacaagtgtgtttagtgtcctataaagactttatgttttccttttatctttaggaaagtttctttcttatactacaaggactagtatctacccatgggtataaatatatacacccggggtgattgtaaaatatcacacaggtcaataatactcctggcacatcgccaccctcttttctgaggttttacttattcaaccgacagaatttggcacctgacgcggggctgcattggttcagttcgatctccggcgaaggggtaagtcctacgttctgccggcccaggcaattgtatcatctacgtcggctttgttcaaggctgcatcagtacattcaatctcttggattgctctagtttgattgatatatttgcttggctatttatcatatgtcttagttaatctagtcttagtatctcaatttagctctatcggttgtctctcgctttagggtttctgccagtatcagctaaattgttttactagattagattagctaagacatcaaccaccctaaaaatcagccaacggcttgattgtgtatatattatgtttctttacatacttagtgctgcatcaattaagtttgatctactaagttatgtttagaaccataatctctaacctgccttttgactgctaataagggtttcattggggtttcagccgatgagttatctggatgttgctttggcttacaaggattatatacaagttggatttagccgatgggaacaaagatttcattgtttaatctaatcttatggattgtatgatatcggacctccaaccaatgtatgctttaaccttcggatcagtgcttattctatcttgtcattgttagccaattggtctctactaggattatattattgttatatcttattatcactagcagattgtctttatatcattatctacattggacatataggtgattgctcaaaaccctatcgacatcggctggaatcggcatcggctgggactactccattggcttgttagccgatcggctatttgatctattgtttgcatatcttatcagttgcaggatcaaactgattagcacgcccacatatcataaacctttggacctgcactggagctaagcagatctcccaggccaatgtgtgtttttcgcgtcaacacttctttggcacgcctggtgggacgcgaattttgcacccaacatgtttgaggaggaagtcaatgccatggaggggcaatctcctgagccgatggttgaaacatctcaagataaatttaatgaaacagttcatcgtgccttgtttgatcagtctggggttttgatgcatacactacaagatgtgatcaagaagatagttcctgaaatagttgctcaaagaaatcaacttggggggcaaatcggtgaacaacttcagcatcatcagcagcaacaatatcggctcggggggcaagcatatcaatagcagtatgatgagtcatatgaatatcggtcagaggaacttcatcagtatgggcatggtgaagaatatcaatataatgatgatttggccgatagaattgcaaagatgatagaggagcagtttggaatcaaacctaaggaacatacttttgtgtatcggctgccatatcctgagtggtttgatagggttccattgccacaccgatacaaggttctagatttctccaagttttcagggcaagatgatatgtctacaatggaacatcagctgattcttagcacaatgtggagaggcatcggttgaagaaactctaaaagttagattttttccattgtctttgactggatcggccttcacgtgggtttcatcactaccatcagattctatccaaggatgggccgatcttgagaagcaattccacgagtatttctttgctagaatcgatgaattgaagctttcagacttaatatcggttgagcagcaagaaggagaattggctatggaatatattcaaagatttcgtaatgtccgcagccgatgttatggtttgagcctaagtgatgagaaactagcagatctcggattccaaggattatcagcatctataagagagattcttttgccacaagtttggcagcctggctcatctaatgcaaaaagtcctagctcatgaaagccgattgcaagaagcaaaggaagatcagttttggagttatcaagacaagaaataagataattttgaagcatgagttttcatactccaaaactggggggcatgtgttaacgccaaaatttggtaagccccaaggagaatcatcgcatcgccaatagttggattcctactatattcggttaaagaaattaatctatcaaaggaagcttatccagaagtgaccgagtttaaggaggatgcggcatgacaagttatctattaattaggaataatttgttagtttccttttatctttaggaaagtgtgtttagtgtcctataaagttatgttttccttttatctttaggaaagtttctttcttgtcctacaaggactagtatctacccatgggtataaatatgtacaccgggggtcattgtaaaatatcacacagatcaataatactctcggcgcatcgccaccctcttttctgagatttttacttattcaaccggcggaatttggcacctaacgcggggttgcatcagttcagttcgatctccggcgaaggggtaagtcctacattccgccggcctaggcaattgtatcgtctacgtcgacgttgtttaaggctgcatcagtacattcgacctcttggattgctctaattttgttgatatatttgcttggctatttatgatatgtcttagttaatctagtcttagtatctctatttagctctatcggttgtcttttgctttagggtttctaccgatatcggctaaattgttatactagattagattagctaaggcatctaccaccctaaaaatcagttaatggcttgattgtctagatattatgtttcttttcatacttagtgctgcatcagttaagtttgatctacgaagttatgtttagaaccataatctctagcatgctttttgactgctaataagagtttcatcggggtttcagccgatgagttatctggatgttgcattggcttacaaggattatatacaagttggatttaaccgattgcaacaaagattttattgtttaatctaatcttatggattgaatgacatcggacctccagccgatgtatgctttaaccttcggatcagtgcttattctgtcatgtcactgttagccgattggtctctactaggattatattattgttatatcttattatcactagccgattatctttctacattggacatatagccgattgctcaaaaccctatcgacatcggctggaatcggcatcggctgggactactccatcggcttgacagccgatcggctatttgaactattgtttgcatatcttgtcagttgcaggataaaactgactagcacacccgtatatcatcaacctttggacctgcactggagctaagcagatctctccggctagtgtgtgtttttcgcgtcaacatcatcggacatccgatttctaaaaaaaactctcatttatctatttgtaacactggctcgtcaatataaatgctcaattgcacagggcttcatgctaacaatgtctccatatgtatacaactttatatgtctattttagtttgttgttcgagacataaatacactttgcaccaacaatctaatacccctctcttcttaggaaatactcgaaaaaaggcacaggatacaatacaaaataagtgtattctagccgtatgcatcacgcaaattctcccagcaaactccatatgtcatctacatatggcatctagtgttacgtgttcgttacttcatttgcagtccgagataaaatacgccttcgcattcacttttgcgccagaaaatagatatacgcctctctccctcatacacgtataacaacaccgcaaccgcaaaatacgcctagcagttccctttatatagagcagagaaggctttccatgggctctctcttccaacccctcacacaaagcggcgcctccgcacctatgtaaaaaaaaaatcagaggtgaaaacctctcaaaccctaatcccctcgtcccctcatggtagtcactcccgtggaggagcagccacctcccgcggccgacgcatccacattggaagaggctgagcacgccgcggccgcagccaccgagggcgagggcgagcacaagagtgttatgcctgtgccggatgagctactggcaacgaccgaaggaggtgtgccgaactgaagacgtactatgaaaagacgttttcgagtggctatagcgtattgagtctatgcactgatttgtgacactggcttgtggggccaagggttgttgagtcgggtgtgtgttgtataaatcgccagcctgtaggtatgtgacatctatcgaaaaggagaaagaaaaatactacccgtcctctgcttctctctttctttctattgctctgttttcttcttcctccctactactcggttcctatcagatctccggtgagcatcgccaccggtgattggggtcgtaacaattttggtatcagtcacttacggtcctgcttgctccctcgcactctcttgacctttgatcggtaaatcctgtggccgagttggtggtcttccttcgggttgttgccgccgtcattctcgtgtctggttcggttgggttcggaggacgtgacgcaacaacgcccgctaagcagagtgtgtaagttcggcggatggtggtggtagactcgattgaggagtggatgatggctgtgctcacgcagctgatggcgaaggtcgacaacattgacgtcatcaccaagcatttgggggagatcgacgccaagctcgtcactcaaggggagcgcctggatcgggttcaagcgaagatggatctctccatgacatcactggggcaagttcaacaggagcagacacaagtggctcgcgctctgaaggcggacgcggcggctcccgtcgcatcggcaccatctacaccgcctcctcctcaacctccgcatctggcgactccgggggcgtcctcttcgtcttcgccaccaccccctccgcctcccccaccacctcccccacctccgcctccgccgtgcctggttcctcctgttcgggagcaggttccttacccacccatactccctgctccgcgtgattttgggtactacatgccacgtcgccagtggtcacctaaaatggattatccgaaatttgatggcaccgatgttcgtgtgtggttggataattgcgagacatactttgtgttttatcaaatcgctaaagggtttaaggtttctgctgcggcgttgaatttgttggagaaaatggacattaagccacgttcaaaactaggcttcgccggaatgccatcacgaaaacgggattcgctaaaatgccaggatgaagcgcgccgcactcgccactttgccattttcctccttttgctcattttcgaaatgaatttcccttctatgcaagttgacctgatggaattgcccctacggtcgggtcttgaaagcgagagggggttgagccagcccgtgtgttcgccgtgtgcgctcggtcgcctctctctctcattgccatcgcaatgcgccaccgccatgccctgcatctccggtccggctagtcgagtctagctggcaggtcgaggaggagttgacgcacgaagccgcagtccctccccaggcctcgatgctcgtcgcgggcatcagagagaagaaccataaccctaaccctagttagggttatggcgatgcagcgaagaattgctcaaggtagcgaggacaacatgtcccaaggtagttcctttcgtgctcccgggcgccaactctctcgttttcttcttggtcccagtggacttcctcttgtgaagtgcccaagatgtgggaatgcagtagtggagtgcaaatcctggaggcaaggtggtcgggtgtttttcaaatgcgagaagaatgaacaatatgttagtaaattctcttagtttgattttcagatgagatggttggaatttcagaatgtatagttaattttatttggtattgttgttttcataggttcaagatgcttgcacatttttcaagtggtatgatagttaccaaagaatggtggaaggaatggaattagatttcaatgaagaagttgcaacaccagttgcaatagcagcagcaggtgaagctgacagggttgatgaagggaagatggataaactaactaagtggatgcaacttcttgtgttgatcaacatagggcaaggcatattagttctaattggagtgtttgtttttcttatgaaatgatgtaattgaaattatggatgtaataggaacggagtgaagcaaaacttgatgtagtaggaatgcttgatgtgttgattttggtaatatttgtgctgtcaacccttatgtactagaatcatggattgatttggtaatatatgtgctttaagcccttctgtttaatatatgtcaagtctttatggctatttgagaatctgaagatgcctgtatagttaattcagcgtgtggcaaattttaatcaatcagaacaatgtcaggcaggcagtatttagcagcacaagcagcatagtcaggcagtatatagccattggtgcattcaggcagtaaatgatgatgcggtgtaacaattccaggcagtaatacaattccaggcagtgtaaatgggcacaatgacataatatctccaacaacatagtcattgctcctccacgagcctggtaagatagaaaaatgtacgcaagttaaatgatgcgcaaactacaacgaactcgcccacaatcgcaacatcaacaacattcaaatcgccaaaggtttgagaatggattcacttacccggcgacgagttcctgccacgtacactccatatttgccaccctcaccccgggatgcagtgcgacggcggcacctacatgcggtgtgccgacggtgagctccttccacgacgggccgtctccacggccagatcgatttcctcgccgacgagcagacaggatggggcggcggaggaagagagagatagccaagaaccacctctggatctcgatcccctttctacccgaccgcaggggcaattctgtcaggtcaactcgcatagaagggaaattcatttcgaaaatgaggaaaaggaggaaaatagcaatgtggcgagtgcggcgcgcttcatcctggcattttagcgaatcccgttttcgggatggcattccggcgaagcccagttttgaacgtggcttaatgtccattttctcaatttgttgggagatgctgctaactggtaccatgcatggaaattggaagtagggtggcatgattggccaatgtttacggctgcagttatgagtgagtttgaagttaatttgcaaagtgtgaagatggatgagttgttgctgttgacacaaactggttcggtgactgaataccgctctaagtttaatcagttggtctatcagttgaggctttatgatcctttgctctatatcacattttttattcatcactttctgttgggtctaaaggatgaactgaggttgcttttctggcacaacagcctactacagtaactcaagcttatttagtggctcttgcacatgaatctgctcagaatggggctggtgtgaagagatggcctctaagaaagagcattctgctgtcaagagttttgataagcctaagttggcccctggggaactttggaaggctcagcaactcaaggagtatcgcgagctcagggactttgttttaaatgtggtgagaaatatgttcctggtcatacttgtgctaagactgacaatgtccagttaaaggctattcagttacaggaggagtctgaggtattgtctgatgccctgttggatgttgtcatgaccctggatatgtctggcactgaggtgaatgtatcattgcatgctttagctgggacttgtccttctaatactattcagttgcgtgctttggttcaaaatcaagtcatcattattcttgtggattcaggtagcattcatagttttattgatactggtttgtgtcagcgcctacaattgcctactatagctcttcagtctactgctgttaagatggctaatcgggagactctctcttgttcagctcaagttccctagtttgcttggtggattcaagggcatgagttttctttccctttgagggttttacctatgggtggttatgatgtggtgttagggatggattggttatctcaattcagccctatgacctgtgattgggcagccaagcagttgcagttctgttataaaggctcagtgatttctctgcagggtatgcagattcctcctaaattcagtcttgtcagtgaagtttatgctgttcaggttctgaaatggactaaaggcaatgatgtttgggccatggctgctatggaaccatctgttacagtgccatcttcttcttctcaggattctgaaattcagttgttattacgagaatctcagtctgtttttcaggaatccaattccttgcctcccccacagagttctgaatcatgctattgcattggtgcccaatcctgtgccagttaatgctcgaccatatcggtattctcctgctcaaaaagatgagatagaaaggcaagtttctggcatgttggctgctgggttaatctctcccagctgcagtccctttgcatctcctgttattttagtgaagaaaaaggacaattcctggcgcttttgtgttgattaccacaggttgaatgatcttactgtcaaaaataagtttcccttacctgtggttgatgagttacttgatgagttggctggtaccacttacttttctaaattagatctgcgcagtgggtattatcagattaggagacaagaatctgatgagtataaaactgcctttaaaactcatcatggacattttcaatttcgtgtgattccctttggtctcaccaatgccccagctacctttcaatgtctcataaat

SEQ ID NO: 78934 - DNA, 7374 bp, Oryza sativa
  unsure (1)..(7374): unsure at all n locations
acccgtgggtcccgcctatcggcgccgcccccattgctgacgtcagccctggggcaatattgcgcaataaatacattaaggcttttctttaatagtaaaaacacagagaatcttctaaaaatcataactaattcatccgagctccgattaagtccattcaagtctcagtaaattcataaaaatgcatagaatccattaaaaatggttttgtttcctgttttcagtagtcttatagcctattttgcttgtgtgctttgtttgtcgcgtagatttcggccgtttcgtcgatctgcggttcctcgaaggcgttgctgtggtctcatcagtgcgagagcaaggcaagtcatgcattacaattgatcatattgtacccaatttacaaatgtcccgcatttctattaaatattgcattattttacaatatcatgtgggatgggtcctattacttagctatatgttgtttcccttatgccattgataacttgggtattgaaatgactagatattggtttaggaaatgcttaaccatgcttagttcaactagtacacaaaaggggaatcacattaatgcatagactttgattattggcatagctttggtttagtgccaccgtaatgatgttggttaattaaaatacactacatggtgggctatgggtgcatggttttgttagtcgtgcccatggcgattaaggaccggttcgcgggaaaccctggaagaattcctcgtacttaccacaagccaacgtgagcaacggctgggcttgtagtgtagctttcctctagctgacgcatccaggcaagggtgggcgtgatggagcggggcgggccttgcgacgacctctgtcgcttccggattcacctaggcacgagaggggactgcccgctgccttgcgaggagtgggggtgaaacctgaggtgtggtgtgcttggttagagagggttatgcgaaaggtcctgtcacggcctctttccggtatgtcgtggtggcatgtcggcgcacagaaacgtgtcgtggggctgtgtcttgtgggtacagttgtacacttctgatcagagtaaaactattcgaatagtcgtgcccgcggttatgggcggtcgaccagattcaccgtgattagtctcacccctagttagctaatgaactagcgtagttcaggtggttggttgagcctgttgcaacatggtgtagcattggacagtgattggttaatactgattaattactacaactgttttactgctttcaactactgcttttaaatgctagctttatgcaaatgagccctttagcctcccttgggtatatcctgcatcatacctcctctttcggtatgacttgctgagtacaatgggtagtactcagtcttgctctcttttcccccacaccagagttgaagtccttctcagctgaagatgtctcaaagaagttggtttcgtcgttgccgtcaaggatgcctgtggaatggagtcgcccgctgcaggagtcaagtctttaggcttagctcgcttttatcttttccgctgcatttgtaatcttttatatttttgtaagacgtggatctgtatgtcaacaattgtcgtttgtgtaccctggctggtcctggacaagggtttaatacacattcagcttagaaattctggttcgggaatttctgggtgtatagggaaataatttattcaaatactaggttaattatcatgaataaatataatttttccagaatttatcttctctgtttaggtctcctaaaaatccaaactagtttccaaagagcccctcttcccctaatttttgagagtaatctatccataatttttaagtgcaaccaaagaaaatggaaactaggtaacttcatctacctctagaaaaatccacgagaatttatcacactcacaaatgaaactatagaactacagagtgagatggagagaaataatcctgaaaattcgtccaaaatcaattaacaccccatcttctacccacctctctcactccagccttgttcccttcgccctggacccacctggaagcctctctgagtcacttcttctctgtccatattctatttctcctccatccaacacagtgacagccgagagagagagactgagggcgccgaccggcactggacggcgtcgacgcgtggcctcgacgtggcagtgccgaaccaaagcttcacctccacccagctgcgtcgccactcttcacccaccatcccagtgccgatccaaccgagggaggaagctccagctctccctctccacctctctttcgtcgccggccgccaagaagagggacatcgccaaccgtcgtcgagccctctccatctctaactcatactcgttccattctcatctcaccatgccgaacaactttggtttttatcccattccatttcatcttctacagcagcgggaacgctgccatgtcatggtcgctctagagcgcgctctgtgcaccgccgcagcgacatcattgccgttcccgcttatctggaccaagccgggccaagctgtcgcgccagcgttttcgcctcgacctcctctccattttccttcaagaatctagaaggatggtactacgagtgcggagatcggctaccgtcttcttcacctccggtcgccgtcgccattgtcgatttcgcctcctccggtgaaccattgtccgattcttcgcgtatacaccatccctgggacctcactaaccccatgaaaacacatgcatgtcaattcgatgagtggatcgagccgttgccgtcttcccggagctctacaccgtcgccggaccatcttcttcaccgttgccgcagtccagactttcccgcgtctcgttcaaggttcggtgagcacccttgagcccataggattgcattcatgcatttcattcacttagaatcgagcaccaactcaacaagcaatagcagcctaagcacagccgccgctcggactcgccgccggcgttactccgatgtccactgaccgataaaagtagaggaatggaatcgcaatagcatgatcttcattttgtcttttggtcgcaccctcaaacgagccaccgtttgccgctggcaaacttgaaatcgagctcagccatggcttgatctgcttcagctcgaaccagggacctcctcacaagaatttaggttaatgtagggtcctttatgcaaaagctcatgacacacagaacaggcataggactgcggtttgatttcctgaaaccctaggggccttttgcatattggcatgagaccgacaggtggaccccataagtttaaaatctgaaaatgtaaaagataatactaaaagcctttactttttaacagcaaaacacctaaacttgtaaaatccatataaaatcaaatataacttattttgagatgattcaaatttctataggttaacaaaactatgaactttaatgtgataacaataagcttggcaccctcagcacagaccttgtctctaaaatgggtctaagataaatcatacataaagcatacacaaacttataaaatacatacaaagtacatctcaactcattttggagcaaactcagtttctacagatccaccaacttatgttctcctataaagcaaaatgaaatagtatacatactatacatcaaatgcctctaaaactattacctttaaatgactagttttagataagctgaattttagaagttcatataaaattcatcttagatcctttttgaataaacccaagttctgtagaatcaccaaaacatgtccttccaagttataaaataaaattacatacttattgtatgataaaagcctctaaatacttatgtaagtaataaccaatatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggtgctaatcacatagtattgattgagcaatatgtatatatataaatgtatatagaaatacactctagctataaagaaacccaaataaaacttgttagaccagtgaatacatagatccatccccatccaccaaaacttaaggcacttagctcatataataatttctaggttgatataataaattgctagcatggactagagctcccctagtttataaaatatgaaccatgataataaagaccataagcctatgaactaaggttagattagttaactaaaatactcatttttatacatcactagctagatgaggcaagttctggacctaaacctctaaagccatgaacctatagaacactatacacctataacacgttataacttgtaaaatacataaagaattcatattaactctaaaaattatgaaaccaaatgtgttcatcttaaaaacacatatcttcaccccagcaaacataaacttaataagaatcacctacaacagcaattcacaataattcacaatagtacctaagtaaatcctacactataccgacgaaacttctaaaatttataactctcaaatgaaatgagataaaatagaaattctttcacataaattcattttagaccagtacctatccactgtgcacaaatcatgcattttagagcattttggatttttcacatatttcggtgttttaattgcataacgtgtacattgtatagatgattgcttaaacggtgaagaagtgatttaggtgctgactttttccagttacaaggcaagtcctacctccctctctttgatcactttgaacctatgttttggaggttattgaaaatgtttgtaaatcttgcatgtcgatttgtacactaatcaattaaaattttgttaaacttgttagacaaactcctattatttgcattatcaccttaaccccacatatatccatatccctcatacctaaccttaggaacaatatgactataccatttatatacgagttttggtgacactaggttactataatgcttagccatgcttagaatggtcttccttgtcattatgggctcattacaaacatgaaaattgatttttaaataatctgagcagaactttaatacttgtgattttgataaataaaatggtggaaaatatgaattttaggtttgggcctcaagtggtgcacatatggtgattagttatgtaccgatagggggagtgtgcgcccaaaccgacttaaggacttcactcaatgtcagttcattccgtatacagtacaaccacatatgctagtatgggatagcccaagcttagtaagttgtttatggtttagccttacattctggtaggccggtgtgtatgagttcatataattcagaggagcttcctatttaccccgacgtggtagtttaggtgactaagtgtgtccaatacaacggtattgtgccacgtggtgggttcccgttgtgtccgtcaccacggcgttaagtttaaggcgtgggcccaccacttaacggttctaggccatatatcgagtatggcttaggatggagtaacacgtatcgtgctggtgtaaggctaaatcatgaattttggaaaagctttgttgcgggtaataaatcgggtacttatgtatcgcgtgccatgcttttgcatgattattatttcgtatcatgtgggtaaagtgtacaaactctgcaaagttaaaactaatcgattagccgtgctcacggtcatgagcggcgtgtggatatgtattgagtatagacttgtgtttattctcctgaatgctgaaatttaccttcaaattgtgatgagatttgagaatgatctccttgctgccatggatggcaatgaggtggatatttatacatgattaatgcctactttgatgcccatatgttaagtactagcttgctgaaattttatttgaaagcaaatccgttttgaatgcgttttatgcaaataaaacttgctttatgctaaaaagaaccatactatgccttccttgattatatgccttgcaagtagggtgttaggcttgtcttgatgcttgccagtacattattgactcttgctgttgaattaacttttgcttgcaggttttagacttagcctttgagtgatgcgggtgatcgactgcttcttctaggacttgaacttaatggggtaaacccctagtcggtgtgcttgtggattggaaagacaagcttccgctgttctattatttatttggtcggtcggccaatgtaactaaagtagatgtagtttataatcactttcatcttatttgtgtttgctatgtataatcatgcttgagatgaaagtgtgaatctagtgcacatcctgggaattagattcacatgagtatgagttaagaatatttgagatgttgtagatcttaagccatttttgtcaagtctcctaaatgtgtaacatatctggtcaccgccttcgagtggtttaacgggcacatctcaggctgaagttgactggcaggctaaaggcccaacaatatctccaatattactctctcgaggcgtcggatatttcattatgcttgtttgatgacttgaattatttatttcatctcttnnttataatggaagattcggagagcctacgacagataaaaagaattattgcaattatatgcacgcataatcggataaaaagaattattgcaattatatgcacgcataatctctatccttcaacgctctcttcctctactcactcatttaattcctttatctcctaatttttaactaagtaaagaaatatcaataattagaaagctaaatgattataattcttaaattaaatcataattttaacttatttgaatttttgtttttttacaattaaataaaatatttaagatccatattacccatatttcactctataaaaaatgaaaatatgtcatttaagcatagacactgttcctttgcatggtaaccaaatagaaaaaacacggaccataatacaaaatgaaaataagtattatattaccgtaaatcactggacatcctctgagcacactcaaggcgtcatgtgttacgccttaaataaaaatataactttacaaattggaagaaaaaccatcttagcatcagtttccacttaaataggtagatccattattttcaaccaatagatattcttttaagaaaatcttaagcaaccatgtgttacgtcttaagaattagaaaaaaataacataaaatgtgagaaaaaaatatatcattggtttcacttaaatcatttagataaaatagaaaaaaaatacccctccacttcgccatcccccacacatacgcacaacacggcactattcgccccatcccttctcgtcttgagctctccactcta

SEQ ID NO: 78935 - DNA, 3004 bp, Oryza sativa
ttctgtttatatatattcaaacgcaatgtacaatatatgcccgcgcgaatacgcgggctaccttcctagttattctaatataaagttagttgtcgaacttttaaaaagctcaccaaattttatcataaatgatagatatttctgaagggagggagaagcaaatattttaggggagcactacattttttttttctcgatggtgcggtaacactgggaatacaccacaccaatacaggcgtttttttttcttacagggaaagggaattgtattactcagctaataattactcacggtccaatgtaacaaactaaagcattgtactatttctccattttaataaaattcaggtagggaaactgtcccaagtgatcagtctgaaaaaaagacccggtaaagattcggaccaggctttatttgctagggtgtgacttatactattgctgcttttgtgcatagcgattacggagtacatgtgtatccttatacagtatttatctctaaaatgattttcatcattaagatgatgtcaacaatacagggaaaaacaaaactcatgcgtctagcaagtctagggtaaattaccttaaaagaacaatatttgattacctaactatattgttatcgtagattttttgcaccatttttaaagaacatattttttttttcaaaattgtcttctatgaaactagttagagcactttttctaaaatattccttccgtttcacaatgcaagactttctagtattgcccacactcataaggccacactcatccttataagtgtgggcaatgctagaaagtcttgcattgtgaaacagatatttgtttagtttatttcttaaaatagttggtttatccgagataatcgatggtaataatttagcggacaatatgtttcaaacagggtaataggattacgacgagagtgtacggcagtgcaattgttgacaaaacaataatttgtgagtaatagataaaactaccactagcaaaacaaagatatttagtacatcccggttttggggataaagcctgaagataacaacaacttgtagaaactaaatgctttccaacacaaacctacaaaaataaatgcaatggtattattaataatcgataaaagggaaaatagtaaacgtgaatagtcacgtgtaacatgtataaacagagggaaaaaaaaaccacacaaactcgggaattcatagcacaaaaatagcgtcctccggagaggaaaaacaaacaaacaagtcaaaaaaaagggaaaaaaagagcgaaaagaaattaaaacaggagcccgtgtgcgtcgcgaagcattcgccattcggcaccccgcgaagcgaccatggccatccctcccctcgccgtcagcggggtcgccgtcgccaccctcgccgtcctcggcctcgccgtcttcgcctgccggcggtggcggcggggcgcgtcccccgcgcccccacctcccgcttcctcccaggtcggaccccccggaatccctcgattatttttttttcaccaatttatttgatcgccgtatgaaatggaaacattgtcgagtggtgatttgtactttcttgtggtggtggtggatcttggtgatgttcgttacgagggtactgtttcacgagcgatttgatttttgaggtccttggattcgtccatggcgttctctcgttagaatatactacaccaacacagaaccatgagcgaggggaataccgtggcctgctcccagccctagattgtagctgctgccttgcagtgaatgttgcattggtggagattcggcggtagcttttgttttctgttctgatatttaatccagcatgcatatttgattgatgaatttggtgcgtttgttaatttggtcatcgacaaggcaaattgcagcttgataggaggagggggggattattgtcgtattgcccaagctgcaatgttcttagatgcaactggattactggacataagattgttatctttgcttctttaagcttcatttccgactcttggtttgtcaaaagcataaacagtaaatacagcccgatgaaatggatgtgattttctttactttagtcaatgtttttccatttttgtacttcaatcatttttcatgatcttttacttatattatactttgctgttttgtgttaaatgatacattgtgtcccatagtactctcaatcttaaggaaatttggtcggcctaatctttggccggcccggcaagatacgttgcgtcccatatggttggatatgggtagcaaccacttttccttttcctctattaagcttcctggtccactggaacaactggcactaagccaatgaagcccccactgtcttacttttctgctaagagcacggaatgctatgtttaatctaagcgcacttaatttgtttttagaagatatacaagatttttctgtcgtaattcattcacatacgaatgttatcacaaactgtaattaataaaaccatttacagcaagtctgttttatctaatttatattacttgttgcttgcaggatgatgatattaacatgcctctcatatctgacaatttggatgactattcagtctcgagcaatagtagtactgtcgatgaatcaggaattcggattgataggattatcacttcacctaagactcatggcattgttggaaaaggggcaacctatcccactgaatctcatgttattgaaggtgcgtatacatttacacccaaactttcatcattatgttatacagcatcagtcttgttttcatttcctcttttagtaatattcatcttatttactaacaatcgtcataaaattacaaaaataatcaattctttggtttgtgtaggagaaactcatgtaattgatgttacaaacagtaaaacggaagagctctatttgggaaatacgcttaagcgtccagctgtggcaaatgggccaacacctgatgtgaagcacataagaagggattctggagagagtaatcacaatggcaccattcctg

SEQ ID NO: 78936 - DNA, 7081 bp, Oryza sativa
tccaagtcatttggtgttaaaggactcagaggtgtcaggaaagcatgcacagattgactggaatgcaaatgtaagttgtgaagatctaagctgatctaaaaaaaaaattcatatgacctatgtacatacctgcaaatatcttaagccttcttacattcccatccaataaaattattattactcttttattgcagaaactcaaatgggaaattgtggatatgggtagtctaaatggaacatttttgaattcccggtcagttaatcatcctgatgttggatctaggcgttggggtgagcctgctgaacttgcagatggtgatattataacacttgggagttcatcaaaagtatctgtaagttataaccgcttttgtttttcagtgtgtcctttcaagtgtactgaagatttttataactaatttatagtagaattggtcttttattgcttatggtccagcattattattcatctgatggttaatgcttttatgttcacatatcattctgcttgaaatgaaacccctatgcatttttttttcatataatccaactatacctaattcaaattggcaaacatgttaccacactcggcttttctgttttcttgctagctgttgacatttcagttcatatgctggcctatttggttccacatgtctgccatgccatagaaactggagcatatataaaaaagaaaaaaaaactcttcaacatatgtttgaaatttggttgtatctatctttgaagaaagcaattccctgatagcgctaccgtgctaggtccaaattgagctacaaaaccaacaacctgtaggagttggtatagcatctgatccaatgacagcccgtcgaactgggaagaaacttcacatggaggatgtcagctgctgccagtatcctcttatcggtgtggaaaaggtatgtgaatgattagtttttgtgcaaatacttgagtggtttctgatattgatttttacacagtttgggctatttggcatattcgatggccatggaggggatggtgctgcaatagctgccagcaggtaagctatttctgcctatttgtttgatcaagtgcaaatcataatgttatcctagaatttggacattcgtgtattaattactataaccgttcttgattttgagtttgatatgattatatacgtgttgaactgatgaccccctttgttgcctaggattcttccacagaacattgcaaacattttgtctcaacaggaaacaaaagaaagagttctttcatgccatagtgcttcagatgttcttagacatgcctttgcattgactgaagctgcactccatcatcagtatgaggttttccttttatctggatttctcgtgtactatattttttgaactatgttgcttaatttcttgtctggtagtttaataacttgattaaataaatatcatatgtttgttacaaggtttatctatacatttggttggtatagaatttgttggacgaatgttgctacattgtatgtttgttaacttttttgatcaaatgatgtgctactgcaatttcttgtcctttacttgcccctggatgtgtaaaattcatcacttgctgggtttctagatttaaaagtttagttctgattcttaatttggtttctgaaatgtatacatgaagcgaagtctcttgcaatttaaggttcccatgattgccaggaacatatttaccgaaattatgagttgagtctcccattaaaactcctagactccagatagtctttctaaggctatatgctgtacatgaagtgtagtgggtccttggaatcctctgcttcttgaattgccaccttttcagtaggctaaccatgtttttctatcttttacagggctgcacagcaactatccttctgatttggttcgaccagaacgaagattgcttcgcccaatgtgctaatcttggtgactcagcttgtattatgaggtaattagcatcttttctgttctcgaagacactgtactatttggttttctgtagcacttgcttcctcgcaaagaaaaaaaaacccactagcagtcacttgctagtataatgtgaaatacaccataattgaaatttaaatattgccaccctattgtatattaaactgctatacaatagcaataaaaaatgatttataaggtcctctttcatcaagctttgtaatacagcaataatttataaattgttgccagtgtcaacggggaaataattacaatgaccgaggatcatcgagtagtcagtacaacagaacgagcccggatggcaaattcaggacaacccctgaaagacggtgaaagccgtatatgtggtatatgctatattgctatcttacatcagctgcagacttgaacaataatgatgacacgatctcgctgtttatttccacaggactaaatcttggcaggatgcttggggacaagtttttaaaggaacaagattcacggttcagctctgaaccatatgtgagccaggcagttcgcatgacaaaagcatgcttagcctctgcccttattgctaggtatcaaaactccccatctatgatggtcatgcttgctaatgtaatgcattactcatacatttcataacgtgcgcttgtttgctcctttgcagcgacgggctatgggatgttattagcgctaacagggcagcgcagcttgtccttgaggtaactcatcgatcggcttcaacctcatggttattaagtcgtggtgtgctgatcttttatctcatttttcagggtaagcagaagtacagcgagcagaaaacttcagcagaaaagtagcacatcatgtgttaagtgaagctaggaaattgcgaaccaaggacaacacatcagtaatatttgtagacctggacactctgagaagtgatccctgatcctgaatccccaattgcttttgtcaggtccggagatcgtcctacctgctgctcgaacagttgaacaacactatttcttttgtttcactggtagttaatatcctttgtcaaagttgagccaggtgctccggtgttgcagaggatgaatgctacagttctccttgtctgcaaatacccagggagccccttgtgcggttatgcctgtaaattgtgagtgaattggttaaaagaaatgtttatgaactttaaattctggagttccatcacatggttggtcaggaaaagaatctcttttgagcttatcctgtgtaatatgcagaaataccaaatcgcatgcagccaaaaccagaatagcaagactgcatctcctatctatatataccattgtagattgtgctcagtttacaggttccgaatgagtggcaaaatttacagggaacatggacactgttttggcaaaacttgtacatcactatgatatatatccgttgcaaatctgcaatctgtcctcatcacctacacatacaacaattggtactcgagatacagagctcagcattacaatctgtgccatcacctacaggagatcactgatattgcttgacaatccaccatatctcgtcattgcaatctgtttcatcacctaataagtacaagtagtggtcctccagagaccgatcctgtggcagcacatcttgctctcttgacacatgcgaagtggactccttaagtctctgaacacgcagcctgctatatgcgtcaatgttcagatgtgagaccaagaagagctctacctcagcgacaaaccgctccgtttggccaaggaggaacggcctggcagcttccatgagcaagctcttgaattcttccctcctcttctctggtggagccatcttcgaggcatgccccttctcttgccttttcatgaaagactcgatcacaccatggatgtggtagataatagcgtcaacattttcatcctgcaaaacccagtattacaatacattgcagcaagcaacacgatagcagcacgacgattatataacatcgtagaataatcacaaattctcaactctctacgacacttgaaagaataatagaaaccatcatcatgctcccaagtcatgtgcacttgagtgcgtaaatcaaatccaatttgtactaaactataagagtaggtattattcccaagtgtgtgtttcagctatgatccatgagtaatgggtaaaatgagattgtcagataatgcagataagaagagaagccctaattacacacagataagaagataatgcaagtgcgacccttttaagctatggaataaccgtgtgacaatatgcagtactgtatgtatgtacccgtgtaagagcctgtatttcctgtcttagccaggtttgaagccaaatgttcttgcgaagatacttgcgttgcttccagaattgctgaacgctggaagtattgcctataatatctgttcagttgagcacacgtcagtcatataacactagattcatagatagatatctggaacaggttctaaaagtgtgagcacggacataactaaaaaccaacactatacctcgtatactatagaattgtgtaatcaagtcgtgtgcatctgaaagatgtctgcacgaggaggaaaatgagcttaatatacttattgaaacatgtaacaacaatatttaatttacaatgagaagagtggcatgcaaatggtctccatcgcagaaataaaagaaaaatgtctgctcgttaacattaactacaaaaagcgcagcactgcacaaccagatggagggaaggagataactggacctttttctggggtcctgatttatgtagtgccgctcaaatgattcaccattaaaaccatgtataatagacacattcacggtctgcaaatgtcacaagggacatataatcaggattcaggacctcagggcacagtctcaggtgaacaaaaaatttgccgggcggtgaacaaaaaaggggtcaaatttatagatatagttgactgcatcatcaatagataaatgtagcagcaccaaaaagtaatggctggtatggtgtgttctccacatttaagctttcctagaaaaacacccaaagctagcaaattaaacaatattcaatagtggcgtttcatcacgttcaaaagcgtttttttcaatcaacatatgaatggggcataggttcatatggtttctgtcagaattcacttgaagatgataatctatcaagctaagagaaatgtggtgagaatggtatcagacaaacagaatgtcctgttcctttttggaataactattggaaccagagaaaatgagttcaccttgcaaaggggacattgcactgatgataaaggttcggcatgcttggtcgatacaatctttacccactggcatatgcacttgtaacaaaaagaatctgcacaaacattatgactctaagaaaatgaacttgaacagatgaaaggcaagtggtgatttcaaaatacagtagatttctgtcctgattccagcaatgtttctcttgatgaacaaaactgaagcaaattagttagaggccatcaagcaatttcgcagaaacttcacatcttttgccctctacttaagagtcgttcaagattctatccaagataagaattcttacagaattgaagagcttacacataattaattattaaagaccctatgcggagcaatcttaagatccgaaataaaggataattagagagattctgagaggagagactaacggaagcaggtgtcgaggtacgcctcgtctaggaaggaatcgaggcagatggggcaagcacaagcagcgctcgccgccgccatctccccctccgccgtgttgccgccgctaccaccggaggaggatgcggcggagggagaggtcgccgccgccgccatctctgtccggagaagccccccgggtgcgaactagatgcgatctggaccgtcggttaccgatcagagatcagacggctgggctgatccgaccagtgggcccacatgtaagccagcagcttagcagtagttcgcttcgagttaattaacgaaatctcaagggatcattacgcaaatctccctccttaattacggactgtcggccctcgtaatcacgcgctaatccgtcgttaccgcctataaaaccaccacgtcggacgtcgccacttccgcggcgcaaacagtacacgctctcctcctcctcctcgctgtctcccactcccatcccaatggcggcggcggcggaggacgtggagttcgtcgactacgaccgcgacgaggaggaggaggaggacgccatggacgaggacgatcggggcggtggccgcggcgggcgcgcgctacccgtaccccacatcgtctcccagggcgtgatgcgctcgcgcggccgcctcctcggccgcagcacctccgtgctcgcctccaaccgcgaccgcttcgactccctcgccgatgccggcaaccccggccacggcccacagcgctgtgagatctccctttgtacttctattttttttttgggcgtgagctcgagtttgaacttctcggtagggttttgtgcgctatttttggtcggtttgcgtgtgatttaccagttagtgtcgcgcataatccgcgagggatttggtgagctaggatttgtttggtgatatttggctagggtttagggtttttggtacggctgcgcttgcggcttgccgattgccactcgattgcgtgcgcactcctgtttgtggtgcaggcttttgattttattcaggggaattggagccatgtgatgcttaagctaacgatccaaactaaatcgctgccggtggacagttatatgctgatatggttgtgggaaaaaaaaacaaatgtataattgcaattgatactgattttgtggtcctgaatgctgagaaccacatcaggttctacgctgattgagtgagtttccatgctgacaagtgacaactactaccatcagtagaatgattgtataattttgcacgctgtgatctttcgttcttctgtaggtttcgtagttgtgtgcctttggcaggcatgccttttctccccaatgtccttgatggcgttggaggaaattagaccattgtattgaaagttacttgggacaaaaaaaattcattgcagcgaatgcatgacatcaattagtttgagcagcaccatga

SEQ ID NO: 78937 - DNA, 1890 bp, Oryza sativa
  unsure (1)..(1890): unsure at all n locations
actagctcctactgtacaggccgaagcagtgaggaaaatcctgggtattgatattgagaagaaaaaagaggagaggaaacagaaagagcgggatgagaaggtactatgccataagtttttattgttgctacatttctgttcatggtacagtagactcattttacccttcctctcacctttttttccaggaaaagcaagaaaaaacagaagaatatagaaggaactgcatccaatgtgtcatggggccagaaggaactgttgtcacatttcctgataagatgggcctccctagcatatttgactccaagcctatcaggttacatatagtaccccatctgtgcatcttttaagtttttccaagtttacgtcaagcatagaatccatgtattgatccattttgaagttatgcatttacattcaactccatttgctttatccatcttcccagctatccacctccaagggagaaatgtgcaggcccttcatgcacaaatccatacaagtaccgggactcgaagacgaagcttccgctctgcagcctgcagtgctacaaggctgtccagggaagctctgaggctgcccagggaagctctgagacgctaacatgctgatctcagaaattaaaggatggtggtgaggcaatcgtgactgttttgtggaactggagaattgtgctagttccatttgccacctttgctgcttgttcttgtgttgccaatgttaccttttgccattcctaacaatcaaccaaccaacagagggggtgtcgcctgctgctggccatccttttgactcgttgtggatgcagctgcagtgttctcgattaaggattaatttaggtggtagtcagatgaatgagagtgatgtatacattagttgtacagtgatcatcctactcgtcatcgttggtcatgaaatcatcttgaaaattgtctctctgtttgcactttgcagcagttggctattacaaaccagttaacaagagtggcagcatcaggagttcagaggtcacctgttctgctctgctcttcagaagcaagttgccggcttgagactggtaacaattttgctgggccaaactgagaaatagaagatgggctgggccttgcacatgaacatgcttggttgctactaatttgaccatagcattaggacatacaagtacatgctgctactatagcaaaagaaacaaaaatgcatggatcaatgaactggtaacaggtcataccaatcgtacgataatgcactagttgcaggcactccgccaaagctgccaatgcaatcgtgttgaccagaaaaagataaacacgtcctgtacgttcgattcgtttggatatgatcgcactatgcgaacgtgttgacctctccaatccattccgtttcacttccatcatgtaatcacaagaggataaccaaaagtgatgggggttttgtatgcttgcttactactccaagtcaactagcttttgagtggcccaaaactctcaaaacgaattgacctctgcctttactgttactgcaactcactctctctcatcatcatcgtttgttctacgacggataagctgtgaaaaaaaataaacaaataacttaaaaatgatttaaatgtaaaacttttatctttatgtttttagctatttaaaagctgatgttgaaaataaactacgattagaaaaaacctcaaaatcaactttacaattatgttacaaaacttaaattttagctatggttgagaagccaacatacaatggagctgcttctgtagccactagtcctgaccnnnnnnnnnnnnnnnnnnnnnnntagctcgaaagtatatcaggagagagagagaagctactcgatctacctgtcttgcaaaagctggggcatatattttcagctgaaaag

SEQ ID NO: 78938 - DNA, 3161 bp, Oryza sativa
attgcgtctgtagcagcaatctgatctctaatttgattgttgatgccgctgtgtacaactgtagtagacaattgcctatggatggcgtgaatgttttattattctttaatcaccatggcgattgtagtcacatacatggtcatatttcgttcactctactaatttttatattatactcttgtagtagttcacaggcaattcagaaattcgactaggttactgcaaacagattatgctaattacttatccagtgttaccgggacactgacacgggtgtcggagtccgactcggcaagctaagaaaaaataggattcggggactcgctccataaatatgatttttagtgaaaatattatatatatcatcaaataaaacatactcttagtcagtaaaacactaaaacatatggtgtcacacattattctgcacagaagatcctatcttcttattagttaggacaaagactgacagccaaaataagtgaatttcatgtgtagaggatcccttgtgcagttgtgcacaaaaaaacccactgctatcctgccatccacatgccactaccaatactactcatgagtactactagttgtctctggagtactactagtatgcctgtgcattgtagatgcacgcacgcagctacttttcccatcgagctctcccatcccattctctctctctcttctgccttctttttcccatcctctcccacaggtctgccagacaaccaccggcactgctcgcctatggcagctgagagagacaccgctagtagtgtctgatgcgtgtcgaaccgtgtcagacacgagctgacacggggatgcgtgtcgacatggaaaatttttttggactcgcgtgtcccggtaacactggttacatctggggaggtcggttttatcttaggattcaacttcaaaccattctgctgtagaattcctacaaataaaaaaaaatagcagtcttgtgtttgacccagattgtttctgtatcctctgttcgtctcaactggcctcaagaacacaactattttaaggaatatataagcagaatggagagtttaaactccattctaattttgttcggttttgtctgttgtgcgtgtaattaggcatttaattttcctatttcatgttttttttgccaaacggccaaatggccacactctggcattcgatgtaacaatttatcatatcgggaactattgttacaatctgtatcttctttgtgtgctgtctaccacaagtcttatctgtaagatgtcatattttttatgattggttctacctgttactgagaatatcttctactatttctctttttgccaggttttggtagaagcaaatggtgtaacacggacattggttttgaataggccaaagcagttgaatgccctctcctctgcaatggtatgacttctaaagacaaaaacatgacaatgattcaataagtaatggggcatatatggtattagcgactatatatagggtgcaggaacactgatttgataatttttttttgctttcattttctagataacgtgttttttgaggtgcttcactgcttatgaggaagatgatggagttaaactattgattgtgaaggtaacgatcatgtttgagtcctacaataatgaaatatctaatgtggtccatatttgaacaatgtatttagaggcttatctttttttaaaaaatgaataacgaggtagtagctaacatcaaacatgaattgcctgtttaaatttccaaaatcatgaattcaaagtttcatccgcttattgaagtttgtacaaccaagttgtagtaacgtaaaacaacaatgctgcccgtgccttttgttgcatgctaactgtccttttgccatttgtaaatgtaattgattttcgccgggatgaaatgtaattgattttctgctgctgatatatgagtcttgacttattgggataattccatctttagtacctcctgctgttacctttactgctgctgtttgtgctcagcttgatttttataactcgttgccattcttgtcatcacttgttttttcctttgtcagggaaaaggaagagcattttgtgcaggtggagatgttgctgcagttgtccggtctataaataatggtaaacaacacatatgatgcatccttgagactatgatgtcaaatatcttgagctggtttatttttggcttttagctgttttgctttgacttcctttgcctttccatatgctatatgctaattcactgttaacatgcaatatatagagaattttcttcttgacatctaattagttttactatgcatttcttatatcagatagctggaaatatggtgctcattttttccgaaatgaatttctgttaaactatatcattgcaacatatagcaaacctcaggtaagctgtcgctatggctttgaaactgcttgtccacataattgttgtcattattgctcaattcttaccactgaatgctacaacactcttatctaggtttcgcttctaactggaattgtcatgggtggaggtgctggtgtttctatacatggaaggttccgagttgtcacagatagcacggtatatattacggaacaaactctatatgaaccttccgtttttgcttaaatcatttcaaaaaggatgtagctggtgtgcataaaaagcttgtttgattcttttcatgggataaacagcttaccagcatatgcctagagattgactctgtatttttactactatttatacaggtttttgctatgccagaaacagcgttgggtctctttccagatattggggcttcatattttctatctcgacttcttgggttctatggtgaacttttttcctatctcatatctcctttattcaattgaactttcacacatgatcatatgaattctcattgcaatgtctaaaactgattatgaatactggaaacccatgtgcagttatgcatccttaaatgcttattttttagggaaaatccaacctcaaatcttgcaaattttggatcactggatgtgcttcacgattcgtgctcttctccaactccagcgaccacctcttcttctccggcgccagcgccggcggaacccaaactccggcagagggccgacgaattagggtccggggtgcggtggggatgggagggggggaggggt

SEQ ID NO: 78939 - DNA, 7421 bp, Oryza sativa
agttcaaacaatgagagccacgtcactagatttttcagttcatgcatgtagttatacgattctaaaaaaaaaaatacatgctactcaacaccatagtgagatatagatttatcaatggtttaggttttatctcttccaaaacgtaaaagtagtaggacggcatatatatatatgaacaatggcaccatgatggatatatacccattaaacctttttgaactgaagaaaggagtagtacttgtctaccacgctctgtttcgtgcatcgtgttatccagcaaaagtagctgtagatcagtacatcatcttgccgggaaaagtgactttttatttttatttttgcaacaagcgtgtttttttttaccactgacaacaatggtactctctcctacagtactagggagaatgtctgtctcttcttttgagcatggcgagatcgaatgaatgtgatcagtgatgagagccacatacacaaacacacatgctgctgatgaagtgatcgatgagcagctaagcacacacgatccaaggacagatcagcagctttatcataatggtagcagctctggacattcatactccaaaaatccctttcccttttcccctgtctttttgctgcaggccggccagcatatgaatgatcaggagaggcaaggagacatggcaaagcattggcagcagtagactctctggagatctctcctccttgctagtacttgtgtagtactccctctgtttcataatagttatcgttctagattgttaaggatagattaaaatttaatttaaaaattataatacctcttattgaataatgcatgatggaaagtggaatggttattgtggacaaagtgagaacttttggatagaaagtgattgatgtgataactagcattttacaatgacaagtattttgagatgaaatttgaatcctaaagagacgagtattttgggacgaatgcattggtagtactccctcggtccctccatcccataatataagggataatgggtggatatgatcacacattccagtacaattaatctgggcaaatgatctgtccaaatttatcacatccacctattatcttttatattatagaacggagggagtagcattctgcgaagacgacccatgcacatattgctcaccttttgcccaaacacacatgacacaaacacacatgccgtccatgagaaattgagaatgatcgtcgtcgtcttcctcggttgggtcgcagtggtaagtgctaatcatgggctctcgagcgcgcatgtcaaaagcgaacctctcccatcctcattgcctccagcatctcgatcacctcgcttttccctgtttcatctccaatgagtaattttgcagcactgcattctggctgccgccgccgacctagatgccattcttaatttactgttaatttcagttttctttcagagaatgtttttgtatcgaatgaaatgcgtcacattttttaattacctaattaaagccgcatttgagatagattaacaacctgattattaacgcagattatttactgcgttatagagataattaaatattttatgatgaatactccctccgtttcgaaatgtttgacaccgttgactttttagcacatgtttgaccgttcgtcttattcaaaaacttttatgaaatatgtaaaattatatatatacataaaagtatatttaacaataaatcaaatgataggaaaagaattaataattacttaaattttttgaataagatgaacggtcaaacatttttaaaaaagtcaacagcgtcaaacattttgtgatgagggagtaccagaaaccatgcaatagagaactgagatttattttttttaaaaaaaaacatactagtatacttatagggtagggtttgcgtgcgtgcgttcataggtgagtgtgtgttgtgagtgtctgcattgtactgtgtaatttttttaaaaaaatatatctcttgaacatatacatgcacatcttaattatacaagcaccctatgagaaactagacggacatatcttgatcgtttaacggaatagccaaattaagacaacacgatgttagcatgccacctaccactataactagcctaaataaaaacgtttatgctaaatcatagaatcaaatccgctgaatatgtttcatcgtaagaaacctaaccacatgagcttatcctagggaccgtgatttcaatctctcttggatagtggttagatataagagcacaaagctgtcacaaagatattttgggatcagctcatggatgtcaatttggtgagaaagatatcgaagtgctcacttggagattgcctacagcgacatgtaaagagttgccagtgctgctgcatttttggaaacggaggaatatatatgccggaagatgaaagagggcaattgggtgtcattatcatggaatcactattgcaatgccctagaattgtgagagacgtccatgagttgggtgcttggttgactacatgacctatcatctattcatgccgttttgggtaaataagtaacaaaaaccttatctgcatagtctctccgtaccataaaaaataaatctaaaatcggatgtaacatattctaataatacgaatctgggcatatatatgtctagattcatagtgctaagatgtgtcacatccgatattatgttggttttttatgggacgaagggagtatatggatatgattctataaattataattaaaaaaagtaacaaagacatgtacggtaaacgggtaatgagcactataattatactaacatgttgataggataatctataatttttatttaaaaaaagttggacatttttactggcaaccatgttactccattcatttcagaatgtaagatgttttgattttatcctaagtcaaatatcttccgatttgactaaatttattaaaaggaaacatgcaacatgtttaacaccaaataaatatgttataaaaaatatgtttaatggtgaatttaataaaattaatttggcattgtagatattactatatttttctataaattttgttaaacttaattgtagataaaactatatttttctataggacaaaaccatgttacattctaaaatggacggagtttttctttttttatatattttctgcttctttgaacaaactaaacctatgagtaagcacaataatactttacaatgaagcgtattaagaattccttagccaaattatttcaataatatataagttattccttctcactatgatgaggagaacaaaattaagtatatactccaaagaaaaagaagggtagaaaaaattagaagaaaacaacacataaaagaaaaaggagggtacaaatttctgccgaaatgaaacacagagcattcaaaaaatatttttatggcaagtttaatgtaaaaaaaagttcctgttgattatagttaatatcatgccctggggtgagaatgagtaatcatcattgtagcaggcacgatgcgctgctctacttggtggcctgtgcaattatgttcctcaatgagcttgcctcttcctttgctgcttccaccaagttgtcctgcaaacacaccagtttatattccacaatgtcatcatagatcagccaaatgctcaccattgatcagtagtgcatttcacatgagcacatgaccatgcttgtatatcactttttgttgttactcctagaaactcagataaaaagtttcagaaagaaaaggaattcagataagttcagtggaaccaaaagtttcagaaagaaaaggaattcagataagttcagtggaaccaaaaggactatcacaaggaattcatttcttgtcaattcattaggatgtgtatacagtctgtcaaggtagaatactctacatattcctcctttttgtgtgtgtttgttctctaactactagtccctgtttgtggaaggtacctatgggagttgaatatctgaattggttcgtgtgaaattcctacattttgaatgtggcctatctccatttcaattgatacaatacctgtgtagtgatcaggcgtagtactgctttcttgttcgattcttgaagctcaccggcaatcagaacctcatccaatataaagtatgcctgtaaatatagacagaagcacagaaaagacagcaggtttagcaatttgacaggcatggtcaatagatataagtaatcatttgaacaaacgaagtaggtaccttgtggaagttgaatatcaggtcaagctcgcagacctgcaacatggcaaacacagaagaatgtagaataagcaaagaagtttcagaatgcctggtagcacaacaaattgggagaatatcatgttaaaggtgtttctgtgtgagcttacattgccaaaatatcggtccaatatctcaacaaaatgatggatgatttgaagagtctccagttcattatcagcagcatcaatgcacatgcagaagtaaaggcttgcatacctgcagacggtgcgaaacagcttgatgcaatcagaaatatcaaaaatatttctttacagatgaactgacatttgcatgtgatttagcactttagctgctaacagtgctcgccaacaatcacataataacattgcaggtataatcacaactcgggagtaccttttgtatacaactctgtatccgtgccaatcgacaaaattgcacatctttggacctcttgtcaggacgagcgtacttacttctttgataaccttatcatcgaaaataaattatcttgctgatatttttacccagcggaaagaatgatggattaggattacagtaaacatgtactgatatgtgttaacctgtcatttcttaccttggatctttccttctgaggatatggattgtaccatttggtcagcctcaccttcccttgtctgctgatgaggagcacaaaatgtatctgacaacacaacaaatggcgatgtcatatggaatcctcttgtctgctctccagcatcaaaagaatcatcaaaaactaatgctgaaccaaagttcaattcgaggatcacaccactactaatgatgatatggtgcacatcaagacaagctaatggtatgataatgttatcaaggcaagctaatggtatggccacggatatatgatcccaagttcccagctgcatccaactgtacggcatttgtttatgtaatcccaaatcatgcaatctgacgcacatttgggcgaaattctagccctagcccaaatcaatctaactgtaataattcaggaatgggctacggatcatgaacgagtggacgaacttccctcacattaaattgccatcgaaaactgttgggaaaaaaatttcaggaacagaagaaggaaaaaaacagagagagaccattgatattcgagaatagagacgagaagaatcaaccaaatgtaggagggaagagaatcggatcacgaccggattaccatgacgagcgacggcggtggcgctggttagctccggtttcgaaggctcgccggcggtggagacgatctcggccgagaggagatttttttttcccctgagagagagagatgcgtagtagaggacagaggagttgaggtcggatgatactagtcatcgggcccccgattattcttttgcatgggttgccttttctttcttccgtgcatacgtgcatgccgtgtaaccaatccctctctctcggtttgttctctattctcttctcatacatgcaactattttcctgggttctctcttctctctctatctctagtactctcaagctttaaatatatattttttaaaataattatccaatctttaattacatcattatatttattatataattaaatgatatctcatataattatattttgataaaaaatatatacgattatatttctacttgaaacaattttatataacacatgaagcatgaacaacaccaaatattcgctaaaacatctaatgaacatgacgctaagtttgcaaagaactaatgaaatatcagaaaatatttattgaaaacatccagatgacaccatgcacaacattgaaaaaaaatacatattgcaatattaaaaactaaaaatgtacaacatagtttggttacggttgaaacattaaatttcaatggttgaaacatatatatttttattagaatataatcatacgatatgttgttgtaaaaatttaattgtaacaaatattacaatgtaaacgtaatataaattggataagtagtttagaaaaaaattgtttcaaacgttaaaaataaagtagataagaggagcgaaaatcttctctatgtagtggagcatgacgttggagggctccatataacgctgcatggtcgaccgtccgatcagaagtagatcaagtaaatctcggttggggtctccgcgaactgtttcgttttatttctctctgttttttcctttttctattttgggctcccgcatcttgggggcccacggcccacgaacgggatctgcatttcgtcccaatacttatacaattacaaaaataaaaaagttattttccgcacggattctactactgctttcacaattgggacccatatgcctgtcactacatgcaagtctgcaagactgcaactgcagtgcattatgcatgtacgtaaacagcatgaaacagatcactgttgacaagaaattaaaaacactataatcgatgccttccaattttgatggcatgatagatatgcgaatcactcgatattgcaagtgagaggtgtgttttctcaggtatccgtatttacaaattacaacagacaacaaacagaaacattctctaccctgaatatcatgatttttttttccgggccaagtgtacgaatgagaaaaactgttgcatttacaacaatatcatgatcttcacgtcttcagaaacgaacaacactccccagaataacatgatcttcagaaatgaacaacattccccagtgaaagagacagtatggatatatttcaagtgaaacatgacctggcatatttcaagttagcagtcaaccatatatttctcgagatgctttgacatcagtcgccttttggtatttggaaagagaaaaatggatatatggcactccacactccaaaggttgccagcgataagcatcagcatgagcgcaccacagatgagtcccattatcacacatgctcttgaaaactgttgcagaaagaggatactggatccctggtaagtatgtatcagtaagaattggtcagtttcttatgtgatggtagctaagcaacagatctgaatcatcaaatttcttggctcatgtcaaatgcttgcggttgttggaatgatggcatcttgattttgcggaatgaggcacatcgatctttcttcagaggaatcagtttaccagaatatagactgccaatgacccagctcgccggctgcaaagaaaattc

SEQ ID NO: 78940 - DNA, 8556 bp, Oryza sativa
ggatctctcagggcagagtgagtatcaatatacctttctttaagacccatagagggcttaggcagggggaccctttgtcccctctgttattcaatctggtgggtgatgctttggcagctgtccttgaaagtgcaaaaacaaatggggttttagaaggtttggtgtctaatctagtgcctaggggtttaactcattttcaatatgctgatgatactatttttttttatcaagaatgaggagtacaacattagggtgctgaaatttctattgttttgttttgagaaaatgtttgggatgaaaattaactatcaaaagagtgaggtttatgttctgggagttagtaaggaggaggaattgagagttgctaatatgctgaattataaagtgggtagtttaccttttacttacttggggcttcctatggtggttgagaagatatgaatgaaagatttgtgttacattactcagaaagttgataagaggttgtagtcctggaaaagtggttacctttcttatggaggaagagaaattaaaattaactcttgcctgtcaagtgcccctatgtatgcaatgggtttttaccatctacctgagaagtttcataagataatggactctataagaagtaggttctactagtagggtttggggaaaaaaagaagtaccatatgctgaaatggaaagctctaatcagaccaaaggagtttgggggtttcggttttctagatactagggtgatgaatctgtgtttgctaagcaaatggatcatgagaattgagaatggagatcatgatatgtgtttacaagttctgagaaggaaatacatggtccagcctagtttttttttagagttctcctgggggggagggggttccagttttcgaagggtttgcatgactataagggttggctggaaaggttagtggttaaaaaagttcatcagggagggtgtgtgaaattctggagggatgtttggctgggtcaggtacccttgaaagttgctttccttgagttgtttgacataagttatcatcaagaagcgactgtgagtgaattatgggagaatgggacttggaatttggagtttagaaggaatctagatgataacagtggtcaagatttaattaggttgagaggccttttaaatgaatataatctggatggtagagcagatagagtggtttggcctaacaccagcaacaagatctttaatgtgagatcgatgtatagattgatcacttttgggggtgttaaagattctgaaatgatgagtatttggaagagtaaaattcctcaaaagatcaagcatttcttgtatatggcaggaaaagggagactaccatgttctactcaattggttaaaaggaagtggagagggggagatgagttgtgtaagctatgtggtaaaaaagaaacctcgaaccatatcctctttatgtgccctttagctagttttacttggtgtgtcattagggatgctcttggcttggacaaaagaccaagtaatatcagtgagggtttggatttggttaaggggaagaaaatgaatagggtttggggtggtgcttctggctactgtgtgttgggcgttgtggttggttaggaacgattgggtttttgaaaatgtgttgattaaatcccctttgcatattgtttacaaaactctttcttttgttcagaaatggtgtatcatgctaaaaggggaggagcaaggtatcttggaaggatggtgtgatcgtctgctggaaaaaatgggacaactgaagacaaatcgattgcctgaagatttgtaactgtgtagttcagttggcccttacctacgcctcatgggaaagacagcctgtgtgctgaactgtgtttttctgttttttaataagactgtttgtctgttgggctttctttcaaagccaggtcaatataattgatctgtttcaaaaaaaaaacaagaagacgcagcacctgccgcgcgagggaggtgccatccgccgtggcgcacgcctcctcctccaagtcatcacagattccctcaagcttggcatcgtcgacggcggagacatcggttgcggtggcggggaacgtcatcttcttccgtgcagtgtcctcgagccctaacgagacatctcggagcataatcccaagcgggcgtgccctcacaagggcccgagcatccactgcatgatgcgccagttgatgtccactgcctccgtcaaggcggagaggatgcgtccggcctcgtcctgacggttgagagatcggacctcgacatcaacgccgccgacggccgcaaggtccgccatggcattctcaacctgctccagcgatgacactagtacagtagataccaacacggaggtgggagaggccgaggaaccgaggctcgaggccgacaacgaggagacagaggcagaggcagaggtagaggcaaagtgcaccgcggagattggggttgaggagctcgccgtggcggcagtgtcaaggagtgcgcctaggaaggcgaaccggtgggaatcgaggcggaggcagagttcgccaaggctgtcagggtagcaaagctcaccacggcgatcgcggtagtggagcgcattgcgaggcggtcgaggttgaggagctcggcgcggcggtcgtggttgagggccccacaagtcagaggccttggctgtctcgcagtccacgtgaccatcgccattgttcctcactgttggatagtatagagagaggagaatactgcgtaacgtggattgattgtattgagcctctgggggccggtatatgtaggagtacgtggggaggagataaggaacgattacagatttggaaggagttcacacaaatcaatcatatcctaatatgactctaactaccatatactcgaacatccccccgcagtccatgcatgagcagcgcggacacttggactgaagaaaaaaccagcaagaatactcaacacgatgatagccctttatgccatagtcgatgtagataaagcaaaggagccgagagagccgtggtcgatgaagccgtgcgtagactagccgtggtcgatgtagccgaagtagggaagccgatgatgtcgaggtagccgagccgtggggcgcgcatggggcgctgtagagtggttgtaaacgcacgggagggcatcatggaccaatggtgcgcgaggacgtgctggagatgaagacggtgatacaatcacgatgatcgtggaggaatatgacgccgaagagccgatgtagtcgaaccgtgaagtacgagacgtcacgccgggtttgccagacccagggacaactcgggacgaacacgcgcaacggtgttgccaataccgcgtagacgaggtagggaaccaccatgaatcatacgccaatgtcggaggagactagcagagaaggccttcgagacggtcgcggcgcgagaacggcgtagaggcagaattgccgaagtagcacccgcagttgccggagaagagcgaagtgtagtcgaggaagatacggcgatgctggcaatgagacatgctggatgaagaagatggtgaagtagcaggaccaacggcctggacagcaacgtcggtagccatgtagaggtagctggaccaccggcctagaacggcgatgatggcaacttgcagacgcagcggcaatgctctaagtagacgaagaagaacccgagtggctgacgatgaccagtgcggatgatgaggttgtcgatgcgcgaacggtgagaaagaagacgaaagcggcgaaactgcggtccgagaggacaacacagctgcagctccatatcgatgcaacggcaagaactaaatcgacggtgaggccacgctgagaagggcctctcagcgttgcaacagccagtggacggggaccatgggcagcggcactgcggcccgagggaacaacgtagtggcaaccagaagattgatggcgtagtacacgtgctcgaagacgatagcagcagtgtgtcgtagccgggcgcataaacgggtgatcaagccaaaattgcatgaggctaggcgacgaagaggaagccggagttgatgccgatgttcgagatgtgcaaatgtcgacgaggcaatggacgacgcaaacccaatctctgatcgggggaaaaacacacacacacacacaaatacaagcagcaacagcactgtagcagggtagcaatccacacgctcgacgacagtccaagctgaacgcagcacagtccttcatcaagtcaacaagctaacctctctgtacgtacatatccacgtgacctctctcctcccttgcatgtagagctacgcaagttcatagcagaagggtacagatacagcagagagagggcggcctatggactagcggcgacccgttggcttggcaggggctgggccggctgggcgcaggtcgacggcggcgactggctgtggagcggagcagagaccggtggacagtgtcggctccaggaatgaatcgttgggtggtcctacttggcatcccaaattgtcacgatgttacaaaatcaagtcaaatatgtcaaatatagtggaaatataattcaaatattgcaatatagctcaaaacatcacaaattgattaaaaccaacatttaagccacactacaagaaaaatactctgtatagacatttttctagtactgtagaggcacttatcaaatacctttacaacaatatagaagcattttaaaaaatgtctaataagtgtcttatggtgaattgtctctacagacgaagagacattttataaaatgtctataagatggtagaggcattttttagagacactaaattgtaccgcaaacatataaaaccagtccaaaaaagagaataaaatagtttccttgcttttgataagtcttgaactcgtgatcttttggttaaatcattctaatctttgatacactaaccaactcaactccatgtcattacttgtatacttgttcctttagttacttatatttaatcctttagtacacattatcattctaaaaatgtctctacatagtttaaaatgtctcaacaaaatgcctttatatattagacgcattttatagtgccgaaagaatgcctctacgagataaaatctaacaaaatgatataaaaatgtctctagagtaaaagttttctaggcaatttttaaagtgcctctataaagtgtctctacactataaaacttctgattttagaagcaatttacaaaatgcctctacaaaagtgcctctatacgaggtttttgttgtagtgccaatcccatctcttgatttaatcgaatcccactttctatttcacccaattcaagtgcttccataatcttatgaacaaaacaaaattgaagtggcgcttcttaccataaatttccttgactgggaaatcatgtggataacattggtttggacctttcagaatatatgcacgctgaactgcgtcttgttcattgacattatagctcgcaataggggacctcagtcctggatcatattgaagatgattagcatcatactttggaggtgcatcttgctattcatttgttgcctcaacaactagagttggctcaggctgtggctcaactagtggcggctcatcttcttcaatttgagcttcctcatcaataagatctgccctcttcttcgcctttgcttcatgtttccgaaaaagcgatgcaatgtctccattccttttcatgtctcactgtaatttgcattacaaattaatgagatactaagttataatgttatattgactactaactaagttgttgctaaaagaaaattccaagtttcagttttcaatcacattttttcatccacatttttcattcatcgatgaccgatctattcaaagtatatactaaagacaaatgagtaactcgccatctcggtcttcacagaggggcagggagcagcaggggagtagggcactggaggccggagagtcgtcgactcgttgagtaggagggagagggacccgactccggtgcaccgtcgccgccgtgaggggcagcgggggcaaaatcgtggccggctggccgccgccggctgggatggtgctgcacgcccgtgccgggcccgggcggccgacggacgacggctgccgcctgcaagcgcaatggccgccgacgctggcacctggcgcagagcgagagtaggaggaggcaaggagcggggagtcgggagaccggagggagaggtagagatgagacagaagcagcgtgatttgggggaggattggagtggcgggcacgcctgcgcggtgcgcctctcctctgacctctgtcgtcctaaccctagcctgtggtgggctttttctggtttgggccgtcggggggagggggtcctcctaggccaaaatccagggtggtccagggaccacctggactacccactggagccgcccatgccggtggagagcaccgtccttggcgccccggcgaacagcaagaggcaagatcctatcggtcgcagagcccggtagaggtcgacggaccgtcggtggaggaagtcggccggcaacggggttatccgtggtgtcgtcggtggcaggcaacgaaggcggaggtcggttgcagagcccggcggatgtcgacgcaccgtcggtggaggaagtcggccggcagcagggttgtccgtggcgtcgtcggtggcaggcgacggaggtggaggtcgaaggcgtcggcccacgcagtcacgtcgaagtcgagggagcccggcatagcctgtgaagtggagtcgcggaaagccggcggggcggacgacgtcgccgccagtcctgcgtgggaggcttgggtggcatcggcggcgaccgaggctacacgacggcggtggaggcagcgaccggcgaggatggctcgacgaggaccatggccgtgacatggccgcgacgaccggtagattcatgcgacgacattacagctgctgatgcttgaattgatgacgacgtgaggagaagatgcaggactcctggaaatcgatctctccaactcaacgatgacaacgaacgaaaaagatgaggccgccagaggggatcgggatcgatcttctcggcgacgaaccacgaacgaccaatctgggaactgaaccagatcgatctgatgcgaagacgaaaaaggaaaaaaaaggggtgaccgcccccgggagatcgctactcccggcggcggcggaggcggaagcagagagagggatgctagatcgcccgctctgataccatgttggatagtatagggagaggggaatactgcgtaaagtggattgattgtattgagcctcagggggccggtatatataagagtacatggggaggagataaggaaggattacagatatggaaggagttcacacaaatctgtcatatcctaatatgactttaactaccctatactctactccatccgtttcacaatgtaagactttctagcattgcccacatttataaagatgctaatgaatctagacattattatatatatagattcattagcatctatatgaatgtgaacaatgttagaaagtcttacattgtgaaacgaaggaagtaacactcacctctagctaagagtggtaatgggtcgagagactcatgaatgctttacaaccctatgtaaccctcatatattttaggtgaaaatgtataaaaaaaataattccatcatgctttagatccaatctttaaatttttcaggataaaaaaactcaagacaatcaccacacctacctgcggccatcgatgcatcccaaacaaggtaagtcgataatgcgccatggcgcacccttcctcattaacatttatagcctccgtcagggatctcccattagccacgtccacttcactgccgctcatggctcaccagatcctcctctgcaccggaacctagatgccccaccactttgtccgataattgatttattacaagtttaattctagattgttttaaagataattttaaaaggaatgaaattgattggcattgaaattaggagtagggtggtcgggtggagcttcatcaagatcaaagagtgtcatggcctcctccagctttaggatgttacattgaaatcccctctctttcagtgaagaaaaaaattgtattatagcaaaaaacaaaatgtataatagcctttgtttgaaaacacttttacacattagcccctcaggattgtagtgaagctcagccactgattagaagatttggaaaattcaaccataaaacaaagttaaatcagctgacgatccaaaaagaaaacattcgtcgacgatctttagggtctgttcggcaactacaaatataaaatactgttcttgttggctgcagtacagtaaaaaaaaatcgggattgctatatgtcattcgaataaaatttagggaagaaatcttacagattttggaccactgcatccatgccaagattcgtgcgtcggcttctctcctccaactccagcgggctccccttcttctccagcgccggcgacaccccaactccggcgggttagggtttggggttggggtgagagtaggaggggggttgggagagggggaagaggggggtttcctcggggtttaaagggatggcc

SEQ ID NO: 78941 - DNA, 3083 bp, Oryza sativa
tggttggtgaagattttatatggcatacgatggaggtattgtgtgcgtataggatgcggagtcgaatttgaaggagtccaaatttggtatgattggttatgtaaagtttgtttcttgtacgagaaggtttcctatggggattaggacttctagtatgagtttagttcgtggctttaggctgcctacctcatgtataaatagagagggagcgtgaggcttcccggtatcgcttttgagagcattgagttgctagtttagttagggtttcgagtttagttgagatttttgtaagaagtgctgttggtgcactttgtaaacacagagagaagcaataaagttgtcatctacttaaagagtttttcgatttgtgttttctcgggtgcagcggtccaaccggcaggacacctgcggtcagaccggtggcatcgaggtcagaccggcggagcaacggtggtcagaccggtggcagcgacaggagctggcaggcaatctcggcggttcgaccgatcgatctatatcggtcagatcgacgttcttcaggtggtcagaccggcgctgctactttggtcagaccgcgatccttcgaatttgagggtaacttttaatttcgcaaaaagtttgggtttttgggcataccaaccattcaccccccctctggttggcttagttcttgtgattcgatcctacatatactagtcctatttggttacagttggatttaaagttgtaataggtgttagcggtggagttagagtcccacaatgtaaccatggcgactacaatgtagcgtagacacgcagggagataatggaggcgtggccatagactcgtagctgctaggtgctatattggttgggaggagcgcccataatcagagccccgaggatgtaggcttcggctgaacctcgttaacaaatatcgtgtgttcttgtgtcgtcatctggtgtgtcttgggtgatcaatgactaaagcgatcagaaaggttagtcgtcgttccactatatcgaccaacttttataatagtaaatgagaagatgttgcttgagatgttcaaacaagatttttttaaaaaaactgcatcattcgttgcatgcgaaaaaatgtgcaaagtatttccatcacccagctctttctgagcgctggcacaagagatgacaggaaaagattctctgaagtgtaaagtaagaaatacagaacaatgaagcagaaaaacactcggtcaaaaattggaatttcttatctatctttctttacccatacataaaatattgctaaactaaatttgagtgagttctctccaatccagagcaaacacatcacataaagtaaactatatgtctatatactaaaaaactaaggagattctctgaattgtaaaaaaacaaatacagaagaatgaagcagaaaaatcgtagcgtgttccctcattgaaaaaaacacatgacagaaactacaactcgaatatatcacaaaagcaatggaactcgttatctgtactaaagaacttatatgtgcagaccgactcaaatatgaaagatactctcggaatccaacacgcgattaaactcctccatgagttcaacaatgttacctagaagagacacgatcttataattaaataagaatagtttactggagttttataggctggagggagatttacttggtctaatatgcagttacagactgtgagaattgccttggacaaattttttgtttatagtacttgggaatagaagcatcatttaactgtggtgggttgtgttggatactagagagagatgggttagcttcaacatgagtgtttttagaacatttaaaaaagatgatgtggcatataaagggataagttgatttctgttatttactgatgccttttcttaaaaagtgacttagcggctggttaaaaggtggcttagcggctggggagcaaataaggttagtaagttcagggaaaaaaagtaaggtgttagaacagaaattgggggagattgatagcagagctgaggagagagatctttttgaacatgagtagaaaaagaggtggaaagcatttatttgcaagaataaatttggtggcagaagagatgtggggagaaatggctgctacaaggtgatgctaatacttctttttttcatgaagtagctgatgggggactcagaaaaagacacattttctctttgcaatcatggagtagctgatgggggactcagaaaaagacacattttctctttgcaaagtggggattaaacaatttctgagtttaaggatatacaggagcatgtgtatagttactataagaaactttttggtaaggaagagtgcagaaatgtacatttggggtttctctttgcaaagggggatcaaacaatttctgagtttaaggatatactggagcatgtgtatagttactataagaactttttggtaaggaagagtgcagaaatgtacatttggggaatgtttggagtgcttttcttagattaactgatgctgaaaaggaaaacatgatcagacctttctctcttgagaaactaggcaaaaatataaaggagatgaaagctaatacttcccctgggcttgatggcttcccagtggggttttataaggactgaatttggagggttaatcaaggaaatgttggatgatttacatgtgggctctctcaacactgataggataaactatggtgtgatatttttattgccaaaggttgttgaggctaaaaccatcaaacaatataggcctatctgtttgcagaatgttattttgaaaatcttgacaaagacaatcaatggactcaaacaacattcattcctgggaggaatattcttgagcggtgtgtcatcctgcataagttgcaaagagagggtgacatggggattatctttaagattgattttgacaaggcatatgatagagttaattggaactttttgtatgaggtgatgagaaagaagaattttagtgattagtttattggttgggtgaaaaagataacagaaggtggcagagtgagtatcaatatccctttttttaagacccatagagggcttaggcagggggaccctttgtcccctct

SEQ ID NO: 78942 - DNA, 76156 bp, Oryza sativa
  unsure (1)..(76156): unsure at all n locations
ttcattaatatcaatatgaatgtgggaaatgctagaatgacttacattgtgaaacggagggagtacctttcactcttcccctattggtggtcatcaggtcttcaggcaacatttcagagaatcaagttatttgcttgtaaaggcttaaaaatgaatgttgaaagttgaaacctatgacaatcagtgcaatatttgccaacaaactaaacacagaaattgtaagttacctggacttctcacccttccaccagtcactgaaggttcttcactgcttggtaagatttatccatgaattttatagagggcttgcctcacattgagggatatactgcaattttggtagtggtagattgtttcactgaacatgcccaattttaccctctgaagcatccaatttcagcagtcatagtagcagaatttgtcatggataatgttgctaaaactcatggtattcctacattaatagttactgatcaggatatatagattactcaccagtaattttggaacgacttgcttgcgaagcttgatactcaattgaacctagtaccgcactccatccacagcctgatggacagacagagcggattaatcagtaccttgaaatatacctacaaagcacactccatgaaacgccaaggaagtggccctcttggtttcccattgctgaattctggtacaatacaagtttccacactaccttgggtagctcccctcacaaggcattgtttggcactgaacctagttgcttcagctgataatgaagccactgatatgctgacaacaagggctgcttattctgaatttttgaagaatcagttggctagagaacatttgagaatgaagaatattgctgataaaagcagatatctgctggagtttcctgtgggtgacaaagaatatctgaagctgcaaccttatactgaatcgccagtgtatatctgaggctggcaagctgcaaccttatactcaatcttcagttgtcaatatgtcatatcttaagtgggtctataaattctcggcccctatgatgttcttgctcgaaatggtccaaatgcatacaaattacaacatccagagggcagcctgatgcatccaatctttcatacttgtcagttgaagccacatatacctgatcacacacaccaatctttttatctctctcggatataattgaatttgatgctgaaaaggttcaagtggaacaaattttgtgcaggaaactagttaagaaaggtaatgctgctcgccttcaagtgcttatcaaatatcaagtggacctcattagctattttagcagcaaggagaattatgatgtccttgtgacaagatttcctgcagcatcagcttggggacaagctgagtctcacggcagtgttgcagctatactagaggcaatgggccagcaaggaggacgcaaggtaggcaggacattgaatgaagagttgaagacatataactgagagtgcgggtggagggccagtgagccttgtaatatgtgagaggtgctcaggccaagtctagctaactactagctggaatagactataaggacagcatgctgtatcacgtacgctgttaagcaatgaatgagggaattagctgttcttctctgcctcttccttcttcttcctcctgctaatccatggggatgtacagagcaggcactgaaaaacagatatgataatgaggtaaatcatcatttctaattagaaaacagatgttaagaaagcgatccacatccattacaggggaagggaactggctccaatcagtgctagagtggggacacatacacacacaaaaaatatgtaaaccaacctgaccaatttttgttgtttgggatggacacgctattttgagcctgactcattgaagagatcaaatcccaaaagaagacatcaaatatgaataagaatattcttgagagctcacttgtgtatagccaattgataatctcatcgcatagtcatttgtgatatgttgcttctctgttcctgtaacagcatcatggtgctgagcaagagctagagcatcagctaaagtatctgttgtgagatttaatttgctttccccttaaaagaattccagaagccaagatgcctgaaaagtgaaaagaaataagatattaagcatatggcaccacaaagtaccaagggaacaagaaaatatatcacatttaaattggacatgtgaaagccagaataatgaaaagggtggtaaaaccaccaatcatagcacggactgttgttttaaggaaggtcttcttgtgaaggaaccagtccaggcattcgggttgtccgcataccaggtgtaagaaatacagtcaaatgcatgtgaaagaaacaaagtgaaattacccataccaattatgaatatgaaaatagaacatacaggtagaaatcatttgtcttgagaggccatggctcatttaagcatattttgcatcagtataaatggaagacatggaatagagagcattggcatggccaattaagggaatggaataaacacgttgaaatcatcatatcacaagttcaagatatctgcattatgtaatgccatgactgcaacttcatggtgaaaccaaaacaaagaaactaaacaatagtcagtattagtaatattaatgatcatctttaaccttattgacataatgaattagtttgtccatcattctgaaccaactttatccataatgataaatcataattgaattttgaagtctgtatccattgtaatcatggcatggtttgtcgtcataatatttgcctagagaaaagaaggaaaaaacatgaattaggatgaatcattcattcctaagcagatcgatagcttcaagttaaaatgttgatattcagaaataacttttgagtattaaaagcacaaaggtcgatgtatcatggaatacagaacagcaaagatgcattctcatcttctgacaaacacatatcactacaacatccggaaaatccagtgtacattcaataaatagtttgcagttgcatcaatccatatgagactaatggatttacatgaaacgcacataagagagtgtacattggcatgaagaaaagcgagaatatttttggagtctaatgtacctgtgctagagctgcaacaaagtcgttcacccattgttcaacattataacaaaaaaagagggcatccagcatagaggcaagcaatgtagaataagttcaatgtagtatgtgttaactagagttctcattaaattacctggaagacaaggtaattatcatcaacttcgaaataaaactcactaggagatggttcataaatttttgggaagatatcagcaaaggatgtgtaagaaaatgtgcatatttcatatgaaatatggattcctagacttaataatataaaattgaggtgtaacatttactatcaaaaaaagagagaaggtttacttaaatcagctgacgagccgagagtcttggagcccctctcacaacctcgagttcttctgttccctttccgcgtatcactatcttggtaatcaacccggagaaaaaaaatcatcaattcctgcatgaaacataacaacatgtttgctgaaccatcccttttctattaagttcaatatgttagtcaaaacactggatgggcaactgttattccaattaacgaatgggttgtgttagactcaatagctatgttgtgtggtcaatgaaagggctctcggtggcgtcactctttaggggatagcaaggtacatatactgacattattatatctcaacataataaatatctatgacgggcaataagtgataacatagttactgttgtaacagcacagcagagttcaaagtttgtcttatcttgcaaactagctatatgatgaagtagcagtgcatcatatacaatatttgcgttagtttctgcccatgaaagaatttgactcgcattaactctcaaagcatagaagtgcatcatatacgacatttgcattagcttctgccatgaaataatttaattcacaactctgaaagtgaaagcatgatcacacaaatgggtttggcacattacttacgcacctaggcagtaatcctgaattgcagagtgcgaaattggatcaatctgccaaccaatccttggaatctgacccccaactactccttgatgaacctgtgccaaatcatagattcatagtcggtatatatatcatgttaatgtagcagtgcacagccgcctcagcatgcatgcacatagccccattcttcaacttcacaagaagcactgtgttcgctatagaatacagacatgagtggcaatgctaacatatagagtaaccaatggggcatgaaaggccacacattagttccagccatccagtgctgatgagcccctccaccgtatccttaatcatgggctatctccaccatttctgaaattgcctagaaccaatgaaaccattggtcaagaaaactcattatgtctacaagtagatgcacattgcttcctacccaaccaaaaaaatgccccccacactgcagcactaaccattttgggatttagtttcagtaacttcaaatcttagaactggtagccaggaaatggctgtagaaacatcaggaaaatagtagtactgcgctttctacacccaaattccaattacaaacagccggtgcaaattttacgagaagaaatcatgcccaacagaactaaactagcttcgctaaacccgtcaaaaacttctccacccaaaaatggggaaagaaatccaaggaccgcgcagcacgggcctgcacattctgcaagcaagccccctgaaccaaaaacacccagaaacaagaatcaaaacaatcaaccgaaactatgaggagaaccagatgattcgtttccaaagttcaggtaaaatttgacggggagaaaccatcaatcgtgcgtaagctagcttccccaaacccttcgaaacttctccccaaaaaacaaacaaagacgggggaaaatcgcggaaaattccaagaactgcatcgcgcagctcgctcgaaccaagtactgacctcctggatggagttgttcgaactgacgtggtagtactacgtcgtcgcggccttgcgggtgtggagcttccccttcaccacccctgccgacgtatggtagggatgtacacgcactccccccgggtggtgggcggcggcggagacggaggcagaagcggcggcggcggcggcggcgcgaggacggtggcggcgctccatccgaagcttctagaatactagtactactttagtggaggctttggggattggatatccgaggccgtcgatgacgtggagtgcgccacaagaagcagccgtggcatgggccccacctgtcggtgactgcgtgggtcccacctgtcggtgacgcgaaaagcccgcttataaatttacgacttcaccccccccgacctctctctccctccctttccctccatccgcaacggctaccaaagccagagcccagaagccacgaacgaaatcccctttccgctcgaatccccccgccgcagcggcggatcggggaagccacggctccttctccggccggccgtcgcctcgcccggatcccctccgccggccggaagccacggctcctctcccggcttcgcagcccctccctccgcctccgcctccggtgaccgcccggtgatcgatcggggactactccatcaactcgacgcgcttcgccttcctcgccgtcgaagcggagatggagccgatcaatatcacctcggttcgcgagttggaggaggctataggcaagtacggcgccggggagagcgtacgggtcaccatcaacgtggccaacgttttcgaggccgatgagctgcttcggctcatcggcgatcgggagctcgaggttcgttgggagctgagtcccgggggcatggatatgctgagatccgcggcggactactacctcaatctcgacctcctctacgagttcatggaccttatgcggctggatctgcgcgacggcgtccctgtcaagaaatcgttgttcgattggatccggaccgcctccacggatgtgcttacttcttctcacccatcgtcgactcgtcgcatcctggaacaaatcacgctggaggcacagctaatcgggcgagtggccaagggattgggcttcggggcggatgacgtgcagcagtatctcatcaccccgcacgaaatgtcatggtatctggaagaggatgcagttgcggtaagaaagaggagagcaagtttgagttcgggtgatgccgccacgagtgatgttgctgcgggagcgagtgatcctgtggagttgctcaaaaaccacaagcagaggctgctggacaaggttgcgcatctgcaacaggtgatatcttcatcgaaatctgccccttacatctcacagttagagcagtagaaatcacaagaactagaatgcatttcaaagagtctcacatggcatggtacgcataggccattagaagtagagctctgagtacaccaggatcaggatgcacttgcaagacttccacatgacacagcagaaatcaactagtagtacggctttacttcagtgtggagttgcagtttttcgtttgacttgactattgtaaacagctggtttatgtcaacaaataagaccaccagtttctggttttacttgcagaagaaagtattgtgcactgataccatcaagtattacattccctctgcatgtttatagttttggatacagaattagccacggaataaaaataaaaccatgaaacagatacagggaaaccttcttttcttgcatgcacattacatgtttacaacctggtcttagaatgacagtattgattgttgaagcgcctatcgtgtgaagccaatacatagcatcttgatacttgattgttgaagcgaggccaatagtagctgtagaatacagtggaaggacaaatgcataagtaaacacaatgaagtatcaggcaagacaaagatctgtagaaagctattctaggatcagaaattccattggcttggtgattgaatggtgaaccaatgaataacgatggcttatgtctgaaagattatttaaactcaggctcaccattcacaggtattaatccaaaccataaattatactgaggttttccgagaagaaatttacatggctatggcttagtgatccaacgattgaagaatttaatagtctttacttggaagcaggatataaagggaggaattcaagaggctcgccaagctgcttcactctcagcaagtaaaaaccatgtagtaaaaatgtaatctgtgaaaacaaaaacacaaggaactcttgagagctaaagaaaaacattttttccctacagagtacagacaacaaacagattgtactgaagcatatttctaaatattgtcacacatcttagcataatctcccaatattaagtatacatgacaatcatgtagcaaatgcagcaagataatacatctttacctatgggtgtacttaaaaaaggtcactagaagaactcatcatgataatgtatacaacatctgaaattttcatgtaatctccatgaaatgtgcataggataataatggattcttgaaataaatatgttacaaaatgttaaatagcagaagtatgcttgtcaaagctggatgaaaaatgtagcccacttttcccctagcaaatgcattgtatggtgtaacttcagttggaaagtatacccatgtatcataaaaatattagcatgtgatttcccagaaatgaaaacacaaatcaaattcaggaactaagtcgtcagaactgttttagatcagcaaaagaaactttgcctttctttactgagcaccctgagcttcaaaacatgaatggggaaaactattagcaactgacaaaaacacttactagctaattaaaggtaccagtaataatgcataagtacatcccttgccattgttgtttggtggaatgatattattcagttgaggacatagcacaaaggaactgatggctccaacaactgtaactttgacacatatcgtattctaaaagtcgccttaggcgttaggagctgggtagccaccatgattagaaattacctggtgcattaggcacataatctgccttgagggttcttgagtgtacactgaagactctgagagtgtgtatacaatgaagtatgtcctgcacaggccaagatgagagcgtacaaacaatggagcatgttttactaatattacggtacgatgcattctgggaacagatagtagaagcaaactattaatttgctaagaaaatatttaagaacatgggactcattgttcattgctgtttgctgaaatatagctccagaaaatgcatcagtagtaatgatgacgattttttctgttcacgtagtttcatcaatagattgttttttttttctctcttttgtactactccatacctcttgaggatatggatatcaaattctgctctactacattattcagaatcatcaccaccacatcaaaaaaaaaaaaggtgagttctttattccagtaggtgaaatagctagtacgtgtacgcccattacctgagattttcactaaaacgaacgatttggtattgatttaagatccctagcactagcagcagaagcatggagatgaagggatgaggtgggcacctgcctccaatgtccccatgggcgaccaaccaaccggcggtgatgactcccctctcaagagacgaacctccgacgaaaagaggggcgctgaagaagccgaccgaacacctcctcggacgtcgttgaggcggaggatgggagaggattgcggcggcgctgcggaggagtcgagaaacggcggcgccgccacacagcggccatcggcggcggcgattaattccacggatcccccaaccagcctccgctgctgtgtggccttcgtcttcgtaggtttttgaggtctttgggctggctaactgtaactgggctacttcggtttacatgggacgatccgtgggttttcgttgtgatttggctcaccacaactatttttttttcttttaatatttacagaaataatctatcgacgcaaaaaattacaaaaatagaccctgccgccctaatggagggtggcaagctgatgtggcagacggcgccatctgccgccgtctgcgaaaattgcatttagccccctaaagagcatttggctggtacttttttgcatctggaccccttgccgccctggcccagatgcaaaaagtaccagccaaaaagtaccaggcccgggctggcttttttgcatagaggccctgagggcggcaaggattgtcgtgcaaaaaaaccctccctctcctgtctgccgtcaccgtccgtccctcccctgtttgccacgtcagcttgccgccctctactagggcggcagggtttatttttgtaattttttgcgccgatggattatttctgtaaatattaaaagaaaaaaatataaaaatgaaaaaaaatccaactagtgtgagtggatcgatctataataataaatctatttatagattaaaattattaggttatctactcgtgggttggcccgcttacatatttaggtctgtctacgtaaaaatgtaagaatcaataacaaaatttgtgacacctaaatattcagtctcaattggttcggtgaaacatattgtgtgctagctaggccattggtcgattgaatatcaattcaacaactaggggtcaggtatatagcaaatgtgctcattttaatataccacgcaacacactcataaaaaccgaaaaacacttgacagacaccgcgagtgacccacatctttactaacacagctggccggtccaccaagcctaaacatcatcgagtaaccgaccacatgtgtccgactaaagaatcgtcatcaccaatactggcatagactatacctccgtcgcttcctccgtgacaactgacaaacacgccacattaacagtcaatagagtatatatgtggtagttataagaacaggattgatttgtttaaattcttcttcttctatatattcttattacattccttatctttacccaagagtactttaatgtatataatgtttctaaggctcaatacaatcgtttaattatgcagtagtatttcggtatcagagcagcaacctagggtcaccgttactttatgctttttcattgttgcccttagaagggaccgtatcatctgccattccagttccaactggaatggcagagggctacagtgatccatgctattggccacttacatccgtcggatcaagcgtggacgtacgagacccgtcgctacagtaattctaataaagtaaccgattgtccgatgtttctactgttcctctttgccatttaccccctaatggcagaggatgcgaacccatctccctcggggcaaccacttgtttagtcttcggctttttcttgtgtcattgtgcatcgccgccagattgatctagatcccctcggacgagtcttctcattcgtttatcacgacttcgttagcatattcaagcaaacaacaattgccatccatcctcgttcttgtcattgcattgaatgaggcatggtgccatggggtgggagcgacgctagggtgcactgcgataaatgcaaccaagggctcgatgtcattgttggagtagctacatagattcttagggcgggtttggttgcctacatcaagcttggcccgcatctgtagatgcaacttcctcttgtttggttgcctgtgcggccttctcagcctggccccgctgatgcaaaaagggcttcccagccaggctgaggagaaacgctcgattcgagcttccgagcgcagccaggcccggtggctacagcgggttgcatccgcgggtgcaaggtatttctaagtggtaatatcaaaaaagaaaaagtatccaaagctgcaaaccatgcaaccaaccaaacaaaatgtattccaaactgtacatttcatgcaatcaaccaaacagaatctcctgctagccaggctaaactgatgcaaacaaccaaacaaccgcaagtgcatctcctcggtcaggccaaacttagcctggatggaagagatgggccaagatgaggggatgcaagtaaccaaacacaccttgtacccacggccggggactcgcctgctgctttcaactatggctttatggtgccgcttgctaaatctagctatattcatggagaagatgagatgaaggaaaaaatacatgaacaatttggtctaatatatactccagtgttaaaatataagttataatgttcagtttcataggtatatatggtgttaaatttagtaatagatagctacgtgttaaaacggaaggagtatggactaaccatgaaaatataaaattataatggcatgacttgaataataatgatatcttttaaatggctgatattttttaaaacttaaaacttataatggcatcaatataattaactcaaccagatgaccaacctacggattatctacttaaggtcaagcctcattgctctctgggaccgacaggtgggtcccgatgaccattgaccactggcccacatgccagtgagtgtgtgcttctggtttcccattttccacttcgtcgcttcgccccaccctgactccgctccagatctccccgtcgcgctccgctccgcctcctccgcgtcgccgtcgtcttcctcctctccagccgatgcctcctcccaaaccctagccacctcgcaaaaccctagatcccctcccccccgccccaccacgccgccatggatccctccggatccggccctcgccatgaccgcctcctcatctccccgtcgctctcctccccgtctgtagagatggtcgcgattcctccgatcgcacgagggtagggggaagaggcgagcgctgccaggggaaaggggacggtgaagaggactgctcagcggactccatttgttaatccgatctctaatttgaaagaactgtatcttttccgattaccggttttctgttccaggtgcaattctaatttgttttatctgaattatcacatggaatcgattccttaatgaactttccaactgaaactaactgctgctctgagcaatcaataatttagttactactaccaatcaggttatatatataccatggcattcttgttttggttaacgatctctagctgacaagattctgtcgttgtgattcccgtgattttctccaagtcgaaggtggttaattactgtatcgacttgggcagtaatctgcaaaattacaattttaccccgccctcatattttttttttgacaattatagccctccacttttctactgctgttaagtgaggtggtactataaaccggtggtagtataaaccgatctaaactcttgaataaaactagatgtgtggtttagattgttttctactgctagcagagagcaccgtagtgggactctaattcataggctaaagaaaatttcacaagagaaaaatgcaagaaataaaggtatcgtgcacatttctactccagcttgctacctccattcctaatagagcacaatggtgtattttcaacacatacatcacgatgttgtatcaacacccagataaacaagtcacttgcaagttcaattaaaagtttattcattcaaaattcataactttttaccaatacaacaaagaaatcagctttacacattgatggaaatgatagatatagaattttactctgcctaatatatgtaagctcctaaacaaaagctaggacataagttaagtacatgccatcacaagagagaaaatagcatacaccacagttgaacagtttgaagttgagtatatgataacaagtgacattatgcatactatagcctagggcctcttgatgtttccacaataactcgtttcctgcaaggctcaataacctcgaaattaacagttgaagggactttcccttcgatatatcttctaataacttgtggagccctatatgcttctattagatctgaatcagacatgagcaactctctgtctaactcagattccatccgatcgtccgtagtcatcataatgccacagtcccaggatatgaatctcctaatttcgtatttgaaaccatatattctagtgtccagcgtaaggaactcgagtgaaggcgtgttgtcaagaatgtgacttatcaactcaactagggtctttgatgacatcagtccagtgatctttacattcttcaggttactgtagttgcatttaggaagcttcctcaattccgaggaatcttcaagaatgcgatcattcttagtcccgacagagtccaactgcataaaaatattgatgtaacaataccacaggtaaataaggttttgaaagtatcagttccaaaaaaagccttgttgcagttgtgatatatcaaacagttaaccatatcagtctatgttggtaaaggttatgttttcctaagtttgagctaatgcttttaacctttcactgtagctagctttgagacataacaataaacaatgacttacatgtaagacaaaagtttccaaggctggggaagcgtcaagaaaaaaaacaagagaaaaaaaatcatagcaggggggtgattcctttctcggtccaataaacaccatctccaagtacctgaggtagagaaatttattaggcaccatgggtgtgttgacatcctacagaaaatacatacagaaaaaaaattagtatcatatgaaggaatgacaatgatatgcctacatcattctccaataatttgaacataaaaagtactattaactagttggcacatagaagctcaaacaaacctcatcacgagtcattagaaacagattttcaacattacgggcaatggttggaagcttggtacgggcataatggaacatgcggtgccaagggtagagcaatagatttacatcccttaattgtactgcatctccgagtgatattactgtcagtggccctcgataatgaaaactagagagcattggagcatttatctctatcatatctaacctatggctatgctgcacacgcagacagttgagcttttgcagcacacttgttgtcttgaggaaaccaatcttgcaacaggaagagatttccaaactctccaaattgaaagaattggagatgaagcatgccaattcctccccagtaatgtccacccaactcaaatgcacactcttcaagcttctcaagcactcaaactgaagtgttggatggagcgtgcaggaagataggtggaaagattgaactgaatttcctctacggttatcagaaagcaaatgtgaatatgggaaggtgtattctgtcttgttgcgtaggggaagctcaaaggcgaattccttgattttgagtgtgctagcagccttaagccagcgatcaagatgcgagggatgcactgcatagccaggaccaagttcaagcttgaatatcttcacaccaacgcccgagtggtttcgcataatgttgtccactatggcgatgaaatccacaggtgtctcattgtcattaacaccttttcggtttagcgctaggttttctgcattgaagatgaggtttggatagcatctccaggaatgtagaaatgcatgagatacgcatgcagcacgggcagcgtctcgcattggcacatgggaaagtatcatcagcaggagatcctgtgcaggcatgggaaatatatatctttgatattagaatgatagtagctcttgttgtaaaacaatgttaccagtaatggtcactttttttggaacaaacaaacagtgcatacaagtgtggagtcaaacatggaatataaatagagcagatgtagcttgaaactgcaaatccaagactcagcaggactattggcatattgtattttgtcgaattagtggcttattcattacagctaaagtgattccacattttgttatatcattgatggcttccattgaaacaaataaacattacgccaatcataaaggtgtggagtcaaagatggcatataaacagagcacaaaaacataactagtaaaaaccacaaatcttatgcaacacaagacttaacaagactatttgcatattacttttgtcagattaccagtggcatcatcaaatattttattgtacaaagaaagtgtctaatctgtctaaaattcgaaatgtgcaggcaaacatgaaactatcatataggtatttaattaatttccctgttggacacttctgttgttaatactttgtacctctggaagggaaggaatatctagtttcgttgttttgtcacatggggaagaatcatctcgttggagaggaaactcctttctcttggttgcaacctttctttcagcttgtgaagtgctcgacccgcctgcaattcagttatgtcataatcagcgatccaaatactggtggtgaccaacaggtaaccaatctgaactcggtgactggtaccggaacaaaccagccaatttgaatataaattttaaaatctaaactatataccatcatattgttatagtctcatgcatcatattccgtatattatgcctcatgtccctcatcagtctattcaacataagctggtgatactattttgttaaaaaaaaagaaaagaaaggtgccatcccgaaaattttggccaaatttctgaatatcacttttgtgaagatataaagaacgaaaacctaagaggtcacaaaaatagttgggatttcggccaataaacaattaatctaagtttgtgatcttgaatgttgtagcactttgccctaattgtccgctaaatcaaataactggaagtgtaggtcgaagggatcagaaaccacacagagagagaggcagaggcatacctacccgcggccgccaccgccgccgctgtggcgtggataggtctatcatccccactccccaggcgaggagtatctcctcctccggatgaatctttgcgagagaagatgacgagaaggaaggctctgatctgatgaatccattccggatcccatccccacccagtcccaggattgaccacggtcactgcaggtgggccatggagtctgggcccactagtacacgcgtggcctcttctactaggaatttttttcgtttttagattttttttttaatatttacagaaataatctatcggcgagaaaatttgcaaaaatagaccctgccgctccaatggtgggcggcaagctgacgtggcaaacgggggaggaacgggcggtgacggagggtgggtattttgcatgaaaacccttgccgccctctggtggggcggcaaggggtccgaatgcaaaaagagccgcagggggccggccattttgcaggcggccccttgccgcccactagccgggcggcaggcctcgctgcctataaaaggcctgccgcccagcccccagccctcatttctcacctctcaactccagtgaaaaaaaagaagagaggggaggagaagagaagaaggggcgaagccctgccggattcagacgccgatttcaggtaatattcgtatatcctatatgtgactattgagttaaatagtgtgtatttttaaaaaatttgtttgaataaatgcattatatttttatggttttagttgtactaatttagaagtgtgtattgtagatatcggaacaacgtagatctgctagtttggaatcaatactttaccgttgcattggcttacacaagaagatattacgttgtagatgtttattgcatgaaagagtaatatgatctagttaattcgttgacagatatgtcgaacaaaccaatattccaagtttaccatagaccaggaaacgtccgttacgggccaactggggtagatctgtcagattttattgtatcagaaaggggaattgagagaccggctgagaggagtgtaccttctataaaaggatggttaatgaggggcttgaaagttgatccacagacaagtgacataacaatcaatgttatagtaagtcgggcaactgagggtttttattgggaactaatgccagttcaaaactctcaagtgtggagatggtatgtggaaaatgcaatgcaacgtgggtggcctctagctttggttccgtttgtgcacccgaaggatccaggtgtgcagatgaacatggatgatggcgagggaccaagcgctgaagtaaatgagacttctgtggaggaggtcaacgcaggagtggacaggggcgtagtagctccagtgggcattcaaccaggtggagtggccgacgagggggagactgtcgcagccattgtggatgaaatggagagggaggattctgacaacaagcgtgtagaggaaggtgattcgtcagatgaggagacggatattaatccagcagaatgggctagtcaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtccaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgttcagaaataccacaggaacattacatgtgcatttgtcgcatctgagatgtatgcgcatgtcatcgataatctcacatacgaaccaaggtcaataatccgacacatcgaggagacatacaagtatactattagctatgccaaggcctggagggccaaacagaaaataatagagatgagatttggaacatacgaagcctcgtatgacaatttgccacgcctgcttggtgttatcgaggaaagaaaccctgggagctcttacgaagtgaagaaattcccatcaattgaacatcctggcaagagtgtgctgtaaagggcgttcttagctctacatgcatgcaagatggcattcgtgaactgtcgtccagttctctgcattgatgggacattcttgacaggaaagtatcggggccagatactgacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgataggcacactggcattctgcgagcgatagaagagttgcagtttgggagcatggaacgaggataccctggtgtttgggacgatgtacagagtaggtggtgcatgcgtcatatgggagctaatttcttcaagcaattcaagaacaaggagctcatgaacatgttcaagaggctgtgtaatcagaaccaggagaaaaaattcaatgagctttggaagagattagatgagttgacagccaaatgcagtgatcagcgtgcagcggctccatcgactgccgttgatgaccctcctcaagctcttggacctctcccaacggatagtccaactttggttagaagaactggattggagattcagaaattttctcagtggattctgcatgaaccaaaagagaaatgggctaaggtgtatgacaccggtggtgctagatatagaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacaacattttgtttggaactttcatgcagaaaaagctagaggagttgcgtaaaaaggccatgaaacatcgagctctagtgcaaggtacccaacaacataggttcgagatactatgtcaagataaggcaggcaggggtatctaccgcaagagagtgaagcaggagtgtgttctcaaagccgacggcacatgtcattgctcttgttcaaagccgaagctgctccacaggccatgcacccatgtcattgctgccgcagcggagtgtggcataccagatgcagtatatgtgtcgcagtacttcagtaagcaagcaatatatcatacatggagcggcgagatttacgggttcggcatagctggggagttcacagagactaacgatgaagtactcaatattcctgacccatcgaagctccgaggcaaggctggaaggaggaggactcgtcgcatccgcaacaatatggacgagtcggaggctggcagggtaaagcgttgcagcaaatgcgatgaacgtgggcacacctataagcattgtcctaaagacaaggagaaaccaagtgcggcggaggcaggactatcaggatcagcagtagatggagctcgccctacgggtgaaggcactacctccactcgaccacgtcctaggcgtcgtcgtgccacgtctggctacgtggtgtagttcttatgttctatgttggcatgtgggtttgcttgtaatttgtttcgaacttatcgatgtgtttatgtttcgtcgtgtaatttcagacttcggcttgtcatgtctttaggtctcgtgatgtaacgtcagactaaggcacgtagtgtctttaggtatgctgatgtatgtcggacttcgacacgtaatgttatgttatgttatattatcgaactctacatatatgttaaattgcacgtcatcgttatgtaccattagtaatgtttgctttatttaaataggctgtactcttattgtacgtaattattctcatgatttttttactatttcattaatttgcgagtcatcttttgttttacattactactttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgatcgatggaggccagagacgcacacttttcacttgccgtgcggtgaggtagcccctaccctacaggacgtatcgtacttgttggggctaccgctcgcaggagacgctgttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattatatatttagtccgcagttaaggtgcctaacattttatcgacggcttgcaggttgagcagctacaggcggaggccgacgagtactcctacagccgatgtttggaggcgtacttgctctggctttttggctgggtgatgttctgtggcagtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttccgcgtaatgcggcagttcggcttccgtcagccctttccagtatcgtttccaaccaccgtcccagctgctgttcaccggtaagatcttgcactacgctttccgttgttgcattaaaatctgcctgttcacaataatttgtaacatctgtcgtttcacactaatattacacattaatttgcaggtactcgcgcaagggtcagcatttagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctacgccaggcaccgcgactaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccatccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatttcttagcttacaagggtcccgttgtcgatgtgtaggtttcgcccagttcgctatgacgcaggccgcccacttctcccaggctgcagggtcagcgtctcaggcagctgcgtctcaggcagctgtgtcgacctcgcactcagcgcagttctggcagtacaccgggacttcgtcacaggtagccggcacgtcgagtcagggtccaccactggaccatgctgggacctcgtcggaccgcttgctgccttccaccttcctcttcgacatcactgacttcgacttcgcttcaggctcgacaaaggacgtcatcggcccctcacagctgggaggcgcaccgccggtgcagacgcaggaccaggcgcaggccactcctccgcgggacactcgtgctacccgtgctgtgccaccggatcgtttcaccttctcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcactgatgcagcctcctttattcgcgtgtgatacgagtatttgcccgccatttggcgcatacgaccaatgtaactttcggcgccgatcatgcatgtatctttcggcgccaatcaagtgtaaccaccataccccaccacgttcacatgtcaggggcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctaggtcccttgccaccctctattggggcggcaagggacccagatgaaaaagtacggccgcaagctctttatgggcggccaaaattgcaattagccccttgccgccctctgtatgggcggcaagggcctaatcgcaattttggccgacggcggcagacggcgcggtcgacccaccgtctgccacgtcagcttgccgcccaccatttgggtggcaggggctatttctgcaatttttttggtcgatagattatttatgtaaatattaaaaaaaaatctaaaaacgaaaaaaattccttctactagtactaacaggtgggccgtgggccttgagcactggagtactatactgctccggtctgcgggccccacctccatccgtccgtccggccggtgacaatgcctcccaaaccggcagtgtttggctaatgggatagggaaaatgatttcccacccaccaaaagacatctttaaattctaaccattcatttctccttttccatttaatcttaaccattcatttatttcccaatcccaataccaccacccatttcccattatctaaacacaccctagaatctagatccacagccacggcgcggccttcctcatcgatgttgccgtgactcctcgctctagcagcggccaaggttacaggtgttgtagccatcggataccctgttatggcgtgttgccgtttgcgtgatagcaatatctttctttttttttcttcttcttctttttcttcttcccaaatttatcatcaatttagcagtactgacaaagctcgttttttgctttatattgaactagcagcatatatgaagtatagtgaaccaaaggctttgccttggaataatcctgatggtctatgctattatagcactctgtaaatttgtttgctaccctgctagttgcttctgtacagttgttcagactttttagtgaactctacctgaaaatcaatgtcagtactagtaataaattggtggaggggattattctcgaatttttatttttcacatgcttttagctatctgtcgaccttattcattatcccatttgttgtgaggtgatacttggccattttataattgatttcattctgttcatgcattcacttggtatttggtatgaatgatctaacttcttatcttgaattggttatgatcttccctccataagtttgaatagaattgggaaatcattgggtaacaatagtctttcaaaagtttctataggaagtattgttagcaatacctcaatcaccattaactgttgaaatggtgataccaatatttcaatcagcattaattctggtgttgtgatctcctgtgaatggtctccaactatgtaattcgttttgacctgactttatgcaaaatacaatgatgtttcagttacatcagggtttcatagtatgacatgttttctgaaatctgaactgaaaatagagctttgtagatctgaaaatagggtttacatcagggtttcatagtatgacatagtattgtaaatcatatccatctgttggatttggtgttaggttttagaaatcatagcagagtttggaaatcatagcagtgtttccttttaaaaaggttttagaattgaatctacttgtaatttatattatcatgtactacatgatactaaaatttattttagactgcccttctattctgtttgcacgggctgccctgcttcaagtgccattagttactgacaatgaacttatagatttatttctgaagttttcaaatataatggttggatcctcatggttaattttgcttcccttagtacatgtctgaaattgtcattttaattaatattttcatcaacgaaagtatcatcttagttatttttcatcaatgaaaggatcattttagttattcacaagtgttttactattcacacccccccccccccaaaatcccaacataagttttgggatggaaggtgtagctgtttagcataaaacaccttcgtaattaaatatttaaatccaacgacttggatatctgttcttttttcttcagtcagactatttgttctgttgcttatgtttaggtattgaatttattgcatgtcaaccttgcatgttattttggagctggcagtgtttcagtgtgggctgcgctagcggtaacaaattgaggcaaactctggatagttctaccaaaaataacagggatcaaggtcgatggggagataagctttatcttcgagagcgaaaaagcctagatcaggcccttaatgactgttcagtggtaagagaggtggggatgcaaagacagccagtaggtttgctagcattgattctttttattatttgtctgcgatcagcagaaagattcctggtgcttgactgcttgttgtggccagagggcttcttttttgttattgtgcagccacctattaaactttcatcggtatagcggtcagaatttcacaacagcagttctatgggtcagagtatcacaacagcagatatatctgttggctacacttcaatgtatggttttatagcatccaacccacatgaccattatggctgctcattgcaacggtggtgcttatgttaacaccagttacataagttatccctgtgaagtatgttgtcgagttgctggcttcttatgcattgggggttggagtttacacttggcatctccatatctgtttcagtacttcatccaggcagttgttccatatcctcatcttgttgcaacaatcgtctctgctgctgtctttctcttttagtattcacacatctgccatctgggtccagcacaatggttttccatgtgtgttctcttcttgatagcatcgtttccagtcacatcttcttaaaggacatctaagagcaaagagttttgcgggtgatcatgaagcaaagaagttcaccaatatgttggctatagaagaggtcaaaatgtcagtgtttggtctctatgctgctgtaagtttcaactatggagtgtggactaggtgttatgcatggtgcacctggtcacagcttggcttttccaccaaaaacaagaggtcatgagcagaggtagcttgaatgcctgcgattcgtaacttttctattgtattatgtatcgtctgccttattctcagtataactcttgctagtggctcagaccatgctgtttttttccctggtacctttccttctgcttctgaaccaggattgcggacttctttgcagggtttgatgctgtcagcattcctgttaacagcattgtatataggatatggagacctaagactagcaatggagggtgggcacttgatattgggggtcctaggctggctggctctttgctatgacaaacattgcccttctcatgctgccgttacctaatgctaatgtacatttcgattgcttcatttgagattttatatatgtcaggcagacagatgcgaattgtgaagttacttctgatgctggctttcaacaatgccgccagttataatgccacaaacatactatgcaggtaataggatttttaattaggtgctctttattctctagcatcactatatcgtggtgggtaggagtttctgggataaaatacatttaaactaggagatgcaagttcagaggtatgtatattttgtcacaattgttgtgaatagaatctctagcttcctgaacaactgaaccaaaaaaattcggtgctttcttgcaggctttcagtcatacaacagtgattgctttcttaggttctggcagcatgaagtcatcttttaccgtgagttgggagcagaattgtgcaacaatcgccaattgtcatcacttttgtactagatgatctttctactggactagtggtaatctaaggtgttgacgtgttgtgtagcatattatatccctaaaatggtaccgaactcaactcatacagcacatcaccttggacttgtgaccagacaacatcgtgtcgatatgttctttattataagcctcaccaggaactgaccatgcgaatctgcattggtttgttgtcaaagtgactagtaattccgaaatgcagtgtaatgttctccaggtccaggagaccactttttgcttcagaaactaacccagattgggaggacatgtcgtcggtagtaaaattcgactcccaactaatagacccactaaaattcaacgaactggaacaacaatcggtagctgcacagattcgactcccaactaaaattgaacgaactggaacagcaatcggtagtgaacagaaatcgggatcagagcttacttcaagtctgacaagaccaccttgtcgtggagagtggcctcgacatcatggatgagcgcctccaggtaccaacgtacagcagtggcgcggaggtgggcgttgcgcgcgtcccaggacacgcgattcgccaaggagaccagatcgcggaactcctcggcggtgacggcgcgccccgcggctgggagaggttcgccgaagcgcgcctcgagcagctccagcccgcgcgcgtggctgacgaggtcggaggggagcacggcggcggcggcagtgacgcggtcgaggatccgcttgaactggagcttccgcttgttgaggtccttggacatgtccgacgccttgccgagcttgtccatgccgacgatcacccagcccatcctgcccctcgcgtacccaagggaagacatccgaggcgtcgacgaggcggtcgagctcctggacgacgacgcgggccaagggcggcgggtggtggccgaagacgtcctccagcgccaggacgtccaccatggaggtgacgaggaagtcgttgggaccaggtgccgccatggccgctctccttgctcgctgctcgggctcggatagaaggcgaggggaaggggagggctcgggctgagagggaggcaattggggcgatttgaattttcggtttcgactcgccgcctctaccttttataaagtacagtagtacacgatcgaggtggagaaaactgtggcggattcgattatctttttttagtggaatggcttaggtggtgtttgcataaaaggacttaacgcatttagatattaatttagagtctacttacaaaactaattacataaatgaaaaactgcttttgtaattacataaataaaagctaatttgcgagacaaatttttttaagcctattaatccataattagagaatgtttactgtcgcatcacatagactaatcatagattaattaggctcaatagattcgtgagagagaatgtttactgtcgcatcacatagactaatcatagattaattaggctcaatagattcgtctcgtgaattagtccaagattatggatgggttttattaatagtctacgtttaatatttataattagtgtccaaacatccgatgtgatagagacttaaaagttttaattacatctaaacagagtcttatactactcattaaggctatgtttaaggtttccttcaaatttccaaaaattccgtcacatcaaatgtttgggcacatgcatgaagcattaaatattttcgggaaaaaaaaccaattgcacagtttacatgtaaattgcgagataaatctttgagcctaattacgctatgatttgacaatgtggtgctacactaaacatttgttaatgacggattaattaggcttaatagatttgtctcgcagtttataggtggaatctataatttattttgttattagtctatgtttaatacttcaatgtgtattagtatacttaaaaatttttacacctcaacaactaaacacggcctaaattagggcatgttttgatcccctggcaacattttttaccctgtcatatcgaatgtttggacacatgcatagattattaaatataaaagaaaaaataactaattacacagattgcgtgtaaattgcgagatgaatcttttaagcctaattgctccatgatttgacaatgtagtgctagagtaaacatttggtaatgatggattaaatttttttaatgccgtaatgatggattaattattttttttagggaatgacggattaattaggcttaataaatttgtctcacaatttacaggcggaatatgtaatttgttttattattcatctacgtttaatactttaaatgtgtatccgtatatccgatgtgacatgccaaaacttttcacccctatatttaaacaacccaacccagatcatcaatttactgtttaaaaaaaacaggagtacaatatattccaagcagcaaaaccaactcatgcgtgaagacatcacaatatatatcacccaatttgagatgttagagtatatgatagttagagtcatattaggataggattgatttgggtggcctccttctatatttgtaatccttccttttctccttctcatgtactcctatatataccggcccttgaacctcaatacaatcgtaccacgttacgcagtatacctctccttctatactatccaacatgatatcagagcgggcaacctatagctgccgctcacgcttctgctgccatcgcccccggttctggtctcccgggggtggccaccgttttttttttcttctctcgtcgagtcgtcatcctgagagatcgatctctcaggcatttgcgtagtcatcaagcagcaatagtagcgtctccggtcgtcgtcgttctgcccgtcaccccttccgcgttcggcctcgggactgtacccgtcacagatctgtgccgcgcatgtcgtccgccagcgtccaccaaatccaagccgtcgtcgacgtgcggaacttgctccggcgtgacttgttgacggtcgttatccataagtttcgatcgtcaatattaccaaaatagaggagaactagtgatacttgcaatgcatatgtttgttagaataataatattccactagtattaggtatactaaccttttgcagagaatgacaataaagtggaggagaatcgacatcagctcaaacgataaattaatcggacgatgtcgagaaccagacttaagtatgaatgggccaagaactcagaattgacgtgacaaactgggtcagaattcacaagtctgcagagaagaacaacagagtaggtcaccagccgaaattgggctggattgggccggccccaggttcggctgaaccagggggttcggccgaaccctcctcagcgccatccgatccagggcttcgcctgaacggtgtggattagcccccaatggcggttggagggaatttccgaccattccaaccgtcacaaccgtcattgggaggctataaaaggagtttctcattctcacttcactcacacacctcaagcaatagctctctcatttctttcaagcttagtttagtagtatctatctggtggaataggaatagagtagaaatcaggagtccgaaagccttcgggagagttcgggtatggctctagtagcttttctcttctcttttgtaagctttgtatttttattagaatactcttctaaatacatttatggtattgaaatactttccgagtatatgaatgtctactttacattatgttcatgttatacttaatatatggctagcttatctaggaaatactttggtgcgggtataatgtttgcttatgcaattactctatgtcatgacaatgatattagagtagtatctggtagtttaggcgtggtgtctagattacgggatatcattatttagggttatatattacggatgagaggtgggccgctgatgctgacaactcagtacgggtattccttcgccccggtatataatcctaagttaattctctggggaggatattcctccatatttagccccggttgtatggtcatgacggactgtcgtaaggaactcggcagtcaggggtggcttctcgaagtaccaggagggcatcggatagagggtattagctagtatgtcagttaactagaatgtatgtatactatgtatattacaagtataggaatatatttttttcctcttttctttccacttagcttagatgatttattatgagaatgagtagttaaagcttgtgtctcactctactcttgaattatcttaacccctgcttagaatatgattatcacaagtaatatataaactattagttgagttctctctacatgatcttcccgcaggataaaaaaaatacgatacccttggaatactctcgggtgaaatgctacaatggtatatccgtgcgcttgcggatgaactctgtaactataatatactagaagtatttctgcgccattgctgggaattatatttctagtaatgtcgttaagaaataccaacagcgacgccgccggcaccatccgccagcatggcgctgggggacgaggtccctcctccgtcttccgccgcccccgacaccgacctgcacccgccgccatccaggccgacggggccccgcttcctgccatctgccagggagccggcctcggcgccccccaccggccggtcaccgcccgtcgacttcgcccgccgccggccaccgcctcccgccggccgaatgacgtcacaccgtcctcctgccctctgcatatacgccattggtcaccacgtcagcccttgtcgtctcttggagctcatgcgctctctctagtggtaaattattaagcgcgaacctaagaggggcatttggataattgccgaacctaaaagtggcaaatagttaaattccccccttgtcaagagcagagaagggataaagcgttttgaccaggaggacgtggacttggtctatggaccattggcattggactttgctggactgctactgattgctgctcgtgctgttattttccttttacgatcagagatcggtttgcgtcgcccatgccatcgtttcactgagatcaaggatgttgttgttttgctgtcccaggctacaacgacattgtccaacatcgtcgtcnnnnnnnnnnnnnnnnnnnnnnnncgccgtggtcaccatagtgttttttttaatttctttttctttatatttttttcttttggtcgtcgtgtttgttggctcactacaaaaaaaatatgaccttttatgatgaattcctcgtgacgtcagagctattcatcattagcatattccattttatgacgattagtatgagatgtagtggcttagtgacgaaaaaaaagtgtttgtcgttaataccaactggaaatcgtcataaagtatttcaatgggacattgtgatgaatattaatttttcataaggggcaaaaagcaaacgtcatagatttatataatgcatttctagaaaaatatattaaaagttgaagcaatttaatcaagtgaattaataaggaaacaaaaattttcctttaaaaatcatggccggaaatatttttttaatatactaagtagtctaaattattctctgtaattttccgtgaattttcgaagctcaataactaattttaataccacaaagtttatttaacctattaaaataaataaaaaacaaattaaaatcactctctctgtccttgggcctttttcggccaagtgttactctctccctctctcagtccacaacctctctctccctccttggtggcttcctcttcccctcctccctcctcgggccgctggcctagtccttttgctcctccctcaccgagaagtctatttttcctcccttctctcaattccaatattttttcgggtagtaaatgatttcaaatgaaaaaattttcaataacaaagttttataacttatcaagatttacaacttttgttttggtcattttgctatatgactttgtttcaataatttgaatttgaatttcaaattatgacaacttcaaacaacattttcaaatactaaatgatttcaaatgaaaaaagacatcaacaacaaagttttgtaactcatcaatatctacaacttttttttggtcattttgatatatgacttgtttcaataatttgaatttaaatttcaaattatggcaacttcaaacaacattttcaaatactaaatgatttcaactgaaaaaaatcataaccaacaaagttgaataactcatcaatatctataacttttattttggtcatttcttcatccgacaaagtgatactaacattgttcacaaaacttacatatctctcttatagtttataaactactagaaaaaatgcctgtgcgttgcaacaggtgaagtctattttaatcttattattgttatatgatttagttaagatgaaattcaccgtgggatttcgcttggatatatatatttttagaaaattatgagctacagttaggaatctgatcgtctcaagttagcatgtgagttttttttaaatatatatttcttatatgattccttctttattaccaaaagtgaacgatcttaaaaaccgactcaaatacgaatatgtatttttaaaagtaaacgaacttaaaaaccgactcatacacggatgtcgtaccaaaatactagcaaaaaacattttcaatttttataatagtagagagaagatatagattaaaaccaaaacataaaattaaaaccgactcgaatatggatgacgaaccatggaaacattttcaatttttataaccgactcaaacacggatgacggaccgcgaataacatcttcaattttataatagtaatagatataagagatatgtatattttgcgaacaatttacaaatcacttatttacaaatcactttggcggatcaagaaatgaccccaaataaaaagttataattcttaatgagttatagcgctttgttattgatgacttcttcagttgaaatcatctggtactcgtaaatgttgtttgaagttgttataattttaaattcaaattcaaactgttcaaacaaagtcatatagaaaaatgaccaaaacaaaagatgtagatattgataagttatacaaatttgttgttgacaactttcccatatgaaatcatttactaccccaaaaaattatttaaatttcttatattctaaaattcaaattttatatagttcaatcaaactcggatggagaaataaccacaagaaaattggtagatctcagtaagttctacaactttggttttgacaactttttcacttaagttcatttagtatgataaaatttgattctaagttttaatactttgaaattaattttttccctccttacttcaaattttttcatcttctctcttgcctcctctcctgatattttttcatttcctctcctcgagaaaattgcatatgtaccactcataaaaactggcttcgctataatgccaccctcaagataggattcgcccaaacaccactcttaacacgtgggtattcgctggaatgccactttcgggcttttttccatttcggaaatacttttcatcaatttcattttttcttggactattatgcccctgagtcaactgattcggtcggactctttcttctcttcgtttcaatctagcgagcgagcgcgagaagtcgagaagagaagtggcaacgacatcggcgctgcccaccaaactgcatcgccgacgctgcctctctattccagccgccgcggcgcgcctcaccggtcccgccccccaacagttgtgccgccgcctctccccggcgagtctcctccccagccgcgccgcctatcctcagcgaagccctaggccgagccggccgcatcgacgcgtacggccgtgccgtgtctgccggcgaggtgctggcggcgcaccccaaccacgtgctgagccggcagtgctcgtcgcagcagggggcggtgggccggatacacatcgtgtcgccggagtcgaagctggagccggcgagatctacttcctcatcccggccgcctccgtccccgatgccaagaggaggacgagcaccggcggcgccaccggccgagggcaccacgtccgcagcaagtcggagggcagtgccgccgtcgccgattggttgggcagcctgggcaacgcgtcgccggagacgacaagggtgatgagggcgcataagcagcaccaccaccaacaccggcggcgcatgagcaccgggagcctgcctcgccgtggcagcgcacatcttgtgcatcactgatgacccctgagcttagcttttgttttttttcttctcttctctgaatttatagtggttttcttgtctcctgtgtaatttcctctggtgcccggtaaatatttttttcactttttgtgtcagtgatgtgccaattttacattctgaaatcaacaactgtgtataattttcaagcacaaagcgacttctattctagtagtatcttcttgtatcttcgaaaaacattttgcaacttctttttaaagttcgtttgggttaaccaaagcgaacgaacttgctcatacaaaattaaacaagtcggcagctctgcttgatgcgaaattaaatgaaaattaaacctcttgcaagttatatatatgaactcatgaagtgaggttgtgtgtcatggactcatggtgtatgtcaccgaggaggcggcacaactgcgcgcggaccaggaggaggcgaggagcggcacagctggagaggacatcggcgcggcggctggagcagaggtagcggtggcgcagtggtggtgggcggcgccggtgtcactgccgcttctcttctcgccttctcacgctcgctagattgaaccgaggagaagaatgagtctcaggggcataatagtccgagaaaaattgaaattgatgaaaaatattttcgaaatggaagaaagcctgaaagtggcattccagcgaatgcccacatgttatgagtggcgtttgggtgaatctcatcttgagagtggcattatagcgaagccagttcttatgagtgtagggatgaaaacggagcggatagtttccgtccgctccggataaaaacgaatacggatacatctcggatcggataattctcggatagttcggatacggatacgaatacagatattttctcttgggtacgaatacgaatatggtatcagggtttccgtcggatacggataataattcggatatccggtgaacagtgctattcagatatccgcagaagccacaagacataccccatttctctataactctagtagtttatctcttaacactagtccacattattaatattatttaaaattttaaaattatttataaattatactacattttatataaaatgagctaattatatatgttgatatttgtttctattagaagttgaattggttttcgtgttccgagaaaaatttgtttccgtattcgtgtccgatcatattcgattcttattcgtattcgagatagtccgtatttgttttcgtattcgagctatccgtattcgtttccatatccggtaaaaaatatgaaaataaatatgatatgagcattatcggtcccgctccgttttcatccctatatgagtgtggtacatatgcaattttctccctctcctctcctctcctgtcagcctctcactctttctcctctcccctctctctctctcaccgacggcgaggacgggagctgcgcggcgcggcagcggcgggctcggcaccggcggcggcggcggcctcccttccccgacggcggcgggcggcgggcacggcgacggccggcggcggcagatctgcacggcgacgggctgggctcggtgcagtcgaccgcgagcgatgggcgctgcccccagccaccccgcgggcgcacaaggtgccgtctcctggcggcacgcgcgagggagacaaacaacgcctgcgcgagggagtcaatgcgagggggttcaggcgaggctggcggcgaggctcgcaccgcggcggctcctctcctccggtggcaaggtgctcggcgaggaggagaaggctgccgagaacatctacatcaaggtatgtccaccctgttcgcttcccaaatcttccttccctcgtgattcttgctgttcttgctgcggtagatgggctccagatgcaactagagatgtattggtgtgctgtgtagaggtttatggtgccaagtggtgtgtatgtgtgtgcgtgtgttgcggtgggggtcgattcctcttcgcttcttgctccgtcgcttcagggattttggctgatgggacacgtgaaccgtacggtttttttggtagtattgtgggtgcgcatcattttgttgagcggtatggttcggggaaatggatgtgctcctaattgaaatgaggctgtttttcctatgcgaattgctgagtttgcttcaactttcatctgttcatccatccttgtgctgttgtgcacctgttcaaatcaaatttcttaggatgacatattggtctgtgtactgctataataatagattacaagagcagtgtgcaaataagatcacaatttgatgatatattatatatatactgatgcaaacaattaatcagcaacaatttacaggttttgaagttgcatagagcatttaacaaacaagattgatgaattagatttcataaatacatatgagttttacgtttgggtctgcaatttctgcagagataaggtaattgatctgtcgtcagaagtagttaattcaccatgctatctgtacaggttgagactgaacattgtgcttgtagctaggtggagtactactcaaatgtttctaattaagaaacaccccctttaggatatgaaactcctgtttttatagagaaataaaaaaaatagctctaaaaacgccgcctcaacattagcttttcttgtagcgaaaacatctaaattcacagtgcaactgttgagttcaagatttcgtctacttccatctaaacatgtgaagcataatgccccattattcatgcatctgaactactacgtcagtggccaatgcaaatgccatcacctaaaaagaatcatgatcaggagtagggccagaagttgttgtcaagccatggcatgtttggtgaactagcacggccaagagatgctacaacaccggcaaatggtggcgtcatgggcatggggttcacttaagcataatgcatacactcatggacaatttagggaaggaattgaagaataatcagtccatcaatcaatcagcatccttttcttagatcatgcttggtaaatgtgaagttctcttgtttgtttgtttatggtaggtgttgttttgagtaagctgggtaggagtacttgtttttggtgactctcactcattgacctgagctggtggtgattagttaaaaaaaaatggaaatgggaggaagtactacatcagtacatgcatatacattgcaaaccaccacaaggaatcaggcatcagcatcagcatcagtcatcacttggatttgtctgcgtttgtgtgtgtgtgcatcttttgtgcatgcatatatgggtgctagtataactttatataggaggcatttacacacagccacagcagcagtgtactgctctgaagatctgcaatatatgttgcttggtgttgccgaaaaggagaaagtccttcacatctatcactgtctaactctccaccagaagcaatttgcattttttgcattcctcacctcacctcacagtaacatagttcttgacttgtattcaaattgaaggcttgtttgttaatctcatcagaattcagaaaccatccaattcatctttcagaagaaagtatatatatatatatatatatatatatatatcgttttgcctgatctctgagcatgcttagtttctttgttacaaaatgctgaaccgagctgaactgaaaatttcagaaatgtgtgatgtgcaggtggagataacatgcagagggagacagctcctcccgatcctgacattgcagcatgtccgtgacatcagtaactgcttggatattttttattcatctattatactgcttgaacagtagaagaaactaggatgatatggcagttactgatgttttatcttgtgcatatgcagtgctgctaagctcacttagaagatcttggtcacgcggcatccggtgaaattttggttgctgtgattgtatttggaatgtggctggatttggctgttaactgtgttgtaaattttgtgttgtattggatgtttgtcgggttgtgttgatgctaattgggctgtaacatttatgctatatgggtttttattgtgtttgattgttgggcctatatgggcctagcccacttgttatttgatactaatataaatgaatataatatggcgggctgaaaaatgatgtggtataatgtttgggtctatatgggcttttgtactggacttggcccatttattatttaagcaaatggatataatataattgggttaaaaatatgctatatcatagatgggtcaggctaaaatctagtcgggcttgccattgggctaagctcataaacaaggtactcaatacatgaattttaatgggccactagatattttatgacttttttagactagataatgacgaatatgagcatcataaagttactttatgacgacagaaggatcgtcactagattaatgatgaaaaaataaggtttcgtcatagaacgcctttagtgacgcatgataggtgacgggaattttcgtcacgcgagtgtcacagattacgaaacgtgacgaaaattttaatgtttgtgacgtaaatgaagcgctatctatcataagatctcttatagtggcttcttgcctgcacctgcgcactcttgcgcctggcgccacaatccatgccacgaaccgcaaccgcacactattgggtgacttgtgctatattgatattggcgataactggctactacgactacgacaactttatctcggctacatcgactacggcacaaaaggctatcatcgtgttgggtacttttgccggttttttctccagtccaagtgtccgcactgctcacgcttggactgcgggggatgttaaagtatatggtagttagagtcatattagaatatgattgatttgggtggactcattccatatatgtaatcctttcttatcctccccatgtacacctatatataccgccccctgagactcaatacaatagttttatgttacgcagtatacctctcctcctataatatccaacatgacaatccaaagcaaattaatattaggagacttgcaatacctttcgacgtgatcactgcaaaatcagtgtgttctaaagatcaaaattcatacagcaggtgatgatcgagcatattgacaaatgacgaatacaagaacgagagtgtatccacgcaaaaaccacgagccgcttctccgtcgatcgagatagtacgctatgtcaccacgagccgcttctccgtcgatcgagatagcacgctatgtctccagggacgctgcctccgtgtcgagctcagccgcgcgcctctccagcgcagaggcccagtcacgcgagcggatcgtgtcaagcaactcgctggcctggagaatcggctcggagaagcgcttgatcgagaggtaatcgaggcaggccgaatcgagagcgcggaaatcatcgtggtcgatgtggctgaggtgaagccataccttctccatctccttgccatgacggatcctggcacgagctacctcctgtgcggaggctatctcgtcgtcgtccagcgacaccaagtcccacaactcggaggggatccgcttgccatcgaccatgacctcgtcctgcttcccctcaacctcctccccctccccctgctcctgggccatcgcggcgtcctcgacgatctccccctcctccaggtccatcccggcgtcctcgacgatcctatccgtcgcatcggaggaggccccctcgccgccgcccacgaactcctcctcctcctgctccatcgcggcgtcgtcgactatccagtcggtggagtccgaggcgcccttgccgccgcccacgaacccctcctgctcctcctcctcctcctccccggcaacatccctggcgcggcgacggaaaaaactcgtacatggcgttctgctccactaagatgcgcagcagattgcgggccacgtcgcgcgtgatgccttcctccggctcatcatccacgacgagcagctcgcgaagcttctccgcgcggttgcggaactccgcggcgcgcgcacgaagggcggaggctgtcgtggtcgcatccgccgccatggcgtatgcgtgggcgtgcgcgtggcgtgagagagagaggagaggggtcacaggtgggaccgtgggaggagagagaggaagagaggaggaggctgagctggaggaggggaatacgatttttactttatggtttggactatttatagcccagcttaaagcaagcaatcagatgatatttcttttttttggtatttacagaggctatgtgtattgaacatatttgacatcaattccaactggaatgcccgttgctcactacgaaaaacagttccaaacctattttgcttcaagcatgcatgtgacatacatgaacaatgggagcaatgatatacatagattttttttctatcttcttactttcactctccagtctccatggcaaacaaatacacaccaaattcgccataactaaagccttttgagacaccatgacagactaactaacggatgaaacaaaattgcgtaatcctaaccaacctaatcacaatcaagaacttgagccggtcgttgagcttcttccggcgacgggcgctccgccatgttcttggccgggatcccctccgctggcgttgcgacggatggagctcgcgctcattgggggaaacgagagctcgcgctcattgggggagacgatcgtcagaggcccagcatcacggccttgccgcgtccacatttgcagagaacgtgtagtggtcacgggcacagaagaagcggcggcgctccgggcacgcccactgcgtcgaacaagttgaagccggtgaggccaccgaactccggcattttagccggatgccgacgcggtgccaatcgaagccgacgaacaccgccgcgttccccagcgccaagaaacgccacccggagacgtcgaatgatccggctgttccggccgctcgccgtgttgaatgatcccggacgcggaggcggagcccccatgaatagatggaaccagcgccagccatcgacccccgtgcgagccggcgacggcgccgacccccgccgcattgtagtaccagtcttcatcagccagcccggcgcgcggaaccccatgtcatgcctccggcagcggccacggccaggaggtgtgctggtcgcgcgcggtggctccctgcatcctgcgccgacgacgccgtcaccacatcaacccctgcggtggctgcgccgcgctgctcgactgctcgcgcccatatttccacttgtgacttgtgccactgctgctgcgagacagccagatagagtatgtgtggaattactgctaaaagcccaatttggaacaaaagaaaaggcatatactataagttttaaaggattcctatcttgtgagaagtaattatatgcagcattttgaaacaaaaagggttaatccctatcaatgccgttaaaaatttggctgtgtacatctgattggatgttgagactgggtttatcccattttctaaaaaaaataccgttaaaaatattatgaaatgggctggaattttggaggaaaacaagcatggtatatctcaccttatgttttttttgcacgtttgtgacttgagtttttgaattatatcacgataaaaagaaccaacatttcttcttcagctttcaatgtcgttgccatggtctcactctcacgaacttatcctattgttaagcaccacgggaattttccttgttttgacatcgagttggcccaccctgattgctccatcgaatcccctacttctatttcgacatatcaacgccgttggctcatttcaccattcactgatttatccccatctttattgtaaatgatctgaacataggttgcactttccaatatgttaattcactaggccatggttaacgtccgtagcgcctatggttcattccttatagtccattgctcctcttggatttagggcctacttaagttaagggaacttctaataaccatggctactttaagaagctccacaccaacttctcaaatactttagattctcaccctacattttaagagtagttgtagagtcgatgaactagtagacattcttttccaccaagaagatactcgtgaagtacttttcacagtctctaactctacaaacaaagtatgacttgttcatgatttaaacttttagattaattacggacatggccacataattattccatcctaattgctccaccgattgccatagttaagtcgaatgatttagcccataaaagttttatctttacatttaaccttgtgaaagcctttctcggagtttattcttacacacgacatttgtgtaagaataatataggtccgatccgtcgttgattaaaagctaactccaagttaccttgtaaaacagaccaatctaaatttatgcacatattattcacatcttaactactcctttcgtccataaatataaaatagttttatctttttatccatccaaaaatataagatatttgattttttttatttgtagacaaatatatgaaatattaagatctcgaggacatcaccttagttatccattcaatctctcagcctaccttttttttttctttatttctgttaaatatgtcaaaaaaaaataacaaacataatctcatttatacctttttgttgctatcttaagttttatactagaaaattggtataatcccttaaataggtagcaatgtaaaatgagttagaaataaacaagattaccaaccaacgtttatctacttaaggccaagcccattgctctctgagaccgacaggtgggccccgatgaccattgaccactggcccatatgtcagtgagcgtgtgctgctggtttcccattttccacttcgtcgcttcgcgtcgccccactcgattccgctccagatctccccgtcgcgctccgctccgcctcctccgcgtcgccgtcgtcttcctcctctccggccgatgcctcctcccaaaccctagcccacctcgcaaaaccctagatcccgcgcacacccccaacgacgccatggatccctccggatccggccctcgccacggccgcctcctcatctccccgtcgctctcctccccgaccttctccaccagctccccctcccggtcccccgcaccgcaccacgaccgccgcaactccacctcctcgccgcagccgctcctccccttcccttccgcttcttcctccaggtccggtggcggcggtggagcagccgggggcccgcgcgccgcgggggcgttgtcctccgcgtcgcagccggcgttcgcgcacaacgcgcgggtggcggccgcgctggcccccgccgcggcgttcctgctcgacctcggcgggctcccggtgttcgccgtcctcgccgtcggcctcgccgccgcgtacctcctcgacgcgctccgacagcggcagggggccttcttcaccgtctgggccgcgctcatcgccgccgacgtggcgttcttcttctcggcctcgctctcgtcggccgcgtccgcctcggtgccgctcaccgtgctcgcgctcctcctctgcgccgagacgtccttcctcatcggcgtctgggcgtcgctccagttccgctggatccagctggagaacccgaccatcgtcgccgcgctcgagcggctcctcttcgcgtgcgtgcccatcgcggcgcctgcgatcttcacgtgggctgttgtgtccgcggtcggcatggccaacgcctcctactaccttgccacattctccatggtgttctactggttgttctccataccacggccgtccagcttcaagaaccgaaagcaggatgctccgtggcaggataccgatggcattcttggccccttggagagctgcgtgcatgctttgtacctgttgttcgtgccagtgttgttccatgctgcatcgcaccatgctacgctcttcgcgtcatgggccaatgtgtgtgatctgctgctgctgttctttataccgttcttgttccaactctatgcctctacacgaggtgccttgtggtggattaccagagatgtgcgcacaatggatcagataaggatggcgaatggcttggttgcgctggttgtagtggtgctttgccttgaggttcgagttgtatttcactcgtttggaaggtatattcatgctccaccacctctgaactacctgcttgtaacggtcacgatgcttggcggtgctttgggtatggcagcacatgctgcgggcaaggttggagatgctgttagctcggtagcctttaccgggttggcagtgcttgtcagtggagcaggtgctatagtcatcggattccctgttatggtacgttgcagtcttatggtatcctcttgtagtacttgcaaatttatcatcgaattttgttttttcttatgcttgtagctgtatgttaatcttagtcactgaccaatgtgtttcaaggtgacacttggataatttacagttgactttattctattcatgtatttgcttggtcttttggtatggatgatctaagttctcagaagtcgttggttctggtgttctatctgttaaattgattagaatttgagaactcattgcataacaacaatcttttaaaagctactatgggaagttattgtagctgtatctcaatcattgttaactgtggaaacagtgttaccaatgtctcaattaacattaattgtggtgttgtgatctcatattgattctctagtacatggcaatagctggctgtgcatgctctccaactatatactcctttctgagttgatattgttctccctgaatttgtctactcaagctggtgtgattttagtttttatacagaaatgctgtacccaaatccatatattcctattgtgacactcctcaccactactgcctacaaaccttgggtaactttgctcctaagtataccatgattgtgaatttgtgatgattctcttgagtccttagctatttgttaagatttagtcagtatttctatttcagggtaattctagcaagctttgcatgttcatagttgcccatgcttgaaaaggaaacttgcatacacacacatgagcgtagtcttatttaacatcataaaaatgatgttcttgctagacttcaggtgcttaaatattcataatgaaacatgttctagagtgcatgggcatcatgagaattctgattgttgtagaatagctgtctcacttccctttgaccgactgtggtcttgaggcagtagtctgcccatagattttcttctattgtggttgtcctaccataccctcgaatatgcagcatcagcataaaaagttattacgtagcatttttatttttgatcactctatacttatttctgtgaattaatcttcttgcagttccttccacttccaatgatttctggctattatgcggcaaggttctttactaagaaaagcttatcatcatacttcacctttgtagcaatagcaagcatgatggtcctttggtttgtagtccataattattgggatctgaatatatggattgctggcatgccattgaagtcattcaccaagtatgttgttgcagccgtaatcatggcaatgactgttcctggtttggcgcttctcccaacgaaactgcggtttcttgtagaacttggtcttactggtcatgcattattgatatgctacatcgagaaccgattgttcaactatgctacgatgtactactttggatttgaagatgatgtcatgtatcctagctatatggttttgtttacaacctttctcggattggctctggtaaggagattatctgttgatcagagagttgggccaaaagctgcttggatcttgacttgtctttattcttcaaaattatcaatgttatttatcacatcaagatcggtgctatgggtttcagcggttttgctactcgctgtcactccccccttgcttctttacaggtataccacagcatcatgttctaattgagtgttttgacttctttatataacattcttccctgtaccttccagagacaagtccaaaggggcttcaaggatgaaagtctggcaagcttatttccatgcatctgtagtagccttttctgcatggctctgccgggaaacaatcttcgaagctttacagtggtggaatggaaggcctccttcagatggcctacttttgggttcctatattctgttgacaggtcttgcttgcataccaatagtcgctctccacttccctcatgctcaggtatttgacgcttacccctctgttgtaaaaatatcgatcttctcataatcatatttgttattatctgttcgtgatctgctctgtacttttgcactaaaattcttcaagtttgccttctcaacaaattccctagtgagggtttgcttcccagtggttatagatggaccactgacttaaaacactttgaggttgaggttctgtggaattttaaatgatgacatcaattgtcagctccagcttatttaccttcttgagggtatcatgttggttgacattgctttggggacactacttgctaaagaacattagatgcaaacattagatgatgatatgtccaatacatgctacacactggtaggattcaagctaaccttttttggttggacgttaccttgattttggtaaagttttattaagttccatatgttggatttcattttaggttatctttttaaagagtttttgaagtgatcctactcgtaagttttattatcatgcccataatgttaaaagttattttagattggtctaaggctttgcttgcacggaatgcactgtttgaagcacttttacttactgaatactgatcactagctaaatgcctatgcttctctatggataaaagaaaatatgccatagtattgcctaaaataaatgtattctttttttgcttcaggcatgttactcgcttgtttgctataggctgtgctcaccttgatcatatatatgtggcaacccatttatttataactattctgtaatagaaaaaagagtatcagggcgcaattataaaagctggagaggatagatgtatggatgaactttgaaaggagtatagatgaacttactccctctgatcccccccccccaaaaaaaaagaaagaaaaaaaccaacctagtatgggatggggcataatctagtacaacgatgtagacacgctcctgtccagattcattatgttctatctcgtactaggttgggtttttttgggacggagggagtacaggtttatacccgaagttatgatgatgcttggatcctcatgtgttagttttgcttttctcatatgtgtagtcggtattattcatattagaaagcatattattcagtgtttacagtatctgtttagcaggaagcaccttcattttgaaatatttaaattcaacattttgctgcccctatatttgttacttgttcttttcctttctcatgttgaagtgtcaaacttttggtaatgtgaacgttacaaggtattttggagctgctacaattgattctatgttacgatttgtttgcagtcagccaagagattcctagtgcttgttgtggctacagggcttctttttgttatcatgcaaccacctattaaactttcatgggtataccggtcagagtttatcaaagctgcacatctatctgatgatgacacttcaatatatggttttatagcatccaagcccacatggccatcatggctgctgattgcaacagtggtactgacattagcagcagttacatccattatccctgtgaagtatgttgttgagttgagggctttgtatgcattgggggttggaattacccttggcatctacatatctgttcagtacttcttccaggcagttgttctgtatcctcttcttgttgcaacaattgtcttggctgctgtctttatagtattcactcatctgccatctgaatccagcacaagggttttgccatgggtgttctctttcttggtagttctatttccaatcacatatcttcttgaagggcatctaagagctaaaaattttgtggatgatgaggaagcagagaacttcaccaacatgttggctatagaaggggccagaatgtcacttttgggtctatatgctgccattttcatgattattgcattagaaattaagtttgaactggctttgctattgcgtgagaaagctgcagacaaaggtgtaacacatggtccacctggtcggagttctgcctttccaccaaaggcaaggctacttcagcagcgaagagctcatgctgcgccaactttcactatcaagagattggcagcagaagcagcttggatgcctgcaattggcaacttttcaactgtgctgtgcttcatcatctgccttattctcaacgttactcttaccggtggctcaaatcgtgctattttcttcctggcacctatccttctgctcttgaaccaggattcagatatcattgcaggatttggtgacaggcaacgttacttccctgtaacaatctccatttctgtttatttagtattgacagcattgtatcgtttatgggaggagacttggcctggcagtggcgggtgggcacttgatattgggggcccaggctggttctttgctgtgaaaaatgttgcccttctcatgatgacattacctaatcacatactcttcaatcgcttcatgtgggattatgtcaggcagacagatgcgaagctacttctgacgctgcccctcaacttgccgtcaattataatgacagacatacttactgtgcgggtactaggactgttaggtgctatttattctctatcacagtatgttatatcaaggcggataagacttgctgggatgaaatacatttaaactaggacatgcaacttcttttgaggtaaatcttgtatgccctgcgtcaatggttgtgaataagagtctccagcttctgatgctaatatttcggtgcttgcttgcaggctttcaaccatatacgacggcgattgctttcaaaggctcttgcttgaagtcacatttgtctggtgaactgtgaacaaaattgcgccttgaagtagagaaacaatggtcagtagtcaccagttttgcccttagatgatctttatactggtaacctaaggtgttgtagtataaatgttactgaactcagctcgtacagcacatcaccttgggtcctcagaacctgtgaccatacagcattttgtgtcagatactttcttatataagcctcaccagaactgacatatgctgagtctgcatagattcttttgttgtccaagtgactaattctgaatggcaatgttctccacggagctgtctggttctgtttgcttcctatattaataccttttcaatgtacattatatatgatagggtatatgctgaggtcttggagagttggagtgactgatcttctgtttgtcagtaatcagtcagttttttcccaaaaaaacttttgatttcatgagatagttttaggatctgctttctgacttgtgaggctgttctttggtactacatgaagatttgcttcgtattcggaagtgcacgagtttcttcaggtcgcagtgatagacacgggatattctaaactaccatgtttgatgtttcatcagaacattgtctatgcaattttccgcttcaatgcatttacttatctcgaaaattggacctgttgtcagtcatcacaattaaaagtttttcttttttgaaataagaagggtgtttctcctgtggtatttttgttccgttgaaaacgtaatatgaaaacccgcttccttggtcacaaagcgaccgacgaatgaccggacgcgctgcacatggcccagacgctgccacggttgccaccgagccgcaccgctcttggtgggtcccaccagccaagcccgaatttaacgaggaggcgatggggcccaccagtcagccacacgtctcccaccacctccgcgatcccctctcctctcacctcgcctcccatggcggccgcgctcctccgccgcgcgctccacctccacctccacctccgccgcgcgctcccctcccctccccgcgccggcgcgctcctcctccccgccgccgcttcctcccccgcccaccgcttcctctccggcttcaccaccaccacccagcagaacagcgcctccaccaccaccatcgacctctcctccgacgagagccgccgccgcctcatcaacaggtgcgccgcccatcccgcttctctctatccttttcctttccccgcgatacctcgtcgccggcggcggttgttgacgttgtgttgggggtgggtgctggcgcaggctggtgtacaggagcaagcagcgggggttcttggagctggacctggtgctcgggacctgggtcgagcagcacatccactccatggacgaggccaacatccgcgccctgctccaagtcctcgacctcgtaagatatctttggctctttgcctgtctcccctcttatttcgtcatgtacaactattcatccgagtaaacctgttgccttgctgtaacagtagataaatcagctagttgaaactgttcccaatgaacccattgtatatggtctcagttatattttactgtttatttttccctggccttgggtcaatttgtaatttataagtatttgtttgggggtttagcctccattctctaaggctgattcgtagttgtgtgcttttgtaaagagctatggttgaacacctttaagagaatgtaaagcatcttgatgagtactgctcggtagattcagaagggccatgaggttttttgggaactagaaattattggttctgattgttgatgctgaagagttctgactatccacgtgggttagttttcttgttcaacaaagtcaggaaatagtttcagcccatcagaagtttgcattctagccatcctctgagtatcctctgagtagttgcaatgaatacatgggaatttgattgggcaattcagcaattgtggatcctagatccaagataaacatccagactgtacattcatggataaagagagtataaatccaggcagtggcttttgtgactgaaaaattcatagcataaagtggtataactgtaagtcatttgaccagacaaatttggtaacctatgagtctggttttcctttgaaccatttatctgcctcagagccttcaaattgtttttttttgggttgaccagaaatgtcttcttaaacaaacaagaataccaatcacattttagaatgtttagaatgtctatgcatcatctctcatgcttaacaacgttttatataacatgcttcatactgctcataacttcttggaaggcaagtgccatgatccattggacagccagtgcatcaaagtatccatttattcttgtgttgaacttgtagattggctctaagctctaatttatggcttttcaggaaaacccagatttgtggaagtggcttactagtcaggaacaaccacccgaggcagtgaactctaatcctgtatgtcatatcacagaactcttctatctttcttctatccttctgaatctctggttgcttctgtactcaacgggttttgtccaaacaggtatttatcgctgttaaatcgaaggtcacggacaacctgagcaagcactcttctcctgagaccagatcagcacctggtcagccatgggtgagagggtgggatgacaagcgaggcattgaaggaccaaagtatggaaatcagtgatgagatatgcttcagagaatggtagcggttttatgcctaagtataatcctgttttgttgcccctatagtttggtgcttgtgtagaataaattaaatcatggtatccaatgatttggaaatttggagtgtcaccatgaatttggattgacaaataatgctctgtacaagtttcaaacactttctggttgaagacaaagcagtgtggtggtaacaacttaacatgtaaatcaaaagctcttgtgtttagcattttctcgtttatgaaataatgatggaaaataatactctaaattgcaatgcacagacctatatattgcaaccaacaccttaagaggagggcctacccaattaatagaaggtcaatactaattgtaagttaaatgatgagagacatctgatcatcacggggcccctcatttcactacgaatcatagaactggtgtatatatctttgcaagatttgaaagaaaaaaaaacattgccaaggcacgaataattgttatactgaaattgcaatgttcattttgtggtgtatacaccatctttgccacactgaaaaatgaaatatatcgctcttatttacagaataaatgaaagaacgaaataataagatggaattatttttgacattatcgtacatcacagaactgcacagagaaaaaaaaactatcgtttgagaatatcacaattaatttcatcttcatataaagaaacgaagatcacttcaacagtatgcagaatctatgaaccggttgaagcttgttgagctcgcatcaccatttcttcagtagtttgccctataatgtcatttgcacgcttcaatggaacacatacaattctcccgattgaatcctgagcagacaaattttctgtcagaattaaaaaaaaacctcgaaatggattggtaacttttgataaaaacaagttagagctagatcttgaaatataaggattgttcaatgaaatttgaggtactttggtcactttctgcgctgcaattacatgtgcgtctgctaggacgagaatcaaatatttttacttggagttacttgaatgaatctcgttcgtaatcttacccgagatacaattccaagcttttctagcttcttcacagcatcaacaacgtcaaaattgcactccacaccaaattcttccttgatgagctgttcgcagcgtaaatcgagatcctgtaacgggcaataaacttcagaaagtccatatatatgtgaataagtcttaagggcataaaagtgaatatgattacatcctccatactctccatttatatgatgaacttgatgccacagaaactaatgtcagaaaacagagagagatgtgtaactagtgtacagaaaaattatggttgtgtgggcacaataaaaactgcaaaagcagataatgaatgcagaatacgtgtggaaacatttttttttcatttttgaaaagcatttattcaaatgggaagcaagtagggaaggaaaattagttatgggcagctgaaatatattgcataaacgtcatttcgggccttcagggagaggtatgattactcacttgtacagttgcctttccttgctccatcaaaatatagtaagaaacaatgacctctttaacctgcaaacccattttatatgtcagtggcatatacaaagacaagttatatatatcaaagagaaatcccccatggttccatacttcttgctggatcacatcatcacacaaatgcagaagtgttcctttcccactgtcaagctgtttatcatacatcgattttgtaatcaaattctggtaagacaccatattggcctgaaatctgtttgacaagagataaaaattctcggtaagcataacatcgtgtaatagaccatgtcggtatacaactgatatataccgaactgaatctaatgtttaagaaataattgtactatgataagtttaaccacttacgtaaagtagatcttagcacagtatccaattaaaccagacaagattgctatgacaacccatatatcagcctttggcatctcaagagaacctattagagtaacctgaaaagaaaatggctatttagatgctcaaagattaacttaccatcatggttggacatttagagcattaggcacataccaaacctaacacagcagaaataagaaatttcacccaatccattggagtcaaactagggttcttcttctctggctaaatcatagaaatactaatatcaggtacacacaagaagaacagaaggaaccagagaggaaaatgatataaaaaacatcacatatgaagcacgcttctatattaccagaactaattccatatcagccattggaatgttcttgaaatgctttacaaatattcctcgatccggcttggcttctgtgcttgatttccttttaatttacaatcgaaacaagaaagtattcagtgtgccaagccagaagatttaaaaatgttacattacttaggatggttagatgaatacatgtataacagagcgatacctatataccacaatcatcctttcaaatgtaggttcttgaattgtcatttgacttagtagattctttatgctgccaatgccacaaggaaaatatgcacatcagatataagttcacttttagtgccaaaagtttacatgtaaacactaatcaacaacctcagctccatcttttctaggcgaatgcgctcaacagaaaattcttgttcttctacttcttcattaacttcatcagtcttctttgggtcctttttggccctcaattgctttttcttagagaagagtctgtcaatcctgttgtaaaaccaacaccatcgttttaaagtaaatgattatcttccaatcttgaagtatgaaaaagaaatgatgttattgaaccacattatcatactttgtaactcttagcaatgatctccacacccgtgatattattacatccactttctccatgaagaagtaatcagttgtccggtcgattccaatgccccgccgaaatataatgtactgcaagcatggttgatgtgataattagttatgcaatatattatgtagaactgaaaaaaatgcatttatcatcaaatgtatgccatcatcatgaggtatcaatagaaagaaagaaagccatttagaacaaagaagactgttttttttttgttgcattcattcttttttcgtccaaactgttgcttatgctcttgaaagtaaaagaatgataccttatcaacggatgctggtagattatcatgtggatgtgctttgaagtaccttgtcaacaacttcttgtctacctaggatggttaaaaaaaacagttaagcaagtgaaatagatcatctgtttgcatgcatgtttatggcccttgattgaaaatattacagaagtaggttcagaccttggattcatcaactttgattggtaggttcagaagatactgaccagactgggctacatcatattcttcatcagataacaacttgaagttgctcttttccattatctagttagtatcatgagtattttttttagaacaaagggagtatgagttattgtcaaatctcacagaccacatatattttagctataacgaagtgtatatatagtggcttaacctgaaacatataagttaagaaattgagttcaagcgtttcaatctcatctggtgtcaggctttgctgctccaaactcttcacgccattaacaggatcaaatagggcatataattgctgaaccacggcacaaaattcagacaattgaaacttgatcaactgaagggagaactatgaaataataaaggagggggaaaaaagaggaagtggcctagataccattaggtcctcaaattgcagaagataccaagcacggatagtgtactccaccctcctacatagcttcaagaactcgccacgatccttatcttgctctgaagattaaacccaaaaaatgtgtggattatgacaatgtagataaatcataaaatttcaagtgcacagttccaaataacagaaattctgattcacacatggagaagagtaaaactagttgagagtttcagaaatgtcaggttgtttactccaaaagaaatttcagaaactcagaaatgtcaggttgtttattcccaaagaaatttcagaaatggattgccaatatactgaaatggagtaaaatatgcaatattcaccaacaactgagctagaaggacatattttttatccagataaagaacatcatcgcatttgagatcactgggaaacataaaaagtgatcaaaatccacatgcaaaggtttgaaacagattgcaaagtactccttcatgtcagacagataatgtaaatgtaatataggaccagtaactgtaatcacgggaactcccaagtatataacatgaatctttcgaatcgcagcatggtttcctcgtcagcaattaatcgactgtgcaacacatactccaaaagagcaagacagttcccagttcctatttgaaagaacccattcaaatcaacccatctaggacttgttagtttgtcataattcaaatcaacatgagtcgttcgtcgtagcaatcatgaatcgtgagatgaacaatttgatcaatcgttcgtaacccataaatttcaccaggagaaattaacttaaaaaaaaaaaagaacagacatgttcttgtccctcccatttccaagaaccgcggattcttgtggcaatgcgcggccaaccgatcgaccgatcgatcaaaacccaaagaaatcaaaaaggaagaggcgggcatgggcgggcgtgtaccgacgaggtaggcgagcttcatgatgagcttaggcttgaggatggggatgacggactccctctccagccgtatcacctccttcaccaccccgtccttcttctccctcctcatcctctccgcctccgcctccgccgccgcttgctccatcgatcgatcgccgcccggagcaacgtatataccctacacctatccgaccctgatctcgcagccgcagccgtggaatcggggcaagggatggcgtcgcgccgcgggaagaagacgatgccgccgcgagagagattagagaggtaattaattaagaattaattactttattagtgattgattaattaggagttgggaagaaaagaaggaaagataccaaaagtagtaaacacgtgagggtgtgtgcacggggcaaaagcttccggaatcgagggcctgttcacttcgatgccaaaaaaaaccttaccaaattttggcattaccaaaattttggcaattttggcaactagccgaaattttggcaggatttcttatatagttaccaaaatttggcatgaaactaaatgtagtcatttttttggtaactttaccaaaatttggtaaggttgaaatggcataaaagtgaacaggccctgatttggtccacggaaaaggctcatcatgggctggaccgggccgggccgaagtgaaagcccagtatggcccatggtatttcggcccatattcagccggaaaaaagttcactgactctgtcaaatatacgtgtaatctgattcgtatgtttcaacagtattagatatcttgatcctcaaactattaaaacggatgcaaaacgactgcctcggtagttcattaaatcttgcttcgatggagttcattgtagattgatatgcataatgctgtttttttttatatgaagtgaaactgaaagcattgcagaatttgcagttcgttctgagcaaaatctaactgtattcatgactactaattataaaatcttaggggaaaagagaaggatgatcttggcaatcgtttctcatttttcttatacctcaaaatacatggcactttgggcaaatgtagccatcaatctagaaaaaatatggtggattgataatactaaataggcagtttggcctcctttcaagtttgagtttgcatcttttggtatcacaaggttgtgcttttcatcgtaggatgatcaaacaggctttaatttgccgacgatgcggcacaatgagaagtcaatttgttgtcaataatataggggatggatatcttcacccctaaaaaagtgtagtttcttctctaagatacagaaacttgccatggatttcctagaagcatataacagcacgtttgaaaagaaggcaaaatttaaaactctttgatgcttttcccccactgcagtggatcgatcatctcgtatgtttctccatctagtagacactgttcaagtagaagaacaagccggccaatgcaagtatcccgacggcgataccgataggcaacgcttgcctgcaaattgatcaacaaagttttttgttaacttaattaaatcattcaccatgaatcaagggcttgtttggaatgcaggatatttgacgaatgtaggtgaaatgggactagtttctgtggagtttgtgcgttcaaatttgtctacctaaggaaaattgaaagcagctcaaatttaatttaacaacttgtaatctttcttctgtatctatgaaaatttctgattacccgacggcttcgtcctttttcagctgctccttcctagccttgcgggcatcggtggcgttggcgttcttggccaccttaggctcgtacggcttgaaccttctctttggtgctccacaaactgcatcagcaatgcagggacagaagaaattcagtaatgcagaccaaacctcataatgtgattgtcccgaaatcatgccagtatgccactcaatgatccaattaaattgtttactaaaattccctatatttttcttgtttgattccccttaattaaaacagggtaaatatgctgccagctgcaaactctgggtgggtctctctcttccgattatggaacacagactgatacagaatgtcagctggtaatttcagtttaagctgtacaaagcctcacctcacacatcgaaaaccaacatatattctagttaaaactgtttattttgggtgagaaatcatgtcttaaaatctgttctcttttgaatgaaaaaccttgtaaaatcgctgatttttgcacatgttgaattcaccaaaaaaattgcgagctgttcttaccggggcagaagtacttgtcgggaagcttgtcgaagggggtcctgtcgctgtagatgtacctgcaaacgagcacaaagtcgtcaccaaattttgcacagcatcaagcagaacaagacgagatcgagtcgttcgacgcggccgcggcgaggcagtggcagaggcagagcggctggctggctggctcacccgcagtcgcggcagatgtaggcctgcttggacgcgacgccgaagcgcatcgtgatcctcgccgacgccgtcgacgccctggcgccgcgccgcggcggcgccggcgccggcagcgacagcggcgtgcagaacgatgacgaccggagcggcgccgcggcggcggcgggcgcgcgcagcgcctgcagctgcagggcggccatcaccaccgctcaccgcagcacaagaaacaggcgcgtggcgagctcgagatccgaggagagaagaagagaaggtaggaaagcaatgtggggggactggaggaagaagaagcggtggaagagaggggaggataagagggagcgggagatgattggcgcgcgcgcctgcaacgcaagcgctcgctctccttttcttttctccctcgctttttcgcgcgcgtggcgtggcgtggcgtggcgtggagccgggagctccgagggggcgagtgtggattggagaaggtgcgtgcgtggcggccatggcgtcccttcgcgcgctatccctttccactggacgggagcgccacttgccgccaattgcaagggctcttctcctgtaccgtttgccagggacgaaaacggtaggaaatggttggaaatggtatcattattttattatttttttaaaacgatcggaaacggtcggaaaattttcatatttatgaattcatctatttagtgtcaatttcaatgccacgctgatagaaattaaaaaaactaaattttaaaaagggtaaccatcagtaaaaatattattattgtactacctctgtttttttaatagatgacgccgttgactttttctcacatgtttgaccattcgtcttattcaattttttttacaaatgtataagatataaatcacacttaaaatattgtgagtgataaaataactcataaaaaataaattataattacgtaaattttttaaataagacaaacggtcaaacatgtgagaaaaaatcaacggcgtcatctattaaaaaacggagggagtattagttttgcgaaaacagtatcggtacggtcgggaaatttccatgccgctttcacccctaccgtttgctaatcccttcgttttaaaacataacaaatacttgttggattaaacatatcttagtacttcgtattataaatctggataaattttgtagcaccgagatgtgtttgtgctcaattcattcacattattgctatatttcaggacggatgaagtaggagggaagaaagaattgtcatttgtctatgggggtttaatttgacgcctaaattaaccgtattaaattttggtgttacaatgttttgtgaggttaagatggatagagtacgtgtagtggatgccatttaggataatctttgcaccattaccttgctaaattttagtaaatgcaaagatttgctggggtatgtttttgacaacaaaggggacaagctagaacaacttgtactctacacatatttacgcttcactgatatggtattttgccacttcacaaaatatatttcgatggtttgtcatcttggccaactatgataatgcatttttaaagcccaacacctgttcaatcggacgtacacgtcggaccgaacttgtggctcaacaagcaaaaaccaagaccagtgcaaactttgtgagccagtgagctggttgaaccgattggtttttaacatgaactgggcattaatccgcaatggttagatccgttgggcatatgaaaatgtggatttttttattttacttttttattaaattatttaaaaataattttctatttcaacatttaaaaagtgcttcatccgtttcatattataagattttctagcgttgcctcattaacatctactccctccgtcctaaaatataacacccttagatttgtcctaaaatataacaacttcaccacctcttcccaaccaattacaactttccaccattcacttttctcacctaccttcgctactaatccaatcacaatcctcagcattcacttatatctactttcttaataaccgtgtccaactctaaaacttcaacggaggaagtatataaatgtagacaatgctagaaagtattgattcataaagaacactgctcgtattaggttgaccaacaatttaacgatggagtcaatgagcaacgtttgacattacacaattacaggctatgcatgcatggccctaattaacaattaatgatcaataatctcaaaatgtaaatctgaacacgtacagaattaattaattaagtgattaaacacggagagcgacgacacacttaccctctaattaaattaaacatcatcgatcgatcaggcacatacacaatgatcaattttaattatctacttgcattttgtgattttactcctccaaccttctatctctcccatttcactggtcgctgccggtggcgggggcggcggcggcgccgtcgaccttgaggggctcccagtgcgggacggcgtcgctgaagaagcggccgacgacgcgctgctcgaggacggcgatggcgtcggggtgcttgatgcaccgcggcgtcttgtactggttcaccgacgagccgtgcgacacgcacatgtccatgagcgcgtcgaacgcccccggcgccacgacacggatctccagcggcccgatcgacctgtcccggctcctgcaccgccggtacaccgagtccagcccggcctccacggcggcgcagcacgccgccatgacgtgtgccaccttgtccttgtcctcgccgatgtcggctgcgtcgtcggcgtcgtcatggcatggcggcggcggtggcgagggagagggggtgagctcccagaagaggacgtagtggccggggatggaggaggtgtcggcgtaggcggtgtactccgcgaggacgcaggagagggggtcgaggaggggcttcgcagcggtgacggcgcggaggaggtcgtcctcggaggtcttgtcggtgtcgacgctgaggacgacgttgcgccggtgcacgaaccggaattgcggcgccgcgttgtgaaacccggccacctgcaggatgtcccccaccctgtaccggtacaaccctgcacacaattaattattaacccaattatttattattggattattaaaacgaattatttgggggaatgatatagtacggtattccgtttaaagggatgatattctagaagtatcgtctgatacctggcaggtatcgcttataccccatttgaacaggatgatacctcagaggcatcacctgatatctggtaggtatcagctgatacccaggtgatacctccgatgtatcatcatgtccgaacggggtatgttatatagcatttttcattatttgctccatcctttaaaaagtatgtttcctcagaaaaaaagagagtttctaatgcattgtttatactgcttgttctaaactattggttaagtttgtttatcaaaatatttaattcatccctagtaagtacaatccatgatggcgatccgctaaatattaaaattcaaaatgggcctcacattacaaactaagtacctatatgccttttttttttggaacacgtgattttttttggtaggtgattgttgtggcattttttaagtgattttttttatgtgaggagtgtgatagttgttagtaaaatgcttggaaaacaaaatatactaagtattccgacaatgtaagtaggggagtaagaagttgttgggccaaagaaaatgccagcacggccttttcagcccactgaggatacctgtcctttttggtgcagaggctctgtgtttttagcctgggccctctaaaagaacacctttctatctaaatttcttttaagtgacatactatcttttgggataatgaaactacataaacatttcaatccgtgaaatttactgagataaagaggcacataaattatactaactccgttcttttttgtttaacattggttactgcaaatttgcattaaccaacgtcaaacattgagagatgtaggtagtactttgacaagaagtcagtttcagtgttgcttaattaagttctggcaaaaaaaaaaattctcccactgaagtaataactatattttattcttattactcaaaataaaataaatatgcttcaagataattagcaactatttaatctacctagccttttttttgcggaggactttataaattttaatactgaattaaattgctgaaatattttggtacacatcactggccatgcatatgctacaataattggcactttgactttgtgccaggtcacacacttgtgtagggcttttccacgtgcaattgctatctatttgattcagtattgcattaaacaacttttatttaggagcatagtttatgtatggcggatccatcagatgatgtgcacagtccattttttttatggaaatgcaaatttataataaatttattcagctggtagtgcagggttgagagaggaaggtcaaagaaatcggatattgttttaatatgtcacatctcgatcaacttttttttgtgtcatctatcattgattcttccatgcataatatatcattgttttcagatgatgcacatatatcattttgatttgggtggaattaatgaatccttgagtaaatttaatcaagctaggagataatgcagtggaagtcaagcactctacgcactgcattaatcaaatgaggtatatgtcatatatcaaccatgcagcttctctagtgatctgtacaactgaactttctcaatgaaaagctagacgtatcattttttatcttttctttagctaataccatttttcgtgtagtagtagatagcatcatacatatataatgtttatgttgtcaaatatttttttaattttcctgcaactatttttgttttacccctcttaataattaagtatgcaatgaactatatattgtgactacatcctttcttgtgataactactggttcgtaattagatagtatgttaattatcaagatatttttcaaatattctagtgatatatataatttccatcacccaatatataaattatatacatattacacagagggagcaagtagttgataccaacgtctccatgtcgggttaaagtaagtataattaagtgcagacatgaaaggctataggcaagctaggagataatgcagtgggagtcaagcactctacacactataccccgttggcctagtagggaatcccaagctataacttaattatttggtcaaactctgaaaaaaatctactcaaataatcaagttaccaatattttaatcttgccacatctcatcacaagaaacataagcaactaaacaagtgtgctctttacttattccttcaatataaaagaaatggaaagtacagtaagctaataaaaatctattttatgttaacacccatgcattgccttggattaattagattaatttgaaaaatggtacctaagaaaataattctctgactccccaaccaatcgacttgcagttagcttatagcttatactacttgctagtaactcttatttctcgatgaaattaaattaaaccttcttttagatattaagtagctagcctcaagggaaaagatgtgtgatgttacttctgttgtaaactaaaaatcgagcttgtgtactgtggcttagggaagcagaattcattagtgtgtgactgtatccaccattagaggaacaacagggagaccacaaaaaccaaaacaaaaatctaaacaagttaaaagatagaacaggtgactcataaccttttcgtctaaaggacacctgcacttatctttcgaatagaccacaatgcatgccaggaatggtatcacatcgcaaaaaagtttcattttattgttttggtacgtgccaccgcaaaaaacacggagctgaaaaataccatcattttagcatcgacttgtagaacaggtcctacatgtcattctcatgtacgatgtcattttgcaattcgcgtatcttagtaaaggtggaacttacatgatgattttttttctcaaggtgcatgattattatcttcattatggaacattagaaaaacgttttcactaattcatttcttcttttctgggaaagggacttcacccctcctatttcgaggagatataaataagatttgcccaatttggatcgctaatcctctcctataggggcacttcatcttagctatgattttctgaataatggttcctacatgctgtgtgtattgttgctacagtttccgtgccgtctttgcgacagttaattagttgatcaataattaagtaactgtgctacatgttaatatttttatgttttattcactttaaacttaaaattacccacccgaaaatggtaaaagaaaattcgaggaacagtacttggaaaaataatattacctctgtttttacgcatgacgctgttagacttttccatagcgtttgacttcgtttattaaaaaaataatataaataaatatttaaaaatatatcttaatattatggttcctttgttgaaacaagtcacaacaaaataaataacattttatatacttttttaaataagttaaatggttaaatgttggcgtcataccatggaggtagtattaacgtgagacgggctcaaccaatctcagccgttgattttgcgatcggacggcgttgataaacccatgcaggaggtgggaaagaaatcgaacgggctgcacacgcgctcacctgtgaaggtggtgacgacgagctcgtagtaggcgccgacctcgacgccgacgaggtccaccacctcgccgtcgcggaccttctcgccgtcgccgtccttctccaccttgatgaactcgtagtagcacatgttgggcagcagcgtgtacaccacctcctccggcgggtccagcggccggaggttgatgccgaagtaggactccgacgacgcgtacatcgtcgacaccagcggcagcccgccgccgtagaactccagcagcgggatgtactgcgccatggaccccgtcacgatcacgtcgatgtacttggtccgcggccacagccgccgcacgatgccccgccacgacgcgccgccacactcggcggcgatggcgtcggcgaggtcggggtcggcgcgggcggcgaggacggcgtcgacggcgccgcggcaggcggcgtcggtgacgacggccgggtcggcgcggccggcgcggatgtcggcgcagagggcgcgccagtggccctcgaggaacttgacggcgcggaggaaggcggaggcgaagacggcgccgacgcggagcacctcgccgcggcgggcgaggccgcagagcagctgcgcgtacatgctctggcggctgtccgggcagaggatcgccgcgtcggggctcgtgtaccgcgtgtacgggctgtccggccgccgccggaagtggcggctcttgtagtagctcgtcagcaccggcctcgccaccatccccgacgccgtcgtgatctccggcttcacgaacagcaggtacatccccctcccctcgtccagcccctccacgtacctgcacctccatgtcagcatccatggcgatcgatggcgaagccagcgagagagactcacttgttcatgacggggacgaggaggttgtagaggaaggtcttgcggtcgagctcctcctccgtcgccggcatcagcttcggctgcccgcctgacgtgccggagctgcggcgcacatcgccatgatcgaccgagtgattgtgtcaaattgtgaggttagccatggcgagatcgagatcgatcgagcttgagcttacctcgtgaggagctcggtgatgggcttggaggagatgagcgacgacggggcgccgttggcgatgcgctcgatgtacggcttcacgtcctcgtactccaccaccggcacgcgctccttgaacgccgcggcgagctcgtcctcgccgccggcggcggcgacgacctcgtcgccgagaaaccggcggaggtagtcggtgccggtgttcatggcgaggacctcggcgaggacgcgccgctggacggcggcggcgcgcgtggtcagcacctcgatgagctccaggcacgccggcccgtcgtgcgggtcgcacgccgggatcatcggtggcagcgccgccgccgtcgccgtcgccggcgccggcgaagaggcgtcgtggtcgtggtcgtggtcgggcgcattttcagacgacgtggacgtcattgttagatgatccatgcatgcatgcactctggcctagttctcagcttattcagctttggtgtgtgtgtgtgtgtgttcttgtatgtgtgcaagctactgtttttgcagaggtgagctccttcttggtctctatgtgttatatacatctcatcataagcatgtggaaacttttttagtcggacaaagagagaaactttttagacaggggtgaggatcctctatcataatatcactaccattatagtcattggtatggtatgtgagtccaactctactattgtctcacacgtcagtgtctgtaatggtagattatggtagaggacgtgaaccctttagatagagaaatggagaaaaaaatttagggagagaaagaaagatttttttttgaggaaagagataaatgctttttatggagagaaagcttaagagagaatttgtttagaggaagacaaaaggagaaacttctttttagatatagagagaattttttttagggagagagaggggggagatgtggtgtggacttataggagtgtgaaatttttttgtgtgtggtgcaacaaaattatgggaaagagagcacaaggtagtgtgtgcatgttatatttgagagaagggcctacacacatgtgaccatgtcttggaccttgtgattagatgcagctattatgggtcaaagttcatattggttgcctgcatgcctctccttaattttagtgtctctttatgtttctgtcattctgtgatgactgtttctttttgatctcttggcaaatagagccaaagttcagttcttaccagatgactcacctgactttcttctgaattttgacagtccaaaggttattagcttagtcattgtaaactacagcagaaatgttcagactctgaactccagtatttagcatatatacatgcaaagggtagaagaaaatgaacttttttgagtttgacgaaaagctaggtcaacttgtcacttgggaaatggtttgcatttaaaagtgcatatgcatctgaagttctgaacttgctcttcttctacttcttcagccggcaatctgacaggctgcaggttctaccatataaaaaagaaaaggggagaaattaagaagatttcttttgatgccctttcaggtgtaaataaaatactggatatatatgagtccatttgattccttgaccaatctgaggcaggccgaaactgttgtaaaatatgggcaatattatttttctgctggatagccatgtcacctagaatgtactgttgatgctatttcagatttgtttatgtggtgccaaatattgtagacttcttttattcagtatttttttttctgttcctgctttttttaaattagtgatctgatgctcaatcaagtgcatacaagattggctttgacacaacagtctgaacttttgacagaaatattagcagacaaaaattaatctcatgccagtacaattttccagtgaccagctgttctccggaggttactttaatatctcgaatacgtctcttgttgctgatgcttttatgggtgcttatcaagggagcatttttagtggaatgttaagctgacttgttgggacaccttaatttcagtcaagagtataatgacacacacatgggaaaatctcttgatcccaagctgtctctcttttgctgctgcagctgcttctgcttctgaatccaatcatgcctgctgccaagaagtgcctacaaattcgacttgttttttataaaaaataagaacacaaaactgtcagtaggcgtaattgaattattcaggctcccctgcactgttgcatcacttgacaaccttgattggttttttaatcagccaatcttttaaatcagatgtgagatgatttagccagtcagtagaaagaagtaaaataagcttgggagagatcacaaggtcaggtctgcaccagctagctgtccagcttttggtctcttgctgccattagtataagatatgtcatagttgattgatttaattttgtcatgttgctctcatcaaattgacacacaatatgtgtcttattgcgtctctgttatttgttactacctcctcccaaaagtaatttatttttaacctattttgcgtataccaatataaaacaaaaatactaaaatatttttaacttgagtaaacttcaatgcacttgtccattacaaactacaaagcattgattgctctaaagatgaggttttcgtgagacaaataaaattaaggaaaaataaagttattttgggacggagagagtactgaactagcatttctctactagcttcaattatagcccctttcgataatggaaattaatccagctctccaattatggctaggtattctgttctcatagaccatagactgcaaagactgaacttctgcaacttgtacaaagtaagtgccagcttacttcagcaaactttctgctacttgtgtattctgcaacttgttgtttgaaagaacctagttattctgatcataatgcatcagtccttgtattaacaaataatttctatataaactaattaggaccatgttacagcgctgtgagctagctgcatctcagttgcagaacatgacagtgtgactgactatatatgccttgcattggaaagagagaaaactgatggagtcaatcaacacctaatagggtcagtaaataattgggcttgtctgcaaagaacaaatgctataaaaagaaactgttgttttattgtttgctagcaaaattcacacagtgttgggagaggataagcctgttgtttagtgaatatatcaattgaatggggatctgctagattcggttcttaaatttaagtaacagggaaaaatatgcaagatgcaggtgacaacagcttaattgtgcagggggcagaagacccttgaaaagggcaggaaaagaggaggaaaacaaggaagatcatgtcacttctggcacaagctggtttatatactaaaagccaaaagccattgcatactactcttctttcacactcacgctctgtaattctgcattatccaaaatgaaatgcagggatctgagatagacactaaaaggaaaataatataattaagtttaacaacgaggaacatgaatctcattgagaagagctgagttggtgagcaatgacacaaaaaaaatgacttagtcaacggtgtgaaaaaacaagtttggaggagtgccttgtctccactttgattcttttatcaaataaaggtggtgtttggatccttggacttaactttagtcttaatttagagtattaaatatagactacttacaaaaataattacataaatgaaagttaatttgtgagacaaattttttaagcctaattaatccataattagataatgtttactgtagcatcacataggcttaatcatggataaattaggctcaatagattcatctcgtgaattatccaagattataggtgggttttattaattgtctatgtttaatatttataattagtgtccaaatattcgatgtgatagggacttaaaagttttagtcccatctaaacagggtcaaaggtcagtgatgtttttttcacccatgtagataggatacaaataggcatcttggggaaataaagtttcaggaaagaagacagtgatttgattctgttcactttagattttcaatcaacccataactgccaaggtacaaattaacagatgcaactaaataatttgatcattatgttctacactaaataacagacaagcatattgaaattcaatcctaaagatccatcttcgtcataacaatatgcagttcctaacccaaaacaacataataatgttggaatgaacacaatttgccccactgtggagggaaatatgcattattcgagtgatgatcgattcatgtctcttagcaactacagtagttaattagaaaagttgaaatttggtaaactaattccttcgattttggtttaccaatggccttttaaaccaatatttcgtaaaacgatggcactcatcacttaacaaatgatcatctttttttgttgtggatctgctctacaatatataaattttgtatctttagcatttgaagttacctcaccaaacacaaaattacatagtaagcactacatcatcatttgccccgtcaacgacgactcgagtggatcaaatattaggcaaattaaataaaaaaaaatggtcgtttcggtgacccatagagctgctttgtgtcatgtcatctctccaatttatatacatatgttcaattagaataggaactctcaggaaaccacttggtactttcttgactagtgataacaatgttaacatcctccaaagatgcatagatagaccaaaggaccaccactagcactttttctagtttgaagagataatattatgtcaaagtacaagctcaaaatcttgtcctgaggaccacaaggcattagtgagatctcactattctcatgcttcccattaggatgcaattgtatgggtattaaccatactcaaagcttgatgaactaatgaaatgctagcaaagtacaactgactttttagttggaaaacttatcttgcacattatatgtatgttgtattacttttcaataactagctagtagctagggtcgctatagactgctaactgtaagatgttttatttcattaatccaacaggccaaataatatcattcctaataacatcatgatttcgaattttcaatatggtttacttgcttatgtagttatgtgcaacaaaaatccctattggaggattaattttcaaactaacgtactatgaagaaaacccattttccttgttattaacacgctccaaaattccaaaactaattagttttcaaaaattctgtgaaagccaacgaagcacagggacatatggctggttattacctagtctggtcctggtacacttcacacaacaacacagtcacactctagtcagtagttcagtattttttttcccctgaaacaagtgttgtctctgaatctaatcattttgacaggatgggcgcggcgaccgaagtgcagcagatccaagaaatgagtggtcctaagacaaaagaggagggggatagaaaaatatgaacaaggcacaacttgtgctttgtgaaaccttgcaagatcaccatgggagacaggccacatgaactcaagtgctgctctcaactgatggaataagccatcacatggcgcaatgccgataaactaaccatccctttgcatttctccaagcaagaaatggtcactattctagctcctgaaaccctcccttcaaggggctccacatgagctatgcacatggattattctttggtcagccatcactctttgcacagctagcatgatatatatgttattgcagctagctcacataactgtcttgcgctcaccgaccaaatcttcagttattgtgcttgatcagatgcagcatctgggataaatttagctgtgatctagccatctagaaaagaaaccatttcagatgcatgctttgattccaactgcctcatttttgaagctcctgatgattcccttctgaattgtctttctcctgcaactgcagattggcacatatgttcaggtgggtgagcaaaggccaggaggaatcctttgacccgaaagctttgtgtccagtgtgttgtgcctgtttggagctgaaaagtgtgcacaaataattatgcaggttatctgaaagtaactaattcaacacaagtatatataacaataaccagtttaattcctactgaaacagactggaatttttactggactatgccttgcggtaacacggtatcagaaaaaaaaagtatgttatcaaatatagacaatttccctctagatctgtctcgcatatgaagtagtttctgcaatacaagagcgtagatactcgggtaattgtttctttgtttattgagtcatattttgtgttttattttcaatattggaagatcatgtctttgtacactctagtaagtaatccactaataaatacatatatatgcaaatggtgacttggtgcaattgaatcctaaccactcagctcaggtggttgttagttgatactgttcttacatgcttgtctgtctgaaaaccatccaacaaaggcctataatctacttaattaaaaaaataaaggataaaacaaaaatggttaccccttttaaatacaggaataggaaaaccacaagaattaaatacataaacgcatattgaattcctataggaattaaaaatacagaaagttccaaaactaccgtttggttgacacatagaagaaacacatgaattaagatcagtcaaaggaagaagaaaacatgaggcacaaactataattattttcctccaaaatttttataggattatccgttccatatgaatttccatgattcaattctttgtttcaaaggttttcttaggaattttcctatagaatcgaaatccttcaaattcatatgtttttcctgcaatttatgttagaagctcacatcaggatttgccattcattcctctatcatttttaggatgacaaataattgccatattttaacctataaatcatagactaaacgaagggtagtagggaagtggcccttcatagggagatggagtcataagcattgatacacatattttcttgtacttgaaagaaaaattataagtttacggatttatttcaatctccattaatctgattggttagttaatttcaagatgttgtttcatcattaattttcaatgaatttcaatatattttgaatgaaattcaacaaatttcaaacaaaaccactcaagatgcacatgttgagccagctcgagatgttcaaaattcgtaaaatttgttagagattcgtcatgattgtgaaccctgagtgcaactgtgcctcctccttggaataaaaagtgcatgggaatacatactctaggaatgtggaacaaagccatggatgacgtatctgcaatcttgggctaaactttgggataggcagcgatggagccagtggtgtcgcgaagcctagacgactaatagtactttcagatagttgaccaattttttgggatgtcaacagctgtcaacagtggagacatcaatggcggagcctaggtggccacccgacctgcccggcagctagcttattagttatggcatatctcaaattttacaaaattataatggcatggttacaattttccctatcagttatggctattttagtgtcgtttttgctgtggataactggatatggcaccatatttttgctgtgatctcaggtcaattttctgactcgacaaactaaatgctctacacaaaattctataccatatttttgctgtgatctcaggtcaattttctgacccgataagattggatcgagacatcctggttggaaagggagattcttcacctcggcagggtgacaaactttggtctcttctgttctcagtgccatgccaactcatcaccttacagccatccaagctccaaaatgggtaattaaaagaatctatcgttttcgaagatctttcctttggaagggtgaggaccct

SEQ ID NO: 78943 - DNA, 3484 bp, Oryza sativa
  unsure (1)..(3484): unsure at all n locations
tgctcccctgagccaacgccgacgcattcctcccgcctcgaagccgacactggcctccccgtgtttccccgccgtcgtcaccgcgttcctcccgcctcgccgccggatttggacttgggaggagctcaccggcctccccgcgcctccgccggccgcgcgtgtggctccaactctaccgccgctcctcctctccgccgcttcttccccgtcggccgcgccgaccctcttctccaccgcgtcggtgccgccgccgcatcggccctcctctccgcgtcagttatgatggccgcagccgcgcgccgccatcgccgaccacacgagggggacggggaggccggcgaactcgcaccgtcctgagcccgcgcgccgccacccgggaaccgccgtcgctagccacaccacctttcggccgcgcgcgccgccgcctgtgcgagagcagggagcgagaggaaggagagaaatagagaaagagagatagggtgctgacgtggcttactgacacgtggggtccacgtgggtcccacgctgagtcagccgccacgtgggacaaaactagggtgaaaacccccgagggtcctattgtgaccggttttgtaagttaggggacgccggatgtccggttttgtggttaagggacgattttgtatctggctaacaagttgagggaccttgcgtgtacttttcccgatttgtactagcatgagtgctactgctagctctctgcaactgtactactgtttgccaaaaggaaaatttcacattgaaggcccgtttaaaccccaggcaaaattttttaccctgtcacatcgaatgtttgacacatgcatggagtattaaatatagggaaaaaaactaattgcatatattacgtgtaaattgcgagacgaatcttttaaggctaattgctccatgatctgacaacgtagtgctacagtaaacatttgctaatgacggattaattatgcttaataaattcatctcacagtttacagccggaatctgtaatttgttttgttattagtctatgtttaatgcttcaaatgtatatatccatatatccgatgtgacacggtaaaacttttcaccctgatctaaagaaaacctgattgatactctcaccgactcaccatcccataatatagttactttactttttatgcgtttagattttatcccgaaatataactatatattatttaatttctttatttagagtaaattgcgttgacggtaaaagaacttggcagatgggtgtgattaggtgaaaaacttgaaaaccaagcgtaacggtacaataacttggctaggtgggtgcgctcatggtgcaaaagttgccacgccattgttccaccttagcgaaagtgccacattagcattgaccatctcattttacagaaaagtccctagtaacttttatattccaatcacttcttcttcaggtgtatctgttttcccattgtttggtactccctccgtttcacaatgtaagtgaatgtgaggaatactagaatgacttattgtgaaacggaggaagtagaaagattagaaagatctagaggccccaccgcggcatcgacggagcagcccgaggccacttagcaggcgacctcgacgtcctacaggttcggcaacaccggcggcgccatgaccagcgccgcgtccgctgctggctccttccttccacattcgctgggtgcagatcgagtctccgacaatatcaagtccatgttcccctcctcgtccacagccagcggcgccacctccgtcaggcacgatgagtactaggaatcccaccggacacgacgagtacacgggatccccaccggaccaccagcagacgcagggagctatgcctcaataatatcatcaagccataaggaagatcatgtgtcagtgtcgcaatgatcaaaccagtccaccttctcatccagataaattctgctactgccaactccgaaaaaaaaaccccaccatgatgcagttcaattgtgaattcttcctcatggcctgcaatacaaaataattggtgatgtgttatacccgcataaggaaaataatacactaagattatttgcagattattgaactaattatatgctgttgatcgataagggtacaaaatacatctagtaagaatttctcattgccaatgttactcttatatcgtatacagctacaggaaacaccaatcaataattacagtactaccaatatcgtggctagtaccattagatctcttcattgcattgtaataacaaataacaggatattcaagtgaaagaccaaaataatacagccatcgtataggtcaatgagaccttaactttgcaatcctccatcaattgatcgaacaataganatctacaaccatcagcaggtgatttaccataacaagctccaggaactcgccgagtcagagccatcccaaagtttgtggcaatcacgtcgacagcagcagtttgtggacttgaattggtttggttatggtttagggcttgaactagcgtggcacacagagccctcgtcgccgccgcgatgtagttgcacggcttcccttgttgtcatcatcgtcgccgcagccgccaccaccgccaccgtcgctacgtcgccgccaccgctgcgtcaccaccagcgcaaccacctctcgatcaggatcatgtcaagaaagataaaaggatatatttgtacgtcaacaaatcatattagggggttttctataaaatgagatagatctttcgtgttaaagccaatacggcaattgtgctaaggtggaatagtaatgtggcaatttttgtttacgtgacaacttttgcaccatgagcgcatccatctagccaagttattgtaccactacgctcggttttcaagtttttcacctaatcgcaccctcctactaatttcttgtaccgtcaacgcaatttaatcctttatttacttactcatctcaacaaattataaatagtttcttatttaattttattgaaaaaactttagaggagacgggtgaagtagttttgcagtactgctgtactagcaggaatagctaatgccatattggtaccagtttttacgagacgcagcacttgccaggagaagtgatgattaatcagtgcagttactgtgactaatggccgttcaagatcgatccagtcaattcatgacagtaataatttagctaggtcccccctccatggatacccaatcgatcgatcactgcataaattaattagtagagagaagatcggagcacgtacatagaagtgttttaaccggttaatactgagttttgtttgtgtggtgttaaagtgctaattagtcaaagtctcgcaagcttgccataatgcatcgatgcatgtgggttgcgtgtttggccaatcaggagctgcgaatgacgtggcattattatatatatatatatatgtatatatatgtatatatatatatatatatatatatatatatatatatgcggtatatatatata

SEQ ID NO: 78944 - DNA, 684 bp, Oryza sativa
gtcacatggtagagcaggaggtgagcagtgagggaggggattggcggtagaggcgaggtgagcgggctatcggcaatggagtacatcatctcagattctcagtccgctccccacttacgatggagtccgacagtcgacagaagcatggcagcataggcgacagcactgtggccttctccctcaccctccattgtctctgcatgtggactgagaaggaagaggcgatctagcacaaatggatgcgtagcaacagcggaggaatgtaaaattggcagatccagcactaaaataagcaatgtagtcacattttcaagttttcatttgcaacagcagcatcatgcaattgcttccatagccttaccaacaaatataccatccttatttcatctctaatttcatgaaaaaattgtctattgttattcttaatttgtgcacaatcagcaaaaattccgttctgctatcatcagtttgatgggtactacttgaattgcttgaataataatttaacaatgttattttcttctccattgaaaatctatgaataaatcaaaactatgatcatgaagctcaattcttgtaaatcacatcatctagatgcattactgaaatcagagacaaagattatgaacagaggcacggggcgaggactcaccacttgttctgctagctgctgctgctcgcccc

SEQ ID NO: 78945 - DNA, 1926 bp, Oryza sativa
accgcatctctctcgttccacccctcttctcggtcctccagttaaagtttttgtcctattattccgttcattcctgttagacggcgagtaaaaaaattactttggagcctacagccacgagtaatttttttattttggcgcacgctcccactcccgcttttctctcgctctcgttcgattcttctttccgttcgtccagtaaaaaaatcattccttgttatttcgcccctgttagaccgcgagtaaataaattactttggagcctaacaccgtgagttaaaaaattacttgttttgaccctacaacagtatgtcagcccgtgagtaaataaatcactgccggtcagatattattcacctccacactacattaccaattaacttgtattcaccagtcaaccaagctaccagttaacattctagcctctattaacaatattttcttttacacacgggttctgttacattcagacacactcaggggcgtgcctacgttatactacccggtgtcataggacaccgggtagattattcaaatcctatataaattacactatgttaattaatatattagttaataattagataattagtatatattggaccccagtaatttttgttctgggttcgccactggacacactatacaataaacaaattacatgcttaaactcaaaagtaaaaaagttacaaaggatataaacactccaacaaaaatcatcaaagaaattcagatcagcagatcctcctcttcaccgcgggatccatcgtctttgatggacgaatgttgtagtggaggcggctggctcgccaaccaaccagcttagaacaggactgtgtggcggtagcattaggaatcaggatgggcagcccaggatcaagcatggccgctattaaacatgcagaccataaaatcagtaatgcctcaaaagattagtgcactaacaaccaacggaggtgcattattagtgattgttgaaagttatacctccggcgctagtgacaatgtttcccaggtcaccgcatgatgcatttcatcatcttcgagtccaccgggttacattgtgctcctgcaagaccaaaatttgccatatatatgcactatgagtaggcatgccttagtggattgactcatagtatgaggctatgagcaactgagcattgcacaggacatggtgatgcttgcaggctgaaaagccaaaaattaatgcaagtgcaagctcatgggaaatctaaatgggcatttggtggtacatatcagggataagtggcaaaacgttgatcaagaggcttatgaattgttgatcgtgtggattaagcttattagagaatttttggctcgtttttaccaagagaactgctgcaagctacatagttgaaagcacatactcctaccagcgatcatatattttcagttaccatctgaatgccatggaggacatagaataacttccattgtaacgttcagtcaaaattatttacaggaaacaattgattgtatatacaactaatcaaacaaaccaaattagtactaataaaaaacaccagtcttggtttaccaaagcaatcgtttgtcagagaatgcgacacctaagctgactctaggccacatgtgcacatctacagatcatcctagttcttctattgttttcagaagctaagaacagccctgcatgcatgattcatcacatatacacttatagcaccaagcgaagccatccaccaaacaacttctaatgtgtttaggttggatgtgtccactcaatacacggatacaaaagacatgaatagattagttctgttaggttcctgacaaaacatcaaatagattagttctgttaggtacctgacatatattaacttcatcccgttggctgggaatgaagttggctgtgaaacaaaggttcacgttggccggcaattgaaa

SEQ ID NO: 78946 - DNA, 10839 bp, Oryza sativa
aagtatggttacccttagctgtagtccatctttaatgtataatcaaactatttcagtacaatgtcaaacaaataatgtagagaaaatcccttgtgtacccatgaaaactcacctaatgccttctataccttcgaattttacccaatcccctgtgtacccctgaaatttcgctttgatcccttccatgcccctcctgataggtttctgttagatatgttactcaaaccgtgtgttgtattgtcagtatttttagaaaataccaaaatgcccctgccaaccctaactaaagtttcaatcccctttccttctcccgcatcctctccacgtgagtggcctcagtgtgccgccagcctgcagtcccgcgccgacatcccgccgccctcctgccgcgcgagccatcgtcccgccgtcctccgaccgaacgcgccgtcctgccgccctccggccacgcgccgtcgtccagcctccgtcacgccgtgcaggggcgccggccaccgccctccagctgcgcgggcgtcgccccgccgtgcgggtgtcaccggccactgccctcccgccgcacgggccgtcagccaccgcccctcccgccgcacgggcgtctgtagtcataactaatctggcaactgggaagaggcttggaagcttagataaagctgaggtaatttacttttgtagttacaacacttattcgatagaagctgtttgtgttgaagatagttttagcaatgcgtgtgatcccattgatatgggcgaccaaaggcctttgatcaacatctttgacagaacatgattcatccaagctctgtaaatgtttaaagaaaaagcaaagtacatcttcaccatccagtgactaatgatgattgtagttttcagatttgttttgtgtggcaaattttgttgggtgcatctagctagatatagcaattacgggtcttggtcctctttctgttatattaaattgagaatgaaaagcttgtctcttcgagtttcttagcgattgtgttcaggaggaactatgaagagatgaggtaattcaaattctattactgcgaagcaacaatttagtttgttctctgatgttagtatttagggcaattaagggaaaattcagtagataatatttaatttctgccagtcaaaaagcaactggattgtgtatgtatatcatggaaaatttagttaaggttgctttttgttgtcattttgcaggtgtacttccatgatataccaaccaacctgagccatctaacatgaatgtagccttgccatgtctgggggaggaaacacctatagttgcaccaaaaatgaccaagagcaagataaagggaaaaccatcatgttctaatactcctggtagcccaactatgcgcacaaggagcacagataagagtcctgcaatgggcactagaagcaaaagaaaactttatggactaaatcatatggcttgctgattaggttttattttggtactgtccatttctctgttgaggctgatggattttgttgttgtgatgccctgcaaagtggtagtcatagttgccatattttgctattgtaaggattgcttcctcatgatgtgatgatgtactgttatggaccttgtgccattatgctcatgatatattacctagctaatttggtttgttgattgcactattttgtatgaaatggaaagttggtttggttcctgcactattgggtatggaaatggaattgtgtgtgcgcatgatatgaatggttatgtatggatgatggaaagattttgttctgtgcatgatatcgagtgttctgtatagatatctctattgttatgtatgatgctattgatgctcttattgtaccataatcaatttcttgtatagaggaaccaatttttttatagaggaaactgatgactgtacagacagtcagcttttcctgatcctattatttttcacaaacaaaaagttcaatatattccattttttcagtgccacaataaatttgttatacactcattatttagtctcataaaatacacatattgttcagttaatattttttcaattttttcaatctagctgccacactcctccatctacaagtgtattttagacatttggaaccacacataacgtgaaaatgaaggaaacctatcgggaggggtatggaagggatcaaagcgaaatttcagaggtacagaggggatcgtgtaaaattcgagggtatagaagggattaggtgagttttcatgggtacacaagagattttctcaatgtagagaggttgtgggaaatatacagtgcaaaccacatgtgtaatgaaaacctgaaaaagtaccgttggataaaagatactaccaatttaagtgcagttgtaggttttcttatccaacatttgaccgtccgtcttatttaaaaaattatgaaaaaagtttaaaaacttagtcacacataaagtactatttatgtttaatcatttaataacaacaaaagcactaaccataatttattatcaactaagacgaacggtcaaacgttggacacataaacccacgagacggaggtagtagatacatcggatttttccacgtcattaagagtaaaacttttactcgcagatttaatcataagtaaaaaattactcatttttacttttgatgatgtggacaaatctcagacatatttttaagccaacagtagttttcaggtttccaatatgtatattgctgtgactatatttttcccatggtttgattcgttgagtgctgttgcagtgtataaatcgatcatgggacccagtcacaagaaaaaaaagaagtaaaagcttcttttttttttcttaatcacatggagcggagtctaatatatcagccaacaataaaataattctctattaagatgatttcacttgaaaatatggtttaattttgcatatacattaccaatttaacttgctgtatgttggttcaatttgttttttttttggatctgagagaatacaccgtaaaggacattaggctggttcggtttgatgcctaaaagagtctcaccaaattttggccatagacacaaattttggtatggccatagtttggaaatgttaaattgtgtttggttagtagccaaattttggctaaaccaaatttggttgtgtgccttcagatggctacgccattctttcttgtctcctcaccttctcacccacggatcgccgtttaaaagatgagagttttcatgttgcagctctaattaattactttccttttgcttcattcaaggtcggattattatatttttttaattcttgaataatgtattatattttgaatatttacaaattttctgctaatataagaatgaacgaagctgcagatgaatgctgtcgggtgataattaagtattggggaatggatggagtattcaactatgtacggaacaagagatcaaagcaaacaatgagcagaagtgtgagcaggaaatagaattaagccatcaataaccacaaatatgtagtcaacaaagaagataataaaaggagaatagattgcagattttttttagacaaagattgcagattaattaagctagcattacacttctggcagctaccacaaagctaagacgcatgggaccgcgcacatttctgatagctacagcaatctgctacaatgtgttcaacgtaagcaactagtgcctcctttcgacactctggagtgttctcctttcccctagggcccctttgatttataggaaaagtgtaggaaatttaaaggatttcaatcctatagaaaaaattactatgaaaccgtttgaaacaaaggattgaatcctatactatcctttaaattcctatggaatgggtaatctatagagattttggaggaaagtagaggtccatcctcttggaaaaattcatttgagtctatctctctcttccgattcctgcgtttttcctgtggtccaatcaaacggtcattcctgtgtttttcctgtattttccaatcctctgttttacacttacattcctgtcagaatcctgcgtttttctattcctgtgattcaaagggccctcaaacgagactttataagttcattaaggatgtgtttacttcgtgaaaagaaaacttttggttctcatgggatgtttgaccggatgtcggaaagagttttcgggcacgaatgaaaaaactaatttcataactcgcttggaaactgcgagacgaatatttcgagcctaattaagccgtcattagcacatgtgggttactgtggctaatcatgaactaatcatgctcgaaagattcgtctcgcgatttccatgcaaactgtgcagtcagtttttgttttaatctatatttaatactccatgcatgtgtctaaagattcgatgtgatgtttttggtaaaaaaaatttttggaaactaagggtgtgtttagttggggaaaaggaaatttttgggtgtcacatcgaacgtttgaccggatgtcggaaggggttttcggacacgaataaaaaaactaatttcagaattcgcctggaaaccgcgagacgaattttttgagactaattatgccgtcattagcatatgtgggttactgtagcacttatggctaatcacggactaattaggcttaaaggattcgtctcgcggtttcctccataactgtgcaattagtttttctttttatctatatttaatgcttcatacatgtgttcaaagattcgatgtgatgtttttggaaaaaaattttgggaactaaaccagacctaaatcattgattgacaaaataaatggtggatatcttgagctactatccgttgatgtgcccctctgccgtaggaggtatgacagggtctctaatcaccaggggccgtcgttgaggcaaatggggattctggtaatgaggtggagtagtttttatctatggctagtaaccggtagaaaagtgaattaattaataagaataatttatgcataaaacttttatatctattgtattcataagtgatttaaaaggcaatgtaattgtttgaaaaaaacataagccaatctagaaattgaactacgataaataatcaaaatcaacagttaaattaaaactaagggcatgcttagatcccctggcaaaacttttcaccctatcacatcgaatatttggacacatacatgaagtattaaatatagaaaaaaaactaattacacagattgcgtgtaaattgcgagatgaatcttttaagcctaattgctccatgatttgataatggggtgctatagtaaatatttgctaatgacggattaattaggcttaataaattcatctcatagtttacaggcaaaatttataatttgttttgttattagactacgttttatacttcaaatgtatatccgtatatccgatgtgacacaacaaaacttttcatccctatatctaaactcaacctaagtttttaaaatcttggatgtactcccccgtcacattttaagtatagctatgagtttccgtgttaaatatttgaccatctgttttatttaaaaaaattataaaaaaattaaaaataagtcacgcataaggattattcatattttatcatctaataacaataaatttattaatcataaaaaatttaagtaagatagatgatgttagacacagaaatttatggttgtatttaaaataggacggagcgagtaactgctattactaagcagcaggcagaaaaacaattcaaggacccgtcgccattttggagtaggtgtagtaggtagggagttgacaggatatcgctgtctcctaatcagtactccctccttgcaaaaatttgaaacctatttctttttcattaaaaccaagaagcaattaaatcactcaccatgtgacaaaatcaataaacatacaaccaataaatactagaatagcttcttgtttcgaccaacaatttaatttagcacatagtaactacaaataagactcaaatttttgaagaaaccaaagaatgaaataggtctgagatttttagaaagagggagtactccaaaattaaacaatggtattgtgttagaagcttctagtggttacaactatattttactgcctccgtcctaaaaaattaagagattttagacgagtggatatttcctaataatatgtatctggacaagctccctgtgcagattcatattactgtaggaaatgttccatctatctaaaatatcttgtatttcaggacagaatgagtagattcttggggtccggtgtaggatctgaaaatatagcggccagtccaaactttttaagagagtgtttatatctaggggtgtaaagttttggcatgttatatcgggtattatataggctgtcacatggggtgtttgggcattaattaataaactaattacaggggcattaattaataaactaattacagtatctgttagtaaacagcgagacgaatttattaagcctaattaatccatatttagcaaatatttactgtagcatcacattgtcaaatcatggagcaattaggattaaaagattcgtctcgtaaattagtcgcaatctgtgcaattagtttttttttctccatatttaatacttcatgcaggcatttaaacgttcgatgtgacggggtgtaaaatttttgtgtcggaactacaccgggcctaagtacttgtatgtggcaaaactcattggatgtaggatctgaaaatataggccctgtttagttcccatgcaaaaacttttcatcatgtcacatcgaatatttggacacatgcatcgagtattaaatatagataaaaataaaaaactaattacacagtttgcgtgtaaattgcaagataaatcttttaagcctaattgctccataatttgataatgtggtgctacagtaaagatttgctaatgacggattaattaggcttaataaattcatcttgcagtttattggtggaatctgtaatttgttttgttattagtctacatttaatacattaaatgtgtgtccgtacatgcaatgtgacacactaaaatttttcacccctagatttaaacacagccatagtggcctttttaacttgtacagatttgtgagatgactggctaattattgaactgcaccattgtagaatctccaacttctacgaacaaattatgggacagtacgcctacatcgaagcaccagctttggtgcattaaactggtcacattactaaaactaaacagcggcaaacattattatgaccaacaacaaggagcacaaaacttgcagataaatttttggaaggatagtgagtgagattgcctacttacatccctatatatatatatatataaacaaataaacattaaaattaggtatatactcaatttgaatcttggagtccatactccatgtagtaccagttaatttacctatacacatacacccctaggtatctgaattttttgtcccgaattaatatggtcgagcgtgtgggtggaaaatacctatcccgttttcactcctacttgtgtgattgtaacttgacactagatgaatagggtgattgctgatcgtgtatagttggaatatatactataatcgtgtattagggggcagtacttttatatgaacgcggagctgaaacaagccgatccaagccaaaagattcaagctttgttctttaccttccccctaaccactctaccacagtcagagtgattaattataatcgccgaccctggaccacgcgtagtatatataggccacaatcggcagtaaagcttttgtcgagtcaagtgcacgatagcgtggttagtttgtggcactcatcagagctaattaagagccatggccatggagaagagccgggtcctcatcgtcggtggcaccggccacatcggccggcggatcgtggcggcgagcctggcggcgggccaccccacctccgtcctgctccggccggagatcggcctcgacatcgacaagctccagatcctgctggccttcaaggcgcagggcgcgcggctcctcgaggcgtcgcttgacgaccacgatggcctcgtcgccgcgatccggcaggtggacgtcgtcgtctccgccatgtccggcgcccacatccgcagtcataacctcatgctccagatcaagctcgtcgaggccatcaaacaagctgggaacatcaaggtaatttattttctatcagctcaccaaatcagcacataattaattaaaataacttgatttggctgtatgaatatagatgaaaacgcttctactcgagcatccaacaaaaacagaaatatcatgagctcctcagttctcagccactcattttttatctcaatttccatagccgtgaatggtgagtgatgacagcttgggaggcaaggcccctctccgtctccctctcttctcccactcactccctcctcttcccctcttccatgactagacgatggacacaggcaagcgtctgaggtgacgtcgctacggtgggatgagttcaaggtcatagtggagcttgtgatctggggatggctagatttatctctgtggcacacgagtgaaggaggtagttgtgggagggggaggtctggcgctgaaggtgacatgcgacgacggcatggtcaccggtgttggagaacatgatttgatccggagctatgtgatgatttttgtgttgagcttcagaactaggcaacgaccgtccttctcttctcacattccagaagactggtgtgctcaaggacgacgtcgtcgcttcacgcacaatggaggagcatcacaaaagtggatgggcgtgttgtgaatttttagtgtttcagtccatgcatctgtatgtttcattcgttcgagaaaattgttgcagtgggtattggatggtgtttcatgttttctttcttcgattttactcagatctacagatgtagcttaaaatcatttgtttcatctacttatttgtttcactattttttcaagacttgaaacatattttcattaactattgaagcatttttgtataagcggttaaatagcgtccaatttttggataaaaaaacagacgttcgatttgtagttgtttcggaatatagatatatgatttctatccactatcttgaaaagtaaaagaagttttatatatatatatatatatatatatatatatgtatgtatgtatatatatatatatatgtatgtatgtatatatatatatatatatgtatgtatgtatatatatatatatatatgtatgtatgtatatatatatatatatatatatatatatgtacatacatatatatgtacatacatacatatatatatatatatatatatatatatatatacatacatacatatatatctcataacttcagtaaaattatggcaatttttactgatatgatatatcgatgaatgtgaacgatgcgagtagatggttttatcttctatagagtatagctcatggacacaaaaataagttatttaattgagcgatgttttagtgtttttttacttatattattatactaacagcagaaatgattaggggttaatttgtcatttatgttttattcccctctagatcgatctgtgctcatccgttgcgttggcattgcttatattctatggaaaaatcagaaaaaagagagaaaaaaatttagtcactactaaattacgattttttatataataatatcccttcatgtttctattaccgttaatcacctaattagggtgatagtacaaatagatttatttgaaccctttgatcaaaatagataatggatcatattgatttctacttttatagtatagaacaccatagtgtgggctcaattacattttcaatgagcggtacaataagatttgtttttttacctaaataactagtcggtttgatttttcttaatgcttaaactaaaaaatgtcacacattaaaggatgaggataatatcagattgccatatatttactatgaatacttatctgcgagcagcgtttcctgccgtcagaattcggcatggatccatcgaggatggggaatgctcttgaacctgggagggttacattagaaactattaagagtggcgggctgggcggccgctcgcgcgtgccacgtcggatagctacagtacgtgggtggaagtttttcgaaaaagtccttctattttttgtaatatataaactgttgcttcattgctttaattttcaggagaatgtttgttttaatttgctttaactgggagggttacatttgatgagaagatggagataaggagagcaattgagaatgcaaacatccctcacacatatgtttctgcaaattgctttgcagcttacttcagtcctaacctctgtcagatgaaaactctcctccctcccaaagagagagttggtgtgtacggggatggtaacgtcaaaggtaaaaaagttaattacttatctataaactgttgcttcattgctttaattttcaggagaatgtttgtctttttctcatggaaagttagatttgtactttttcttctctttttagaaagttgagatttatctttggatcgaagtgtacgtccatctttttttttctcattgtcagtggtcccattcgatccagattctgtgctgcaaataacctgttttcaattcttcattattggtatttccttttctttttcagccatttttagttgcacgttttgttgccacttcgtaaagttcatttcatctaccgacttttcatttaaaaatattaatttattgatattttaatgtacaaatttattagagcaggacaagattcctaatgaaccgcttttggttctccatcatttaattcaattatcattttttaccttattaactttt

SEQ ID NO: 78947 - DNA, 560 bp, Oryza sativa
acattgattctatagctgaaagctaatgaaatcactgatcaatggatcatgtcaaagtcatccctgattagcgggttgcgattaactggtggaggaaagtttctatccacaaattagaagtcgacatctctgcagaactggacctaatggtctacttacacgtgaattctcgcatgcagttcgtgatggtacaagttgtggccacacaaaaggctggacctgttctgttcatctcttgcagaggattttcacccgttttgtcttgtgtgaaaattgacattgcgtagtagtaaccggtaagccagcgatggaacttcagtcaacaggttgttctcatggagggattacttagcagtgtaggcaacaatgtattgaggccgtgttttctccttcggagaaaatgacgaatatggcttctgttcttaattagaactgtccttgttgctcatacatggattacttaactgagtagacaagttaataagagatcatatagagggatagtgcacagctaggagcttaggacgttcgaaaataacttccaatccaatcgattgctt

SEQ ID NO: 78948 - DNA, 57603 bp, Oryza sativa
ccataaatatgaaacaatcacggaaatccaaataaacaacccgaaacctaaactgacacagagtcggccagtctgaccgcgccatacacgctggtctgaccggccaccactgcccggtctgaccggacccaaatcacagcagtacctgtagatcacctgtaaaaatccaatcatctccaaaaccacttcgcaaataaattccaaatatcaaaaccaataatctccaatgccaattgttcatcacagaataataataaaaaacacctttgattttacagtatattcgacacctattctaaccaactccaccttgacgaatatacgccacccagaagtagtagaatcaccatgccaatccacctgtcctccaaacttgggttgtcttctttgcagcttcaccacgagccgcccgacgagcctgtgctagacccaccaccttcgagagactcagctatcccaataatttcttcctctggactccacctacaacaatgctccaccttctctcctatcatcacagtcgtattgccaatcaaaattggattccttcctagctgccacatcatagactccccgaaaaccatgttcatctctatctactgtcttaaatttgacttcatcttatccatggctagatagcccatgccatcaccaaatagataaatcaaactcgccagacttgaagagaaccctttcttccttatcgtcttatgaaccgagctaataaatccaacatccacgctttcccgcatttgtagactgaaccgatgatacttcgagaaaattcaccattgctttgaatcacccaaagaattaccgccatagcgcttgctcttcctcttcagtgacgcagatttcatatatccccatcgtgtaaaccccgcagatcttggatatatcctatactgccaaacagcccgttgatgccctcaacgattttcacccgcagttgcctgtgatttttcttcagttctggcttaactccatatatctcaactcctcgtcgagtcccggatatatcctgtttatgtcagataacttcatatgtgacctgaccagcctattgctaccagtctactcaccctttaaacttgcaaactatccatttgtagaaccgtcttgtccttcttccggattcgttaacaagttcctgcaacgaaccacctgtctgttgaactcggtctaaccgtccgaactccacagcctaaccagtccgtcggtctgaccagtggcggacccaccatgattctcgggtattcctgggaatacccaacgttttttataaaaaaacaagtatacttctagtatatacacatgtacacatatttgtacacctaaattctcaattttttgatccaaacacagcccaacttgtctcttacgatgccttcaaccaacccgacccactccgtcatgacccatcagacatcagttgacccacttagccaccactcttccagacagccccctctcgctctccctccttgacccatccctccctggctcggctccctcgcgccactccccatttgcaaaccctaggtggcggtgcggcaagacggcaatcggcagcgggagctggaccgtgctaccgcggagggggaggccattgccacggcgggcggcgcccgacactccgccaagctaaggcggtcaggtcggttgggtggccagcggccgcgaggggcaaggacaggcaacggctcagtgcttagacgggaatacccaactttgaaatcctggctccgccactgggtctgaccaccctgccggcccgatccaaccgatatacacgcacctctgttacacgcttcaaccaagccttctgtctcgacgaccagcaatatgatttaagcctgcgtgccaaaagttgccgacgttgagtgcccttgctgtcgtgcgctgtctcgtttccttgatccttctacgtccaaagtccgagttgaatatgcaaccgacttctcccttgtcacctcgtatatatcaggggcggagacatgcctagggcagctagagctcgagccagtggcggatccagaaaattgattcattggtgtcataacgtgtctatcggtgtcatagtacactaattatgcttagaatatgatgttgtaatatatgaataagtagttttgctataggttttattgaaattcgtcagtgtcgcctgacaccgatgactatactgttgatccgcccctggcttgagccctaggcctgcctctaaaaacttgcttaaattttgttgattcaccatgtaattttttcagaaaactaatactcaattagtcgagccatatcttaactctagtcttatataatttctggctccgccattgtatatatcgtgtactaacatgtatatatcgtgtactacgatgaagaatctgttacggactcctctccaaacagcacccaaactcaagtctgactagctcgtaaacaacttttgcacggtcattaatctctgtgatgtctcctcgttgcaaagtctctcccatctacggcttgctgccttgctgtatgcaagtccgtatcagctcgtgcttgcatgcgtactgcacccaagccacgtaatcaatgcttttgaccaagcacatgcccaatacaccaattaatttgcatgcagcccgtagtttttgtttgtttactttgcatatttacttgcttgattcgtcgcatgcatctcatgtgcgcgtgtagcacgtacacatacatgcttgttcgtgcctctgcacacaccgcagtcagagtcctcgtgttcaccgtccacgaccctatcgtcccggccctccacgtccactgcgccgcaccacgctcgctggcttcgccacgtgggtcgggcacgttgtccatggcgttacccctccgatctctccgaacgccttcggccacgttcggccccgtcttccgatcatgttccgccatcgccggtctgatcgcgagtgaggtcgtcgccgccgcaacgtcctcgttgtcaccgtcaatctcatcgccacggctgacgacctcgtgtttcctgctccacttgtcttcttgatgcaatgctgaaaccttctgctctgatactacttgttaaagtgcgcagcccggcccaccaaccgtaggccaccaggtcacattgagcctgctccaccacaggcccaaccggagccataactttaggtcctaggtctacacaacccaaaagactagtttgatgggtgaggaccgccctcaccttttaaatcgtgctcctccatcatcaattactgatgtgggactaaacccaacaatcttccccgtcacatcaacccatgtgacccctaagacttgttacttgggcctcgggtctaacaatttcccccgtcacatcaacccatgtgaccccgaagacttgttacctagcctctccactatgtgactcatggaaattgttttgggttccaaaccttgggttctgataccacttgtggtggaacaggcccaatgtgacctgggtggcccacggtgggtgagccgagctgcgcactcgaacatttactactatgcaattcaattttattattttttgcactgtctatcttcatgaaaagagttgcttgttgagtcactatatatatcctaggtagaaaatttgtgtcacgatcttaatggagtctcacatggatacacctcttttcctctcaagccaagatacagatttgcccgtaggtattcaaaatctccctcacctgaagtttgaaccaagggaactgctcttttgaactcttttgttagctctgttctgtagataacaagctattcaatcatgtttcaaagatccccttaacatatatcatccccttctcactgaacttgagctccttcctcatctgctccacttggacatcatcaccccgcacaagaatttcggatacattcccgtcatccgataaaatcattttgaccttgatctcttcttttcttgatgcctttgtccagtagtatacacccctgaaccatcaagaagggacaggttactacatttgacctggaaatttcattctaaatttctgctatagagttgcagagacatacgccaatgggcttaaggtcataagccagaaccagttgttgccaccctccgggactgcaattgatagaacaagaccgacgctgccaaggctaatgcaggtgcagaaggtaagaagtgctgcttgccccctgctcggcaccatagtgccctcaaaactgcgcaaaaaacataaatcgtgcctcattttgcattgcattttgatgtgaaacaaaatgcataagcttatgctagatatgcactatataaacaacatgggcagctttacactgtacttctctacggtaccagggcaaaactaataaatacaactgctatactagtttgggtttccattctattacaacttccaagtaacttgtgagtatcagaattaatgtaattctagcgtaaagcattgttaagtagaaaatattacttgttcatatctttgcttcaatcaagttctgtgtttgaatcaccaaattactatgattgttgttatggtggagatcactgtgaacctaaaggtacaacccacaacatttggattgcaagaagaataaagaagcacattaacacagctggtgtatgtgtaaaactgttgtacaaagtcccaatggtattgtcacaccgtgctaaaagtatagtccaaaggttatcctgtacttctgcatatcatagtcataactcagtagattactgcattaggatagaaatccgatctggctacttacgtgataacctcgccacggtcagagatggtgaagttgttacgggtgaagaacgagaggatctccccagccacctggttcggcgccatcgtctgcccttcctccttgacgaatgtcttctgcacaacctgcactagccaatttgacatagatgacaaccacacactattggtggacatcatgcgaacagctcaaaccgtcagaatgaaaggtaaccacaatggttcacgattggtggatggaactagcaaacactaatttactagtaccaaaaaaaggaattcgcacactaatccacagcacatctcgcttatgctgctgtagtgtttttacttctcgtacaacttttttatacttgtatatataacttttactcttcatgttttgaatgagactagcatgtctaatgccggttaaaaaaaaaggcaaaccacacaaccatgctactgttttcagcaacgaactaaacaacatcacctaaagaccgcacaattcagagaaccagcagccaaacataactaagtcaccatgaaatttctctattcgcatcattgactagacagatttataaaaaaggacgcaacgattttgatacagcaaagcagtcatgaatccctattggatttaatggtggttcttgcactgacaagaacactctgcaaagaagaacttgaaggaagtgaaaaagcaaagcacactcagccactcgttgagctatctacagaagcagcagtcacctccaaagaaaggaggaaggaagacagccatggtccaatgcgaagagctctcgaggctcgagcgcgcgcatggcgacgggcatcgccaacactcgtcagagcgagatggaggaagcagcagaggtggagagccgtaccttggacttgacggagcgcttgatgagcgaccagaggccagggacggagagcacgaagagccccagcgacgtgtagtagctcgcctgcgagtaccccgtcgccccggccaccgccgcgtccaggagcacggcggcggcggccgcgccgccgctgctgtcgacgagcgacgcgcggggcgggacgacggcgcggcgggccctcgcccgtctcggcacggcaccgcgccaccggcccccaccaccggccgccgccgccgcgccgccggcgagcgacggcggcggcgcgcggagaggcgggaggaggaggcgggtcgcggcggcggtggcttccatttgggtcgcgggagataaggccggggaaagtgtattcggcgatgtgttgatttcggttggagtgggcccacatgtaagtgggctgtgggccaggagttcgatgttgggaggaggaggataggacacgtggtagaacaagtgcgcttggttttttttttcttttcggacaaaaagaaatttatggcagttcaaaacaattccgaatttttgtagttagagaaaaccattgcctatgaaatactcctccgttctataatttaagggattttctcaatcaaatttgtctaataaaatcataagacagtattatattcttcacctaccaacttttatactagtttgtttctctaccatctcacatctacaaacttttatagtaccttattctttcacccattgccttgtgtcacatcagatatccttttactacttccttaatttttaccaaaaaagagtataattccttttattcacggatgaagagagtataagcttgcttttatactgcatatgataaaaaaaacctcgtttaaaatcagtacaatgtaaaatgtgttgatccaaaaacagacctgggagatctgcttaactccagtgcaggaccaaaggttggtgagatacggacgtgccagtcagtttgaccctgcaacaaacaagatatgatgagccggtcggctgacaagccaatggagtaattacagccgatgccgataccagccgatgttcgatagggttttgagcaatcggctatatgtatgtagataatgatataaagtcgatccgatgatgatgataaataacaataatataatccaatagaaaccaatcggctaataatgatatgatagataaacatcgatccgaaggttaaagcatacatcggctggaggcccgatgtcataaaatccacaagattagattaaacagtgaaacctttattgtcatcggctagatccgacttatatgtatatgcaatccttataagccaatgcaacgtctaaataacttatcggctagtaccccgataaaacattagcatgaacctatcggcttaacaagacttatattatcaacaacaatctagtagcacaaaattgtatatgattatctaatactcgatgagccgatagatctatctaatgtgatggatataacaaatctatttaggacaacattgtgattgtagagatatatcggctaagacagaagatcggacctaatcgagacagtcccaactaaaccgatgcgtctttaaatacaatgcaattagagatagaattgagatatcacgtaggcaaatatatcaactaaaccagagcgatccaagagatcgaagcgatgcagccttgaacaacaccaacatagccgatagattcatcagggccggcggaacgtaggacttaccccttcgccggagatcaaactgaaccgatgcagccccgcgtcaggtgccaaattccatcggatgataagtaaaaaccttaggaaagagggtggcgatgcgtcgagagtagttgtattgatcgagagataaattacaatgaccctgggtgtacatatttatacacatgggaagatactagtccttgtaggacaagaaagaaacttttctaaacataaaaggaaaatataaagttcttacactaaacacactttcctaaaaataaaggaaactacttcctccgtttcacaatgtaagtcattttagcatttcccacattcaaattgatgttaatgaatctagacatatatatctatatagatttattaaaatcaatatgaatgtggaaaatgctagaatgacttactttgtgaaacggagggagtaacaaactgtcagggttatggataccacatacctaatagtagttgactaaatctcggcaggatccaccacataccatatcttatacggaaacaaccttcggatagggatggagttccggataaggaaagacaacaagagttctacatggaaacgacaaggactactcagattgtgtccatattggttttcctagttctacttggacaaggggacacctatgggtataaatacaaggccccctaggaggagaggggatacggacaacatggaacaacagaagccacaacatacaagccaacatacgccaagacaagacgccggatatcgacttcagagataggcatggctagtcccctgcggtgcctacggataccgtcaggagagatatagcgttgtctctgatctcgccggatgcggattcgaggaggaaagctaccctgttgtcgactacgagtcagaccttcagaccgccatgtcgacaacagttagataggctaccccaaatattgtactggtgtgattatgatgaataagagcaacgaccggcttcggccaacatgatgtagggttattacctgacaattcaggagcccgaacctatataaaaatcctcgtctctgtctcctttactacaatctcgcatatatcctagtaccaacgatccccgtactatgtaaataccagaatcgcgacatcaaacgtcgacacaaactattcctaataacctaattaatagataacttgccatgccgcatcctccgtgaacttggactcttctggataaatttcctttaattgatccgactccatcaagaatacaactgctggcgatttgacaactcctatcggccgattccaaggctttgaagccgatactgactctaggccgatgataacttcgggcttatcaaattttggcgttaacaaagctatacttgtgttctaaccttttctcatatgatccatatgaaatgttttattagtctctctattttcttaatacatgatataattttagaaccactcatcttatttaaaaaattatgtaaatataagacgaatgattaaacatatgtcaaaatcaacagcgtcatctattaagaaaataaaatatattttatattttttacccggcctttatgtccaaccagatatatgcagccatttaaattgggtacttagcctcttaaacaatctaatctaacataatctgaaattcgctcatatggatatttgaacttagaaccttgggatgaagatatagaggataatgaagatagtatatctttatgtcataaaatctatgtggaatttagttatatatcaacaagccattgttgatcaattgattaatattatcaatttggttctgtattgttttgtaaaatagttgaaattaggtgattctgaatattcaaccataaaactcatagttatatcacaacaagttataacatctgatatttttcatacctcaattgtacagcccaaggttctccgaagttcactctataatttatttcaaaacataataagaacgcaggctctattgctctaatgtagacatgaattatcattagctttgatatgctttttaataggtatggatttaggttaaaacaactcctttaccttttgtcgagccaatcctatatatgtacttgaattcttgttcgagagtttttatcgagggaattcatgtgaagataatagcatttactttttatatcgagccaatccttagtacgtacttgagtcagatattagcatttagttttgtaagtggtcaacttgtacccttaagagcacctaagaaccaggatattactccctccatgttttaatgtatgatatcgttaactttttttttatgatatgttcgactatttatttttctcaaaagaaaattatgtaattatcatttattttactgtgatttgatttatcatcaaatattcttttaaatatgacgcaaatattttttctatttgtataaaaattttaataaataaaataaatagtcaaacgttagttaaaaagtcaatgaggttatatatttattaaaatacctggagagtaataatttttcacgctcgtataccggccggtctctctcctattcttgctcgattctttctataaatcagttaatatggatgagatgataaagccgtgcctatatactcacaccttagaattaatctattaattaatacgttattaagcctaattgacgccggcggccacaaggggaacaacgacgacgtcaagccggaagtgttcggcttcggcggcggcgacactctcgccggaggaggcggtcgcgatggcgtggctgccgttcgatggccggccgcacatcgggctcgtcgtctacgacgacgcgcgcaacacggcggtcctggtgcgccgaggagggttcacggccggctcgctgccgctaccgttgccagcggcgcaggccgcggcggcggaggaggagggagtcgtcgtcggcggcggtggtggcggcggcggcgcgcgcgtccgctactgccactgcggcgtggagagccgggagaaggaggtgcggaggccggggccgacgcaggggcggcacttcttcggctgcggcaggtggacggcggcgagaggggcggcgtgcgattactatgtgtgggacgaggccgcgccgtcgacttttggtctcaactctcaaccaagtccaccacgtgaatagcagatggcgatgatgatccatctcgattgataatggcaaacaataataatgtcgattagttcatcattccacacaccattgttttttttattaatagttgctgtgttcaccagtaatccaagactacgttatccagatacggggatacggatatgcgatacggggatacgaggatactgcattttcttaaaaacaccgatacggggatacgtcaatatatatttaaaataataaatatatagaggtaaataattatgaggctgtaaatagagatagccaatacatgacatcaattgatcaatacaccaaatttttttagtacaggctcaccttagagctcccatgtctggtcgctagtactactaatgaatctgcaaagtgcagccgcatagccacgctagcagtagcagtacgtacgagtgctagagatgcactgccacttccaaaactcattggatttaggagaggagagaacacttagcactaagatgagatggggaaacacgcaagaaatgcagatcgagacttcaatgggaaagaaccaagtagcttggtggcgtactgatggtgttggtcttggcggccagtggagatgctgcacccggtggaggagatgaggcgaccggcggtggccctgcgcagctgcgctcaggggcggcgacgcgcgaggcgctcgagctcgattgcgggctggttgggaccctgcggcttggttggcgatgcggcggcggaacccgacagctagcggaggactcacgcctcgggcatggatgcggcgatggggaggacgtggcccgtgggaactgcatcagggattggagcaatagcaggcggcacggcgacggattggatcggcgcttcgtcttccatggatgggtttgggcgtatcaggagcgacgggaggggacgtatcaacgaagtatccgatttaatttattttttcgaaaatcgaagtaaataacgatacgtacgggatacgtatcggagcgtatccgatacggatacgtggcttttcagccgtatctgggtaacatagatccaaacatctgctaaaagcatttgtctagcgtagatggtgccaagtttgtcgtagcaatgccataccaggacggatccaagacagggagactcatctcctttttttcttcggccctcttcaatgatgatccagcagggagttcctaagctggatccacccttaatatcataattcacacatggaagttcctttgttttggctaccttccctaggtattctttccacagaaaatgcgttcttttggtttggctaattcctcaatttatataagcatacttttcaaactgctaaacggtgttttccatatgaaaacttacatagaaattgctttaaaaattcaaataaatgtatttttgatgtttttaataattaatactcaattgattatatactaaaagtttatatgttgttgcgtgcggctaatcatccgtttcaaaatgaactttagaataggtcctttaagtcgcccccaactttgggggctatttttaatacaaagatgaagtacactactaaaaagggttttttttcatgtggctaaatcatattttcataggcggagcccccaagtgtttgtgaaaaaaggaatttttgcaggcaggtagcacaacaacttgcaaaaagtattttcgcgggcgggtgttatgtcgtccgcgagcaaaaacaaaaatcgcaaaaaaaaaagctttttgaaaccctagttcaaatccaccctagtcgttgtcagatccgcgagggaggtggtaaccactgttggatccatgaggcagagggttgttgccatcgttgtcgatgcaatctgccgccgttgtcgtcgtcattgagacctcatctcacccgaggttgacggtggcggatccgtgagggagagggccactgtcgtcatcgtcgatgcagtccaccgtcgcatcgtcgagaccctgctgcacctaaggccagtggcgcagatccgctactcccgaggtaactgccatcagatccacgagggagaggtccgctaccaccagacctgtgaggggagccggtctctcccgatgcggcggagacgccctatggaggctaaaaaaatcatgagatacacttgctcaaaaaaatttacatatatatgatacttgaccaaaattattaagcatgtgacatgtcatcatttatatgcaatctgtacacaatagttgagcattgttttatctccaataatggatcaaataaatttatacgaatcttttttatccaggtaacacatactctttatatatttcttgctaacaaacaaacactaggatacaaattggtattaccatgaactattgtcctgtgattggtgcaaatcagtaagcaactactactaagcactgagatgcaagaatgtacctttcttgcaggctggcactctgaggagaacaaatcaaggatgctccgctgcttgacggagattagccccagccacattgctggcaacgccggacggcctgctcactaagccgttccgctgccgcgcgctgctccgctcgaggctggccgcgggcatcaccgtcggccactggccgcgcctctctgcccgtccagcgcgccgctggctgcgcctcttcgcctgccccgcgcgccgctccccacgcttctccagcgcgccgctagatccgccgctgccagcgcccgccaaaccgctgccccacgctccggtgaggaccccggcagacccctcaaaactgcgctcaacgagtaggagcaccacggcgctccagtgatgctcgcgacgatgacggaggagccgcacagcggcggcggaggttgagattggagtcgccaggagaggactgcggtatgggctcaagtgggaaggttgacggcctgttaggttagtttctttagaggatataaacgtgatatataaaataatatgaaacatctaataaacatatcatttgtagctcagtggtttgcacaccgcccctgaaacagaaggttgtgggtttgactcccatggccaacatttttttaagaaattttgctgagtaacgggttggcccatttcggggacgatgctgttgggctagcaccaggttggcccatctgtgggtgcagataggcggttcattacacacaatagatggcctgtttaggcttctataggtagcccaattagaacggaaaaacagattattaaaagaaaaaatgaaaataaaatctgatgtggcagtaaggcttgcctacatggacaaaagtatttaaaatagtacaataaataatttgtaacacacaaatacgtcttatgacatactaaatattgtcacttgatgacaatagactagctatatgacatttattgtgacacacaactttttattgtcattaagttgaaatgcctgaaataaaatgtcataaattatatgatatagtgacattatgacatgtgtcatattaaatacgtcaaaaagccacgcatatcttgtagtgacgttgttgccttggacccactgctgtcggagctgcagtccatcggcctcctcatgcacctccacgaacttgtagagtgagagaggatgaggagcagaggactcacccagcggcgattctcccatcgacctcaggtgaggagaggagtgggggtgagaagagaggagaggaggcattggaggagggggagaggaaagaagaaagggatgggacagctcttgtgccaagcggatatcttaagatggccacatgcaagaatcaatttttccatgcgggacttaactgaacatcatctaattttttttacatgccgacgttcttttagcccgcctacaataaatagggttgcgtctagaaaaaccgtttttaaagtagtggtagcaaacttcatattcttttttttttcgaggtcatactttttaattcgatgaccttgtatgcataaaatctttctattgtttgttcagtatagccaatatgtataaccgacgcaaaagtatatacattaacctccgtatcatagtgtagcaaaatctattatcggctagtatactgcatgatattgttgtgtgaaaacgaatcattagtgatattgttgacagttgcaaatagcaagagaacatatgcagtcatgagtcataagggaatatatataaattccttttaaaaactaaaggtacagaaaatgaattcaaaatgtttggggacctcaaaaagtgcgtcataccgtgtcgttcttgagtcacgcgcgcatagtttccgaaagatatttgaccagaaattaacgctgctgatgcgaggtcaaaattctcgtctacctgattcttttcagatttccaggcaattgccggggaaaatctgaaagcatccttacttaaatcagcgtacttgatggtgaatttacaccaaacaattttgattttttgagcgaaaggtaatttgtgtagctgcttgatcagcttacactctcttgaagtttctatatgaataccgcggcggcgcgcggaggcgatggcgttgccggcgtccagctccaggagttcgcctacttcgtggtcatcgacttggaggcgacgtgcgagagggggaggaggatatacccgcaggagatcatcgagttcgcctccgtcgtcgtcgacggcgccaccggcgagcagctggcggaggcgttccgggcgtacgtccggccgttgcaccaccgggagctcaccgattactgccgggagctcaccggcatcgcgcaggccgacgtcgacgccggcgtggacctccgcgaggcgctgcgcgcgcacgacgcgtggctggacgcgaggggcgtcaagaacgccgccggcggcggcggcggcggaggagggttcgccgtggtgacgtggggcgactgggactgccgcaccatgctggagggggagtgccggttcaaggggatcatcggcgacggcaagccggagtacttcgaccggtggatcaacctcaaggtccccttccggcaggtgttcgaccgcggcggcgcccgccggatcggactggaggaggcgctcgccgtggccgggctggcgttcgaggggcggccgcacagcggcctcgacgacgcgcgcaacacggcgcgcctcctcgcgctcctgatgcgccggcgaggaggggtcaggctcgccatcaccggctcgctgccgccgccgccgcggccgccgtcgcagctggtcgccattggcgccagcgcggccgcgacgccggcggccgccgcgccgggagtcggcggcggtggcgcgcgcgtgcactactgccagtgcggcgtggcgagcagggtgggggtggcgcggaggccggggccgacgcaggggcggcgcttcttcgggtgcggcaggtggacgccggcgagaggggcggtgtgctcctactttgtgtgggaggacgttgatatgtctcgagcaaatccacggccatagctcatttcgtatttaataataataataataataataataataataataataataataataataataatgtttttgtgctaataacttggacgagctatcagcctatcacgctgtggctttgtaactgtgtcgcagatttacgaaagttttacacttaccgaaggcgactacagacctgtgggtttggcattggtctacttgagttgagctatgagtgccctcatgaaaaaaaaataaattacgtcactttgaattgggacactatcgaatcactagctctacaatggaggtcacgatgtagtattttggtagcttttaaaaaataaattatactatagtaagttaaaattaaatttaaaattttgactgcggaaggtaggaggaagagcaactgaagggttgtctacataaggggacataaggaagatggcaaaatttgttacatggcatttaaaatatatagttttgttgccagacaccccaaaaacatgaatttgcccaataacactttaaaaatgtggcattttaccctaggacacgtatgcattaaaatataatatacatctcattgatgagagagaaaacatgcaaaatgttagttttaccccctatcttctcccccattctcacagtcatcttccggcaataggacgacgagatccctgcgtagcacctgtgggcaataggacggaggacgagatgcccggtgggcgacgatgcacctgacacggctcaaggtgtggtaaatggtgagcaaggtggtgcggcaaagaggacgggtggaattatgacgtgcggagggtgaacaagcggacgctcagagagcacctgtcgtcaggtgatggcgagacgctcgcatcgtgtgaaggccaccggcgatggtcgagtgcatggtgtgcccatgcctggagaagatgggctacaacctcaacaaatcgtgccttgtcttctgctccaccagcgctgcccttcgccgtctctgctgcagatggcacggatgaccttgttccccgtagcggtatgtggcacagctcgaagctaccggccctgctgcctatggtggctagcagatcgggagcaacacggtaaaaaaaaaaaggtggcagccccctagggggcgacggcagcggaagcggtgagcggcagtcctaggtcgcccgctctgataccatgttggatagcatagagacgagaggaatactgcataacgtggatctattgtattgagtcaggggaccggtatatataagagtacttagggaggagataaggaaggattacacatatggaaggagtccacacaaatcaatcatatcctaatatgactctaactaccatatactctaacactcacctctagcaacggctgtccgggacccacgcccgctcctccctcctccaccgacgacacaatcccaatctccaaacctctccccctgcccccccaatctccatggtgaagaagagagggcaacagtgccattttgttaaattctctctctggctcgaatgaaaataatagtttaatggtgttagtgtccagcagcaaattattcttgagcaaattgacgttcctatggtgtctaccaacaaagatcactatagtgcgtgtttgctgctatgaatgtactaaaatcttctatctactaattattattttatcttggtttctattgacgatatgtcctattgtcctgtagaaattgacatgcttcactttgcaatttttaccatcatactttctattagtcctgccccatgttatgtgcttttggttttgttgtctatccgatcatggccgagactcgagaggtgaattgttcaagatcgattcattaggattaattaggagtgtttttaaactgttggtggtttgttgtattgcacataggttgctcatgaatctttgtgtaactagcgggcattttgttaattggagaattagtgataattttgttgatggcgggtgaatccgtcgccaacgaccatggggacgatggcggtgggccttgggcaaggcggcggcgacggcggcggtggcggcaacggtctcccagccttgggcgtctggatccgtcaccggcgaccgcggggacaacggcgatgggcctcgggcaggccggcagcggtggtggcggctggattagggttccaagacggcttttgattttcacgtgtgggtgcttcacttgcacgaaaaaatcggattttcacagatacttcgttccagacaggcgaaagatccgcacgcgaaaaccgcttttgaccgcatggaaaaatcattattgtactagtgtgcgtacgaagcaaactgggattgaaaatgtgatgccatgaatgcaatttaaattgaaacgatttaggatgatactttttttaataagtattcaaagacgaaaccaatttgattcagtatgagtggtacttggtctttcatttgtaataatcaactatatatactaattcccaaaaattttagtctaaactttgtggagttgacacctccaagaccattcttatgggtaaaaaagataagatgtgttacgaagataaaggttttcatgtggctcatattctgtaataggctaaatacgagaaatatgcttgatagaaaatattatccttaagaagatgcgaccttttatgagtgatttgctttagtacagaaaaagaaactcccatacaactttttcttttcttgtccttgcagcagaaattgttgggagagaattggtacaaaaatgaatgataacctagaactctttcacatgttggtcttggcaagaattagattcataagaaaggaaaaatgtttattgcaggcatatctgaaaataaagaaataggaagatctttgagaatattactcatggaatggaagtctttctttgtccaagatgaatgactctcttagctccctgaattcttcttggttacaatggttataattttatttcttttattcttttcttgtttgtacataactttttttaatatatataacaaataggcaaggtctggtagttattttttttaataaaaaggaaagtgaaaaggaaaggtaagagaatggacaatagtgtgacgtcagcatttgagagaaaatgccacatacaaatttttgatgcggaggaaagaaaagtaggatataggaggatgtcgtcatatataataactagagaataccccgcgtgttctccgggattccgagtcttaatgcaagttgctgtggaattccactataaatagtctccctttgtcccatatttcttgtcttccagatttagggcttcacactgacaccataatttacaatggtaaatcgataattttgtggttgcatttagtttagtaccaaatattgataatgtttatggaaattggtgacatcacatttattccatcatatcaaaacttaaacaattttatcaacttaccaaaaattttgatttgactaaattttaaaaaggtttattttggtagtaataatcttaaacatgtcctcgctaaagattgggggagacgtggagtacataggagtatgttccagtctttaggtgtgattgctttaagattggtgacgccacgtgtcaagattgtagaacgggcgtggggttcaagtgcctctccccaacaggagtacctcgtcggcgacctgcggcggcggcgatgtcggcggcggcggcggaggccaccgagcggggcgagccctcgggcggaggcggagagatcgcgtacgtcagctacggcggggagcaccacctcccgctggtgatgtcgctggtggacgaggagctcagcgagccctactccatcttcacctaccgctacttcgtctacctctggccccagctcaccttcctcgtacgccctctcctcccctcacctcgcgcgcgtgtttcacaagagttcgtgaggatttgatgcgttcttggttgatttgatttgggggacaacccctcaaaaggcgttcgatcccaaggatggcaagtgcgtggggacggtggtgtgcaagatgggggagcacaggggggccttcagggggtacatcgccatgctcgtcgtgctcaagccctaccgcggcaggggaatcggtgagccctccttcgattctccaagaagagtttctctgtttgtttgattggttgattgactggtttgtttcaaaagggagcatattcttccctttgatagtatctgcacaagtctgtcctgaaaggaagcgtagaccactcatgaatctaaataagaacttaagaatcctgctgattgggaggaaagcaaagggtttttcagtttttgttccaattcgatctgaaatggctggcacctggtggagtggtgggcgatttagtacggatttacaatcttccatcgatttcgatatgatatccatatgtactaaataggtgtttttcccttgttatgcttgcacaaacttaattgagtatcacttttacatgtgtcaagaaattactagctataggtcttataagtctaatttgtttcatgatcctttcacactaccatttacttgttttttctctgtaatagttgctttgtgttgatatggtattatttttgtcttaacatcagcaagtgaaatatgtctgtgtagcagagtggaacgaaaactagcttactaagtgttactggttttctaaaaacgatgccatgttaagtatttagtaggatttctttgttctttgcctgcttgatttgcagaaaggaaaggcatttttttatttcttttatgggtacaatagccttctattgttcccttctcttaaactatataatcttctctcatcagtttcaattgagatttgtgctattattttgataaaatgttagttaactttgtttaggtggttttctagttttgtgtaggagtaggtattgtgttatgaaccaatattcccatgtttagttttccctgtgacagatgtctcgtgttgggtgcttcagcgattcagtctgtggcacatgagagcattttggtcgattagttctttatggttggagccatttagcacttcatctgatgttgtagtatgcagcctaaccttatcgttacatcaacttcttgcatgagatgatttcttcttagtgtcatacacttggaagcgtgctgactataattgatgtagcaataaataggtgtggtgcgacttgctaatgcatatatcctgtgtggggagtacatttttcataatacttttatcatgaaatgcacactgatatttacatatatcttggtacaatggtacagatagtctgtttatctgaaaaacattgcctttgttgtttctgtaatgacattcgcagcaaggatcttgacagctttaattgttgaatcctgcctgacatgaatgacctttctcgatgtatgaatagagtatatggtagctttgtcatctgttaagagtattgcgaaagctccagcttcagttcgaatagctttcctgaagtatacaagtgctttgcttttgcaaatggtccccatttgtcttttttaattttatctgtaataagcaattaaatggacactatgttggcctttatcagctaaccctctgtttcttcatggtacagccaccgaattggttacgagatctattcgggtaatgatggaatctggctgtgaggaggtaatcaccactgtgttgttatcttctcacccgatgaaaaacttattattatcctattgtcgttttggtacccatcacttgactttcttggtgtaaaattgcttcattgattattcaattatgccctagactaatctgcaatttccataataacaataatatctttcgtgaaattagtacaaaaattgaattatttgatatctgactcactctccaaccaggtgacacttgaagcagaagttacgaacaagggcgccctcgccttatatggtcgtttgggtttcatccgagcaaagaggctgtacagatactatctgaatggcgtcgacgcatttcgcctgaagctgctatttcctcgccctgatcctggtatgcatccaatgatgatgctaggcaatgagagagatgaccagcacatggattctccttacttgtgataccattctggtcgattgataggatgagttaggatccaaggcattttgctcttttatgtcagtttgatgatgcttttgtagctttgctgtaactcttgtaacattgatgtgttcaaagatagtatcttatttgacatggcattatgtttctttcaatccatgttagacggttgaaaaagaatgccttattacatactccctccgtttctaaatattttacatcattgactttttagcatatgtttgaccattcgtcttatttaaaaacttttgtgaaatatgtaaaactatatgtatacataaaagtatatttaacaatgaatcaaatgataggaaaagaattaataattacttaaattttttgaataagacgaacggtcaaacatatttaaaaaaatcaacggcgtcaaatatttagaaacggagggagtatatttcattacttggcactaggaagaagagtagttggggtatgaatttgtataccgtttcgaatatttcgatccatttcctaaatttatggattcattgatcttactggctaacccctgcatatgcggatatgccacacatcagcatctacccaactacaaactgcaagattcttcatattcattatgagcctaaaagtccttgcaaaacagttaagcctagaagttactatattataattcattttgatttttttcccacggcaaacttatttagttttgatcaaatttatagaaaaatatagcaatattttaaacataaaaacaaaaggccatcaaaatatattcagtgttatatttactaaaattaatttggtgctataaatatttctatagttttctataaacttgatcaaaggtactatcaagaagtttgacttaaataagtcaaagcaacttataatataaacaaggagtatttacatataatcttggctcacacatgcagctacataggatgccaccaatctagccaagctacatgtaggagacgaatcactctaataccttatgcacaaaaattacatgataaaattatatggggaggttatggccaccatcgatgatacgggatcgctagtgcatccggtggcatatgtgaagctcaggaggatgaagaagcagcagcacttggtctgagaataacattgttagcagaaacatcagttggccatggagtaatcactggtatgctggtggtgctgcgacagcatatactgacggagcagcagccacattgtttccatcacaggatgctgtgttccctgggtaggagtagatcgccgaggaagctccataacagtagtaggttccaggtgcatgagtgatgtaagtggctgcctgctcgaattggctcccctcagatgaatgtgccgcagctccaatcacactgcttggcatagacccataattcctaacgagttgtaagtttgtcatagctgccccagttgctgaagcacttggagtagccccagaattacaaactagttctgagtttgtcgcagctgcctcaggtgctgcggttgcaccacttggaatggacccataatggctaataggttgcaagtttgtcgtggccgcctcatgctctgtaccgtaggtaattctgaaattgaagacagtagcaaggaacaagtaagacttccaagtagctgcaagtaatgttctttcagattttagacaaaatcgcaaattatggttctctattgcgcctgcaggctgcaagtatcagttcattaagtttttcaaactatgtccagtaactgaacaacatagttttgagacatcaatgttgtcagcattggcctacacgctaaacataatttaattcggttcggagaaacagccaacacattataaaattgacaaacaggaagtactagaaccataaacgcgtacctctcagatgtagttcctaagtagtgtgatcttggaggatcaactgggtgcatgccaatttggtgggcggcataatatggggcagtatagtagccagtagccgaaacatgatcagaaagagattgttggccatagagattgttggccatagagatattgttggctgagggcaatgaactatatgctgtgtgcgctgcttgatatggatactcagctgttgacatatggtaaggaggtgtagtgaactgcatgtttggaggaggcatctgagcatatgaatgtgcataagattcaggtggcatcggatgagcagtcaaaggaggaatataagaagtttggtgctgctgatgcacataagcagctggctgtgatggatgagaagcaggaggtaggtaaacagcaggaggaacaggatgcctgtcactgtcattatggaagagtgcagattctggcattacaataattggacgaaacaatgctctcagtttctcaacctacagcagagtaacaagaatgatgaaaatagaataaagtagaagtatgctatagttcaaaagtcccataaaatttgatgcagaagggaaaaaatggaagataaaggtatattgttctttcctattccatctcaccgccagactattaacaaaaagatttaagaatagcacaaaagagagagaaaacaaaagaaaattataaagaggtacatgttcttatcatgccccacttgtgtttctcttctaatataccagcaattaattttctcagcacaaaaaacataaatccgttactacacaggcaaaatacaatcagaaaatttattcattctctaaagtaaaagaatatgagtttgactggaatataaaaaaaaaaagtgatgtgatctgtattatgtaagcaatacatggaaaataataagcttcaggcctcaaaatccaaacatgatgaaaattcacatgtgagtatgtcacacaagatttcagaaggaatatgttttaaggtctttataaaaattaagattgggtccaatttgtttcatcttcacactgatcataatatcaacaaatggtgattcaaccttacctgcacaagggtaagttctgggctgaacttcccattggaataattctcttttatagcagttcttaggctactctctgggataggcatgaaatcaccatcaactgtaaatttaacctgcacaaataaaatgaacataagtggtcactgatatttctatatcgagaataaaatacagctaactaatgaaattttattattaggattcgttaaaatattttaattcgatagtaaacatcacaaaacgtgaggtaggaggaacacaaatgtcaggaaaatactaatagcagacaaattagttcatgtcaggggggctcctaacatgtctgcctctctggctcctaaaagagataaagttgtggaaacatgtgccattcattgcatctgtaattagttctggtgaagagaatgttaggcctctctcagggcccatatgttcaccacataaggtaaatgctaaaaaggaaaaaaatatcttgatttaatccttaatgttagatcttgcagtcctaaattacaataggccagcatgattttgctgcactatatcagtttctgcagccaagcaagcgcatggtctaaggtaacctagcaggccaacattggactcagtcacaactcacaagcaccagtaaaggttcttcatgccatatagactgttagttaactcatcacggaagtaacaaagacattctgcaaaactactcatcacccaatttggcttcatgtgttcaaaatgtgcccctgtataacagatgtgacagagataacagtaataccagtaattgctcatgttggatattttatacaacaggtcatttgaattcacaattttctcctttatatcgatgaaatgcattattcaccacaaaaatacctgctagaattcttggaacttcaaaaccgagcatatatttgaattcaggataacatgtagtatgctactcctaggatatgctaattcatatttcctttgcttagttcgatttgacagaagaattccacaaatgctagagcaaccagaagaagaatggtgtgggaaaaacaacagtttagaacaaaacaatgagtttcggattatctaaatcacagatcaaatttgcaatttccatcaaccatcactgtgagtattgcaatgacataaagatcctaatcaaccatgtcaacatatatcattacttggtgaactatagtcacaacaaaaacccgcttcctctgcagaataaacacacatagcacaacgacagagaattacctgggcaggaaagcggccccggaaggcatccgggacgagtgtgaggccaccattggaatcggcatggtagggcccatagaggtgcttggcatcgaagtcatagagaaagagcgctgtgccacgcctgatccgggacaccacgtctagactccccagtggcaagcccatcacccggtgcctgtagcactcagctttcgtcacgccattgcacatgaagatgtacccagcaggcgatgacatggaggacccactggagcaaccattctcatcattctctgccgcagaatgtggtttgtcacacaccagagaaggtgcagtaggggacatggagcactgcaacgcatagatatgaattagcttcatgtggcaccagaagagcagttagaaaaggaatataagaagtttgatgatgcacataagcggctggctgcgttggatgagaagtggaaggaggtaggtactcagcaggacgagcaggttgcctatcatcaaaattatttgggagtccaggttctggttgcacaataattgggcgaaacaatgttctcagattttcaacctacaacaaagtaacaacaatgatgaaatagaacgaagtaaatatattatgtagttcatgagcccaataaaattttgcacaggaggaaatggaagataaaagtattgtcctttcctattccagctagctgccggactattaacagaagtcaagattcaagtataacataatagagagagctatatgttcttattataccccatttgtgtttttcttgtgttataccagtcatttcttttctcaggacaaaaaacataatttcaatactaaggccctctttgtttaggcttataagctagcttatgagttgaaaagtctaagcctaagaaaacaagcagcgttttgcagctttttcatttggcttttttaaagccataagccactcttacactgttaagccaaaagctaggttggagaagcttttttggcttatgtgaggtagaggtatgactccaacattaaacttgggactcttaatctattggcttataaatcatataagccaaaaggctaatttaaaagcctaagcctaaacaaagaggccctaaacagccaaaatacaagcagaaaagacatattcaatctatgtaacaaaagaatatctgagttcaagataaataaaaaacgcagaagtgtcatataaagaagacactgaaaagaataagcttcatgccttaaagcccaaacatgatgaattgtcagtacattgcaaccctcccaacctcgatttgactccttattcacaagtggcacaggaggaattttagaaggaaatgacaatatgttttatgatacttatagaagttaatattagatagaatatgtttcatctttactctgatcacagtatcaacaaatgctgattaaaatttacctgtgcaagggtaagttctgagctgaacttcccattggaatagttctcttttatagcacttcttaggctactttctgggataggcatgaaatcaccatcaattgtaaatttgacctgcacatatacaagaacataagttgacactgaaccttcaactatattgagaataaaatacagccaatctacgaagttggttattggacttcattatgatttttaactcaaaagtcaaaagtaaaccgcatataactgccagggaaaataaaaggatggtagacaggttaattcatatcagtagagcacttctaatatgtctctctgattcctaaaggagctaaagttgtaagcaaacctgtaccattggttgctctctttttttcttttgaagagaaccatttgttgcttgtggaattagctctggcagagagaatgtcaataaacataacccagccgatatattctcaccacacaaggtaaatttcaactatataaagaatctaaatcaaggtgagtttgccatcccaccaacacctcttatggcttgtaataagattattttgctgctatgcatgcaatcattgcaattgtacaacttatgatatttgattacagatacgttgcgacagatgggtatttggttagtaggaaaaacaatttttcatcattaaccttagattctgctgtcctagaccataatagctttttacaattttgctgcattacaccagcaaggtgctgcagccaagtgatcgcatggtctacgacaatccagtggaccaatgttatactaaaccacgtgatacagcaaggttcttcaagccacaggctgttggttaactcatcagtcatcacggaagtaacaaaacattatgcataattactagtgcaatgaacatgactgattgtcaacccttctgactaaatgtgttcgaaatgtgctcctgtataccagatgcgacagcactaacgtatgttacatttcgtcctgccggttataaaatatgaataatggctcacttgtggatgttatttacgacaaaaatttcaaatgcaatgcataacgtagcacaaaaatacattctcgaactcaaggaactccaaaaccgataagatgtatgaactcaatgaaagatgctaatccttggaaacgtgtgtacgtatttcctttgctatgtttggcatgttgtactcctacaaaaataatgaatttacattcccttaaatagtacattataatcaccgcatagaatgtgtagtaacatgatggctcaaattaccaaattttccatcagtcaccattccgcgagaaatacggttctataaaaatgattaccactccaattccacagcattctcaattcatcaccgttctccaataataacaaaaacgatatcctaaccacgtgacgtcagcatgtgtcccacacaaccgcattcctcctgctgcttgcagatgaaacgcacgggggagcgcgacggcgcggggggagggcgagttgggttacctgggcggggaagcggccaccgaaggcggcgggggcgaggtcgaggccgccgtcggaggcggcgcggtagggcccgtggaggtgcctggagtcgaagtcgtagaggaagagcgcggcgccccgcctgatccgggagacggcgggcagcctcccccgcggctggcccatcaccccgcgcgcgtagcactccggcttcgtcgccccgctgcacatgaagatgtaccccgccggcgacggcgacggcgacggcggcccgccggggaggccgccctcctcctcctccgacggcgaggcgtcccgcggcctcttgcgcggcggcggagacgtggccgccgtaggggaagacgaagggtggtccgccatggatggaagcgaaggggagagagaggggtttttagggtttttcgttggatggctgcggtgggagtggatgagtgaccgaagcgtgacggctgccgcgggtgtactcaggtgatgtctgcttttttttttcttttttcttttcgggtttattaaaaaaaatactccttccattttagattatactccctccgtcccataatataagggattttaattttttgcttgtattgtttgaacactcgtattattcaaaaaaaatttggaattattttttttacttactttattatccaatgtattttaagcacaacttttcgttttttatatttgcacaaacttttttgaataagacgagtggtcaaacagtgcaagcaaaaactcaaaatcccttatattatagggacggagggagtaatttataagtcgtcttgattttgacccaaattaaattgctccaagttttaccaaatttatagataaatatacaacaccaaattaattttattaaatatataattgaatatattttcgtaatatatttatattgggttgaaaatattattactattttctacaatcttggttaaacttggagcagtttaactttaactaaaattaaaaagacttgtaatctgaaatgaagggagtaagtaaaatttatattatataccgacttaaaaggcaatatttgaaaaagatatttagattggaaatatcttaaatttaactctaaatttaaattttgagaacaactagttattttttggcaaacgaggaggcgttcgttacattgatagcagtcactatgcaatttactatgaatagtactcatctattttatattataagatgttttgacttttcttttaagtttgatcaaatttatcaaaagatttagcaacatctacaacaccaaattaatttcattatatatatcatttgataggaaagaaaatcaaaattacccctgctactgtagaagtacgaattaacctcctcaattcaaaaaccagacatttttcatcatcaactttttatattgaacgaattaccctcctaaccaactttagagtggttttgatcctacgtagcgcacacgtggtagtcagtcagcaataaaaaatactccctcattgtgaatgtggaaaatgctagaatgacttacattgtgaaacggagaaagtatataaaaaggttaaaaaggtagggcccacatgtgttgacggcagaaccaagtacaagtatttgttcatcataatatattttacagtatttatttttgagtctgacaagtgtataaaagttttactagcaaatgattttttatttgctaaaaagcaatttggataagatcatgaataagatcgatggcactgggctggttgtttctcagctggaagagaagagaagaggggtacacttgttaaaggtagtgtttttagaatggaattttactaattttgggtggcaatattacaaagtggcattttttctggagtgggattatcaaattttgcccacgttttaaaatggcaaagaaactggtgtcctgcttggaacttggattgtgcctacctaaataatctgacaggtgggtccagtttgtcatccacagtcacagacgcagctcaatacatgccggtttcctcactgtccagaataagaaaggggttcagaaccaaatgacatggagaccaaaagtttcagtcacttatcttcactgaaaccgagctcaacttaaggtgaagccaaattcatttacaagctacaaacagggctcagtggttggatgctaccagtgcatctctgcattcggtcaccaatcaccatggccacattatttcttattgctcatcaccatgagaagaactcaagctaaaaataaaacattggtgccaaggccatgtcacccctcacatcaactgtttgccggactgcggggcgaaattgatgaggaatgtgcgtatctccatggggcccagatcaacgacgagcttggaaggatctacggggcctccccggacgatcttttcatcagcaggagggccttccaccttccacttcagcctctttttctccatggctgaacgttcttggttcgctgataggcttgtctcaacaatcttgacaatctggagaggtgaggatggaatgatcgaataagttgataatggtcatgtatatcaaacatagatgtatatcagaaaatgtgatgatgatcaccttcttgtctggaaatactctcttcaggtcgacgctagctagagctgaaagatccttgtgctctccagcctataattacacagggcaagactcagaaaataaataaaaaggaagatcaaggtataccaaggaaaagtaaggatgatagcacaagacctcgtataggtgagccaaccgaagaagaacagttccgtcttcaagttcctgtccaacgcaggggcatttgacacatataacttttaaagcgacatcgtgcaacacttgcccgatacagatttagaaagcattttcatcaattttgtacatgagcacatttttagctaactggctcattactgtttgtaatcaatgatatcaagcaggattggggcaggacaaagaactagcttgcaccattgcaaatggttaaaaataatataaatattatactgcataaaggtgaaccaaatcagcgatagttgggtagtcgataaccaaagatgggaataattctggttcccacctctagaatcaagtaatccatcagggctttcaatgtagttgttagtgcaaagacaagcatttcatttttacttttaagagaaacaacagtggtccatagcacgcagatacctgaagagtaagcaatgcaacattatcaggcaagctgtaggccggatccattgcagagaattttgtaacgtgtgaattcacccaattacctccatcctgagtaaacagcaaggacatgctcagaactagcataaccttttggtcaactattttataaataagttccagtttatacctgctctgcaaaagcaataagaagaggggagtatatttcctggccaaatgtccgccgccacctagctccttcaccttgtggatcaattttgagataatactttccttgaatctgtgaaataccataataagatgttttccacagtatttttgcacacaatcaatgtatttgaaaacattatagaacaaaaacatctctagtgacagttggcacaacatatatatcttctctttatactccaagaggactttgttatagataagaaaatatttcaagagggcagaaacgatatattactttatagcactaacttattttatttaagtatgctctaaattttcttcaaaaacaagggatcccatattcttttgctgataggatctcagtagctgacatcttattttgacttatatccagaacagggattcaagaataagctctgtttacttacaactagtccttcacattgattatcaaaacaggttgtttcatttaatgcctctgcaacaccacgaccatcatcatgaagtagtctcctacaaagagtgacaaggatttaaaccattcagaggtacacaaaaagggaatagttaaaaaaagggcatgtcacataaaaacatttttgaaccggtgcaagttccactacagcaaaaattatagctactaaaaaaatcctcaaacacaattattagctatatagaaggacatgacatacattcatggaaaagttcaagacaatgactcatatcttctgcgagataccaaatgataaatatgcaccatcttagacatgtattttattttactggaatttgtaccacattatcaactgatatgcccccaaagaaaaatatgaaagaagcaacaaagtattgtactatgttgtttgagttgaagatatacctgtgtagcattagctctatctgtccatcctttatgctggcacctccaacagacctgtctacaagtatagataactctctgcttccatcttccacataaatgccaagattaacctgaaagtagatataaaatcatcaacaaatgcataaatcagccccaaaataaactatctgtgaagctacacagaaaactatgactggatcctttcaattttaacatcacacaataaataagaattgaaaacattgtaagttcatcaaacattaaggattgagtgaactttaagacagtctcactcgtacatgtcaaattttcattttccgatcattcataatccttagtgcatcgaagtattgtaaagagaaaaaaatttctattgtaaagatcactgaacttcttacgctagcactaaatgttattgttatcatatctcaatggaataaataaccaaacaaaacccaaattcctttaaaaagaagccagccatacgtgaataaagtcataaactaagaggataactcaaacctaactcctgactagtttcggatattgatttgatgataaaagacatggaagaaaccaatttctcagtgcttctacacttgtgaatatatataaagaggctggagaagacaaaggctcacaggataatagtttccagcgataggctggtgcacttcgatcttccactctgaccggtaatcccgtatctgcaaaacaccttatatattagcataaattgtgataatcatttacaattatgcgatgcattttctgttgcagtcctcttctgtgcattgtttagtccttgtccccttccaaaactagagataggagggcattcacataattaattcagggattttttttccagtactatgtttattttcattgtagatgtatagtgcggagtgtagatgtgctttaccagaaagaagagtgagaacacatcatacccttttgatgaagtcacgtccactggaatcagtgtaaaatgttttgtttgttgccatgtttgtaacgacttcagtggatagttcttttccatttccatcatccactggtattggtccaacctatccgtaagaacaattatttaagcacatgtccgaaatctcatccaaagagaaataaacaggatataaagaaatcatcatgcaaattgcaaaatgtgaagactttaaagaaaccatctttagcaatgaaggtacatcatattggcatagcacttactataaattcagtctccacatagtcctttcctttgtaaactctgttgatctgtgcaaagaattgaaaaacaaggcatcaggaaatgagcaacagcagcagcataatttcccattcattcacaaagattgagagagcagaataaactttaggtgtggaacagaaaggagttaagaaaaggtaatgattgatgatttagacaagcaattatcatagaaataacctgatatatccatggattaatctgctgatgcacttcgtccaatatggacccacggagaactgtcagaggaaccttgaagtgggcaacataacttcaagtaagacttacgtgcaattttaaaatctctcaacagatgctgcagtgtaaatgttattctcggaaaaaaaacaatggaaattcttaaggcaaattactgaattagatatcttcttcatacctgtccatcagtcttgataggaactgtgccattagggcgaaatatgtatgctccagaagcctagggtacaggaaagagcaaataaatgccaataatagtaaatgttgctgaataaattaattatataatttgtactgcacctgaggatcacttccatttccatcctgtcctatgtaatacttgtacttctgctcaaaatttgcttcaaccttggaatgtgttaatggtgttagagtacaagtgagtttagatcatatgcaataattaaagcaagaagcaatgaacacatggttttctagggcaaataacatactggttcttactccctccgttttataattagtatttttattgttatgagatgataaaatatgaatagtactttatgtgtgacttatgtattttaaatttttcaaaacaatttcaaataagacgaacggtcaaagttgtgcacggaaaatcatggctgcacttaaaatgggatggagggagtacttcttagctagctactagcaacaacaaatcttacgagtacactactttatacctttacaatggaagcaaaggcaagtcctgtaagagaagaaaaggttccagattggaggtagtgattaacctttggcacattacctgggtcttactattggagtacagagataatgctccagctgcattgtattgaagtttcaactgtccttgcccaatttgcatgttactattttcacttccttgagatgagtgcagagtggacatcaaagagactgatgctgcaatatatgcagtgaattaagaaaaatcgtcaaacttcatggcaactcttaactaagttttggtgaagaaagaaattaattcacctgatttcttcccgcttgatataaagtacgtattgaaaccaagaggtggtacagaaactggaaaagcaagccaaaacttgggttttgcagctggtaacatgcctaggtaagccttgacatgtttctcccgcatgtacaaagatgcattagctataggcagaagttgtgattcaacttctcttccctcagaatcatgaacaacaattgagtcactgatgacctgttgataaattggcatattaattaaccatctaaagcaaaagcagtttcatggtagtagcacaatgcatcagtgcatcacacatcttatgcacaagcagaaaattccgattgatatatgccgagcaaattaaaacaacaaaatatgttgcttttcagggaataacatttgcataccggtatgcgaaggacatcctcccgtttccacccaagagagttgtacacaagcacaacctgtaacataaaaggtgggaaaaaaataaagctatatgtttttttcttaaaaatatcaatcaactacaaacaggtagttcatcttgaaaagagttgtgtgttgtgttaagaacagaactcaccaaacttttcccttgagaaaggtccatctcggaaggggggcaatatgtaatatttaggagcggacactgaaaaggagatataatgataaaggaaatactgcatcatgtataattacaatgcatgttgagaaagcagaccccacgcattacaggggaagggagttggctctaaccagtgccagggtagacactcacacacacaaagatataaaccaacctgttcaaaattcgttgtttgggacggacaatgtgattttgagcctgactggctcaagcaagagagagaggatgaaaccagcttctcggcctataaaaaaatcgaactcattgaagcgatcaaaccccaaaagagaacatcatctatgaattaacagtactcttgggaactcacttgtgtatagccaattgataatctctttgcatagtcatttgcgacatgttgcttctccgttcctgtaacagcatcatggtgctgagcaagagctagagcatcagctaaactatctgttgtgagatcagagttgcttctccctttaaagaattccaactgcctagctgcctgaaaagtgaaaacaaataaaatattaagcatatgaacaccacaaagtaccaagtaaccatgaaaatatataatactgaaactgcacatctgaatgctagagtaatgaaagatgaaaatttaccaagtaatatccactcataacacgaacgtatcgttttaaggcaggtctgcttgtgaagtaacctgtccaatatgcatttgggttgtctgcatacctgatggaagaaatacagtcatttgcatgtgaaagcaacaaaaatgaagttaattatatcaattatgaaatataaggttagaacatacgggaaaaaatcattagtcttgagaggccatggcacattttcagcatgttttgcatcagtataaatcgaaggtgtggaatacagagcattgacacggccatcctgaggtaatggaacaacatgttgaaatcatcatcattacaacttcatggtgaaactaaattagttaaacaatagtcagcatttgtaatatccatgctgatcttaaccttattaacgtagtgaattaatttgtccatctgtctgaaccaactttctgcatattgatatttgaagtctgtgcccattgtaaacataacgtgatttgtccttgtaatatttgcctagagaaaagaaagaaaggagcatgaattaggatgaacaactcattgctgagtagaacaataacttcaagttaaaacgttgtcatttagctaatatctttgaatattaagagcagaatgatcgacatatcatggaatacggaacaccaaaactgcattctcaatttgtgacaaacacttaacactacaacatccagaaaggcagtctaaattgaataagatgtttgcactttgcagtagcatcaatcaacatgactaatggatttccatgcaatgcatatggctccatagagggtctacatcagcatgaaaaaagtgtgaacatacagtttaatgtacctgtgctatagctgcagcaacaaagtcatccacccgttgctccacattataatcaaaaagaaggggatcatcctgcatagaggcaaggaatgtataagttcatgtctggtgttgaatgatatgcattagtagagtactcattagtttacctggacgattggggaagtatcatcaacttcgaagtaaaactgaccaggaggtggttcataattttttgggaagatgccagcaaagatctgtaagaaaatgtgtgtttcatatgaaatatggaatccccagagtttaagaacatcaaattgaggcataacattaaccgtgaaaaaaagaggtcacttacgtcagctgatgagccgaaggtcttggagcccctccacacaacctcgagctcttttgttcccttccgtgtgtcacggtcttggtaatcaatccggaaaaaataaaaagcatcgaatcctacctgaaacataataaaatgctagctgagcaattacttttctggtaaatctaatttcacttaaacaattggattgtgtagattcagtagctacattgtgttgtcaacaaaagctctctgtggcatcactctttaggggatagcaaggtatacataatgacatttttgtatctcagcacataactacctatgatgggtgataactagttactatcgccgggctgataactagttactatgataacagcattttacatttaagtcgaattaaacactggaaggacggcatcaatgagttcagtggattacttctgtgcctaggaggtaagcctgaactgcggagtgcccaaacggatcaatctgccaaccaatccttggaatctgaccaaactcctccttgatgaacctgtgcccgagcgtagtctggtctatcatgtcaatgtagtgcacggtcgcttcatcatgcatgcacattcccccgtttctgcaacagcaaaagaagcatgtcattctctatacaacacagacatgactaccaatgcagcatacatagcgatattcgatttaaaccctacattaattccaatcgtccagtgctgatgagccccttcactatatccttaatcatgtcgctctgctgtctccaccatctctggaagaatgcctaaaaaccaaagaaaccattggtcaatttcagtcaatgtgtctacaagtggttgcacattgcttcctatccaaccaaaaaaggactcccgacattgcagaattgaccattttggatgtagatagaatagcttctataacttcaactcctacaattgtcagccagaaattgcttgtagaaacaccaatatggttacagatagtactacattgcttcctacccgccgcagttccaattccactcctccaagcggctcaaaattcaattgctgacaaggacaaacttccaaaggcgggatttaccccccaaaaaaatactccctccgtttcaaaatgtttgacaccgttgactttttaagacgtgtttgaccgttcgtcttattcaaaaacttttgtgaaatatgtaaaattatatgcctacataaaaatatatttaacaatgaatcaaatgataggaaaagaattaataattacttaaattttttgaataagacgaacggttaaacttatgctaaaaagtcaactgcgtcaaacatttcgaaacggagggagtatatgttacctgctcaacatagacgaacttgcggttctcatccttgagcagcgctggcacgagcgaatccagcacattctgcacgcacgccccctgcaaccaaaaacacccagaaaaaaaaatccaattcaaaacaagcaacgtgacgagaaacgagataatccgtttccaaaattcagcgcatcaatcatgcctaaactagctcccccaaacccgtagaaatttctccccccacaaaaaacggggaaaaaatcgcggaaattccgaggactgcgccgcgcagctcgcgctctcgatcgaaagcgcaagtagtagtagcaacctggatggagttgttggatccgacgtagtactggtcgacggtcttgagccacccgacgtcgtcgtgggtgtgcggcaccacgtgcacgttgagcttcccccccaccacccccgccgacgtgttgtaggggatgtacacgcactccccgacggcagcggcggcggcgaggaggagcaggagcagcgccgcgaggcgggcggcggaggcgcccatgggcctcttcccgaagcttctagaaggggcgtggaaggtggagaagggaggtggtggatggaggtcgttgcggccggccgcggtgaggccggggggtggagtgagctaagaagaagaagcggagcggggtggtggggcccacctgtcggtgacacaagggctcgcggccgcggcgtgccgggcgggtagttgcgcgctgtgccacgtcagctacctagcttttatcgcggttattgagtgaattttcagtatggccattcgagtttcctcgatttgtggattggggtcttgttgcgtatgagactttttttagggtccgttcgatctagatgttccgatgagctaaacagtaaaccctacgtccctaccacgtactaattcatttgatcggtacatgattaattgactatttactaatatgggtttagaaattgatttatttatttttaaaaaagaaacttcaatataaatttttttaaaaaaaatacattgtatagcaattcgagaagtaatggagttgctcccccaaaatagctaaaaagccaaaattattttttttcacgtatagtgcaatttggatgaacacaatccacgcgcatcactaaatgcatatatatgcatgtttgctctttaagcatacttgaaatattatcaaaggcgtcaaacatccctcccctcttcacgcgaactcatgcgccattcttcgaattaaattagtcgaatcaaaaacaagccctacaacgtatgtccagcaatgcttttttatgtagcataaacatgctaacttgatatgtacatcatgagctaattttgccgaccatgcatgtgctacggctctagttttagtttgagagagtcgacgatatatcttatataattcagggcctgttcactttgatgtcatttttaacattgctaaattttgataaagttgctaaaaaaatggctatatttagtttgccgctaaattttggtaactatatcaaaaactatgccaaaattttagcaagttaccaaaattttgatattaccaaaatttggtaaggttttttttttacattaaagtgaacagaccctcaaattatggcgcttacacggttctaaatatgctcctaatgtcgttgagctgtagccttataatctaggctatcggtaagcttcagatctctccttttgacaggtgggaccccgatctctcctttgttatcatatttgtttatgttgttatcggtaacttgttgtaatggttatactatggtataatacaaagtagccatgataataaacaacacctcaatttgcataaaagacaacactctatgatcttaataggttgaagagaaatcaattggaagaagaagataaacctctctcatgtcactactactgaattggttttcctagacgttgcccccttttggttccatgcccccgaattgactggcgctaggttgtgaaccacatgggaaaaatgtgcggtcctcttaaatgaaccgcacgggaaaataagtcgatttttttcgtacgaacgtactaagagagccgcacgtcaaaatagtatttccctcctacccactttaaaatttcctctttttccgcgcacctcggtcctcactctatcttcttatccagtcaattctcttattcaactcccaaaatttctcctctcctttctcacgattctcctctctcctctcctcacttatgcctctcggcggcagcagtgccccacggcgacggcggcgcaacggtggaggcgcgggatccggcgggcggcggcagtccccgcatggatccggcgggcggcggccgtccccgcatggatccggcggccggccgccctcccccgccacggatccggcgcgagaaccgcctgccctcccctcccctccccggcagcaacgggagcgcgcgggcggcggatctagcgggcaggcgggcgacgacgggcggcagcggctcctcccatccctctcccctcccctcccctccctggcggcaacgggagcacgcaggcggcggaaccaacgggcgagtgagcgacgacgggcggcccgcggccgtccctgcacggatccggcgcccggtcgccctccccccgccacggatccggcacgggaggctggcgggaggcgccaatgacgaggcgggagcggcgacgctgccgccgccgccgacgaggcgggagcgacggcgacgacccgatctagggttttcttttttttttgaatttttttcggttttctgtttttccgtgcggtggcataagcaaccgcagatttcgcgattttcccaggcgatttgttccagacaggccaaatctctgcacgcaaaaaaccgatttaccgcataggaaaacgcttagtgtagtaatgtgtaagcataacagacaagcccgtgatataattgaacttatatggcaatgttgttttcaatatcagtccatcagacaagtcaccaaaagtccttattttatttaattttcgtcatcaagcacaagcataaaaaaaatatagtatatactccaggtatcgcggatgaaacaattcatttttgccattgaaaggtcaggctatctatcacctgttactattatgggactgttcactttgataccattttcaaccttacaaaattttggtaaagttataaacaagtagctacatttagtttcctgctaaattttagtaactatataaaaaatcctgccaaaattttggtaatgtttttttcattaaagtgaacagccctacatatacacataatttcatcttaacagccgcattagtgctagtatcatttcctatcaggagcgtagcatgatttagtacgattggaaggtctcattcgcaaaaaggcgagatgcgaataaaaataaatagcccgtgccacggtggggcgcctcttccggataaggaggccagaacggggccccacctgtcggtccctatccagatcgatccgctgcaccctaccaaatatgaaacgccgaacaaccagcggacggcgactacactacgaaaattgttatgcatacggcctgcctcttcgacttatatacgactaaatttgatcaacatcaataattataaacgattataatgtatataaacatattgtctcgttcttttatccaacaagagttggatgaaaattaatattttcgtggcacacttttcaaactactaaacggtgcgttttgtgtgaaaactttctatataaaatttgctttaaaatcatattattctatttttcaagtttataaataattaaaactaatcaatcatatgttaataccacctagttttgcgtaaaaaaacttaatcttcatctttatctttatctttaggagaaaaagaacaccaccatagttgactaaatttgatcagcattaatagtgagtatgaatcgacatatatatatatatatatatatatatatatatatatatatatgaatagattcatatttagaattaagtgttttttttctaagacgtagcaagtatgaatatgaatatgaatctagatatatacaaatgtgaatatggatatatacaaatgttttagaatatacttgctacgtcttagaaaaaatatgaatctggattcatatttagacggcgtactcgcgttggcaaagctgatgatgagttgctgttccttctcggcgcgaataatcctctccctgtcttatccgatccatcttctttgtcgctgtcgcacctcgtggacttccttctcttgttttttcggggaccctctcggactaatcatacagttatgtattattcggtgctcttgaatcttgattagtgatggctaccattattcttttttctcctgcagtaagtttcattcgggaagtgatttgtattttttttttcattttgggattcgacagaaaatcctcaacagatacagtatctgtacaattatagtgtatagtgtagtttctatataactacatgtaagtagtatatatgtgacttgagtgtagtgtaaatagaaaaacacgtactactccgtccaaatatttggacatgtacagattcattgctagtattggtctctttttttttttttttgacagcggtctagtattggtctctttttttttttttttgacagcggtatagttcagtggagactggatatgtgcacttgaaacttagaggctgcgggttaattcgatccctgccctaacgtgtgtaatatattttaccctactcacgtagcacaaatctcaaagcgcatataattcgaaagttgcatagcaatcatattttatttttagagcttttcaaaagggtcatgctgcaaacgagttctccacttaagttaattgtagagcacagaaaacgataatgttatactcccttcctctcaaaatacaactacttattatgctattttttttctaaaaaaaagacatcaaggttaaagtgagaaatggttgtgatttgttgagttaaattaattaattaattaggaaaatgttgtagtagttatattttgagaaaaaaattctagaaatagctatattttgagagagtattatacctcgacgtaactcttcattttcaaagtttggtcaattattgcaccatatttagggcttattaatttgcagtgccatgttttggttggtagcaaagaggtgggtacgatgaacgtttggattgttactaattttggcgtggagttcttttttgtttgcttggcatttctaaattttgacaaaatagagaaccaattcaacagtaagttcgttgcaacaaggcaacttttttttttttcacggagtactctttctattgcatctttttatttgtttgttgcttacctgcttgtttcaatgctttatttcgataaagaaaaatacgatcggagaatgcaataattgctgtggtcacattaatgaaagtcgcagcataactagagaatcaggaaagtacgctttctattgcatactactccctccctgttgttacatattaattgacgttttagacaagattaaggtcaaatttttataactttgaccatcaataactttaaaaatatttagtttaaagcattgaacaacatatatagatttgtctttcaaagcattataataaaagcaatatatattatatatatatattataatagaaaaataaggtcaaaagatatattttatagaccgtgttattgtctaaaacgtcaattaaaatgaaaccggagggagtactattttatttgtttgttgcttggcttgtttcaatgctttatttcaataaagaaaaaaacgattgtagaatgcaattattgttgtggtcacattaatgaaaggcacagcataaataaaaagaatcagggaaaaaaatcaggggcattccgagaattgaattcgggacctctcgcaccctaagcgagaatcataccactagaccaaatgcccttttacgattacttttcaaaattacggtacttgaccaaggttatttggctcgacagacgataattacccatgacatgcattcgccgtcgagcacgccggcgaccaatccgccggcagaagacggcgccttctccggtgatctccagcagaccaacatttttctcaagatgacagcaattattgacccgagcagatgatcttttacaagtggagagcactggttgcagagacaactcacattgccatagttttattctcatttccattccattacatataagtattatttgttcagacttcagacattatgtccaaagccatatgaaataacggacgatgcaaagattcaggtacaatccaggatgcttcaagtctaataacacaaacacaaatcgttgccaagcaacccagaggtacagaagttgcagagatcaagcttgatttttcatggcaggaagcaaatcacaggatcctaaaacgactgaaacaccctaatacaaagctggcagaaacttacacggatcaaatactgacagaaagggaaaagaagagaaaaaaggcgaaaagcgcgacaagcatcgactcctaaggttgaaggtggcatcctagttgtcgacgacgagcttccgccgcttgaagttgaccatcacctcgtccttgatgccgacgaccatggctttccagttggtctccgggaagggggagaccagctcgaactcaaagttcctcagcaggtgagtccatatggccttgatctgtaggtaggcgaagggctcaccgaggcaaccgtgcctgccgccaccaaaggagatgtacgagaaggcgcccgctgccttgtcctcctccctgcctggtgcgtagcggtcggggtcgtatgagtcggggttcttgaagatgtgagggagcctgttggcgaaggctggagatgtcgcgacgatgtggcccttcgggatgtcgaactctttgccatccttcgttgtcactgagaagtcgttgtgtgactggcggagcagcatgattagcggtgggtgaagacggagcgcctccttgatgcacctgtagaggacatccatctctgccaagatgtcatgatcgatcttgtccccgtgccgcttcatgacctccttctgctcctcttcggctgctgcgaagtactgcttgaagcgaagcatgtaggccccagtccaggttgaggtgatagagctagtgtgctgtccagcaaatagtgctgcaataagtaggccggttatttcaccttctgtggttgagcgtccactcttgtacttcgaatcaatgaagcactgcagcatgtcttcctcagcccgtccagaggccttgcgggacttgatgatggtggcgaagatttccttcaaccgttgccgtgcccggtcacggcggcggtgtgcaggaattgggaggtaggggaagatgacactgactggctgcatcccattgtccagatcatggaagagagaagaaacatcatcaaagagcttttctcgcacctccctcccgagcaagcaccgactagcagtcagaatgatgagatgctccagctcatacttcagatccaccgttccactttctccccacttagagaagtactcctgtaggcaaggttgcatttgcagttgagattaatcatccaagatgtatgcaatgatgtaatgattgatgaaaacaagacagaacacagtaagacagtaaaaaagccttagtaacaggatttatcttgacatgctatctaaacgctaacatgttactacaatcatgacactgagtgttcaacatcaagccaaatgtccagtgacttgcataaagatggtctgtataatctattcataaaaactatcgatataatattattatatgaaaagaaagcatgcaaaaagtttatataaaattatgcctagctttttctttatgaacaaaccatgttattgtgaacaaggatgaataagatggagtgccataaaattggaattgcaaaggaaatgagatgatgcacaatacacatgtgctgtggtatgcacctatttgtaaagcgaatataacagaggaacacgtcaattcagtttcttgttgaaacaacagttgctgccaattatgtcctgttttgctgcaccaaaaagtttggagtcttatggtgcatttcttgagtacatcttaagaaaaggtacagttgacccacaggtcttggttaagtcagatagatacaagaatgttggttgtgacagcctgacaggatgcaaacattttatcattgacctccagaacttaacgtcacataacaaggtttagtttgtttcctcagtcaactaaaaaacaggtctttgtaactcaagctatatatcagcgctgtgtttagttccaaagtttttcttcaaacttctaatttttccatcacatcaaaactttcgtacacacacaaacttccaacttttccgtcacatcgttccaatttcaaccaaacttccaattttgatgtgaactaaacacagcccaagcatgtccaacgtttatacactattgatcaaactcatacaagaaacaaattaacaagaaaaagctaagcataatttgatatcataagatctcaaatacaaccagcagcagttcaaatctctacaagacttcagaaacaaaacatgtcacagttgtcagtgtaaaatatggcctgttctgattaaaagattatggtgctggtgtggacattcattcataattaaaagatgtcattcaaaagtggagaaaaagaagcacatagaaacagtatagaaaaggaaagataacacgtagaaacaccatcaagccaaaattcagagtagaaccggaaaagactaacttttaaacgatgaaaattagtaataaacaggaaagatgtgcaagctttattctaaagaactaattcactaaaaaaagggtggcaaaaggcataaagcaaagcacaaacggataacagcatactcctagcacgaactccatgccactggaaaacactgttgacagtgatgcacatatactgatatatttgggtttgagaaaaaaagacaaaaggtgatgtatggtagccacgttctaacttccagaaaagccacgcacaacatattagacgtgttgatacacaccatgacaccaacatgttgagtaatcaaacaggattaacaacagctctgaattgacgtatacatataagaaaaagcaatcatgctgaatattagatcaccaagctttcctatcaaaattgacatagcacatctatatcgagattgtatccttttgtctaagggctaactacaagttcaatgcataatgatccgcatgactgatcttcgaaacaaattctaccacacattagcctattacaatcaagtttgatgatatatccaagaacaagcatctcatgctaagttactatgcgacaaccatcctaacaatatatgaacaattgcgtgaaacggaagcgattctcacctcagcctcgacaaccatctggtcgacatagctgcggagcttgttggcgcggagcgcctcggtgaagaacctgaactgctcctgcctgacggagtagtcgacgtcgaagacgacgccggggccgaaggtgggcacgttgaacttgtagacctcctgctggctcatctcggcctcgttccccttgaagaagtgcgccgacacctcggggccgatgaggaaggtgatcttgcggctgaggatggggacggtgaagacgctgccgaggcgggcgtactcctcccggatcatcgggatcggcccccgcatgaagcggagcagcccgcccaccagcggcgccgccgggatggtcggcgggaggcgcttcttgccgccgccggcggagctcagcagcagcttgatgaaggcgagggtggccaccagcagcgccgcgccggcgatgagccggtggtttgggtcggcgagatccatcatcttcgtcgtcgtctgctcgaccaattgccatcgattagatcagggataatacagattaatcaagatgacacatacgaaaaagaaaaaaaaacaagattccaaagcctcgttcgcatcgaagacactctaggaaagaaaaagaacacaaatgcagcatcaaaaacagtggaaaaaaatacaattgttcttccacactcatctttccacatgacaaacaaaagtcactttttgaaagaaaaaaaagaaaagaaaatctctagatcggagagaacagcgccggaaattctctggtttttggccatgtgccgcgcccgggacatatgatagagaacaaaaaaaagaaaagaaaaaggaaatcaagaaacgcagtaggatgatgagatccgatcttggatggagcataccttctccctgctgctgcgggtgtgggggggggggtggaggggagtgtggagtggaagtatagactggagaggggtttatataaaggaaagcagcaaagattcctccgaggagaggtggtggtgggaatgaggaggggtttactgcgggcggagatgggaaaccggggcggcagagatttgcagaggagaggagaagggaggatgcgcggccggggaagaaggaggggattttgggggggccccacctggctgtgacgctagctggcgaccacgtgtgtttgcacgagcacacgacgtccacatgtgcaatggtgggtgtgggtgtgtcatgggcgggggatcgtgagtggagccgggagccgtagagaagggtcgctctctcgccggccgccgatggcgaggggggttttgccggcgggccacgccagctgcgggtgagcgaggcaggcacgggacttgaggatcattaataacactcagacaaaataacactgacaccgtgtttagttgcaaatttttttttcaaactttcaacttttccatcacatcaaaactttcctataaacatgaacttccaacttttctatcacatcaaaacttttctacaaacataaactttcaacttttccatcacatcgttccaagttcaaccaaacttccaattttagcgtgtactaaacacaccctcatgcaggtgcgcgagttagacaattagactcaccctctaaataatctagtcaatttaatagctaatatatataataatttttaataaatataatagttacctctcaaccacgtatactataatattaatatctgatctcacctatcatacacattgtatcttatagtctatggtcccattgatcttctctcttatttttttatcttcttgatacatgtttatagcttggcttatagtgtgctattgtacatgctctaaacagtactccctccgtcacaaaataatacttcatctattacaaaataaattaatcttagtacgagacatagcctaatactaaatctagacaggaacatgagtcaaatcctattataggttaatttattttacgagggagtacatttttatgctctttaaaatatcatataataatatttttgtttaacaaaattaaaaataatttaccgtgcgttaatgattttgttgttttgcgtctaacgggacgacagtgtcactatcgacaaacgtggttatagcacaagtcatgttcatcaattaatcatactacagtactactagtaccggtactagtacgtgtacgtgtttcagttattggtgcacggttgctgcaatagtacgttaacgtgaagatgtacgtctagttgtatagcctaatttcgtggttttagctataggacatcgtttgaagtgatttttggcagaatacactatgtaaatgtaataattttttaggagacaccacatccattattttaatgttttcgtactgacgacctagatggtgcccactttttaggtggcatgatcgaattgtgtttgtatgttttgtttaggataactggctctgtgcatggagagaatgtactccttgataagctcatccatattagaggtggagctactatgagcgaagtcgtacttgacgctagcggtagtggaggcgatgagggaggcaaaccttcctccctacgtaaacgaggcgcaggtcgcggctgtcctcgtggtcggcaagaggtgggcgagcacggtgcccttcatatcattcaacgccgagtatatgccgagtgcatcaatacggttcttgagtcggtgactctcacaaagaagtggatcctccgaggcaacatgtaggaggacacccctgtggcgttggcagtgtcaccgggtggtctatcagcacctctcgggacagcggcatgagggcatgataaggcctgtcaaggcgacccttcaagggtcggcagtgcttgcaaccaaagtcgttgacgtaggatatgtttacattgagaccgttgcagtggtggcggggaaatcatggccggagaggagaggaggatttaggatgtagaggggtaatttggtttcgccataaaaaaactgaagcccatatcgtgtcgtcatcacaaaaatattaaagtaatgggtgtggtgttatatttacatagtgtatttccatacaatgatacaagtcatttcatatagtattctacagctaaaactataaagtcgtgatgtcttatagaaaaatttgcccctataatataaaagaacgggggagtgaacttatgggttagacaagagacttttgtgattattcatttatttcctttattttttacaatttcggtgttggctattgtcttttttaactttgtccgttaatagtttttaaataaacaaaatgactagtgctgtctaaaacactaccaaagttgcaaaacaatattacaacaagtttaataacaaacccaggtacgggctataatccatatccgccaaattgagagaatatggatattagatttgaacaatacaatagtttacctataatgttgccttcactttactcttttctctctctcacttctccatttattttgtctcttgttctttctctgtatcctttcccaatttaatttgtctatttttaagcacattcttgatcttatataattaagaaccaactctttttcctttctctggtttctctcctcgacatgtccagaagtataatataatgaagtactccaggagtaactataagcttatactaatgtgctagctcttgcaattgcgtggaactgttgaaagaaatattgatatttcttatgttttatacaaaactgccattagatttttccttacatgagacaaaaccactactgcgaaaacaatgttcctagatgaatcttaccaattaatattgccactagctcaccaattaatattgtccgtgttcttcatttggatcctccttttgcattcataaaaacttaaccaccattaacgtgtggcaaaatacatgtttatgtgtatttattaaaaatatttcgagcattctgttaaaaaaggaataaactcaaacagtgcaaatattaaaaacataataaaagtatttgaaaaacaatacaacagataaaacaataaaaaatatatacaactatctatacaaataaggagtcttaaaaaatattatttttagagccctgttgcgagcacttgaaaggaactagtctcatcggttgccaaaaagttattataagcagtaacgacttattagcgactataaaataatttatttgtaaaacttttatagctaatgctgaaaaagaaactacattaaaaatatcttaaaatcaactttaaaattaaaaaaataaattttgaaattcaaattttagctttggctttgactttttataccaaccgatggggctctaaaataatgatactatgcaactcaaattctttgtaactagctgaaatcccgcgcgttgctgtgggagtttaacatgataataataagtaaaaataagatagctagacaatataagattacgcaagttaacgtggtttataataatttaaatttaaatagtatatagaatggtaattcaaatataaaagtaaggtgatatgactttgtgaaagaagaaaaatattgagatagtttggactgtagattaatcatctagaaactaaaaataattgaggtgatatggcttaatgcgagaggaaaaggagaaagataatttggaccatagattaatcatttaagcactaagaacaattgacgtgatatggcttaatgagataagagagaaataacactaactaagtgatgatgaactatataggtacatagcatattataaaaaataatagaaatacatattgaatattatgtgaattatgtgggatgatgatttaacatgcttgtatttcaaatgctctaaaatttaataaattataaattatagataatataacacgttttcatgatgtttaaatttaattattgttagtggatgatgatgtggcatctttgcatatcaagctttaggagttaggccgggtttagttcccaactttttcttcaaactttcaacttttctatcacatcaaattttttctacatacataaacttctaacttttttcttcaaactttcaattttgacgtggaactaaacacacccttagtgggtttatagtaagaaaggatgcgaccaaattctttacactgttatcagggcagtgaaagcaatgagatgtggaccactcttttcgaggcccatatgtcaatgtgatacagcggagttccatgtctatttgtaattgttgtggtataattttcacaacttgtttgcttttctgtttcagcacttatccagattctttccttagaaattgtgttttttttcccggatggagtacatgctttcaaagatcacatcctcatctcatcaaaaccaaattaaatcaatcaggccggaccacctccaactcaaagtggcagttgttcgatttgtcactttctgccatcatgcttttgcagttcacttccatagttccatgtgcacatcctttttaaatatgaaataaactaacctaattccgagccacgcccaactcaagtgacagtcacatgacttgattttgattcttattctcaactccaacataatccaaaactagccaaataagtaaacataatttgatatatagactatgcaaccagtggctactcaaaacaagttttacagaagagcagagcaggtaaaatataacgaagctgagaagctgtaagccacaataccgcaggggccaacggtataggcattgaaccggatcatatatttgttctgaactttggttcgaggtagctactgaatttgtagagcagatcagaagctgtacacagcaaaaaggagccaaagagacagaatagctttggtgacaagaacatgtgaggggattaaaatttgcaacttggcgatgtgagctatcttgatcagcattggagtagcatctcgcggcattttttgaggtgaagctgtatcaagaagtgtcactgcaaagatccaaagaagtacatcttatatatggcctcttggagttcttatggggtgtgctctaaacttcagctcctaactgtaactgtaacttccttgtttgtcgtgagcacgctttccaaaaacttttatatagatgcttctttaaaaaaatcaaaataatcaaattttaagtttgtactctctccatctaattttgatagtgatatttccaaatctgaatttttttaataggcatatttcaatccagcaacctatcatcttaatgactttctcggatttaatgcatgactctccattcttctacacatgattggctacatagacattgagaaatgtaaatattaatgaattgcttgattacgaggaatgactagtagcatatttaaatggatgataagtagaattatttatttttggtttgtgtgccaagatgaaatatgactatcaaaagtagatggaggtagtaataattaatacttaataaatcatgcattaatgacttgcctcgtacgttttacgtatgacgaaaagtccaaaaccaaaatgaaggttcgaacgcacccgggaaccgttgatgagccatggaaatcccaaaatactatgctgctgttatatatgagagagttagggagaagtgggaattggaattttcagtgccatcttatgaaagaatgttcatttagaagcatgagtatgctttatatagtcactgtgtatccatcaaagttgttaggttcaattcaattacctaaaacaaatctacaatttgtagggcctaacagtaattgccatgctaatcaaagaaagactgaataaatttgggattgggttataacgcttcagattaagaaaaaggctttacatcacaaacaccttgctaataaataggattatttatattggtgtgatcaaattataaggattcaacaatggaatggggttatgtttgacaacaagagagcaaattttgttagttggcaaaggctccttaaggaagacttttatttgcttctccttttgtctaaatgtaagagagataccttccttgttacttctatttcagtttaataaaattataatcgcagggacctcctccttgttctctcatactaagaaaaatataacgggtcaagataaggaagagtccatgtcatgtataactcagtagttattatttccaaatttcgaattaaatgaaattaatggaggtacttaaaaattgatactccaatatacacaagtacaagttggtactagttaatgctgaagtgcaaacttatcacttcatgaaaaaatatgtacataattgagactctaaaccaagtatacctttgtatttaagaattgagactctatgacatgtatagctatgtatttatttatttgttcatttcaaaaaagttaaattaagaaaatagaaataaaaataataaagtattaaagttgactctacatataacttcaatctattaactttgaatgttggtaaaaaaactaaattgattttgctttggagttaacttttgataaagtttgtatggcaagtacttcctccgtcctaaaatttagcgaactctagcgtttaaattttcatttaattctccttcgtctcaatgaatcataaccatttcttaattttctcacatatttttcatcacaatcatcctatttaattttacctgctttgtgcaaaatttcaaaagtttttatatttggaaatggagggagtatataagcatgattaatagcttgtttgaacgcacacgatggggtatgattcttccacgtagtactccctccggctcaaattataggacgccccctttttaatgaaaatcaaactcagtagtttttgactaataatcatactaactatatctgtgctacgtattatgcatgttatatcactagattcatattttgaagtactttcatgtgatgctaatttcatatttgttgggattatagaatggaataaaatactagtcaaagtatgttattaaagaccgtataaaaatatataggtcttataatttgggacagagggagtatgtacttttgtggtatttaagacttgtccttgtcagctttgaattttgctcattaatttcttgcatttatattcttggggactttcaatgcgaacggatctatgcacaactgtttgctcgagagaatcatattttttcggtactccctccgggttggttttatttgttgtttgaggtcagttagctgtggatgagaaaatctgtcgttggagcatttttctcacgtatgggatgagattgcccttgtgcattgatgttgttattgttcctagatcaactcctcgttactccttgaatacttcgttcctatctcaatggcagcatgcatgcatgtatgcaagtacacaatagatttcgaacaggataacatatgcgggttttg

SEQ ID NO: 78949 - DNA, 812 bp, Oryza sativa
  unsure (1)..(812): unsure at all n locations
acggtttccatccgaatgacacttcgatgggacagcccacacctacctccactcccggcggacacgggcgcaacgtgggatcgtggctgcccgttgctgacgcgaccagtgtcagactggtcattcttgtccaccatgtgtcattttaacaagatgcatgtttgcccttcttcgtgtaacaccttgcctgtaatggttaggataaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccataggggagagggcaagngaacccgaccccccctcgggggaaatcaggaggagggcggacacctcaccctcgggcccgacgtccccgaaggtgccaggccacgcgggcgattgtgtctacctcaagcctctggtcatgatactcccggtcccatatcaccgacaggaacattgagcaaagaacacagacttacggagcaaagcaactacactattgattcaaaccatggtgtttatgcagctgcataggattgccaggtcctaattggctgattctgccactaac

SEQ ID NO: 78950 - DNA, 637 bp, Oryza sativa
agaaaccgagtagtagggaggaagaagaaaccccagcaagagaaagaaagagagaagcagaggacgggtagtatttttcctctctttttcgatagatgtcacgtgcctacgggctggcgatttatacaccacacacccgactcaacaaccgttagccccacaagccagtgtcagaaatcagtacatagactcaatatgctatagccactcgaaaacgtcttttcgcagtacgtcttcagttcgacacacctccttcggtcgttgccagtagctcatccggcataggcataacagttgccccccctggaattggagcttgtccccaagggacagcgtccggaaatctggtgcgaacaacgtcagcatcctcccaggtggccaaagcagcaggaagagaaccccaacacgctaagttctggaccacggcagcattgcgggatgaaagtggtacggataatttccgaattcacttcggtcggatttttttcggatattttcggattcggatacgaattcggatagtttttctcggaaacggattcgaatacagtagcgatggtatccgtcggaactcggattcggtcggaaactatccggactttttttccggatatccgaatcaaaatcaacagccaaa

SEQ ID NO: 78951 - DNA, 780 bp, Oryza sativa
ctaaaatgaatcttagctgatacaagtaaattgaattaccaaacaagattaactaagatataagatagataggtgcttacattgacaagatcagagtatcgaagccctagccccgccatgcaaacatccttgacaagtataaaatcgtcaaaaaattataaaggtaaaatagggtggtaatgtgccgaatttgtattgattgtggagataaattacaatacccccaggtgtacatatttatacccatgggtagatacgagtccttattggacaagaaagaaactttactaaagataaaaggaaaacataaagtccttatcggacactaaacactctttcctaaagataaagaaaactaacaaactctttttaattaatagataaactgtcatgtcgcatcctccttgaactcggtctcttgtgtataaacttcctttaattgattaatttccttaaccgaatatagcaaaaatccgactattggcgacttgataattcccatcggccgattcgagtactctaaaaccgatattaactctaagccgatgatgacttcggggcttaccaaatttcactgttaacaaaaggttccagcggctactcaaaccccctctcctctcctagatccgacagtcgatggatctggggctaggcagtggatccaagggctcggggtggtagggttgccacatgcgatggagcgggaaacttggtcacgggaggcgggcggtggatcggggcgatggctcggggggcacgggcggtggagctcagccatgg

SEQ ID NO: 78952 - DNA, 29499 bp, Oryza sativa
  unsure (1)..(29499): unsure at all n locations
gcaggaatagtagaagtctagaagacgaagacacatgactatatcttatggttcttgttatgtattatgacatgatgaactagtactatatcttatggctcttttcaaacaaaggaaatttaaataaattttataaagttgagaaaaccctatatatatgtctaatcggaacgaaggaatagtcattccaaattcctatgaaattccttatggttggctcgaatcatagggatattagagaacttttaacttgaggtccaatcttttagaaaatattctttgcatctatctatcttccaataattatattatgttttttctatatatgctccatttaagcagtcatttctgttgttttcttgttttttttcttttatctctctgtgtgtgtgattaatggtttcatgtttatacatgtagactagtagtagtgctagccaagtttaataatagagatgtctaccgcctttaattttatccctcatatctcctcatcgattcgatcaggaggtgtatatatatatataaaacatgtgtactaccttcatcttaagagattttgcccatatatatatctacataagcaaaatcttttgtatttagagacaaaggtagtacaatatatctcatccataatacacaaactctaatgttatttatttgtttactatcacactagtatttgcactttttaaattatgtagaggctgctttttatactgagagattgttcgttctctctctcctcacttaccccacactcatcaccaaatgcaacataacactgttaaaagacaacacttgagtcttataagcacgatcttgagttttattatacttgctcttatgtacgtactccttctaattccataattatcatgtttgactagaactttaacaattttaaatatttagcttaaaaaaacactggaacatagattagttttaaaaagtactttaataaaattaaatatctacttatatttttatatattataattgaaaatatatttggacaaactctgatagcggtacgtaagctcagggatccatttgattggattggtcaatctttttctagctaccaggccaattggtatgcacactctatatccatgcatgctgatagatcatgtcatgcactggcaaatagtgtaagtgatgtacatgaaaagaatagatcgactagctagttttctgtcgtcgcttgtggagaaaaaaaaaacaaacaattaacagtcgcaaacctatcactttggagaatcccatatatgtgtgctactatcagaggtcgtttcgtttgacagctctagcttaattagttaccccgaatacaaagattgaacaattaacaagtttagattggttgtatttttgcttgattttgccatgtgttaattaacactgtaaacattctggtatatatatgtggggtatcagttaacaacactcttgacattagatatatatatgcacttctttccatgtgattagttcataacacaaaacgatcaacacagtacgtaccctcatgttacgacatataattaggactaaatttgtttgcatatatgtatacacaatggttagaaccatcagtaacccaagttcagttgacaaattaattagactgtataccgatatataccatatccattaaaaataatttgaattaaatagttgttagttttcattgagttgcctagctatgtttgaccaacaatatttttaagaaatctagttagtatttagcatcaaagttataccattagatttgtaataaaaaaataatttatgaatgagttggacttaaacctttttattttgaagttgcttaaaaataatggtcagtttaagcacgctcggttaaaactaacaactattcgtgacaaaagcaacagaattgaatatatatatatatatatatatatatatatatatatatatatatatatatatatatatatatatattactcatgcatgaagaatatgtaattgtcatgacaaatctgctgctgatctctgaaagctgtaataattaatttcagtatatatatgcatgtacaaactacatgccttcttattcctgctttaatgaagaaaataatatcgatgagattaactaaaaccagatggtttttacgagttaaaatttcaacaaaaaactttgaacgatatatagtctgtttcctgataagcgtccagggtgttgtctacaagatctaattaattaaaatagtgatgtcaaaagcaataatgtaacaaacgtggaaagaacggcagtgtcaagaaattagcagagaagatacttggaagtccactgagcttgtagaaaaagatggagaaagatgcagttttatgagaagatccaaccagaagcaataatgtagatatggttatctatatgtataacaactacacatcaaatcatgcgagaacagggtaagttttccacgagtgctttcacacatgcatgcaaaacctgtcctactttagtttttttttcccaagaaaatctgctatttatctctggtcatccagtccaaaagagagaaaacacccctctctgccgagtctcttccatacggtcttaaattaactgaataagattgctgacttcaagagtgaaaaaaaaaactatatatgcttatatatatatagccgtgtgcctatcggtgtaaattaaccattttcattataaaaaatgggtcgagtgaaagatagaagagaacacgacataagtgctaaacaatatttcaaattaagcgcactatggagctataattaataacatcatatacagagagctctatttaagaagctgggacatttttttcctgggaattaaagaacattccctagaagaacatattacattactcatctagaagaaaatgaatcaaagcgccgaacaatcaaaagcattttgtagaatcagagaaagcaaaagacaaagacaaaactgttgtaggattgaaagaattttacacagtacacacactagcgaattctatataaaccaaagacaaaactgttttaagattgaaagagccgatgatgagaaaaaatatacacatctatcactgttgtgtatatggagtatatccaagaaaaaagagctgaccgaaaatccgaaattggaaagccatgacctcaatctcaactcctcaactgaacaactcaattagaagcacgataaactagaattttatgtttattatgataaattttatactaattaaacacgccaaaatgaagaacgtaacttaccggcaaatcaattagggaaatttcagaagaaaaaagaaaccctgatcgatcgacaaagagccctaacaatagtacgatattccaagaaccgacagagagatcatcacccagatcgagatttaattgcaagcaaattaaacagaaataactgcgagcgagcgaaggagacgccggcgaggaagagagaagcatatatgtgttggtgtgtgtataactgtatatacatgcatacctggtgctggcgaattggaagagcttgccggtggcggagaagacgacgagcccgacctcggcgtcgcagaggatggagagctcctcggccttcttgaacagccccctcctccgcttcgagaaggtcacctgcctcgccgccaggttgtcgatcctccgtattgctatcctctccctcttccccgtcgccgccctcccctccccctccccccttcccccgccaccgccgccgccagccatatcagatcacacaccaattcaccaccgccgccgcaaaatcggggaggatcgatcagacgaaacaaccaaaaccctagccgctaaccgcaccagccaaaccagccgcgagatacgcggcgccgcagatctatggctgcggcggcggccactcccgctactactactacttatggaagaaaaaggcagggaggaagggagcaatggagaccaccaccaatggaagcgaagcgaaggaggcgagagagaaagagaggaaacaggagcagggaggtagggctagcctatagcactgcagcaggggtaggggtaggggtaggagtaggacgactcctactttttatggcaaaggctttcaagtggtggagccacagggacggaggcaggtgtccgccacgaggtggttaggactcaggccccgtctagatctcaacttaaaaattttcaccatatcatatcgaacgtttgaacatctctataaagttttaaatataggtttagaaaaaaatttaattgtacatattacgactaatttgtgaaacgaaaattttaagcctaattgctctatgatttgataatgtgatactacagtaaacatttgctaatgatggattaattaggtttaataaattcatctcgcggtttattgacggattatgtaattagtttctttattagagcccgaacaacccatacaacaccataatacaatatccgatgtgacacgctaaaactttacaactgtatatctaaacatcccctggggacgcagggactagtgtaccctccctccacgccattgcccctgcaacttttgacattttgaaaagtcacatagttctgggttcaagagccttcggaactatttcgaagagcttaaaattttaagaattaaggggtgtttaggtgaggctaaaactttttagtccatgtcatatcggatgtttgacgctaatttagagtattaaatatagactaataaaaaaaactaatttcataaataagagctaatatgcgagacgaattttttaagcctaattaatccataattatgaaaagtttactgtagcatcacattgtcaaatcatggcgtaattagactcaaaagattcgtctcgcgaattagtccaaggttatggaatgggttttataattacagtatgtttaatactctaaattagtatccaaacattcgatgtgacagagacttggaataagtctctgtttcccaaacaccctcctcacttcgttaaaaaaaatcaatcacatcaaataggtttaactaagttagtggtttttttttttacagatggagtaattatactctttctattaaaagaaaatctatatgttcagattcatccgtagagttgaattcttttttgacatatggagtactccctgattcgtccaaaaaaaaagacaatttaggaggagatgtggatctaggagggttgttcagattcgttgtactactagaaggagatgtggctctaggttgctttttttttttgacggagggagcatttgatagtcatcttctgataatctaaaaaactaggtttcacaccttatacttctagtttgttttttagactctgacttcaacttcttagaatctggacgaaaagcttaattgtttgggaaacttgttactccatccacctcaaaatataagcatttttggaccctgacacggttttcgagatgctactttgccaacaatatctataaaagtaagatgatttaaataaaaagagttacatactatgatagtctgtttgatgataaatccagtaacatcattttttttcatgattgatcttttttctattaatggttaaagtttaaaatgtttgggttatcactgtactaaaaatacttatattttagaaaaggggagtattttagaagaaactgcagttgtcccactccataggatgtgtttagtttctaaaaaaagttggaagtttgggaaaagttgaaaatttatgtgtgtagaaaagttttgaatgtgatgtgatgtgatggaaacttgaaagtttggggtagttggggatgaactaaacacagcctatggcatgtttgtagattctgaaaaacaaaagatgagatgagctgaaaataaatagcttctggcttctggattttagttgtacttttgtatattcctcgactacaacattttagttgacagttgttaaagggcctagagatatattacagaattctccaaattctaaaaagtaacgagtgagaacctagaagaaatcgtagctgtcagaggctcctcaaattaaacagatcctttgacagctacagtcactactacgtaactcattttgccatacggggatatccatttttccgtgcggtcatttgacccgcctgcacaccgctgtctgtgaaaatcagtattttcgcgtgcggacggaaggaccgcttgggataatcgattatcccgtgcggtcatactataccacccacacggaataaaaaaaaccaaaaaaaaagaaaaatcgtcgcccgcccgccggcctgcaagcgaaccggccgccgcaactcgtcgtcgacatcgtcgcgcccgccgccgaccctcaccgccgtgagggacggccgccgccgccggatccgggcgtgtgggggccggttgccgtcggccctcgccgccgccgcctcgccgcacccgcccggtcgtcgcctcgcgaaagtagggagaggagagccctccctcctcgtcgtcgtcatcgtcgtcattgtggtcgccggcgccgctcccgcctcgtcgtcgtcgccctcgagcggggaagggcaggagaggaacgctgccgtcggatccgggcagggacagccgcgggccgcccgtcgttgcccgccctcccgcccaccggatccaccgcccgcgcgctcccgtcgccactggggaggggaggagccgcggccgccggtcatcgccctcccgtccgcgggatccaccgcccgcgcgctcccgtcgccgccggggaggggaggagccgcggctcctcgcccgtcatcgcccgcccgcgcgccggagttgctgctggggaggggaggggaggagctgcgggccgcccatcccgtctacgccagccgccgcctccccacgtccgcccgccgccgccgagctcaccgccgtcccgcctgtgggttgtggagaaggaggcaactgaagaagaaggtgagagaaagagggaggaaaatgagtggaggagaaggaaggtgagaagataagggagagagaggagagaaggggccgcggggagagagaggaaaattttgaataggatgggagggacgactatttttctgtgcgggtggattaggaggcccgcacgcgaaaatagggttattttcacgtgtgggcctgttaagtcacctgcacacaaaaattgattttcgtgtgcgggcgacgctcccaccatttttccgtgcagtctgacttacggaccgcatggaaataaaatggggtggtgtccaggataatcaatcctgtagtagtgagtttcttctgaaatgttcggtcctaaaaaatataagctaccgaaaactccgtaatctacaaaatgagctactgaagaataaaagtaactcccttcgtcctataataaaatttaggagtaagtttcattcatttatcttaaaataagtttatttttaataatcattacatcaaaattcatgaaaattaaaaaatatatcggaagcagataaagtactggaaaatgactgtattaggatttaataaatatggtattctgttttaagctttatactccctccgtcccaaaatataacaatttttagccatcaggatttgtctcaaaatataacaacttctgcaccaacattctctttccaaccaatcacaaccctcaaccacttacttctacctactttcttaataaccgtgtccagccctaaaatttcttaggacctgtttggttggtgaaataaaaatttttaggtgtcacattggatgtttgaccggatgttggaagtggttttcggacacgaataaaaatactaatttcgtaactcgtctggagaccgcgagacgaatcttttgagcctaattaagccgtcattagtacacgtgggttactgtagcacttttatgcctaatcatggactaattagtcttaaaagattcgtctcgagatttacatgcaaactgtgcaattagtttttctttttatctatatttaatgctacatacatgtgtctaaagatttgatgtgatgtttttaggaactcaatagccccttatattctaggacggagggagtattgatatatgtagaaaattaaatttattttaggatggagggattaaaagaatcaactcttaggctgtgtttagttcacactgaagtttggaagtttggttgaaattggtacgatgtgatagaacagtagttgtgtgtgtatgaaaggtttgatgtgatggaaagttagaagtttggaaaaagaaaactttggaactattaggcccgtttagtttcccaaattttttttctaaaaacatcacatcgaatctttggacacatgcataaagtattaaatatagataaatgaaaaaactaattgcacagttagggaggaattcgtgagatgaatcttttgagtttaattagtccataattagccataagtgctacagtaacccacaagtggtaatgacagattaattaggcttaaaagattcgtctcgcggtttccaggcgagttataaaattagtttttttattcgtgtccgaaaactccttctgacatccggtcaaatgccctaaacatagccatgagagaggagagaggacttctgacatccggtcaaatgccctaaacatagccatgagagaggagagaggacttctgacatccggtcaaatgccctaaacatagccatgagagaggagagaggaggggaagggggggtggaagaggggtacgttggcatcagtcggtccatcgtccgtccatttctttctatgacggcaaagcctcctgctatcgttcagaaattgatgagcttttgtagagtagctaggggtaggagtatcctattttgagctctcgccgaagaaactgttttgggtggtttttctcgggaggatggaggaaggaatcgaggaacagggaggtcaggagggacaacgtactgaccgatggattgatgcgtggacgatgcagtagctaggcggtgtgatgaggtgttgccgtgttggagcctggaagacgggttggtggagtgttgcaaacaaatttaggagtaggtggttcgttcaggtcaccgtttatcaataaatattatcgtcacgtttatttaagttgaaatgattaaattcttaatcacatgttagcaaggctaacatgatcttgatacacgttttatgttactaataacgcgtgagatccaatttattgaaagatactctcgctactaactgcgaccacaaccaaacaactgctaataaaattaaactcacctaattttaggggtggtaaattgtgacctggtaaccaagcacccacctgttatatagcaggccaaatgggtggcttaacctaacacgccacatcacctatatcggaccgtgccatgtcggcccacatgtcaagaccacagtctaaggtggtgccgtatcgtgctagggcgacgcggttactgttacagtcaatggaccggtgaaaaataaaagaaaaatgtggagatgcaaccacactatataaggaaggaaggatatatatgattcaattttgctatatatttgtcgacaaattttcttccaaaaatttaacagatgtaattacagtacaatcgcagtgtaattatactgtaacttgtatgtaattacactgtaactataatataacttgtatgtaactttcaaaaatctctccgtaacatgttatttcggtaaaatcgaggtcgtgggaacaaatcctttcatatacgtgtgtactgtgatctttttgttcgtcactagaacaaatcttgtaatagatctaatgattcaaaattacgtgaaagttatatacaagttatactgtagttacatgcaagttacagtgtaattacattgcgattgtactataattatatctatcaaatttttaaaagaaaatttgtcgataaatatataggtggttcctgtatgattaacatggatcaacactaaaattagtatagttataagattgcatagcttacggtgggttgcgacttacgaatgatactcagcatataccagagagaatcacactagagagctgataaaattaatctcgcgctttcgttaacgatcgccccttcgatctgagattgtctccggaggaattgatgctcctatcgtgtccttacaagatgaaggtaaatcgatcgaatattgatcggtcgtacgtgtgccgccgtggttttatggtgtttaatcgacggcgccgtacttagcttactagctagctctaattacgtacctacgctgtctccctcaccgggcactacgactcacttcccacttccccctcagccttgatctcgatatttgattgtgccgtcaactccaacatcaccttgatcgaacgatttcccacaactcaacttcttcgagatcaccatgattgaacgatctccgagctgcttcacaactccactcgatctagactatgctcgtgagatcagattgagctaaatccctgataaacatgtcataaacacacatctagtgatgattggacgacactttcttaataatgaaaacattcgctgaaattctctaccgatcaagcatcatttttcgtataaataatatatatgttcttgatttttttagtcaaatagaaattttgttttttctattcacttttaaacaccatatttctatcgtaatactccctccgtttcgaaatgtttgacaccgttgactttttagcacatgtttaaccgttcgtcttattcaaaaacttctgtgagatatgtaaaattatatgcctacataaaaatatatttaacaatgaatcaaatgataggaaaagaattaataattacttaaattttttgaataagacgaacggtcaaacatatgataaaaagtcaatggcgtcaaatattttgtaacagaggaagtaataaattgctaatatgatcaattgttcgactgaccgaaaatcgtttcgaacaaatgctaccgttctcgacgttttggaccacttctccctacacattctcctatccggggcccagtgatgcaaacacaaacaaaacccaagtcgcagaggttacacggcccaacagaaagcccacctatcctctccccacggcccagtccgcgtccgactccgcgtcgcctctcgcctcctctctctcttcttcttctcccccaaatcccaattgcttattctccttcgacaagccggccaccgtccatcgctgcttcgcttgctcccacccgaagcaacgcgaacgcgacgcgctcccctccccgccacctcggggcggtgagaccaggcctccgcgaccctcgccggccgtccctgagcgccgcccgcaccggcaactcggtttcgaggctgatctcggcaggtttgtgtctgccctcgatccaaaaccggtgctgtggtttgtttcacgatcccgttaaagttgtcgaatccgttcggcgattgtgattcaggtagaggaattagttttgcaagacaggttttacaaggaattttttgggggggagtgggggacacgtttttatgctgttgttctgatgacttcttgaaagtcacacccaagttagttagttatcagcagctcatggtaatcttcagtgatggattaaccgctctacggtatctaggcaatttgagagtagaagcaagccgtagcctacagaacattttgccatccaaatgcttggcattttgatttgattacgcaggcagtaattttggagtagaaaacgcgtcctaccgaacatgagacttatcacaagtatatcgttttttgacaatagtcaataggaactctgcgttgaggggtttgatttcaatttgttctagatttgatccattcttcttccttttatttttctgatgcaaccaacaattagtctggcattggcgttagcgattaccatctactagttattttccgttagaatctatatgcatgtacagcttattgattaccaccaactgttggaacatatgtaacctgctatttctttttatgcagattgctctagtacaatgagctggagatttcctctttttgggtatgttatttttactgaaagcaatacttttttcgtttgttcttcttatgtctgttcctaacctttcctcgcatagcatttgtattctataaactgagcttcctcttttatttggtagaaagtattgtatttgttgatcagtgccagccagcaggcttgatgtgattcgtaatccttagtttctttctatactaaaaagccttcagatattgatgctcaaaaaattgctttgcttttgttccaaaagtttattttatcatccgaacagtgtccaccactcagctactctgttatttcttatggttgggtcttcagttacgctgaatttaatttttagcataagtaaattaacgtggctatttaatatgattcacttattgccttaagctttcctgaaaaacgagctcctctggcttactgtctttgtttctgctgaatgcttgccagcagcaactcgcagcagcagcaacctgatccaaatttccaggacaaccctacgcaaccttggtaccctcagtctgtagttggttcatcttcacatccatccacaccaagctcttccaatgttggtccacatcaaagagcttctgataattcccagtcttcatcgcgtgctcaaccatctccagctgaggctgcagggataattgctcggttaaaggacaaaaggtcagcagctaacctttttttgataagttgcttgtagcttcctgtatacgaagtttcattgtattatgccttatcttatctatactgtgggttaaaattgcaacagccttgttactttttaccatggtattttacatattctagtgtttatattagtactaaaagagagtcactagaatctaactaataatattagagtaatgaatttttaattgcaataatgatatcatggctgatattctatattctatcaattggtaatgaatgaagaatccctagcttttcagagggcacgacaatttgtgcaattcagaagggatgtatataaatgctaaaagaagtgattatgtatggttgggttgctttttataatcgccacctttactacatgtgtttttcacactattccttgtgagcatgcttgtttggaatgcaaaactgctgtatataatactgtccttttttctgcagtgttgatgagttgcagaggctgttgaaagacaaagaggcatataatgctttcttcaattcactcgatcaagttaaaacccagaacaacgtaagttttgttgctgagtacacaggtgtttgaaatttgtattggtggctgtacttagatgtttctgtatttcctccagtagttaaagatacacaggaaactccaaactatatgctccaattatttttctttttctttttctggcctcatatttgaggctttgggctgtggcacatctcctgtgatttgggcattaatgtgggtgattattctttaatttatattcggtgctgcttttaaccttagatagttgacttgtctgaatgctagacctcttgtcaatttgctcacttcttgttctttcttaatgttcagttacgcgatgagcttagaaaggagacagtgcaacttgcaagtgagttattcgtgtttctgttatcggcatgcaatgcttttttattggattgtcttaactatgaaaaagatataaacaacttgttagttactactgtttctaaatcaaatatggttggatcttctgaacttacaggagaaaatttggaaaaagagcaacggatcttggagctcaggaatcaggtttagtactgtgacctccatctcagaaactataagctactgtagccatgatgttcattgttaaacgaactttaaatacagttaatgctataataatggattttgtctgcgtttcaattttttttcctgagattcaaatcgcatttattattgtgcagtgcaccattataagaactacagaactagctgctgctcaagataggttggctgagttggaaaggcaaaaggatgagattatgaggtcatattctcctgctgcactgctcgacaagctccaaagtaagggttctgaacagctgcatctgcatcatttttgctgtgtattttaataagagtctgtgctttattatttgtagttgaatacattatgtgaattagtgcaccgaatcatgggcatgttttgtatgtatctattgtttgctatgaatgcactacccttctgtaaccggccaatgatcaggctaggactggtactagcgtcatagtggcgtctatgttagttccatttcgtgaaaccttgatttatgcttctgtcattgtttgaagtccaaccatgtaatttaatttttcaaacacccaaccgcaaccgctgacattttcatgaattgcttcggtgcttgctcagaatcgatggcaaagttggacgaggagtcggaggagctgcaccagaagttcctggagaaggacattgacctcccaacctttgttcagaagtacaaaaagctccgcgccgcctaccacaagcaggcgttgctccatctcgccggcaagacctcacttcgctgaaatccatcggccgtctgtaggacgaacaccctgttgtatgagtttcccatttctccatcattctattctgtcgtggtgtctgtccacttggctgtttatcagtgccgcttaatattgtagggcttgtgaaaacgtcagggtttgattgcatttgtagatatacgattgtattcgcatcatggaattttatgtatgatcatttggctggtgccaacgccagtgaagcattttgacctgtcagagacacggaaacaaatataaatcttgtgttcaaatctgagcacgaaccaggattgtgccttgtgcaaatcttgtacgtacaaaactgctccatgctccatatagtcatatcaggcattcctttttgcttatttcaaaaaaaaaaaaagctaggattgattgaatttgagagttcctgaatgaaaaaaaaaagaagaaaacgattggcttttccaacccatttgccgcaagctcaaagcatcataacctatgggttcagaacccatttgcactgcagatgaagtggcaggaaattcagatgagctgtactacatctggataaaactgcatcctcccatgagcttttgcacgggattggatctgatccctgcgaccgcatggacgcatgcaagcgaggctcgcacgtagaacaaaactgcattattagccgtggattagaacgatccaaggcgagctttgtctgcaactctgcgtgcatcgctaattcgccgcaacccgcaaggaacaaggtgcccgtgaacctgctccctttggaagcatagggaaccaactgtactccctctgtttcgtattacaagtcatttaaatttgttctaaatcaaacgtctttcaaattaactaaaattttaaaaattgtataagcattttcagcaagaaacaaacttacttaaaaaatgttattcaattataggtttataattgatgagataatttggtactatagatattctacttttttttctacaaatatagttgatatttaacataggacaaacctgaaataacttgtaatataaaatggagtagcaaactgacgtacagttggcctcccgaagattagcagatatgtgttagattaatatatggagtatagatttgttctgtttgtgttaggaggaaacaggggagggttttgggcttactctcaccgacaattcgatcacgagatagatgcattaatagatgtaggaagatctgtctatgttccttatccttgcttctcctgctaattaatttgctgataagtggctaaaccttgtacatagccatggccgggaacgatgcttgccacggatggacgacgatcttcgtgctgaatttcagtagcgtcctgcaccgttgactgctggtttgttcgtttggctggctggcttgttgatgttgcctgcttgcaaggcacttttgaaggtacaatttgcgtttgtcagctgtgctctcttctgccaggacgataggagagttttcggacaactgcttgttctagaattttaatttctcctaagcagttctcacataaatgctagttaccactgattcgccaaaaaaaattatgggtagttttatatatatatatatatatatatatatatatatatatatatatatatatatagggcaccatggtatctaatgtacaaaatcactcaaatttttcaaaattttcaaattgtgagtatatacctagttataataattcgattcatatctatacctatcaacaaaacaactcaaatttaactttatttcacaatccatgattacatacctaactaattatatgtatggatgctatatacctagaatcaaaatctaacaaaaacaagttcaaattcagtacaaacatgctttgaactagttagtaaagtagttaatgttaatacctaagtaattgaaaaagtttcatactcatttgaattgggtatatactcaatttcaacaatggtgcccgggcaccatggagcaccaaacaaatttaatatatatatatatatatatatatatatatatatatatatattcttaataaatttaaagtcaactttgaaaaataaactacaactacaatgaaaaagaaaatcaaaatgaactctaagattaatttttaggtggcagcggctaataagttataggacaaacgatggaagcctctaagatacttgagttgtaaaatctaaaaaaaaaagtaaagaaaaaaaagctaagtgtatttttagattctcatcaattagcaagtcaatacttcctttgttacaatataaatatacctagtgcgagatgtgttatatcttacgactataaatctgatcaagcaactatttagatttagatttatagttctacaaatacaaatctggacaaataactatatgcagattcgtaatcgtaggatatctcaagttctatcgcagatgcatttatattgagaagaaggttacttagccatctgcgcgctgagtacagcaatgcacgggccatccgctcgcggctgcgtagtacactttttacgtgcgcacgcaatgcatgccgagctggatggaagggatgggacgtgatgccgctggctgctcgtgaagaaggaacagacgagcagtagaatccaacccccaaagaaaggaggccgcggaatcacgcgtggaggaacggggatttgtacacatttggatctgtaggcgtcacagcacaatagattcaccgagaaaatatccatagtccacatcaatatttccctagctagttaatagtgaggaagcaaatacatgtactgaaagaaaataaaaggagattaattgtgaggaagcaaatacatgtactgaaagagagaaaaaaaaaagagatttggagggatgtgaaattgtgagagggctagggattgaacataaaacctcagagttgaaaccacacgccgactactattacactatcaagtgcatctcaattacatatactacaggatgagagtcagagagtcggacatggcagacatgcatatgttactttgtaggaggaataggcatgtaggttacgttttatatcttgagaagcagcggacgagaatatgaagaaattggaaaaccaacttctaatttcttataaattttctgaattatacaaagttatccttttaattatgtaactaatacagctataaaaaatatggataaaaaagctaaaagctcctcctaaaaaaagccttaaatatctttctaagatacccctctataggaagtgtggttatcaacacgtacaagcatgcgttactcaccaatggatcgtggtccttgaacaaatcattcggatcacatgtttctgcagactgcagaaaataccaggatgcgagcatctacgttgatgttatttgtacacatccaagttaataattaaacaagttaacctgatcgccggtcacagccaatgacccagagaataatgcaaattaacagtaattattaacagacactcaacggttgttgattggttgataactaagctaagacacacctggtgattcgtcgacagggtgtgatgatccttgtccttgttgacccgtgaagaagctgtctcaggacgtgtcaggaatcaaggatttcgtcaggttttacctgcagtggccggacaaaaactttgacaggatgtggtacaatattcttgcccatctttgtgacttttggtcgcactcctaggcgtgtttaacttccttaatctgtcttcctcgctgtctcagcttaactaagtaattaaaagggtcaatttggttctgtgcatctcactccactacaattttgcatgtgataagccagtattttgcttctccataattaatcattgttcttgtgacaatttttgtctagtgagagattcttatcccaaataatctttctactccaagggagaagcagaacattgttcaaaaatcaagaccttatcataatttatttactaccaccatgagatgatgattgaggtaaatagtaaagcatcgaactgtacggcggtggagttgtgagggcataataccaacgaccaaagttcacattctttgagcatgtgttaggttagtcaaaagatgccaagatggtgtccgtatgtgcttggtcaaacggttaattaaactataaccttcgaaaaacaattaaacttaagaaacaactatatgtctataagagtataagcaagttaatcctaaagacttatttctttttcaaattaacgtgttctgtaaaaatcatcggcgatactattaactcaaattaatatataaatggtcctaaaagcttaaggcccctttaaatcgcatgattgagaaaatgtaataatagaaaaaacacaaaaatttgatatgaatgtaagagtaaaatagatgattgcaaaacataagaaaaacacagtaatgaccgtttgattggaccgcagaaaaaacgcaggaattagaggagagataaaaactcaaaggacgatttccatgaggtagaacctcgtgttagatttcctccaaaatttacgtggcattagacattctataggaattttataggattccaaaagatttcactcatttgattcaaatggctatataggaaaaatttctacagggatgaaatcctctaaaatttttatgaattttttttgaatcaaaggagaccttaataatgatgaacttattagcttatggtatctctctttttcgtgagcacgttttttcaagccaataaataatctgtttttacagaaactatttacgaaagttcattgtcaaaaaataaatatatttcaaaatttttaaaatacccattcgtctctaaaaacaaaaacaagtccaattctaactacgaacctagatactacttatgttagagattttatttttcttttggacagagtactagagtagtacttaatgatttgaatgtgcgctattagcccgtcatgttgtccgtgccgccgtaattaagctcaaaccattcaatcgatcggcgccaaagactacaggatcaacagccagaaaccctatataaacccagctcgctcagtcacaatcctcactcccctcagtgacactctcttagcaagcaagctagcttagccaggagagctccattgccatggcggccaccaccaccatccctctcctcctcctcctcctggccgccaccgtcgccgccgccgccgccgagctctccgtgtaccacaacgtgcacccctcgtcgccgtccccgctcgagtccatcatcgcgctcgcccgcgacgacgacgcccgccttctcttcctctcctccaaggcagccaccgccggcgtctcctccgcccccgtcgccttcggccaggcccccccgtcctacgtcgtccgggccggcctcggctcgccgtcgcagcagctgctgctggcgctcgacaccagcgccgacgcgacgtgggcgcactgctcgccgtgcggcacgtgcccgagcagcagcctcttcgccccggccaactcctcctcctacgcctccctcccgtgctcctcgtcgtggtgcccgctgttccagggccaggcgtgcccggcgccgcagggcggcggcgacgcggcgccgccgccggcgacgctgccgacgtgcgccttctccaagccgttcgccgacgcgtcgttccaggcggcgctcgccagcgacacgctgaggctgggcaaggacgccatcccgaactacacgttcgggtgcgtgagctcggtgacggggccgacgacgaacatgccaaggcaagggctgctcggcctcgggcgtggccccatggcgctgctctcccaggccgggagcttgtacaatggcgtcttctcctactgcctcccgagctacaggtcatactacttctccggctcgctccggctgggcgccggcggcgggcagccgaggagcgtccggtacacgccgatgctgaggaacccgcacaggtcgtctctctactacgtgaacgtgacggggctcagcgtggggcacgcgtgggtgaaggtccccgcgggatcgttcgcgttcgacgccgccaccggcgccggcacggtggtggactccggcacggtgatcacgcggtggacggcgccggtgtacgcggcgctgcgggaggagttccggcggcaggtagcggcgccgagcgggtacacgtcgctgggcgcgttcgacacgtgcttcaacaccgacgaggtggccgccggcggagcccccgcggtgacggtgcacatggacggcggcgtggacctggcgctgccgatggagaacacgctcatccacagcagcgccacgccgctggcctgcctcgccatggccgaggcgccgcagaacgtcaactccgtcgtcaacgtcatcgccaacctgcagcagcagaacatccgggtcgtcttcgacgtcgccaactcccgcgtcggcttcgccaaggagtcctgcaactaattaagaattaagattaattaagatgatctaccgctatctcatctagagccaagctgctgctagcaaatgcacgagaacggcttgtgcagtctatgtattctcttcttttccctttctgaaatcacggtgtcctcttgtgggcttgtagctttccgatctgtgcaataaggtatacgtgacatcaaaacttggtcacgggcgcctgtctcatctgtatgtgccaatagggctatatctaggtgattacgtacgtactcagggttttaccagtgtgaattggtatgtttacatcgatcttaaagatcttcatcatttgcatcgctagaaaaacttcatatgagaataccaaatcaagggcagcaattcacaagtatgagtactgaatcgattttttatgtgagcagaattatagacccaagttactcatcagaactcacaagatggcaaccacacatatattccttgcagcaaatgtcactgtgatacataggccaaacagagaacatccgatcagttacttcatgttgttggatatttttgagctgcgggtctgcagcgcgcgtatacaacagggtgaatgccagatcagtttgccttggtgctgttcttgatccactccaggtacttggtgttaccaccagttatgggaagagcgataacttcaggaacactgcatgaacaagttaccagtaaatctgacaggaacatttttctcccgggccggccgaaagaataggccaaccaaattacattaagatttcagggagaaaagttacaagtaaactatagtaaacagacagattgtacagcaagatcaataaactgaatgaagcttactcgtattcatggttagctttgacatgttcagtcaaggcatctagaagagattctctagtcttgattatgagtaactcttcagcatcagtttgcacctgcaagaaggcagattattgatcactaaatcctaggtctgctaaggagcaggaaatacatcatccgaaggaatgataaaccactgaattacaaagatgagaactattaataatctattcagtctataggtaaatttccacaacgcacctttccctcccaccaataaacagattcaatgcctgaaaaatgtacagaacttcagtataattcagtataaacgataatatgaaacaagctaattgcgaatcttggcacagcacctgttgcctaacagcataaggaagggcagcgcaacaatcattggacaaccaaagcaccattatatttcgtgattcaacagagttcttgtttcagtccaaagtaaggtaagcaaagctttaaaagggtttgttcccacatatgatggattttcttgatctaattcgtttacactgccacctctactaaaccttttcagtgtttccattaaattttttgaaggtaataaagatgttttctatggaatacagagggccaataacactgacatatgatctgggttcataggcatatagtgtcagagaaacggaagtgatgagcaaagtgacaaaccaggcactatattgacacaagcagctagtttctcactgatgatgctctgtgacagcttcttccctgcagtagatgtgaaacatgatgcttttaaagactgcttaaacaaaaggcagaaatagatgctaaaattaattaacaaaaaaataaacgctaaacaacaatattgaaaggagaaacatgatgctcacaagacaaatagtgcaagatcaatctcaactctaactgctttatcttggaggaaatgaaatatattgcctagcaagttccacaaatgaaatgcgcacacaatataacaagaacaaaaacacagtaaagtactacctgcttccctgtttggaacagtcacatacacaacaatggatggcacggtggtggaagcggactccatccgagcagagctgagacctcttaccctgagaaattttgcattcagatatcactacaagaagatagaattcaaactagataaaagcgtagcaatgttaacctccaaagttcacacatccatcaatgtcataacatggataaactacactcttgtaccatacttcagcgattcaattttttagcagccgcatgttcggacgtgcctagcaatttcgcgggttccacacaaaatctaagagcaaagaggaaagagaaggttacccgaggaaggggaagcggcggcgggagaaggcgcaccccgtcctgcaggcgacggcggcggcgctggcggcgccgatgcttaggaacagaacgccccggtgagcgacgagcggcccccctctccggcggtggcgcggcgcggtgcggcggaggccgcggcggcggcgggagcgagaggtcggaacggcgcggggaggagtggcatttttcccgacgagcggtttatgtacacgtcagcattttgcttccttccttcctccctcgcgaagacgcgaacccgatgctttgctcttgggccgggccttcctctggtgggcccacatgggctaggctcgcatcgagttcgcttttgttctctcgcgtgatacttaaccctctcgcttcgcttggaacacctccaaaaccctacttccgcctccgcctccgtctccgcggattcttcgagctcccggccatggctgaacccgaggtggtggttgccgcaggtggggaggcgatggaagccgaggcggcggagccggctgcggcgaatccgagtcagaagagggagagggaggagggggatgactccgccgccggcgctgctggcgaggaggcggcggagggagctgcggccaagaagcagaaggtggagggggagggggaggcgaagggagcggaggatgaggcgaagggggaggaagaggagggcgcgaaggaagaggaggcgaagccggtgaagctgggacccaaggagttcgccacgggcgtcgagatgttcgactacttcttcgccctgctccactcgtgggcgccgcagctcgagatcaacaaggtgagggttgcgattcggttgtcaatcgtggccggcctctcgctgtttttggccgcgaaaaaaagtttcttgctttattgatgactcgcgaagtcacgatgtgtgttgttgtagctaaactttggtatgataaaagttttatccttgtagctgtagtgataagctggtaggttatttaattagctttagtggtgtataatggtgcccgtattaggtagtactttgcctttgaaaccggtgatccaatcggctaaataattcgacatgataatctgagtgttcgccttgtatttagccaagtttgcatgaaactccatagagcccccagattcgttgagttgatctgtcactgtcaaggatgtttttaagcttggagaggctgctttatgcatttcgtatgtatggtaggtacttctaaaccaatgatctttgttgggttgagttcgttagcaccagtgattggcacttaaacattatccttctttcacctagcatttctttaggttctcatgggcaagtttcatttacagaatagcatatggcgttgaatactccgtagagcccccagtttcattgggttgatctgtcatggtcaaggatgttattaagcttggagaggttgctttaggcatttcgtatgtatattaggtacttctagaccaatgattttacttctaaaccaatgatctttgtgaatggacatgttgggttgagttcagtagtaccagtgatttagtgcttaaacagtataattctttcacttagcttttcttttaggttctcatggtaagtttcatttacggaatagcatatgacgtttaatactctttcagctgcactgccttcatatgttgggactccatatgagttcttccatgtagtgtttgacgaactgggactgggttctttacttaaggatggttgtaccacaaggagaacagactctatttggggcttcaggcatgtttgtttaacttgaagtgttatgttatgacttgcaatttaaatctggttagcttgcgacctccaaatggtcctttggtgtttcgcaacattttctgttaaaattgagttagaccataagtagcaatttttttctctatcaaagaaaattgttggtttattcctacctgtttttagcaagtatgcaacagtagaggtaaaagagatcactttgttttctgtcatacatgaacaaggtctctaggtggtttgctaatcactcttataagaaaattgtattggattaaggctgcaattatgatatgttgcacataaattgaactgtctgacacatatatgagttacaaagaaatacactatgattcttcatctacatgtgatcaaaataatcgcatacttgagccttgcatcttttacttcatcgttgtttggaattggaagataaaactatttgtcagtgggatgtttatgttaccacaataagctcatctctagttgcccttgagaaaaataagctcattgctggaagtgactatagtttcacagtaatcaattgtggtgacttccagatgcctatgtgcttgtgtactgtactttgtctggttcaaactatccagatgtcactttactttttgcattgtcattgctactgtcacacttgagtttgctgaatcgcttaacttttgcagtatgagcatatggtgttggaagacctgctgaagaaaggccatgctgagtccgataggaaaattggagcaggaattgaagcatttgagatccgcaaccacccggtgtttcagagccgctgtttcttcgttcgacgagttgatggatcctctgatgatttcagcttccgtaagtgcgttgacagcatacttcctctcccggaggacatgaagattggcaataagtccaatggcaagaagggtggtggccacttcaagggcggtggaggtaggggaggaggacgaggtggtggccgaggtggcgggcgtggtttccgcggtcggggtaggagaggcaactaaaggactcaataaaaccccgaaattttttgcatgcctaataccaatccttaagattgaggcattcatggcaacatgtgcttgtttgtctgccttctcctagagggactgatgctccactcacttgtgtactgtgaaagtgcaactatgataagatctcgccgatctgtcttcccatatcttcaccgcattctgtttgagcgatttgtctacttgtcttcacatggcatattttgttttgtttggttttgacatctcattttctgtgtgatgatcatattgatccggcttttgtgataaaaccagaacatagtctgtgaccgctgaccggtcaccggtcagttacagtattttctgggaagatcgggaattcagttgtggtctgaaaccacgggaaccgcatgcccagaccaccggtgtaaaaacgatgtcagtgtgctcgaacaaactagtgagttgtgatggtcatttggtcaacttgcaaatcgcgagataagtgcacaccaatgttgtttttgggcactgctgctgggcacagacgaggaccacggcgaattggttgtgtgagttcatgcgatctggcacgctccaatacggccaggaagtatacatgatacattgatactagtagtagcaatgtaagtgcagctcagctcgctcctgtaggctgtagtcctatgtgagttgtgactgaactgaactccacggcaggaagcatattcccgccatcatctccggtggttgacggccttttttgtcgatgattactctataataaagccatctcccggttgggcgagcatcaatggcgaagtagtgagggtccagtgaccactttctcctgtgggatagagctgaaacaaaggaaacatcactttctcctctgggagtaatacatatccggtccaatgcactagcagtctagcagcagcagcactaccgctgtccggttgttgcttgcttgctcgtcagctactactactagcttagctagttgcagtgctggattcttgacggtagctttactactactttacggtatcagcaatggcccatttgaatcaaaaatcctacgaaggaatttcgtaggatttaaatcctatatgaattttcctaataatcatttgattcaaaagattgaggttttccaaatcctatgaaactcctatggaatggttcattgtacatagattttagagaaaacttactggttcatcgtatatagattttagaggaaacttaccaagagctacaatctcttgaaaaatttccttttgagtttacctttctcatctaattcctgtatttttcttgcggtccgatcaaacggtcatttatatatttttcctacgttttgtaattttctgtatacttgtacttctgtttttcatgtctcttgtttttcttaatcatgctattcaaacgagcctaagtgagtagtaaggggaggaggagcttttcatccgggaggctggagctgcttttctgggatgcagcacgttgcacggggcgcgcggaggcgagaatatgcgtgtgcgggatgatgtctcccggacatgtgtgcgggtgcgtggtgcgtggataaggaaattcaccatctgcctgcctacctgcacgctgtgttggtcgcgtgttccgccggccgagagcaccatcggacgatgccggctcgctatcgccgattcgctgggaagcggtgccgctgctctgctctgggggcgcacggcgggtgctgttctgtcgatcgtgtgtttttgtggctctaccgtgtgtgtctcttgggtcttttttgggcccagcggccttatttagagagacatcaactaatgagacatggagaaaggtccaaaaataaataaattggcatgtgaggtagtatcagatttaagatatatcacgtcttatacgtgatttgttcattttagaaccaagagaaataaattgagtagagttttactattggtcaaatttggagtatgattttggactatataaaaatgtaaggctttataaatgtagcttgtcttgcttatattaggacagttttttctcctctttctcaatctttacttacttacttgtttttcgcatacacgattttaaaattgttaaatggtgtgtttttttaaaaaaatatattaaaatattactttaaataatcatattaatcaaaatttaagtaactaatacttaatagcataagaaaaactaataataaaaaaattcaaataaaatagacggtcaaacgctaaaaataaaaattcacaacaacacttaacatgtaacggatgaactatgttcttattcatcactctgttttacgtgtaatgtaacggggaaaaggttcatagcccttgatgtccaatacagccctaaaaacttttccaaacaaagttacgttttagtcatccaactgatcatccattaagaatggataaaacatatactacctccatcctaaaatatttgacgctgttgacttttttaaaaatgtttgaccgttcgtcttattcaaaaaaattaagtaattgttaattctttttctatcatttgatttattgttaaatatatttttatgtatacatatagttttacacatattacaaaagtttttgaataagacgaacggtcaaacatatttaaaaaagtcaacgtcgtcaaacatctagggaaggagggagtatatgtgtcgtatggtttgtgttcaaggggtgaagagtgtcgtgcaaccgtgatttctctatggtaatttaacttactgcgagtgatttcccttttggtcctgtcaaagtttacaattggtaatactagttggtactattgtgcttgaacttataaacggaaaaggggatccaacccaaacaacaaaacacaaatagaaaataaaaaatactccaaaatccaaactaaaaacgggaaaaatagaaaaggaaaacttatacgatttctgcgccctcctcttcggcgtcttcgctactctccgccttcgagccccaaaggaccccccccctccccgccggcggcgccgcttgccgcgggggacgatgtacaagctcggcggccgtggcggttggacgcggcggacggggccgagccgctaagcgacctgcagcccctcaaggccggggacgtggggctggcccctctatccgtggaatgccccttccccacagaagcctccgcgctcccgttttcagctgtcgggcgaccctgttcactttcctgcgtctgcttgattgtccgtcacccccttttgggaattcctcctaatatgcctcctagcccccagtccacgcaacatttcttccccctataaccgggtccntcttcccgcgttttttctcaagaataccgccccctaagtggctttcaaaaaattttactctcccattccacgggggcggaaaccccgcgggtgatttttagatttccaggggtgttcccaacgaaaactcccttgggggctttctttgtcgcacactgcggcttctgcaaaaccgtatgcttttttt

SEQ ID NO: 78953 - DNA, 1614 bp, Oryza sativa
ttcaaaaatagattaatttgtttttttaaagcaactttcgtatagaaactttttgcaaaaaaacacaccatttagcagtttgaaaagcgtgcacgcggaaaacgagggaaaggggttgggaaacttgtggaaagaacacagccttaattactttattatggttacttttgttcagagctgcttgtttagtattacatgcaagcatttattttcggttggactaccagtgtaatactccttggaatatatgctctatatatttttaaacgttcttatgatccataattatttttcatatacgatctaaataattaaattaaacgttcaaatatagtacggagtaagtatatacttaggcccatatttcgggtattgtgcaaattttacgtcgactaaaattaggcccacgttgagttgtagctgttccaacatttgggccgtaaacaatttcgctaggtcttttgaagggcctgacatttggcccacgtacaaacttttatctgggcactggcttcttccctcgaccgcaacggtgccggctgggcgcggcggtgggctgggcgaggggctctccggcggagaaaagagcggccgacgcggcgacggcgaggcgtcacggtagcggctgggtggcgggggaggatcttgggcggagagaagagcagccgccgcggagagggcgaatccccctccagctcattccgtcgacgggtggtgtctccttcccccgttttttttctcttttgcatcccttcgttttgctcgtctcttttcttataaggaagcagaatgtttatctcgtcgcttaggtcatttggttcagttcctatatatggttgtccttgcgtaagaaaatagtaacagggagagtcaatgattatactggaatcgactggtttagggatgtggaaatttgggagttttcttcgattgctgctgtactgattaatcgcaatgcgacttgcagaaaatttaatgcgccatagttttggtctcaatatataagtatataaccagcgcagtatatgcgaatttgagggttttgtgttcactcgcctccaaacaggcatcgtagtttacaaaaatggaaaaccaactactaaaatcaaaatcaggcatcatgtcatgcattattgacatggcgcatgattcatgtattcatggttgttcagttgagttcgccagggagggactgtactccataagctgtgcaatgtgggctgctactggcttgcgttgaatggggctagttgctacaaaagataactcaattttcaggtgtcaaaataaaccacagattttaagaaaacaattgatgccaaaactagtacacgtgctagagcctggcacaggaactgcaatctatatattaccagttatgcattgttcaccccaagagatgataatgggacaaatcatcattagaaaagcaggcaaacatattacaatgcagtactaatgaggttggccgtgtacatccggttggatgtagaggtcgggtttattccattttctaaaaagaaactaatgaggtacaattacaatagtattttctcatctcagaggcaaatcgtgttctttctagaaaggccatgtgcacattcacttttttct

SEQ ID NO: 78954 - DNA, 883 bp, Oryza sativa
ataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttgttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagcgagagcttgagatttcaccctaagcccccggccgaactggcaaaggggggcctgcgcggtctcccggtgaggagccaccagctccgtca

SEQ ID NO: 78955 - DNA, 18878 bp, Oryza sativa
ctttccctacacgtagtaagtctgttctgtttttgtacttcctccatcctataatgtaacaatctagtatgggataagaccttatcctaatacaatgtatctagacatgtcctaggttgggtctcagattactaaattttatgacagagatagtaactatttaaactcatgtttctcaattactctatctaattatatagacttgctcgttaaaacctgggtacgtggtaccgaggttgagctaccgtttatactactacgatggtgcatcccgaatagcaagagtacacgtgacagtccatccgggcggtgctgaggcggagcccgggcgcccacagacccaaagctaggacggacgaacggtaaagcgaagaagcaaagcaaaggccccgtccctccctggctgcagtgtagtgtagtgcagtgcagaccaagataagggcaagggcggcccctccccccctcgtgccgccaccaaaaggagaagacgcgagaagacaagcaatcgaatcgaatccaagcgcgaaaacccacggccgcccccctcccccgatcagggtcccccgttcggtcggctaaggtttgctactaaaaacatgtgtaattttttgcccctctgcttacggagaaacacgcgatgacgccgcgcttttataaccgcgcgtccaccacgattccccctttactacgttctctccattccatctccccccaatcgctcgggcgcaatgcgcagcagcagcagcaaggccacacccacaacctcccctgcttttcgcgtcctctgctctcctcctaggttagcagcggctttgccaacgagatagataggcaaaagagaaagtacttgcatagcccaacaaggcaacagctgctgctaccctctctttcttttctctgcttctccttgctctctcttctcttcctttctttctttctatctcctgcagtgccaagagtccaagacccaacaagggggaggacggaggaggcgaggcagaggcatctcaccgaagggggaagggcgacgccatgtgggacctcaatgactcgccggcggccgaggccgcgccgccgccgctgtcgccgtccgccgacgactccggcgcctcctcgtcctcggccgccgccgtcgtcgagatacccgacgacgccgacgacgactcggccgctgtggttgtcgtcacgcgccagttcttccctccggccgtcccgggcggcggcggcgaccccgcccccgggaacgcgcgcgccgggtggctccgcctggccggagccgccccgccggtcgctgcaacggggccggcggcgtcggcggcggtgtccaagaagagccggcgcgggccgcggtcgcgcagctcgcagtaccgcggcgtcacgttctaccgccgcaccgggcgatgggaatcgcacatatggtaagcatcctcgtctcctcctgctcgttctttccattttcgagagctcaacggaggaagaaggagagagagagaggcaaaggggagcaaaagaagagcagcatggacgggtttggtattggattcgtcttgttttgggcatttcttgcttctgctccttttacctttcatagcaacatcttatcaagttattcttgccatactctctcctctctctctctctctctctctctctcttctcttctctcatcactcaccatcttcttgtcttctctctctcctctcatccttttgtgcaatgcagggattgtggcaagcaggtctatttgggtaagtttcattcatgtccatcttgtccataccccccatacttgggaactgctacaagcggcctccacgattggctcgccaattggagccgttttttctctatgggcgcggtttcgattcctcacaatggctgcctttgtgacgactgaatttgcaggcggatttgacactgctcatgcggcggctcggtaagttggactcaattcctcgtcttccaatcgctgacttctattccctgctcgcccaatcgaatccggcgctgtcaaaattctaatcttttttgttatgttcatttcccaatcgcagggcgtacgatcgggcggcgatcaagttccgcggcgtggaggccgacatcaatttcagcttggaggattacgaggatgacctgaagcaggtgagagcgcgatcgattattattacctgaactttcctttcttttcatgagtcgccacggtttcgttagatcatactactattactgtagctgcaagattaacgggatcattgcagatgagcaacctgaccaaggaggagttcgtccacgtgctccggcggcagagcacggggttcccccggggaagctccaagtacaggggcgtgacgctccacaagtgcgggagatgggaggctcggatgggccaattcctcggcaagaagtatgtcctaatcgatcaccgtttcttcctctttcgttcgatcgttcgttcttgggcaatctcccgtaaatcatcttgtgggtttttggtgcactgcaggtacgtctacttggggctgttcgacaccgaggaggaagctgccaggtaaaattattgggccgcactgtgcgcgcgcgcggccattgttgttgaatgtcgagtgtggctgctgcgccgtttgcgagtttacgcttctgggttagatgggcgagcggtgatggtgattgatgtttcttgtctcttggccacagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaaggtaaaaaaagaatggggactttgctttccgcatcagccgattgtcttctcatcacgtaataaaaaggcttaaaaattcctcgttttcttgtctagttcgaccagaactcgaaccatccccagatgcctccggtcctgcaggtcacccacctgccattcagtcccaggcatcatcaccaagtgggtagctcactatacaactccactccacttcgctccatttgctgctgaatttctcgcgtttggtttcaccggtatccgtgagctgatgaattcttgatgtctgtgctgctagttcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctctaccttttttcttctctctttcttcttctctgtttcttgattgggcgagcgagatggagatggatctgatcatgaatgggacacaagtgggcatgtaaatgaggagctccctagaaggcgagagagattggccaagcgtcgcctcaagcagtgtaggagtatctatcttttgccgtttcgctcgctttctttccttcttttctttcaccatggccaacaacgatgactctgggtgtcaacatcacagctcattttgttcggtctcatgttgcatcattcactgcatgatgaccatgattcgggaaaatttgctccatgcacctccgcttggccgacaacacttgccctctagtaagcatccttaaacacccacggtttctactactattcatcgctttataaatcctacggagtgctagctttacgctactactactgtcatgtaatctatcatcatcaaaagagacgatcagattaacatatatgtcaactatttaagctttggctctttgctttccaagaaacgtaactgccgagatgtggagcatatagaagtattcgtccttctagatgttggtactaaagtaatgttctttcttttctccctctaagaagagatgttttatggtgcttggtcttctaaattaaaaaagacatacgactgcgtttggtatcctataccaacaggaatcagatatgtgggccctatctgcaatgcaagaaaagaaaaatcgaactgttccttgcagaatcttcctaataatctcttaatttcatagtgttgggttacttgcacacatatctaacatctcgaagacaagtagacaaccaacagtcatctggacttgttggaattgaattcaaagcgtgattaaatagcaatcttccaaaaagaaaaaaaaatgaatcaatgtatatagacccaccacgtacggttgtgcttgatcatttgataaggtacggatctttaggttgctgttgcttgttgcgaaaacaaaaatgttatcatgagatttcccgaatagaaaagagaaaaagaggaataagcagatgcatgtatctcttttccgctcgcttttttatatccttggagatgctttaaaatgtgttgcctatgcacctccctgaaaaagaagagaagagaatagtgccggggcatagatgcaagtgggcgtaacattttgctagagaaaggggattccttgtttctaatttgggcattgcaataattgaatgtgtgtggggcgagatgagagagagtgaagtgaagtgcagtgcagtgcagggtagcatcagcagcaaccgggcatcaagcaaggcaagcatgtgtatgtatgcgactggttcacaaaagcgagctgggccagccactggctgggccatgaccatgagagccaacctctcgcggtaaaaaacaagttaatgtggtctcatccgatgccgtgtcgctctcctcggctctccgaatcagttcgccccctggagctaagctttaccttagctgcctctcaccggcaaccaaccaggcgagcgcattggccgttttcagtctccctgtggccattagagcaggtacaatagcagactataagccagctgcaaacatattttaaggagataaattaggagagagaagagcagcgggctacagatttgtagccagctgtagcacggactccaagacacagtgtgtctatgataggtgggactaggtattaatagtgtagtatgtaactattatatgaatgagctattaaattagctatagatgaattggagctagtagttggctatactattgaacttgctcttattgctagcaccagatctcatcagtcatcagacgcttggtcactttcacctcacttcgtccacctgttcctcgttcaggacttggtcctggtttttatcgttcgcagtggatgggcagggaaagagcttgtcagaaatcgttttggtgttcgttctagatttcgcttgtgtgtattgatgaacaggggtgcctcctgatggatcccttgagtttccgtgccgtgtgcatgtttgtggcaatctatgaaaaaaaatgcaatgcgatcgagcggtggttcagccggttgctagcatcagatatatgacaaggacaaggcaggattaattggctgcgtgttcagcatcattcttagtaagtagggacgtagtacgtctaaccgaagcaacaatcaggactagtcgtcgtgacttgttcgcaagtgtcttgtagcttttcttgtgtaagctttgctaggggccagctcgcgagggtgccatgcacatgcgttctatgcatttctactagccactataactgttgtgcaatagcagggggaaagaaaattttcctcttgtccccttgcgactcgcggacctgggtctgcatgcagctagaaaacgatcgatggcatatgcatcatgcaggctctcaattaatatgtgtggctacaagaaataatctgcgcaaatggtattgaactcttgatatacccgcgaagaaactcctgtactatatcacatttaggcccacatgatccatgagcttatcctcactaagctcatgacaaaaaacggcatgcataccatacaggcaactaaatctctcttcatcaatggccgttgcaagtggtttccttgcacggtcgatcgagtaaatggataagtgccacaatggatacgtctcggccggcaaggcgtggccgcgtggggtctcggcgcgggcggccgtactcggtttcacgggacgaaactagctgaaaccacccgatggcgcgcgcgcgcgagcgcgtacgtacgagcgtgagaccccacgacgcgcgcgcggggcgtcgctagcgagtagcgagacatgagcagctgcgagtgcgcgcactgtgcgcgcgcggctgcaggccctcctctccccggcaaaaatgcccccctcgggccgcatgatcgatgcttccactcgacggcccgggcgctctcggcatcccctgctgcgtggaactgtgcaacgtagggccccagcgtgccggccaccggaaatatcaagcgagcgcggagctgatcgatcgactcgtacgtcagctgctgaagcacacgcacgagaccagcatgcaacgacgggtcgacgtgcgtgctacatggacgaaggaaaaaggtaagcacaaaggtgcggagaccgggaagcacgcacgcacgcacgcacgcacagggcagcgttacacgcatcggctcatcgctacattgcagctagctatctaggccaatacatgcagccacggccggtagcttaggtaccactactagctagattcactttttgccggtagaatagtcgggagtagtagtggtggatttccctggagggaaggagagaggaggaaggaagggaaggaaggacggccggtcggtcggtggctcgcgtcgtcggtcctgttcacggcctgccccgaccttccccaaagggaaagtgggcaccgacgcgcagctattcaccagcaaaagccgctcccgatcgatcgattggtcgcattgtatatcgtattcttttttttctgccgcgcccccgcccgtccggtccagatctggcgccagtgcgcgatggcgacgtgagactggctccgcacggacgccaccaccaccacctctctcgcgcgtcgcgttgtctcactggctacgacctagcatgcgctccgatgctcttcccatccgtctatcgcccatcgcccgccacgcgccaccgtctcgtgtcgtgttgtgtgttgcctcgatcgaattggtgttgcttgcttggcccggcaggcagtcgacgagcaggggttaaaacggaactgctgatgaagcagaatttccacgaaaatcagctgaagtttggacgttttgatacgagtttaggacggcttgctgtactggagtagttagtagtgctacctagctataggtaaatggaaatcttgcagaaattgacttccacttcacggatagtggaggaagtacacacgctgtacccgcatgcctaattcgtttccatccaatgacctgttatgacgccgtatctatatgatgtatagtactcttgagccataatcaataatgccaagtataattgtccgagcaagcccccttgaaattgtggttccaggccggccgggcggcactaatctcctgtagaaccgtcgtgcaagcttagactttggcaccaccgacgatcgaagaacttgtctttagcacgggcacaagtgcgcgtgagatgaccctgaggcgtacatgggcgacttgtgtgagctgtgaagccgacggcataatcaacacaccgattgtaatgacgcaagaatgggacgtgtgtcgttccaagccgccgccgccgccgccgctttacggatgaaatcatttttctggggcgtatacatatgaccggcacagcacgcgtgcatacggcccgtgcatcacttggattacgtactcaccgtctcaccgatcgacggcgggtgatgcggaccgatcggttgtttacttgttcggctcggcgcgcgcggcatcacgcgtacgacaggcggagacgccgccaccgaggagatcgtcgtcgcggcggcacgggcacggagcccacccgcaacgcgcgacgcggcggtcggcgaggctgttttgcccatgcgcgcccgcgcgattggcccatcaaacccgggacagggccgcaattgcagcatggggcgagcgatgaggacacgtgactccacggatgcggcgggatggaccggtggacccaaaagtctacttagcttggtttggctatgggctggtggtccagcagattggcaccgggccagcctgcatggactggacctggatgttcagctcagccttttactcgaagtaaattcttcttctcttctcaacgggttacttttcttcatattttgcttcagagaaaaggcttgtccgtggtactgcactgcgctgcatggaaccccacttgtcacctctgcgatctgtccaacgaccgttacagcagattgtcaaattagcgtttgactgcatctgcgtggagctaatcgttgaagtaatcagccactgagacactgaccgatccatttcacagatctgttggcttgtggactgtgaattaagattgatgccactgactggtatatgacgctaaatttatcgtgcagcaaatatatgtgtcgctttaggaacatagctggcaatctttcctcctggtggtgcgcaagacagcccgacagatggattgatgaaccgatgtcacactagcttgaggtgtacacttccaacgtaagtagcacaaacaagttgtccgtactttcaatccgctgtcccttgattcatgcatcaaaccattaatacatgtgataagtgccaatcatttaggtgggtaaacctcacaaacgttctaagctgacggtggtcgatgccactgatgcacgccctccttatgggccactgctgcaggtcctatccactctcaggttagttatccaatatccatgtaattaatcactaagtaaaccattgtagtagcggtagtactatatgtgccaacaactagtattcttctgtcatcactgatcccttctctacactattgatgaatgtgctcacgaaaatcattttgtactgtggcaagctggcaatgaactctcctggacaaaaaacaggtaattattgtcataacttgctggaatcacaagatactcctgtacttatggggacaacaggagcagtaatttaatggggagtgcaatgctgctattgcactccattctactcttgtccaacggcaccgccgacacttaaaagccccaaacttaggcaaacactctcgagctaaatcgacttttcatcacagcatcacaggattcaccgcgcatacggatagctaaaatccgagaaagggctaaatttgagccccgggtccacaggccagtgagccaatacgcagcatcagtatccgctggtacatgtgtcattgcaaggatctactaagaaaaaaattacggagtgagaccccagcggttgccccacgggaaaagctgaacgatcgctttgttcttatacccgtgtcacctttttctcccttccatccacctttgtgtccttgtcttcatctccctcctccataggatgccgtcacaggctcacagtgaggcagcggcagttcattcttggtgagctgcagcagagccaccacctgttgtcactggaggtcagttcagttcagctcactcacctcacctcactggctactggctactagtgccttttcttgagttcttgaaaatcttgcttccttctattttactcttgcccttttggatcctttgtcaatgcgcggtgtgagcacactccatcttcttctttgtttgctggctgggaaaacgatggggaaatctagagcttgggctaaggacctaatgggtttggagctagttagatggtgatgtttttggcttaattgcttaactacactaacatgcatgccgattgcagaagccgctcttgctaaactgctggtgctcttagggatcctgtcttcttgtttcaccgtggagcccttttggggttttcgccatcagttctagctgatgtaccattttcacttcctgctgcgcagaaggaagcttattttgagttaatatttctagtgggtttagagttagacttctgagctctgactgcttgtttctgcatctttcttttctctcatcttcttctcttgccctccttgtgaattgtatatttgtctagatttagatgcaatcaatttgcataaatactgtctaaatagatattgtgaggttgggcctcactccagttagcaataaaacttcgttcagaggttttaaggtttactactatattcgagttgtccaaaatagtaaatgccatcaaaatagtaggccctaaagattgtcgagacaaagaagaagcatttcgtttttagaggtgtttaagtacttcagttcttttgacttctgagaggacgtacctgagtcacataaatgcctttgtaccggctggttttaattgcatcggttggtgacgcttctggatcaaagtgataggttcaatgtcaatgggcttccactattggagctgacacagaagctaaaagttgacgggcaattctgttaaaatttgttttaagaaactctatagctgtattttgccaaaaactttaccttttgaagtggtaggtacaaagagagtggaacagaacaagcttcactatatcctttactttcttttctgagctgagcatcgctttctgcattgaaaggaaaatgatattatggttagctgatgaagaaacttattaatcatgaatagtagattagatagtggtcaatttctattaacatggcagataattaacagtactttacttctgaacaatcattggttaacaaaatacttgctgagctggcatacgccagccaaagtttttattaagcttagaaagtgttcaaagggatttctttgttttagtccacgagtccaaattcttgtatttttcaaccttgtctcatggaataaaaaactaacgtgtatacgatataattatatgaatttaactgggataaaatacaacttgctttcagattatgttagcttgggatagttttgcaaagatgacttgatacacacaatttcagtttcttaatagaatagcacccaaggaaatgttctgtctgtatccaccttttgtacaatttggtgggaatatatcttactaacatttatatttcttattaatttctagggagtttagaacggcgttgaatattgatagatatttagcatctcactaatggataataaaacatggctttggagaaaaaaatcctcagaaaggacaatttcaacgaagaacaaagccaatatatcagagagggaacaggaggtacatcacttatctctttaacattattaagaagccttatgaattatgatatgttcctatctggattttcaacttttccttccctgcagaaagagaagattgcacggttagagagatccttgcaatgcttaaatgaacagatttcatttgctcaagctgaatgcgtggagaaggatgctattttagctaagcaagcaaaagtggcagaagaagcaatattaggtaaaactccattcacttttcgctaactgatacatgttcttgtttcaaaactagttaagcacatgatttttccatcctagaagagaaatggacagctgcaagtatgcagatacaatggcaattaaagttctgcaattctttttttctgcaattcatgttattggtttacaactattctaggttgggagaaagctgaaggtgaagcaatagctattaagacacaacttgatgatactctagatcagaaagccgcaattgagcaaaggatttgccatcttgatgaggctctaaatgttgccatggtagagagggagttattgataaaggacactgctaaactgatttctcatgagcaagttaaagttgagaggctggaaggagatgtagtagagaaaataaacataattgctagcttggatgccgagaataggaaactttctgaaatgctctcaatgaaagagaaaatgatctcagagttaactgaagcaaagggtgtgatagagtcaaatttcaagaaccttgaggtaaaactagagtcagcggacaaattgaattcttctcttagatatgaggtttgcatgctgcagaagcaacttgatattcgaagtgaggaaaggaaatttaacctgaaatctgctgatgctgcacataaacaacatcttgagaatgtaaaaaagattacaaaacttgaagcagaatgccagagattgcgttcaatggtacgtaaaaggctaccaggccctgctgccattgctaaaatgagaaatgaagttgaaacactgggtaacaatgcagtaataacaaggacgagaaggttcaattctacaacatcattcaactcaggcaatctagtgcagaactcctatgatgcatcacatgaaagttcttcattgcttgcaaggctgcatgcgatggaagacgaaaataagactatgaaggaatctctttctagtaaggatggtgagctccagtattcgcggaccatgcttgctcgcacaacctctaaactttcccaagttgaagctcagcttgaggagttatcaagaggtcgggttgcaacagatttagtaaaatgcagtcctacagtggtcgagaaccctctatcatcaatctccgaggacggttgcaatgaagataatgtcagctgttcaagctcatgggcgtctgccttgatttctgaactggaacacttcaagaaggggaagctgactacaccctcttgtaagagtaccggagtatcagacttgagtttcatggacgactttgaagagatagaaaagttagcattggcatgtgatgcgaaacctacagaatcgtatgattcaaggagggagtctagagaatcatcagggaaagagctagtaacagttgatggtcctattgaaacatctgaccaactccgtcagcacaagattgagaaggcagtcctgaagttgatagaacttattgagggtgttgtccagagatcatcaaaagattatagtagcactgttgtgctctctggtggcagtgagggcgaccgctctaacacattgactggctacgttgcacgtgcattcctgtggaaaacgtctgaacttacttctgtactacaaaatttcgtccttgggtgtaacgagcttttgtatgggagtacagatgttgaaagatttgtgcttgaaatcaatatcacactagactggataatcagccactgcttttcactccaagatgtatcagacatgagggagactatcataaagaacttggagataaatagcagttccggactagaagttgttccagtaattaagcacaccggaatccaaacaacagatggcatgtgtgaacccaggacgcctaacaagatgcagatggcgatagtatctgtatcaagcttaatggatattggatataaagctgatgatgactcagaaattttcaggaataaaataccagtctctaaatgtgaggaatcagaaggaaaagcttcaagcctgcgagcagagcttaatgcattgaaagaaacaggaaaaatgatggcacatggtgtcgatggtgaatccacaatcaatgaacttgggaaaccatccaactctgacataaacaagggcaatcaacacggagtgtcttctcttgaatccaagcttcagctagaacggtaattctttcagttatttatttttcatcatttagccttcatagtattatgcctaatgcagttatttctaaacagtttccctgctaaagaaggtccaaaatgtgtttctaggaatgaagatcagcatgtacagatggtaagatccacattattttacttcttgactttgttagtttgttattctggaacttgcctttgtactttgcaatgtattaggtatttcatttggagaatgtgttacatatttgtgctttgtatctgcaagtaatttgctccaccgatgataatcctgtctgtaatatatagcattgcttttgttcttgtaatacaaattgcaggcaagctcaaataaagagcagtcagtcttgcttaatatgttttttgtttctttaattttgagtcaagttgaataggacgtgatataaatttattaccatttagtagtgctacaattttttttattacccattcactctgtttctgttatctgtctttttttttattttgtctggtttttttgggggtaatacttttatgagcccggcgaaaaagtattacctttattatatatatttttttacaactcaatcaactttccccattgtgtctacagcggctggagatctcaacagcatcagagaagcttatcgagtgtcaggagacaatcctaaacctgggaaagcaactgaaagcacttgcatctccaaaggatgcgatccttttcgacaaagtggttcatacaaaaattcagtctgagcgaaaaccccggtctcagtcgctaaacgagatgctagccatggatgatggaggattcgattacctcagctcccccaaaaccaaggagatcatatgcgcggaactaagatcgcggcatgaaagaagttgctctgtcgacaacggaggcgatgattcagtaacatgcagttcccacccaatgccggtggcaccaccaatgaggccctacgatgtgaatggaacttgcaaggatgaggctgctctcaaggtagtagcacttatgccgagcaagcagaaggggaacaccaacttgctgaaaaggattctggcaggaaggagaaaggaagccatgaccaggccaaatgtcgttgcgactgcttagcctccatggatgatagattgccccttctccggtgtaaattaagtgtggccgtggatgatggattgccctcttcaggtgtaaattaagtgtggccgattggcacttgagctgtgtcgttttgatcacgttggtagtaagaactaagaacagtgcaatgtatatgtaacatgcggtatgtattagcgtgatttgcaatgtttccgcaaccattacactgttgcttgagcttatgaatctatctctgctttggtttaccgtgcaagtgaacagaaaactctaattctagttatgatagatctctggaagacggctggtttatcggcgcgtgtttttatgcctatcctggcgtttctgcagtgggatcccacccagaggaggatcagcagtagcagcattgccctagttttggaggattttgaaaagttctgcaccgatacggggagagaaattcagggtttcagagactgacctagtgacctctcatcttgatcgtgtgctcggtgtcgcggacgcggacgagcgcggggggagactctcctgggtcgtcggcagtcgcgcgcgcgtgattccgcggtggtcgggcgccggccgggatttcgtgcgggcgagaggggcggggcgcaggcggcggaggggatcggtttgggagggaagggtttgggcggcggtggtcggcgcctcagcaggggcgctcgatgaatctggaatttttttcgtttttagattttttttaaatatttacagaaataatctatcggcaaaaaaaattacaaaaatagaccctgccgcacacctctagggcggcaagctgacgtggcaaacgggagaggaacgggcggtgacggaggtagggttttttttgcaggaaaacccttgccgccaggggcccgaatgcaaaaaagccagtcggggccggccattttgcaggcggccccttgccgccctctggccgggcggcaggcctcgctgcctataaaaggcctgccgcctagcccccagccatcattcctcccccctcaaatccagtgaaaaaaaaagaagagaggggaggagaagagaagaaggggcgaagccctgccggattcagacgccgatttcaggtaatattcatagatcctatatgtgactattgagttaaatagtgtgtattttttaaaaatttgtttgaataaatgcattatatttttagggttttagttgtactaatctagaagtgcgtattgtagatatcggtaactacgcagatctgctagtttggaatcaatacattaccgttgcattggcttacacaagactttcgtcaatggctagacgccggatcattgtagatatcttggacgggcttcccatggagggagtgccgtaggtagcacccgccagtcgctctgttgttcacgatattgtcgttcataagccgcttttctctgtaagtattgctcagtactttcggatgcgaaataccatcgaccttcttgtaaacaagtggttaggtcgagaacgggattttctgtatcgacccactcgatgtatgcgcaagccgtagtgcgggtttgctgaatagagtagtgttacgaagaataaagcgattgcccatacggaatgaataagcatatgcagataataaaatacctcacggtcatagttagggcacctaaaaaagcgccttccttgaatatcaggattcctcgaagccattagttggcatcgatcaccgtataggcagagaggacgctggcaccaaggtggtagtaggtatacacaaggatcgctacgccagtttggatcctcaacaccccggcatctagccattgacgaaagcaggtaggatttgtaatgaagcaagtggggaagggagtactgaatgtgacatgtgccggcttctagataccctcttgtgtaagccattgacgaaagtcttgtgtaagccaatgtcatgtgccgtcggctttgcacaagagcaatgacatgtgtcgtcggctttgagaacacactcctgcttcactctcttgcggtagatacccctgcctgccttatcttgacatagtatctcaaacctgtgttgttgggtaccttgcactagagctcgatgttccacaggccatgtcattgttgttatatgtgcacgatacctttcggcgcatgcacgattactttctgccgcaccgatgcagcctcctttattcgcgtgcgatacgagtatttgcccgccatttggcgcatacgaccaatgtaactttcggcgccgatcaggctgtaactttcggcgccaatcaggcgtacccaccataccccaccacgttcacatgtcaggggtatcactcgattttttgcgcctatataagtcgccttaacgagtgagggctcacaatctttcagaactcagttacattcagtactcccttccccacttgcttcattacaaatcctaccggctttcgtcaatggctagatgccggggtgttgagaatccaaactggcgtagcgatccttatgtatacctactaccaccttggtgccagcgtcctctctgccgatgcggtgatcgatgccaactaatggcttcgaggaatcctgatattcgaggaaggcgcttttttaggtgccctaactatgatcgtgaggtattttattcttcgtaacactactctattcggcagacccgcactacggcttgcgcatacatcgagtgggtcgatacagaaaatcccgttctcgacctaaccacttgtttacaagaaggtcgttggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaagattctttgtttgttcaaatattcttgacgatgatttcatggtaagaatattttgattacatgaatccttattttgtcacaacatttactaactttgctcgctttacatctattctttcctcccaggaaccactaaggagatgttaatacagagaatggatagacaccagaagggttctaactccacctagccgtgttgtgcagcttgaactaccagagcaatacagggttactaaagcgcggtttgagagaggagagagatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctacgaccgagactgcgataggcctatattaattatccgagtactaatacgtcgaataaggtacaaaataatacctcacttaacatatgaaattgcgcaacaaccaacttcaatacatttttataacaatattaacaagttttaccaataaatacttctttatttattattaacgtaacatagaaaaatcttttggccgtacttttttacatctgggtccctt

SEQ ID NO: 78956 - DNA, 506 bp, Oryza sativa
ttaacaagttcgtcaccgtcgcctccccatgattatatatatgttccaagaatatcgaattctcgcttcgaatcccctctttggcttccccatgttttgccgagttcaaatattcgatttgaattcaaatcccgcaccaattgcccccaaatcccttaaagcgatttcctggtaaaagtctactttacctccctcatattcgcttgggccgaatccggccatggcctggcctgcatctcctctcccacgtgcgtcgcgcgtgaccactttctctctctctctctcgccgcttcctgccgacgccacccaaaatccggccgcgtcgttcgattttcacgcgcgcgcgcgatgaccgaccgtccgcccggtcgccgctgccgtcagcactgggctgcctgctgttgttgacggtcgttatcgatcagtttcgaccgtcaatattaccaaaatagaggagaactagtgatgcttgcaatttatatatactacctccattattttaatag

SEQ ID NO: 78957 - DNA, 1046 bp, Oryza sativa
agtcttccgctgcaaatagatgaaattgatgaaaattagtgtttctaaaattaaatttcgaaccaacgggagaatttaattttaggaacattaattatgtgctatgatgttgtaattttctgaccaacgttgttaaatgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaagtgagtcagatgctgactggcaaaagagacatagggacaatgctcctctcgtcatgtcgtatgacattgaacaaaagaaatggtccttagccaacaagaaatgtttggctgtggtaaagaatacgattgagcctaccatattgggtcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaag

SEQ ID NO: 78958 - DNA, 597 bp, Oryza sativa
attcctgcagccctgaatagtagctacaaaatggattaagcataggaatgatccaatatatggctctctttttttaaaattatgtggtttaatgcatgttgagctattggctataggatatataaataagccagaaaaataaacatcaagttgcattcactacctgcccagatgaagaaagtatgcagctgagctgtgtgccaaagactattaaagtacagtgtgaatacatgcatggaaagtttgcgacaattgaccacttaattatatttagtggaagtaattaacatctactagaagcaacgtgacagtgcaggaccaagtctaaagtgtctttccaacctcgatctctcgtaatcgagcttagctatagctctcatgatttaactgctataaatacctcagcaagcaacaagtctcagcacaagacattaattaattagcttgagaaactcatctgctggatcgagcttctctgttaattaatggcgtcgaaagcctttgcactcgtgctgctggcggcggcgacgctggccatggcggccagcacggcggcggcgcagagctcgccgcaggacttcgtcgacgcccacaacg

SEQ ID NO: 78959 - DNA, 668 bp, Oryza sativa
aaagaatatatagaaatttagtttatttgctaaagaaggttttataaaaaagttgagaaggaaaatatagtgaaagttaatcttgaataatagaaaccaaagtaaaatgccaaattaaaataagtccaacacattaatattagtttaaaactttataaatagtaaatatataattattcggtgtaatatttcataatatttgtaggaataatgatatgtcattattgtgtgactgttgaaagagtttgtaattattttataattattgtatgactgtcattattgtacgaataattatgtgtgtacgattttttttcatgttatgtagatggatcggcaatggatgtacgctgaccggtggtccaaagagtttattgacggcgtgcattattttttgagagtggccgaagctaacatgcaaaagggttttatttgttgtccatgcaataagtgtaagaatcagaaggagtattctgcatgcaggactattcatttccacttgtttgagtcggggttcatgccaagctataattgttggacatcccacggagagcaaggtgttgaaatggaagaagatgaagtggaagacgacaatattccggactttgctcagtacgctggatttgaatgaaatcaaacgggcgaggaggaaagggatgctgatggta

SEQ ID NO: 78960 - DNA, 11760 bp, Oryza sativa
gtccgcatattttgattgagtttaattagcatttcgtcgccatctgatgattccgaatgattttctttgtgtatatatctcgaaatttgaaattcggtagaatcatgaggtgtgtaattacatatgcaagtaagttgatgggcgtgatcgtcgtgtcctaatcttcgaatttaaaccatgcacaaggtagttggtggtggtgcatctattctgttagcgatatggaatttgaacgtgtttcttatatacactttagtgtcgttgtagagcactaaaattcagttgtgtgctactggtattttactgtcctgattttttgtcgtagtttacccactcacatatatcatcactgaaacgtatttcagcgtctcccctctcttccacatctctctaggcctgtaggatggtggcacgcggaaaccaatagctaacgagagaggagctagacggtatcaccgagctcgagtggtgacggagacgggaaagctcaggttggccttggttgtcccgtcctcctaggttgatgttgccatgtagcgacggccttaggcctacggtatgggactaaaccgaagaaaatgcaacgacgcgtgcactctgtcccgtgttgacagcccgcaggcccatctccctgttctactgtagctaccagcagcccattagtaatttcttccatcgccgtagccaggaataagtcccactttgtctcccttaactagtgaccgaatctaatccatgtcagtgatatccggtattgtggtttagggatatagattagattcaaccactaattaagggagtcaatttggacttattcccatagccaaccaaaactgagactatccaaataaaggaacaatcgatggagcctgaagttcagcccagtatagctaagtttgcggaggaaagcttcggcccagaatagacccatcagaaagtttggatcgccatcaatgtcaggcatctaagttaggcccatatacaggacaaagacaactgatggaatgcaggctttcggcctactagcgttgcgaacggattatcttgcgggccgagttggcccacagcctagagaagtagtatacggcattaaccaatatcaacgtcacccgttagatctaaaatgaacggttcagagtgaccaagaaacaactagtcgcaaagcttgttcggaactcacggtcaaaccgtggtgtgtacttgctagacatggcatgggacccgagtggatttgacgaacaagcactgctggattactgttgctactttaatttgtccacctcgatcgttggaacatgtcgatcaatgcatggtcgtcggccagccgatcagtacacttagagactgttgccaaaataaaccttactaaattttggtattgtcaaaatttttagtaaggttgataatgttgccaaattttagcaagatagctatttttgaatgtggtcactttgttgccaacgtatattctaccaaattttggtcagtactgtgcagttgccaaatttctggtctttttaccaaagtttggtaagaaaccaaacatatgcataattttggcaactttatcagaaaatggtatggttagaaatagcatcaaagtgaacaagcccttatcaaattgtcgacgtttgatgtcgcgattccggtatttgcatagtatagggatcgttggtaccagggtatatgcgagattgaggtaaaagagatggagacgaggatttttatataggttcgggccgctgaattgtcaggtaataaccctacatcatgttggccgaagccggtcgttgctcttattcaccataattacaccagtacaatatttggggtagcatatttaactgttgtcaatatggcggccataaaaccatcccgtagtcgacaacagggtagtcttccttcttgagttcgtgcccgacgagatcagagacaatgctatatatctcctaacagtatccgtagacaccgtaaaggactagccatgcttatttctgaagtcgatatccgacgtcttgtcttggcgtatgttggcttgtatgttgatattgtgtcttgatctattgctccgtgtcccctctcctcttagggggtcttctatttatacccataggtgtccccttatccaagtagaactagggaaaccaatatagatacaatccgagtagtcattgtcgtttccatgtagaactctggttgtctttccttatccggaactccttccatatccgaagtcagttcccgtataagacatggtatgtggtgagtcctgccgagatttagtcaactactattagctattaggtatgtgatatccataacctgatacaaatctagttagtactagtaatctagctccagcaaacaaatcgatcagtagatctcatctcgttgttacgcgcgtggattaagatattgcccccagttgacagcggcatggtgaatctgtgatgattaccgcgagcaaggagaggccggtgcatgccaaatctccccgatttcacagcatcgcgtggcgcgatctactcgatcgatcaaacccccccagaaaaagcaagtcccaatgccggtgtacgtagatcgatcaacgccatcactgattcactgtactgtactacttgcgttacgtacattgcgagattattcagacaagacgcagcatgagcctgcagatgtgcagagtactagctactaaactggtccctgacgatttcacagctagcgcgctcgctgtttgcgcgatggatgcagtaataagctggtagcttttcgcctaccgttcgtcgtcgcgcgctggtgcgtgtggtgtggtgtagtagtctcccccacaccgccaagtcgccaacgccggtgaccagcttggcgctttcactgatctctcggcacgcagtctggccatccatggccgcctttttctcttttccgggctttttgcctttcacccagtgtgcctttaccgggattgccaaaatcttttcagtaatcccatcgtgcatatccatacgtacacgcctggctactacaacgtacggcgactatgtatatatatatgcattgcaacaatttgcaattgcgattgcatgcgtgtcagagatcgccggaggccgtacgtacatggatatgtctggttcaacacattctctcttctcgctggccactgtaattccaccgaaaagtagctcatgcattccctgttctgatcgatgggcctctaacgcgtcgcagccttgttgtatcattgctgctgagtagcaaaagaccgaccgatttgacggtccccgacattgcatggtgtgtcacttgcattgcaccatgcatggtgtgtagagacgacagacactcccctgcaggcaatggacatggcatgggaggctctagctgaatgacactacaaattaaagctatctaagcctgagtacgtgatgaccagtgtgaccaaggacacaggaccagtgtagtccatgccacaagctaagcttatcgatcgatctatggatcctgatgatttgctgtaactaaacagtaaaatatgttattttgcaaggaagcatgcacctcgttttcctgactgtacccagcaacttttgcacgagaatgatgtgtgtcactctctgtatcattagctaagctctgggatgatgggctttacttacctgcaggtagtactgctgcttttgctgatatattgccgggggttatcagggtttcaggaaagccatgttgtgtactcctacatgtaatgtgttcatagagattacagggtactgctgctacatatgcagtgtggaggaatattttttcagtgcgtactggaggtctggagccatggctctgttgatgtgcagtatcctgttgcgagttcaacgatagatggaggcgctaactccaaggtcaacctcagcatcaatcattctgggtctcgctttcgtttgcatgctttgccaatcatatatactagcatgttgccgcttcatcgatggcagatatggaggtttttgatggtctcctcatcgatagccccctctctgcctgcggctaacctagctaaatatatagagcaaatatatatggcaaatcgatcttagagattgcggacaggaatatacttttctgtgttttgctttgctttgcttctagctaggtctatatgatcatgcgcaatcatatatgcaggtatatatagatggagttgtgactagctagctagttatagagagaatagcacacaatatgcaatgcattcagactagcagacagcaaagtaagcagggtaattacttgtcagacgaagactgtaattttaacacactacaaagttcataaatatttcatttgagatatgactatatgagtcgatcagatcgagcttcatatatactagaccatatatagtacatataacaaagatattttttttttatattctggagcaaatatgtaactacatttatgatggccaaatacctggtcagatcttgatcgcaacagagggggatcagcaagcttgctgaattaattgatcaggtcaagtcgttaaagcagacaattagcagtaaactaaatatacaaaactgagaacaaaactcgtactgtagctagctactctttagcaagctcacatctttacgaggaaaaactgtattaattagctaaaacatcatttttctctctaaaaaaaggtataggtcaatgtacaagtaactggaattcgattggtattcacaaatcacacattcacgcttgctttaaaaggcattgtaaaggaagattagttttcccatatatttcttgtcagtcgtcgtcatgaatttcgacaggaaaggtgaaacaggggagctttagctccatgcgagggagaatttttacctttattacagctcccgctttttcgtgaatttgatgattacgattttacgaatgctgacgcctttcatcaccaatctacacattccctgtcgcccccatgaaagggcacgcctttaattctcgactgttacctcgatatctcacacaaaacacactcaaaccctcgctgcctagctttatcgccttctccccgtataaaaacacgccaagatcacgcttgctcgcttagccctagctacaacaatctaatctatctctgcttccaattcccatacaaagctagagctaactctgagttaaactgcgacattacacaatgaggcttcaccatctgcatgtggcctacctggatcacaaagcgtcgtcgtcctcgtcgtctccggcgccaccatccatctccccgtcgtcgatccccggatcggccgccttccctgctttctccttcaaatgcctccgcccgctcgcgcccaagatctcgctgccggagccgaggaagatgatcgcgccgccggacttcgtcgtccctcgcgccagaaacgcttccaagctgctcaactacactgttagacacatcaaaccctacttgttcttgatcgatcgatcgatcaggttcatgatcgtgtatatatttggtttgcaggtgcaggtgccggcggcggggacgacgaggtggaacccgtcggcggagcagataaaggtgctggagatgctgtaccgcggcgggatgcggacgccgaactccgtccagatcgagcggatcacggaggagctcggcaagtacggccggatcgagggcaagaacgtcttctactggttccagaatcacaaggcccgcgagcgccagaagcagaagcgcgccgccctcctcaccctcagcacgctcgacccttccttgctgcccgctaccgctaacgaaaccaaagtaattaatcagcaaattaaccgaattttaataatccatgaatctgtagacatttctgcccggctaatagacattttttgcgtgtatataggaggcaccggagaagaaggagaaggacgtggaagatggattggcgagctgcaagcggcggtgcaaggcgtggggtgacggcgccggcgatggagacgcggtggtggcgacggaggcggccggcggctgcaccgacgaagtgaccctggagctcttcccgttgcatccccagggaaaagcttaattagctgcatgtgcatatatgtatactccgtcgatcgtctgtcacgcatggtatcatcatggattggccgggttgatgttgattgtggaaattaaattccctcgtctttgcgtgtgcattgtgttgtagttggtcgatcgtgtgtttggattgctttgaacatataatgcattgtgttgtggccgggtgcttgatcggaagaatataatcagtagttccaaactggaattagcagttgctcatatacatgcatgaatggtgtagagatcacgcaactatatatgcaaggtttggatatgctaattagggcttacacacgcgcatgcatttcaccaccggttattgatatacgtacttatcatatattcacatgtgtatgacatcatccaggcatgtaagggtgattgctatttttaaaaggtcaaagacacaaacaattaagtacatgttcatatatcaacaagtcacgtcaatctcataacattatttcatactccctccatttttttaaatatggcgtcgttgatttttggacatacatgtttgaccatttatctttatgtgtagatacgaaaaacacaagttatgcgtgtaccttcaatggaaaaaataaaataaataatagttgtgttttttaataatatgaatgatcaaacatatatctcaaaataaacaatatcatacattaaaaactaattgaaatactagttagcgtacttggagattattgatgcccccgcctccccttttttacttaatgggaaataaaaggtgcatgtattatccatcgggtttagtagtcctttttttatggaatatccatgctagcacaaatcttaatgcaaatcagacgatggaaaaatcaagtttttttctaacggaaaacttgtcgacgttttattaagcaaaattgttatccaaaaattaaggaaaacggcatgtgtctttgttaatttattacgctatatgatggacatatatatatatatatatatatatatatatatatatcaagcatactatttcttatgcaaaaccaattaatattggtattgagataaactaactagtatctaggaacaaatatatagtaaaaaaacaatatttttttcaacatatcactgatccctcgataacaaaaacatataattctggtcacgcggcggttaaacagtttttattatttaaaaacacatattcgttctttttgttttagtatgaggatcgccttttcagataattttttgatatatgaaaaatcatcaagtagatctgtctgtaaaaatatttacataaatttgattttatagagtcttatggatatatttcaacttaatatattagtgatttttttgagaataatatattagtgattttaagtgaattaaaatagcatatatcatagttaatgtttttctatgaatacatcactcgaaaacaggtaatggttaaagatgtgcagagtttacagttttgcatgcagtggagtagcaagtaaaaatgactaatacaataaagtcatcaggtgaataatttaacaatatcgtggacatagattgagatcatgacatcggagacttttagggggacccgtgaatctgtaaagttcggcacattaggttttcattatgattcttaattaagctctgttaacacgtggaaggaagcgcgtgtaatccggccgcgtgtaagcgtgtttgtgatattgaacagctgaacactcgacagctaagcaggtctggccactttgtttggttttacataagtatgtcggcttaatcaaggtatagttgaatccataatacagtgttttgcaggtaattaatccatttcataagggaaaaaccagtacgtagtacgcaatacaaagtactttctgatagaatcgtaaagtgagaagttcagggcctgacatattttgcacactgcaaaatcatttctatgcttgtagcctacgcatgtttcaggctttatgagccaattataccatggcctgagcagcccttcgactccagctttatacactcctcgtcccctcctttaaacatctagagtgacatcatactcataattgcgtaaaacatgcttcctatgacaataatttagagtgtgtcagagcttgtatggcactgttgctgcgtactactcctaaagacatactgaatgaagttctgtaggagtatatatatcaacaaagacgtactgaatgaagttctgtaggagtatatcactgtaactaatccttatgtacagataatgtggtttaaacaattggcaacaattttcttgactgcaggagatggacacattgaccaacctaaatttctatgtatatatacaaaagtgatttcatcccttaagagaatatccattggtttattacatatcatctaatagtcaattgattgttcttaaaaaataatattaaaaaaataataatacagattaatatgaaatatatcactccacgaatatgccagttcaaaattaacttctacatgttgtaataaaataataaatataattgtaaatgtgcgttaattattttcagtataatttgtccttttgttgcaagttgtagaaattggatttagccttgcatatctgtggagtgttttattttatattaatttatattgttaattttttaattatttagttgatatgaaaaaaaagatatcctcttaagagatgaaaatccatactcgtgtatatattagtaatattttataatgcacgcagtcgccgcattcatccgggtggtcaaagggtgagtctgacagaagtatacataccctgtgtttgtgtttgtaccactgagattgagggctgcaaaacctgcaaactcgcaagttgtactttgtcacatgcacgtacggtacggccgcgctatcagctacacgcggaacgcgttgcttatagataaacagttgcccttgcttaggcaaacagtttcctctgctctgatgttgtgctctttgaacaacaaaatacccagaaaaaaaggggcggaaaagcgaccgatctcaggggccggacggcgcgcggtgtggatcgtccacgcgcgctcgtgggcagaatttctctcaacgaacgggagatcagatgtacggtggcgcctacgagcgaacgaacgaaaggtgtgagaaagacacgcgcgtgaggccaaggcattgcacgccgcctgatgagaaaatcaaaagacgatcccgcgcagctgcctagcagcagtagcagtagcagagcaggggaggcaaaggcttcagcgagtcgcagcgtatgcaccgcatggcgtcattggcccccgcccgcctgtgcggtgtgcgcccgggccggggcggcggccgtgtccagtcaccggagcgcgcgggggccgcgccgtgatcagccagccgcggtgtgggggtgggggagagagtatggtgcatgcgaatgcggtgcactaccgcttttgtcgctcttttccgagactcccacagtgggcagcgtggccggctttcctttctcttcgtcaaagcagaggagaggcaggcaggggctggccggccggctcggggcgcatggacgtgcgcttggaaaacgacgacgatggcgacgacgatgatgcaggtggtggcgcccatgcatgcgatgcatatgggccgtgtcgcacaggagcggcaggtcccgtcctgtcgtgtaccgccgctctggctctcgcttgcgcaggggcccctcgctgctgaagtaacctttttactgtgcagagaatgtagcctgtagcctgtaggtaggtcggcttgggtccttgatgtgtgatgaaatggggttcgtccatgcttctgtactacaaagttcttttgtgtgggagcaactctcgttatatcggagcagtatcgttgatattttctccgagtattatttgtgttccattccatctgagtaatgcagaggcatatcacggttcaccgttcacgagtatctcaaacgcatcgacgattgctaattagcacagctatgttgccaacggatacttctttcctcttgaatcaggggtaggaaaaaaataatactccttttcccacttattctaaagacaagacgaattcacgaactcaaaatgtaatcattgttatacgatgtggtatattgatatgaatatgctccgtgtcttgctacaggataggaccagcttatatagcctccagctctacatatgaagctaaaaacatacccaatgacacacgagaagttactataatgtgccctaaaatagttaagaacatagatatgtgcttgagtggtccctaagactattggcatagtttgtagaagtggttgaagcaacccccgtgacatcttcttaaggaatatttctcgttcgctggtgtaatcatcaagtttcctttcccccttatcgaatagcatgtttctcttgcaatgtgctcgaacactattctcctggctggccaacctttgcatctgatgacatgaacgcctcctattcacctatcatgaaggctcgagaagtatttgccttggattaaaacataacatgtgggtgttagaaaccgtatttcggtccaataggagatgcgatgtttagccccctgctacaacacataagaaactttcaacttaaattatacgaaactttctcaaaacttctatattgcatttaaaattttaaccaagaatcataaaattggcatttaaaaatatgtgccaagaatgcagctacgctaccataatactacatccgtttcaggttataaaacgttttgactttgttaaagttagcttcaagtttaactaagtttatagaaaaaataacaacattttcaacccaagacaaatttattatgaaaatatattcaattactgagttaatgaaactaatttggtattataaatattactatattagtccataaacttagtcgaaattgaagtagtttgactttgaccaaagttaaaacgtcttataacctgaaacggatgaaatattttctattgtccatgttacgaccgtttctcctcagtttttgcacgcacatttcccgaactgctaaacattatgtttttaaaaattttattttataaaaagttgtttgaaaatatcatatcaattgatttttaaagtttatttaactaatgcttaattaattacgtgtcaattcattgttccgttttccttgtatatgggagaatttcccaacttcaaccaatgaacaggcctaaatactagtaacaattttgcatcgcagtgccattttttgaagggaacttagctatcacctcgcactttaaactaggtcaaatcttggccagtattgaactttgaacttgattcatagttaggcccagtatcaaaccgttgtcggcccgagctctctgttcagaccgtgcgaagcagaaggaatcaaaccggcctccacggcccaaccacgctttctcccctcgcaagtccgcaacagattcatcgaatttttttcgttttcagatttttttttaatatttacagaaataatctatcggtaaaaaaaattgcaaaaatagaccctgccgctccaatggtgagcggcaagttgacgtggcagacggtgggtcgaccgcgccgtctgtcgccgtcggccaaaattgcgattaggccgggaaggggctaattacaattttggccgcccataaaaagcttgcggctgtactttttgcatctggg

SEQ ID NO: 78961 - DNA, 15535 bp, Oryza sativa
gtttggcgtcgttcccctccttataggggttgtttagcatacccctttcttttccctaccatattctccgggtgaaaaccttgcttcggttccgaacgagcggtggcggtgatccacgtcgcatcctccttgggggcaccgctttggagaaacctcttcgtgcaaggatattgtcattgatctatgcattggcttcgaacttcagtcctaggctttgacgaggccttctagctccacattttgttttgcttttctcagtttgggtcatttcttctcttgtttggtgtgttcaacttgtcttgaactacactctcttctggagtggatctttataataattggctgtagttctttttgagcaaaggccgggatattatatttcattatctaaaaaataataatccgtcattacgccattcccaactcaatgactaggatagtgtccatagcattaaataagctatcacctaggatgcaaaataatgtggcaagtgaataactgagaaaagagaaggaaaccagatcttatatgaaacatggtttctacacaacattcaagacaacatgtgagataggtagaattaaatttaagtatatagcaaagtggtgtttgcattggaagagtagcgtctagtactggtttcttgataatgtggagtttataaaaactatgtttaatgtcttgggtggggaatggccttagcacatgtggggtatttgtagcacttatgactattcatagactatttagactcaaaagattcctctcgtgattttcatgcaaactgtgcaattagttttttattttatctatatttaacgctccagacatgtgtctaaagattcaatgtgacgtttttgggaaaaaaaatttggaaactaaacaaggcctaaatcgatgcgactgatgatgtaccattgacaaaagtatatactccctccgttctaaaatataagagattttagacggatgagatattttctagtgccacatcataaactagaaaaatatctcatctttctaaaatcttttaaatttgagacggtgagaatagatggacacgaacgcgcagcgcacagacaggtacaattgacgtactccatccgttttcaaatacaagcattttatatataatataaaatatatttaacgctccaggcatgtgtctaaagattcaatgtgacgtttttgggaaaaaaaatttggaaactaaacaaggcctaaatcgatgcgactgatgatgtaccattgacaaaagtatatactccctccgttctaaaatataagagattttagacggatgagatattttctagtaccacatcataaactagaaaaatatctcatctttccaaaatcttttaaatttgagacggtgagaatagatggacacgaacgcgcagcgcacagacaggtacaattgacgtactccatccgttttcaaatacaagcattttatatataatataaaatttttggtcactgattccaacatataaaattcttttattctaaacaatttagaattgaaacaattgtaaaaaaaaagcttagaaagggaattgaaacaatttagaatctactaaaatttagccaattaacctttaaattttaagctttgctaaacaaactaaagatgcttatatttaataatattgggaataaggccatgtttagttcctacacaaaaattttataccatatcacattaaacgtttaaacacctatatgaagtattaaatataggctaaaaaaataaataattgcacagattgcgactaatttgcgagacgaatcttttgagcctaattgctccatgattcgataatgtggtactacagtaaatatttgttaatggcggattaattatgcttaataaatttgtctcgcggtttaccgacggaatctgtaattaggccctgtttagttccaaagttttttttccaaactttcaactttccatcacatcaaacatttcatacacacacacaacttttcagtcacatcgtttcaatttcaaccaaacttccaaacttcagtatgaactaaatacagccttagttttttattagtgtccaaacactctatacaacactatataatattcgatatgacacgacaaaactttataacctagatataaatgcacgccacgaccagtcaatatcttggaatctgtggtcaatcatgcattcatgccgctcgtcgtacggtactctcgtcgtccactcgtctccgctcatcagctcagctcacagcctcacaggctcgctcccgtgattgcctggaaagaacaacaaagaggcggtgttcggacctctaggttcctaaccatctctctcattttctacacctacgcttttcaaacagttaaacagtgtattttttaaaaaaaatttatatacaaaagttgcttaaaaattatattaatttatttttttaaaaaaatagctaatacttaattaatcaagcgctaatgtattgtttcgtttttcgtacgcactgttcctgctggaacgagcaccagcgcatttttttcttctaatatattgacgtgcaatccttttacgcgttcgcgaaaaaaaaagcaccagcgaacacagccttaacttttcttcactttaatctaataaccatttaaaagtgattggcttttggaaaacaaaacgaaggaagcatatgcggggataagtccattttacaccctttaactcttcattttgtttcaaattcatcctcaagctcccgaaccaagcatttaacaccgtccaactatcgatacttggtaaattacatttctgagcggtttataggctagttttggtaccgtaggatgccacatatcagggactcagggctaactttcttctcttctcttcttactctctcgcacgggcgcacctggtaggcgcattgcctcggtgaactcgcatggcgtgtgccaatgagcggccgctcaccaccggcatggaggaatggcccccctactcctccccgagatcgaggcgctcatggaggtggagctcgatggagacggtgcactagggtgctcggcataggtgcgggaagcagatcttgagtaacggaacttcatcagagccgcacccacgtggcaaggaggagaggatcgaagccactgtccacataagtgattttttttatttttttaattcaattaataaacctttaaaaatatttctcaaaactgaatctcactgtttagtctttcatccaaacataatggaacataatggagggggaaataaatgcacgacacgtcgatcatgcgtgaactgtggtcaaatcaggcattcatgccgtaagggctgttggtcaaatcaggcattcgcgcacggtactctcgccgtcgactcgtctccgctcaccagctcagctgaaaggctcactgtcgcgattgccgggaaagaataatacaaagactaatagccccattgattgacttaaagcaaaagctaaaatttatatttttaaatctaattttaaagttaaatttaagatattttcaatgtaattttcttttagtattagcttgatatataaagttgtacttataaattaatttatattccataataaaccattttgacttattaggaaatatgagcgatcgataatactctaacttttcttcactctagtctaataaccatttttgaaagtcataattggtagtttttggaaggaaaaagtacaccaaggtccctcaacttgtcatcgaattataaaatcgtcctccaaccacaaaaccggatacaacacatcccccaacttacaaaaccagtgtaaattagatcccttggtagttttgaccctagttttgtccgacgtggcagctgagtcagcgtagaacccacgtgtcagcaccatcttcctctctccctttcctccacagttcggctcggcagtgggcaggggcgcagggcagcagaccggtgggggaggcgggagaccggcgacgggcgacgaggcggcggcggcgcggcacggcctcccgcgcccgccctcccacgccgccgccaccgggggaggagcttggcgcggccgtcgggggcggaacggggctcggccggcggggcggagctgggcgcgggcagcagctgctgcatttccgctgccgccgccggccgttgtatagctaccgccgcccaccattcttgctgccgtcgcccaccgtttcgccaccgccgctcgacgccgcgccacccccttcggccacgtgtcgccaccaccatcgccggccaccatcgccatccaatcggtgctgggcatcgtgccactgggcgtcggcgtcatgttcagccttctcttcgtcgtcttccccaccactcgccatggcatcggatatccagtcaccaacgctactacttagttacatcatctctcatgctccgtcatttgctgctttttgcattgatcaaagtattaattacttcctatttaatataattacttcctattcaggaaggcgcgttgcggcggcgagagaatgctgggactgtacgccatgtcaatacaacgcgtcggtggatttctattggtcgccgttgcaggtggaatccaactccgaccacccgctgcgccaccgcatcgccgaccggatcgtctgcgccgcctccatcaacaagcccgccgcccactggacccacgccgacgtcttcgtctttttacttctacctctggtggcaacgccccgccattgaagtcctgtgagttttagctagtagtagcaagcttgcacgcatggacatggatgcagttgatctcgctgacggacccatctcgccgccgcctcagccgccgaagaagaggacgccatgacgatgcagtacaagctagccaatccaatcgtcggcgttgttgtcgtcgactcgtcgtgggcgaaagacggcgccgctgcacggacgaccgttcgtgtcgtcgctgagcagctgcagtgcgccgcggcagtcctcggcgacgtacggctgatgtcgctattcctccgggcgaggggagtttgggtcacacgacgacgccattgccggctacgcgcgcgcacatttggctctcccctcactcttcctccagatccgctcggcgcagttgacgagcgtgacaggcggcggatcgggcgagagcggcggcgggcgagagcagctatggcaggcgagcgcggtggcggtgggcgagcgcggcggcggctgctggtggcgccccgtcgccgcccaaatccggcggcgcccgccccctgctccgcttcggccgccgcccctgcttcgcccgcgcgcccgtctcggcccgtcgcggcgtcgcctacccgctgaagaagagagaaaaagggaataaagaagagatgacgtggcatcctgacatgtggggccatgtaggataaaaccgggataaaaaccaccaaagaatctaaagtgaacggttttcataacttgagggatgtcatatattttttcggttgggggacgattttgtaactcgatgacaagttgagggaccctaggtgtactttttcctttttggaaaacaaaacgaaggaagtatgcttgaggtttttgggccctggcgaggaatatgtaattaaagtttttctttcataagggaccaaaatccagtagctcgtatttcccagtttaaaccagctggttaagcaaaggcccagcccacgtaagcttatctggacgggccaaagtcccagcttattcacaatctggcccatccacacatggaccacaatctggtccatcaaaagagtaactatagtacacaacagttttttggttgaaaaactttcagattgtatatttaactaactaatcgtcgggtaattaatcgctgaactgtagtctgtacataccttggcatccattggctaggtaagggtttccctcgtatcctttggagcaattgcaccgtgctcggccgtaaaggttcccgtcaacagcgtcgtcgatggcgctgtgcacgctgacacatcgcgtccattgagagaccctggtgtcgtaccagaacatgtcctgatcgcggtccatgtccagcgaccactccagcaccgtcgggaccgccgtcgagtcggccagcttccgcgggtcagcgacgaagccgagctgcagggagcgttgctcgccggcgaaccactcgccgtcggcgatgaacgccgccccgtacgaccccacggtgaccgacctctgggtcaggtcgttgaggtggacgccgtaggacgggaggcccctcgccaccggcgtctggcagcagccgaagccggagcagcttgaggcggcggcggcgtccctcggcagcgcggatcggaccacgcacagcgcggcgcagacgctgatgtagtcgtcgtcgtcgttggcgacgaggttggcgaggaggttgcagcccatggcgacgaaccggttgtgcctggtcgacaccgccagggagccatttgccggcaggccggccggccacgagccgttgagctgccgcggcagcgacgacgaggagtccgtgcccagcatcctggtggcgactctcaccgtgccggacggcagggagatgtcgatcacttccacgccgtttcttgcgaaacgcagcttcggtggtgcagcagggtgcgtctcgtcgcaggcgagctcgaagccatcgcggaagcagccgtggccaatgccgaaagggtaagggacggtgacgttgccgcaggtctcggggcagccaggcaaggctaccggcgcggccaatgctgtcactacgagatgaaacagcagagccccaacaacaacaacaaccatggtgccaatctttgcagggcatgaggaggaaagctgcttcatcttgctcttgcagagatcgagctagctattcgattcggtatttggtgtctttgcgtggagaaatacctcttcatatataaccatgatatcattaaacagccagatgaacgagaaacctcgtactgaacttgtctgaaattgttctgttttgtttaatctttcgaagagttttgggcgcaggtgcgtgtcccatgtgagataaagataagagggtaacatcataagatggttgacctatattcatttttcaaatgagatgttataaaaaataaacttgaaagggtatctcggggaattcattaatattaattagttggcttcacggtttagattagcaaatgatctggatgccttccatttcccctggaatggacagacgacacgaccattacacgacgtgctggtagtggtgctgctgtgctgatcaggatatgctagcttttttttgttttcgggatatggtagcttatttgagcagcgtatgatattccaaaatagtcccacttagcgctgacttgctgtagtaaataagtaaggtttcggttcgaagtcaagtcgccggcgatgatgtgccgaaatttgatcggccgctaatttcagaaattcgattccctggttgaagatagacaaagacggcacgtataacttgcaagcaagacataaatcactttggactaaaaggtcaagaaaatcaaaagaaatcgctttgggcttggtgttggcgtcattttttaaaaaatttattttttaacacaaggcaagaagattgccttagagcaagtattataagggctcatgtgttgtccctaaaaataccacataagattggttgaagaaagaaaaagataacatgtataactggaaaaatatacagtgcaaaccacaaatatagtgaaaacatgaaaattttcatttggatcgaaaaataaacgtcaaatattcgtccacgtcaccctgagtaaaaaattttctctcacaagtaaatttgtgagtaaaagttttactcataatgacgtggacaaatctgatacgtctttttttaatccaacggtagttttcaggttttaactatgtaatttccaccacatattccatgtataacttgcaagcaagacacaaaatcgctttggctaaaaggtcaataaagtaaataagaaatcgctttgggcttggtgttggcgtcattcttttaaaattttatttttttttaacagaaggcaagaagattgcctttatatggtgctggcgtcttgggcttggtacaaagtaggctcgccttttgtgtttggggccggaaattaaagtactctctagcttggtacatgaagggttaggccgagcctcgtacttctcaggcctttgtggctttgtgggcttggtacatttgttgcttctgcggcgtctggcagcagccgaagccggagcggtccacggcagtgcggagcggacgacgcagcgcgcgccggcgcagacgctgatgtagtcgccgttcgatcggtgcgtacgcgccgacgagaggttggcgatgtcatttgcccttgtagatgttccaaaatagaatatcacgtcaagttttaccaaatatcacaagaaattaggagaactatattttttagccgcttaaaatatattatattattaaaacataaaaaagggaattatgttacttttattatttttaaactatcagtgttagtatggcataccccgtttgcctgcacttgctatcacctagaatatcgcatttatatccttatatagaaagatattcatgaggatgatatagacaaggggaggggcatcggatcaataagacttacacccggctacatcgggaggaaacccttctgctagccgctgactacaatttgccgcttggtctgtcaagattagtttggtacgctagactagctaacttgcacctcttttctactcggtgtgagatacaccagatcaatacatataaacacaacacaagtaaggctattatctacattaagagtttgaacctatataaactgctatctttattacctatacttgaatatatatcactcgtaccctacgtctctaaatactgtgatcgggtataaaccatcgacaaatccatttcacggtgaaagttacgtgcatttctatttaatgcttttaaaatactgaaaacaatgccatatttatgtgtggctaagaaacagttccttgaaatattttatttttaagctgcacatatattttatttttaagctgcacatataaacctttgaaactgctgcaatatactactgtagagtagagcgagctcaccaacccatttagctcatctttcagtgctctatccacgttttccacaatcatccaagcgacggtaaaaggtatctgtaattctgcagtggtaataaaagtcatcttgttttcttcatcagtaactcatttacctcaacggcgactctcgttctgattcagtgaatttcagctccaacttggctgttaaaacagtggcagttttaccgccctttggtactccgtttgacatgtaagctctcaatcagatgcaactagttcagtgcttcacaaaactagtagtagtagtaggtacaaactcttatccggatcaagtttaccatcgctactcgctagccgaacagagtccccaaactaatcaaacagtttcactgtttcagtgcaaaagcagtcagaattgtgcatgagaattaaaggggtccagcactccagcctccaagtgatttggccactgcctgctctttttacaacttgcacgtagtagaagaacattaaagttctctcatcagaatcaatcagtcgccactgcctatagactagcataaacaccggacgctgtcgtgatcatgcgccatggaagcatgcacgtcgattgcagcagtggagctgaccggcctcgtgctgtttactagtcttggaactccaggccaaagttcggcaagtgcatgtgccattacagactgaagcgccgtgatcagtgccagaatagttttccatcaagactttgcaaccgccaaatccaatatttaactgaatttcagtttaaccatatttgattccatggacgatagtgctcctctgcctagtacttaaatgtggattaaaaaaggatacagtgacgcagaaatggtttcaatttcagatgaaagtgtctggtttagtggttatctgcatctccttcatgggttctcctctagttaggctgctactactatcacctatcagtaccattgtatcagagttcagtaaacatttaagtgaaacaggtttcagtttccaaaagaatgttcaaaaaaaatttcagatggaataagtgaaggcaaaaaaatggcattggaattacagacagacacaaagtttgggagatccgaagccatgcatagagtattgtgaaacaactatgagctttgctttgcttatagctcatgtttaattggagtatttactccacactccaagcaaacatgcagcatgcctaatttgttgacatcggtcagactcgctacgacgaacggcactgctgttcacacctgagttaaggactagcagatggagatttaggtctcataattttgtaaattatcgccttattggtttctgaagtcgcaaagtcgcacgttaaaccccattttgcaaacctggacccgcatatgtgggttgcaccttttgaaaccacgaccaaagttggactagagaaatgcaactatgcaagtggctggatcttgcttgattctgatctactagataccaggcaacaagggagtagcagcagcatgattgtctcaattatcaccatgaataatcatgtacgtacgtatgaccaatacagccttttcaaacctgttgttccgcatagtaggtcagtagtacaattgtgaacttctcaaattcaaggcatatcttcgtctgctctgccatggctataaaacttatttagttatgtttagttgttttttcttgttatacagaattatacaaagtgaatttggcatgtactgaacttccttagtgctagtctgctagacatgtggaactaagctacataacagtgtaaagttttatatttttgtgtatgatagtcacgccaggtaaaaagtgcaagtatgttgcagatcgtagcagcattctgcatgtaaactaagttttcatcacacttctcattccgtgctttctggttgtagtccactgagttaaaaacaatggaagacaaggaaagccgacgcactcgacaatatccaatcggtagcttgacagaaactgacagattggagaagcatccagtaacctcatcagcactagcctataaatcccgccgctcatgtagctctccttgcattgcagagttcagtgtaacaaagacactgaagctacagcctacagagagagagtatctggatacttaattgtgtgcttagcttgcggttaagcaatggcttattccaggcaaatcttcgtctgctctgccatggctgcgttgctcttctctgctgttgtttcggcgcagctctccactgatttctacgacgagacatgccccgacgcgctcgacatcatcgaatctgccgtcagagacgccgtttccaaggagtctcgcatgggagcttcgctgctgcgcctccatttccacgactgctttgtcaatgcaagtctcacacaactcacccttttaagttcagttttccttctcgttttctagtccgacctttgaagtagatgtttcaatttcgaaattcgctagtcgctacagtttacttacttagttactagtcgccaaacattttatattcagatgatttttcccgtgttcataaatcataatagatataattcagaagttcagagtggatgctgacgggtcagttaagcaagtggtgtgcatgcagaaagcgcgcgaaaagtctacttaaaagttaaccttttcaaattcgaaggactaaccattgacctcaaaaacggcgcgcgcgtgcaggggtgtgacgggtcagtgctgctcgacgacacggcggccatcaccggcgagaagaacgcgaagccgaacaagaactccctccgcggcttcgaggtcgtcgacgacatcaagtcgcagctcgaggacgcctgcgagcaggtcgtctcctgcgccgacatcctcgccgtcgccgcccgcgactccgtcgtcgccgtaagcaccagaccggccgatcaccactccgatccctgtatttttgatgaattgatcgggaacgaacgaactgtgtgcagctgggcgggccgacgtgggacgtcgagctgggccggcgagacgggacgacggcgagcctggacgcggcgaacaacgacctcccgccgccgacgtccgacctcgccgacctgatcaagtccttctccgacaagggcctgacggcgagcgacatgatcgcgctgtcgggcgcgcacaccatcgggcaagccaggtgcaccaactttcgcggccgcctctacaacgagaccaacctcgacgccaccctcgccacctcgctgaagccgagttgccccaaccccaccggcggcgacgacaacacggcgccgctcgacccggccacctcctacgtgttcgacaacttctactacaggaacctcctgaggaacaagggccttctgcactcggaccagcagctgttcagcggcggctccgccgacgcgcagaccaccgcctacgccaccgacatggccggcttcttcgacgacttccgtggcgccatggtgaagatgggcggcatcggcgtcgtcaccggctccggtggccaggtcagggttaactgcaggaaggtcaattaaagtggttgataccgtgatcagtgttaatgtggttggttagtgtcaggtttcttaataccgtgatcagtgttaatgtggtttgtacaagtgttcttctttccttcagcgatgtagtctgcttcgaacggttgtagcactactatacgcaaaaataatctgatgaaggaacaaagactggttcctactgaaaaatcgtgttgcacaagaccttgttttactggaattattatgtttgtaatcaaatagagataactagaaatgagatgacacagttgcatgggaatgggaatcactaattagtactgtcaaaattgcagattacaaattgaatatcctacatgtacgtgttaaaacggctcggtgtcgatttgggccctatcaggctattaaattaggcggcccttctcaccttcgccatcttcttactacttgggccgtaattaatgggccgcactggattctgcaagaaatggcgatccaagagggttcggagaagaaaactccgagtctccgacccctcctgatcacgtacaaagagactgacgtcaagggcccaccagaccgctcgtcatctccagcagcgcgcggcctgcaaccccttgtcgtcttcgctgcgcctcctcccccgtcgccgcctcgccgcccgcgacgctccaccttccaatccctcgctgtctctctcgccgctctcgctttcgccttgcatttttcaaatccccaacccaaccaccaccaccgccaccgccttcctccttctcccctctagttaatccctccccacaccatgccggccgcctcaccacagtgtcgtcccactcccaccctcttctccccggccgcgcccgccgccgccgccgccggccgccgcgatgccggctccccgcttactccgggtgctcctgctgctcgtcgcgctagcctgcgccacgtcgggggtcgggtgctccgacccgcggttcccgcacctcggccgcgtccgggagctccaccgcggggagggtcgccccgcggccgagcaggaggccgcggcgcgcgggctcctagcgctcctccttccgtcgcactccgggagcttcgatttcagggtcatctccgcggtgagtagttttaggggtgggtaactgggcgtggcgttgcgtagtaggctacccggaggatcgtgtgtagtgatcgatcggcgagaatctgaagccagttgatggagcctgtcgcgtgatcgtggagtggttgttggaatgggtcatttgcttatttcgactgtaaatcgtgtttattggacaaattaatgcctaaattattttgcgttggtaaaatttgcatctggtatcctgtaatggttaggatttcccactccccggtacagtagtagtacttatctgcaaggactcacaatctgttccatggaatccacaggaccaatgtggtggaaaggcatgcttcattgtggacaaccatccattgtttgatggagaagggactccacaagtactgtatgtttctgaatttctccattttagcattcattttgaatcgtttttccaactattgtgtttgtatgggttctaggtgaaatctattttgcagaagcagaatgtagaggagtcttcatgtaaattatggacatgacaaccatactttgttttagctcactacaagcctattaagtttactattagtaaaatatccatttgtagagatgttagatgcactgaaaactgacttgcctgaaatcaaatttcccaatattttcgaatgtctagtttttcaccactcttctgatttgcgttcttttgtgcatccaaagtgatgctgactattctggccacagcatgttctgctagaatcatgcaccagcttctcatttaactagttaggtccactgtgcggtgcagaggttacatgccattatgctatactagttgaggcttacctacacattatagtggttcccctttttataagattctgctactatttctacatactgaaatcatgagctatacattcctttcatgtatttttgccagtttacttggaacaagtggggtagaaatctctgctggtcttcattggtacttgaagcactactgtgcagcacatgtatcatgggataaaactggtggtgcacaattatcatcagtgccacgtcctggctcactacctcgtcttccttctggtggcattttgattcaaagacctgttggctggagctactaccagaatgcagttacatccagttgtaagcttgtttttactttatgtacagttttaacactttatcctgctatattgccgaattcttatggtggatatgcatgccttcttaaaaacgttttattttcccactgttatgtactaagcaacattttcagattctatttgaaaatattcaggtcaggaatagtgctgcatttccatctcccaaattgatgtcctggattcaattgtttgctacccatgtttgtgtttgaatgagatatttcctgattgtatctctttgtgttgtactgtccggtgtgacttttagggtgccttcggtgtcgatcttttgttttattgaattttataccatgctaactttgagcaatttttctcagctgttactttttatggaaagtggaaatgattttcttaaagactacttttctcttataagattcttttgcttggtgggattgggagcgctgggagaaggaaattgactggatggctcttcaaggtatcaatttgcctcttgctttcactggtcaagaagctatatggcagaaagtttttcaggtgcgtgtgtgttctgctcttttattaaaaaagcttgctgttcactgatactgaatattttgatctatgcaatgtccgtgtgttcttagatcaaaaaatgtttaaactctgt

SEQ ID NO: 78962 - DNA, 21116 bp, Oryza sativa
gatgaacacttccccactgacaaagtgacaatagtgattccgagaaaccaatcggagaggacgcattcgatcacccgacaatgccgagagcgccatgatcagtaggagatcccgacgagggcaaccatggtgtaggcgacgagctcctcccgcgacctccgctcgcctggcgacaacgacgacgagcgcccgtagccagacagctgcggcagctgcaccctgcgccgcccgctcaggaacatccgcatctcgccggcgaggaactccgccgcgccgcggagcgcgacgcagacgcgcggcaggtggcgcgccagcggcagcacgaggttgaacggccacaccaggaacgagtactgcaagaacgcctgcaggaaccctccgcccgccgccgccgccgccggcacggcgagaagcacaacgtgaacagccatctcgatctccaaactccgagcctctccagtttagtttccaccactgccgcgcgcttacatatgtgcgggccgtcgtggcgtgcgcgtggcctagctaccggccgtctgcctcggccatgatgccgatcagcgtggtggtggtgctctgcgcgctacagaaagggccatggcttggagtgggtgatgcctgatcgataccttgcttgctgatggagagatgcttttataattgaatccgatcggatgacggatcggctcgatcgcttgacaggtttggtaactgttaacccaaaccctctgccggttataaaaccagtcccaataacatgttagagatcgtaatgtgaaagaacgttatagaaaatccaaacgtgatgactacaccaagatatatttggtgagggagttcaattgtagtgattatcaatgttcttcctcgatccagtataattacagtgtgcctagggtatctatgagatcatgaccatcgaccaaagctaggctgaggactagttgtttctcgcctatactaccatcatcacgttattatatgtgtgtctctgtttaagagaggtctaagataaaagtccaacttcattattatcctactacttattacatgttttagtagttaactgtaatcgattttatacacataacatattcaacagattaaccctttacacaaatttttgcacggccggccgcccggccggagacctctcgttgttgcttgcgtttgtccaagtttggcgtaacggcgaaatggaattagtgagagacactgtgtcgggagatagcgagattcttggcatgggccaaccagccattggcatcgatctggaatttacctttctgggggagaaagtaatgacactgcctgattgcttgcgggcccgtacgcacgcttttgttctagtctgaactgaactgtaccgaccagctttacatccacatgcactcagccactcgctactttagcagtggtaccatgtccaaggtcactgaagcctggcctcttttttcatttggattattaagcgtattgttacggtaaattattgatttaattatagaagtgaattaaatatttttataaacaaatataacaactagttttaaaaaatggctaaggaatacagtaggaaaaaaatattttaagagattatattttttttgaaaagcaaataatccgttaataatctgataaataagctgaaaaaacaaagcattacgatagctgatcagtgatcacggatgtaaaagttcagatatgggcattgaccattctaagtatgaagttatacgaatctattaggccatcagcaatgggtactcttaacccgtgtctccgctcacggccgtctgcctcccgtcgctttttgaggccgaaccattccccagcaggggagcacggcgcctcgcaggggggcgcggctctctccgcgcctcgcctactttttcgtggggggtccgagccaggcaccacgttgaagcgtggggagctcgtggacacgacgccctaccccgatgtttccccttgtaccctcgcccttaaccacagccactggccgccggctcctcgtcctcatctgccgcgccgccgccggtggctcgccgttgaccaccgtgacgggaaagagagggaaagggacagggagaggtaaacggcagcggcgagagggaaagaagaagaccacatctggccacagcttgccgttgaccactgcgtcgacatgccagatccgcgcgtggctcccctgtcgtcagcggcgatggccctgcgacggcgacaaccccgcgacgagcggagggatctggctcgccgttgaccaccgcgtcggcatgccatatccgcgcatggctcccccgtcggcagcggcgacgaccccgcgatgagcggagggatctggcacccccgagcggcgacgggcggcaacgagagagagggagaaagaagagcggcggtggacgccggtgacgggagaggcgagcggtggcggcggagagagggagaggcaactgcggcttgagggagaggcgagtgcggcagcgaaaaaaagagaagagggggtgggagagagagagattaggggtagggtagaaaaaataaatatgggactttgtgggctgggatacccattgtgggttggagtgtctctattaagttgcttcagattttgaggagactatccagaggtatcctctattacgagctgagttcccctatgagtatcctcagttagtgaggacactctaggagtagcttacattatagatgcccttatgagccctcacttggccgacagaataaaaaaggattgaggctgtgttcacgattcttggttcccgagggaacattatgcacgaaaaacagagtggtctattagcgcgtgattaattaagtattagctattttttaaaaaaataaatagattaatttgattttttaagcaactttcgtataaactttttgtaaaaaatacaccgtttagcagtttgaaaaacgtgcacgcggaaaacgagggagaggggttgggaaaatgggtgccgaacatagctgaggtgtaatcggaagcagaatgattactgtatatcgcaatgtgatgtcgacatcggcaatgttggctttagttcacgctaaaattgaaagtttggtttaaattggaacgatgtgatagaaaagttgaaagtttgtgtgtgtagaaaagttttgatgcgatggaaaagttggaagtttgaaaaaaaagtttaaaattaaactcggacatcatagtggcatcttccagggcccaactacggatagcctgacacctgatgcacaacagcttcggtcgatgccaagcaaatgcattagcagctgtctactacgcggcaggctctgaaactaaaagaaatgaaatactctcgtttcattttgtagacagatcaacatcgtttttaagactggataaggtcttagctcgggtgtgtgtttaaatattggtctccctatatttaaagtgagtagcatgacattgcagttgaatttttgtgtagttttgcgtaccgagctagaacaggtcaagctggaagcaagaacaagattggatagttcagatatatctttcaaacaatgtagccccacaaggatcagtagacagtaattggtcgaaaaatcaacaaaccacttactcgatatgcacaagtttcgctatccattttgttatcatatatgccacatggtcgtttccccgcaatttttttggtcgattcaaggtacatgtgctggcctttctcggttcgagaggccacttcgattgcatttttggcctttcggcaaatccctggctgcatttgggatccatttgatctgtagatcatccactgtgtcacgatgaatcaatccaaatccaatcgatgaactgaaaccggcaagtttttccatcgtgacgtgcaagcatacttgttccctcaatcatgcctgcacagatagctacgttcgttgtacggtataaagatgttaattcagacaacagggacattcagctgtagaaaaatacgataatgtactggaatacactgaaatattactaagattcgttgaaactgtaacggaaaatgaagcaaatctgccacctgttactggtggcatcttcgtcctcaggcttcaaagccttcaatgatcctgacgctgcaagcaacaaaagatgaaggggaatgatggctggaatgattggaagcacaaatactgccgccgtgcaggacagctgtggcgcagggcagactgcacactgtacactccataatgctgtatgccacgatatattgctacagatcaagtgatcactcctgaactaattttcgcggtcctgttgtcgatagcattatggcatggcatagtgggcgggcttgccggccgggaccggataaatcaaggtaactgcctgtgatacaagagcagttatcctcccatgaaggtttttttatgtagccacagaagaatgaaggataggaacttagaaaccaaaaatcttgtgaaatactccctctatcccaaaagattgacgttttaaggattcttaagcaaattggatacatgtaaaaataatcaagttacccttattctggccctgttcagaggcactagctgccgcagcggctgcggcagcagcagcccagccgaacgcaccctctatttaatatgtgtggtcgttatttcagtgctatttaatttgaggcaaattaagtgaacatgcatacatgttatacttatgctgaaacgagagcttttgtgggacattttttgagatgtaaacgacatgttttgcgggacaaagaggctagtataaagacgaagtacaccaaatcagaactgatctaatgcaacctagggtgaccggcattgtatgcccgatctgacaacctatagtaacccaatctacttatgagcaactctttgcatgataattaactttaatgtatccaaatgtatctataaagtgcctcttctatgttaatttattaactcaattcaaaaaccaaagctaaaccctagttttcctgtccaaaagatactacatcttgagcctcaacttctcctctattcatacttaaaagatgactgcacaaaagccaggaatacactatctctttacaaatttggactcaaaacctacttaaatttagactccttttaaatatgaccatttttttcaattccaaacactttccatgtaagccatatagaagctctacctccacatatattgttctttatccaaaatatccggtatgatctccttactgatcccctcggtttaatcatgattatatcgccagcaacatccctgaagcctcaaacaagtcccgatatttgagaataagttctttcctaacttgattagtattagtataaacacagtatatcatacctatataaaataattagaagctataaacaattaaaaattaacgtgaaaaaaattactctaattacgagttaatcagtttgactgttgtgatggctggtctgacttgtcaagcatctctggttagatcgcctatgcaatgacactccaccaaattaatacctcttcataattctctcaataaaaatcattgcaaccaattgttcatgataaattaataatcataataatgatttcacaatgtcctgcttaaatcaggacagcaggacatcctagataatacctgcgcttgtgttagttttactctttattttagaaaaccttgtgttagttttactacccatttacagtttgtttcataaaatggtcacaccatcactaaaattgcggttgttttgctgaacgtagatggacgagttcagagtcgtgcagcactactgtcgtactgtgcactgatcacagtcagcgtaattggcgttttgcagagcggcaaagatattgcaaccgtgtcgtaactgtcagtctaagccgtctcagcctagtgcagacgcattctcgcagcatcaaaattcgcaacgttgagacgagattttctggccgtatttcacttgtatttacacaaaatcacgcggttacaacttacaaccagccctgaacctgatacggtgaacctcgcaatggtgtcgccacgtggaacaccaagagcagagcatcaagaaacaaaaaaagaatgaacccaaaaaaaaaaaaaaccaagaagaagaagagagaagcaatagcagttcgtcagcttttcagtaggagatgctgagcagcgcctggcggaggagctcgtccgcctctccgccgccgccgtcgccgccgcggatgcttcggctccagacgttgccgccgccgccccggcgcgcgtaggcgcggcgcagcaaggcggcgtggaagacaaccccgccgtagagcgcggcgcaggcggcgggcaggtggcgcgggagcggcagccagaggttgagcggccacagcagcggcgccgagaggtggaacaggtggaggaaccccctcgccgccacgatcgccaccaggtggaaccccataccacagcccgctcggccgcttgctttgctcggttgctcccaacccaagtttcacgagagcaagtcgtcgcttcgctgcacgctgcttgcgagttgcgagctctctcaagtagcagtgggcaactgggcatcattggtagtgcgtgtttcgtactcgcgggagctgtgcgtgtgatgtggcgtcggccgcggtggtggtggagggtggcgcgggtgcggccttccccagttgagggcgccgggcgcgggtgggcaactgggcacattgatggctgattttattttgtgtgatggtcggtcaaggccccccgacacggcaacaacgaaatggctaaaacggctgcaggtacgacgtgccataaaggacctgggatagctttgagaagcagctattggtagccggtttataagaatctggcttctgacttctagtttattttataaattctacaactacagcttctcagaatctggatcaaaagatagactgattgggaaagtttctgattttagaagaagctatagcagctagaagctccctcaaacaggcccagataaactcggaagctaaactagaagaatgaaccgtcgaaattaaccgttagcacttagcagctggctagattcggcgaattttacacagtttttggaatgctagcatagtaagcctcgtttagttggtaaatttttaaatttgattgtcacatcggatatacgaacatatatttgaagtattaaaagtagtctaataacaaaataaattacaaatttcgccaggaaactgcgatacgaatttatttagcctaattaatccatcattagcaaatgtttattgtagcaccacattgtcaaatcatgtcacaattaggcttaaaagattcgtctcacaatttacatgcaatatatttaattgatttatttttcctatatttaatatttcatacatgtgttcaaatatttgatgtgcgtgaaaatttttattgtgacaactaaacagggcctactactagtaagattctaggtgggcgtaaacatcacgggagcatctgaaccagcagtacactactggtgctagcgagcaagtgtcgtagtaagattctagcagcacaggcccacaacagaagggagcagcagaggctgcgcaggccaggccaggccagtatcccctgctgcatctcgtgtacgggccccgttttgagtgccatttcttatgggctttacatgggccatatttgcacgcgcgcggcccggcaacttgtatcctaacaatcattgtggtagacaattgttatgttctccatgtgaagtgaacagcagcagctagatataaagaaaagtggtgcaaacaacttaatgccgcaattgattccgcgtgcgccacagaagcagcaacatacaccccactcccattcccatatgacacccagagcacacactcccccaagaactttgcagtttaagtatctgaaaatgaagtccttcaacatgtactaggaggagtacaaggtagtagtagtgcgagtacgatctttttcgatatgcaaggccatatcattacaagcactataaacaaaccctcactgcacagaggagccatgttcaaaatataagttctcagagttctaagcactgggtattccagtactactttagtaagactaccaacagacaaagagcatgctgaaactaagtttaaaatcacgaaaacattttacagcatgctaaaattcttagctggaagcgaactagtcagagagatcatgaccccgcagccattcacctacattaggaactgttctactggctttttttttctgagcagatcaatgcatgcaacatcgaatggatcacttcagaattcagataatcctgccgacataaacccatccatgactaggaattgctagtaagatcgctgtcattgtctccggcagtatctgcttccttcacttcctgaatcatcttgaggacttgccaggcagttggccgactttcaggcgaggatcgaacacaggcagatgctatgtcaacaatcatagagagacgttcgacgtccactccatcgtccctcgcagactggacataggtctgaagattagttgcaaccaatactgagtgctgaagcggaggcttcccactgataagttcaaggaggaggatgccgaaagcatatatgtctgactttggagttagccttctgttggacttcatgttttctggtgctctataagcagcatcgtctttgacttctgatgattccaaaaggaatgccaagcaattgtccgtaagacaagcctcaaagtcagaaccaagcaggacattggaagacttgatgtttccatgaacaagtcgggatgcttggtgaatgtaagcaaggccctgcccgatgtcttcagctatctttaggcaggaagtccagtgaagtggttttgctcgagatgaccttgaacctgcagtgcacacaatatcaatacaacctacatctacaaagtatggctctaaggtacagtaatgtacagaggaatgtatttcaacatcatcgaatccgtaaattacttccatttatcatgccttaaaggaaacatgctattacttggaaaataatatgtccttgctccaacaccaacatatcaaataaatcttagtaacaactatatttgagctccaaactttcactaatgtttgtgcgacagcttaacttataagaatacccacattgacaaaagactcgaatttgagcaggccctaaattctacaacaaattggcaacaatcacatttcaagtagctagcattgctatttggtcatatcatagcctttgatgaactaagttcacagaggaaaatacagttttccttttgtaaactccatttgaccacccatttcgtgaattcaattgatatttagtactatagaacagtgaccacatataataccattggtccactctagaggctaggcacttggtgagaggctccaccgacgttcaatcccacccaacccggtagctagcatgatagatcaatgagcacttaagtatggctattcactatgtttactcagtccataaagaaaagagtccaatagatcatccccaaaagggtaaaataaagcatcacatgcatatgttcaatacaggcaaatagtcattctcctgccagatttatattcacgtggcccaagttctctaaattttaattccatcccatgttagttgggatgaagagaatgtctggttcaaaaaggtaatgctatcctagcacccaactagtataatccaatggaatttgcattagagtagatgtaacggcaataaccagaattgctcctagcacaaatgataatcacacaacctatcaaatttccagatagagaacaacaaaggctgcagggtacgcaccatggatgagagagtagaggctgccattgggctggtagtcatagacgagcagccgctcctccttcgcctggaagaacgcccggagcgagacgaggttgggatgccgcagccggccaacggcgtccatgttctgctcgaacgcctctgcctccagcgccgcggcgccgatcttggccgcgtccagcctcttcacgatgaccacgaggcggccgtcgagcaccgccttgtacgtcgtccccacgctcccgcggccgagcacctccgccgacgcgcgcatcagctgctcgaggctgtagctcgcgccctcgcccgcgcagaacgttaggcagccgctccgctccagccgccgcgccttctcctccggcatcatcatcgccgccgtctcctcgtccggcacgcactccacatagccgagatcggtgttgtccctgctcacctccgacatggccgcgctcttcttggggctcgggtatgccgcggagctcggccgccgacgcttcttgccccttttcattgcaatcatggcacaaagtagaagcacggccacgaacgctgcggcggtagccgcaacggcgatggcggcccgcctcctcagtttccgcgaacgcggcgtggatgaatcgggcaagctgatgtcgtcgcgttgcggtccgtcgccggtggccgcggcgctctgcaccgggggagcagcggagccgttgttgccaggaccgtgaaagaagaggaggtgggagccccggcactcacggcggagaacctcgccgcagagctctggattgcccgcgaacgcggcggcgcccatctgcgccatgacgggggtgaccggcacgggcccggagaagttgttgtacgacacgttcagcagcttgagcgaagactggttccacgccgggagggagccattaaagtggttggcgtcgagccgtaggaacgtcagatgcgggaacgcgacctcaatgccgggagggagcgcgccggagagcctgttcccggcgaggtcgatggagcggagccggcggagcgacgcgaccgaggcggggaacggcccggagaagcggttgccggcgaggaagagcgccttgaggttctcgagcggggagaggtccgggatggggccgtggagcgcgttgctcttgaggctgagcacccggagctcgacgaggcgggagagcgtggcgggcgcgaacgtcccgttcagcccggacgactcgagcaccaggcgggtgatctggccgtcggcgctgcaggagacggccgggtgcgaacacggcgacaccgccagagggaaccgcagatgcgcggagggatccgccttggcgaggaatgccgcaagcagcgcccccggggtcgccgtcgagaccagcgtggcgggcggtggcacggcccgcaccggcgcgcgaggagggaacgtgggctgcgagtgcgacccgccgcctaccgccgcgggcggcggccgtacggcctgcaccgggggaacagcgggcagcgtaggctgcgagtacgacgaggcgacgtcgccggcggcataggcggcggcgacgagcacgacgaggaggaggcggaggcggtgccgcatcgtggtgggcgcttgggttggggggttttcgggggggttgggtgagcggtgggtttcagtggagtgcggccgcgtgatgtggagtggagtgaagtggcggaagcggccggggtggtgtggtgggtgtgtgtgtgtgtgaggctcgggaagggagaggaggggtcagagagcggtcgccacggcacgtgggtggtcactgcagcttagtttcccgtgcttcttttggcacttgatcggttgatcgtttggagagcctgcaacgctgcaacgggtggataaagaggcacactttcgagtttaaactcagatcacggcaaccaattgcacgcactcatgctcaaagttcaaacattcaaattctaggaaagaaaaaaaaaacaaatccattgcaggtaacatatcaggctctacagaaagttagtactccatactccagtagtgctaatattcaggagcattttggttatccatctctggatctaaacaaagtttgagtacctacctcctcacctgaaaaacattctaatgtgctaatggtaggaatgtaggattcgccggaaaataaaaatactcgggagaatgtttgaaaaagagccgttgatagcgagcagccatccagtactataccgaagtcgacgtagcggtccattgttaatttgactgtgctgctgctgcctcctgctgctgctgcatgggtgtgagggcccgatcgcagttgatacctggggccacgaaattcaatcagcccgtgggacccacgtgcctgtcctgctcctcctccccctcccacggtggagtaaaagttacagtgttcttttgtcggttgatgggagcttcgctgtgtttcttcggggggctactgtgcccaccacacgttatcacatcaccactcgccaaggttccgggcctacagctcgatcggaaaggcccacagcttcaggcccaaataattagggagaaaaaaaactgtacaaattggggaataagttcaccggagatccctcaacttaacagcgagattttttgaggtcccttaaccacaaaatcagaaatgtgtacccctaaactcactcaaaccgttcaccggaggtccctcggcagtattttcgtccggttttgctgatgtggcatcctagtcagcaaaaattttttaaaaaaacaccgtagagcccacatgtcagttgcacatcttttttttcctcttttcttctccttctctcctcttctcttttcttttctctctcctcttctccttcaggctgtgggcggagcagccacgcgccgtggccgtcatcgtcgtcgccgtgggcgaggctacgcggcgtagcggagggcgagcgtggcaacgaagcaacggaaggtgcgagcgcggcggcgggccgagcagtggagcgcgagcaggccgcggacagtgtagcggagcgcgagcgcggtggcggagcggcggccagcgagtttgggagggagggggaggcggccggcgaccaataaacaatctcttcctctgcctcttccccttctcccgccggtgatgcctctcctagcatcgtcggccacccgcgggggcacagcggtggtggcggccgagcacgggggagctcctcgtcccatccactgtcttccgcttcgcctagctcgccttccgctgctttgcccaccgccgcgctcgcccgccgccgctcttccgccgcgctcgccttccgctgcaccccccgcatccgcactcctccgctgcacgtaatggcatatatacatgtgagtgtgctcagccatatacacatgcttggctaatatatacgtctgcatgttatcgggcggcaaaccaacaagaagctagctaggctatagctggtcgtctccatgcatgcatatatatgctcgtacgaagacgcatgtacatgcggccgtctgtacccagcgtatatgcgtatgagctacgacgtcaagtgctaccgcgaagtcggcgaagacggcgagggacaccgcgcccacgccgaccaccgtccacgacgccgatgacacgctgagtgtggacatgctcctgctgcagctgcgcgagctgagcgtccgggaggaccatgggatcaggccggcgacgctgccgccgccaccactgtcgctgccgcggcacaggaggagcgcgagcgactgtggtgcatcgtcagccggcacttcgacccacctatgcacggccactgcaacgcctggccgatgccgccgaatggccgcgccgtgtagcctcgcccacggcgacgacgacggtggagagccgacgacgacgacggccacggcgcgcggctgctccgcccatagcctccgctccgccgccgggctcgcctgccgtccactccgcccacagcccgccaccgctccgctgccgcgctcaccggcgcccgccgccagcctgaaggagaagagagaggagagaagcgaaaagagaagagaatgagaagaaaagagaagaaaaaagatgtgcagctgacatgtgggccccacgtacttttttaattttttttgctgactaggatgccacgtccgtaaaaccgggtaaaaatactgccgagggacctccggtgaacggtttgagtaagtttaggggtagacatttctggttttatgattaagggatctcaaaaaatctcgttgttaaattgagggacctccggtgaacttattcctacaaattggtagacgatcctgtttagaataagttcattttaggtacccacgtcttaacacgagtttggaaaacgtcagtgaaccgcaatatcagatctaacttgttcttaatcttgcaaagccaaggtagatagggttcgaagttaatatcgagggtagttttggctgacgtaaaactaacagcaaaagtttaaaattaaaagccatgttagacctagatgtcagtgctggactccaacgagactgccgccgagcatacccgcggagtcacaactccaatggaaggtggagcgtaagagaggttccatgttgactcaacctggttgactaaagtaagctcatcacgttagctaaaaccgagagcaatactatcttgggtcttgggatctaatgtgacccaattttataagattagggatgtgttgtatgtggtattttggttcagagacgattttaaaactcaacggcaagcgaggaacttcaagtgaacttttgatgggcagatgggccgcgagagatagttctgggccattttctgaccagaccttttgaagcccaccgatgtttgggcctcactgatgtttagtgggcaaaccgtcagatttcatgcccctctccatctggattctggaccagttggactcttctccttgtacttgcgacatcacaccgacgccgctggcgattcgtgttgccaccgtgcaatgcccaaatgtccgtgcatcgccgtcaactgtaaagcacaacgctgccgtggccaccatggaaagaagcgacgcttcacgtgctccggcatttgacaaaaaagagaacgttactttccgatcgattgctgttgatcgttgaagctatcaaattatcactagcatttcacgatctgcagcaatctacaaagtccaaacgtcgacctatatatatatggggcctattcagattggagaaattaaactgtttcatgttaaaatttcgtaaaattcctatgttctgaaggaggcaatagggcaattttgtttggatctttggggcactgcagcttgcttgctttggccgttgccgccaattcatcctatgtgaagtggccagcttcatgtttcagctaacacaatacagaccacgcaatttaactagtagtactccagaaaacacatcatttgccacgtgcgcttaattaataagtccatcatagtgggtaatacccgcatttccgcaactaaactgtttataccatgtgaaggaacagtgctgcttgggatgtgattgggcactaatctgactctaatgcggtctctgttgcgtgcgaaagcagcagagctgcaggtcaagaagaaacgactcgatcaaaaccagcgccccgtgcaaagtcgtagtagcacatggggggcccagtttggtggattgacgacgtgggccttcaatatgggcttaccgaccgggcctcctccatggcacagtcgtgggccagaatgcctatggtcggttacttcaccagactaatcagtgtgtgtgaagatgctgactgacgtctcagtgttaggcgcaccaagttgtaattttgcattggttagatatagggtgtttgttgttaagtttggtgcccctaacagccatgtaatcctttaaaaaaatacgcaagcacacaagtatattgggatgatcctactgtatactaagagctaattgtacaactaataaaatccaagtgcgctcatggtcttactaccaaatttcaggcaacctataaattagaacgttgttaaacaaatgcaaagtggagtgacaaatcaaaagcaccactgtttagcttatgcttatgcatataagtcaaaattaaacattaatacttattcttgaagttgattttaaggttttttcattataatttattttatagtgtttgctttttaaatcactaaagatgcatatttaaaagtttcatctaaaaattatgttttggttgctaataaacggtatcaataagtataagtataaacgaaaagataagaaataaaatcatgcttttctctctacttttctttttcttttttcctttaggagtatgatgggttttccttttccgttttgatattgggttatgttggttggtctgtactagaaaacaaaactggccctagccattttattcattcactcattcactcgctcactcggatcccattcaatcattcattcatgtcggattgatgccgtatactgacttgatgagctctgactgctcatgccataatccataccatgccataagagtagggtaacgagcagttgaccactgagccagactgcctcttacccgccaaaatataattactgtacggcccacttgttacgcggtagattttgaactgacgaagtccagaaagcaagcaaggacagatagcaacaaccctcttctctccagtctacagcctacactaccagttgagaaagaaaaaaaaaatctcagctcccagctcggcacgagcacgagcacgagacgacctgacctttctcttctccatctccaccccgtcccctgctcgattcccacctcttctctccagcccacgcgcccccgcctcgccacgacccgaatcgccgtgagatcgagccgatcgagcgtcgagcaccttgcgcgcgcgcgcggggatgaaatcccatggcagccgagacaagctacaggcggccgcgtcgtcgagccaccgccgcgtcctcctcctcctcttcgccacctgcttcgcgctagccacgttcgtcaccttcgtctacaacacctcccacttcgcctccgcctcgggctcgggcgcggcggcggactcctccggtggcggcgcaagcgccggctccggcaccggcgccgtctccgcgctgccgctcccggtgttcgacgcgctggtccacttcgcctccatctccaacgccacgcaccgcatgtccgacaccgacatccgcgccatctccgccgtgctccgcgccaggggcccctgcaacctcctcgtgttcggcctcggcgccgagtccccgctctggctggcgctcaaccacggcggccgcaccgtcttcctcgaggagaacgagttctacgtcaagtacctggagccgcgccacccggggctcgaggcctacgacgtctcctacaccaccaaggtgcgcgacttccgcgacctcctcgacgcggcgcgggcgtcgcgcgccgccgagtgccgccccatccagaacctcctcttctccgagtgccgcctcgccatcaacgacctccccaacgacctctacgacgtcgcgtgggacatcgtgctcatcgacgggccgtccgggtggaacccgacctcgccggggcggatgccgtccatcttcaccaccgccgtcctcgcgcgcaccggcgccaccgccgccaagggccccaccgacgttctggtccacgacttccagttcgagctggagcaggtcctcagcaaggagttcctctgcgacgagaaccgcgtcgccggcagcggcacgccgtcgctcggccacttcgtcgtccgcccagacggccggcgcgacgccttctgctccggccaagacagcacggcggcgggcacatcgtcggagaagtccggcaagtaaaaacctggccaagaattactcttccctcctctgctaattttttctctctctcctctcctctcacttgttaattatttcctgttacatatattttttttactgttttttgggggacaataatttgtaacacagtgatgatatcattgcatcaatagagaaaggaaaatgcaaatagaggttttacacaatttactacacttttcacaacaaccaaaccggcaaaaagatcttggatttgatgacatatctgggggttgatttggtaaaagggtttgtgatggctggcaggagagcgatgctacagtagatggtgcgtggtgggtggttggatcccatcgttttcgctttcttttctccttcgtgttggttgcgtgtgttgcttggtcaggtgagcaaaaagtggatcagctcatctcctcgtcgtattaacggcactattagtataggagtacaagtagtagcaaactagtcgtctgattgatctgacgaagatgtatttgtttgtttttggttgagtcatctgatcatcagatccgagagggagaaatctactaggcgttggcactaattagctgatgtcgtaaccgtggtgtgcttgtgggtttagctccgtcgtttcgtttaaagttaagttaaccgtattttgcagcaacgtccgatcgacctctcaacaactcttgtgtccgatcttgatcggcttctccggtaatggaaaaacaagtgtcgcctacgtggcaatgatcactttgataagccactgaccttagctggctagctggcaaccaatatagtcatgtgtatactctgtgtttgagcacatagagtatctgatttctgctggatcaattttgatagggtagcaatatctggtcagattgaccatcacacaaacaatgggacatcatttcagatctcccagcgagcaacctgcctgggagcgtaaataaccaaaatgtgtcaggcattgtgaacgtggtttgggacttggatattcatcatcaaaatactgcgcgccaaccggatagtgagtacgaaacagaagtctgaacattggacattggaggccgaatcagcattcgtactaaaccggttatttgtccgtccgggatctttcatatggatcgatttaactatttaatagcgactttgatatcccaccgttagaaattagaaaaaaataattaaaaaaaaataaaaaatttaaattaaatttttatattaatgtgtaattcttctgcgcgtttgcaagaaaaaataaattttatgtatgactagaattgaaaacagttgaaaattgtacctttttaaggagatgatacttcttggtcgggaatttctgcaacttttttatccctattgagggtttattcggttcggaggaattttacgaaaatttgaaagaagtgaactgctttacgtgaaaatcctataaaatccctgcgttttcagggagccttggacattgtagaccaaatagccatgcacgttaacatgctctcaaaacctttttatctcatgaaggcgacggaccacgttgcgagctgcatatcacgtaccatccgtttgcggttagtcgtcagatcagatatcggcgctgctcgtcttctcgctctcggtgcccttttgggatgagaacgaacgaaccactcgtaggacaattataaattggattaggctgcactgcagggtacaaatcgaacggaccaacagcgttacagcctttgcccccacatgccgtccatttcaggactttctttctggtgacattccaacaaccgcgaccctctctccaaacaggatgtcatttcaggctttcaggtaagagggttgagcaagccaatcccaagctttagtgatcaaccaggtccgtagcaaacttaataaatggattaccagctagtgatagggtcgttgcaacgatgtcattgtcaggatagtttaccatgttactgtcactaccttaataaatgaggaaatatcacaggtagaattttatatttatggagatgtaaaacattttcattatcttaaaacaattatattcagtagtaactttagcttgaaatggacgtgttggatttaccctatcaagtaatgactgtatttgcgttacagggtttgttaaactgtcaagcttcgcaaccccccgaaccgaatttccgttctaattaggttaggaagcaccagcttaaatatattgacctcgtaggcagatataaaatcgtactactccatattttaatgtataacaccgttgactttttattcaacgtttgaccattcgtcttatttaaaaaatttatacaattatcatctattttattgtgactcgattcatcattaaatgttctttaagtatgatataaatactttcatatttacatgaaaattttgaataaaacaaatggtcaaacgttggtcgaaaagttaacggcgttatacattaaaatacggagtaagtaccagtagaaaacaccacctgcttctggatggatgtaacggagatgtgttcttcattgctaattaggatatctccaaaacgggttcaacaaaactagaaaacgggttgagcgacccaccatggtcctgacaggaataagttagacatcatgtgcttggcgccacccagctctggagaataatagcatatggttccccttacctctgtgggtccttgatttgtattctgatacctgtagtatttgtaatcgcgtttcatgtgtgtactggctttgtgatacggagtactagtatagtaggactagttgttggatactactactactcctgttcaatagttaggcatggacccgggcggattcgacgtgacggccggacgagtggcgtaaccgcatggttgacctctcatcactcgctgttccgcctcatgtcacgcgttgggttgcctctgcatttccaaagcctttgaccgtgaatagcaaatgcatcactgcgttaggccccatttgcaccgacgggtcacaatacggcaatcggctgatcgacgacagcgtagaccggccgaagccgaaacaggcaaggcacgctcggcatcctctggccgcggcagcagggaagctgaacccatcttccgctggcgcgcgcacgtggttggaaccggtgtcatcaaacacaaactactaataacatttttcatgcaatcaaccaatttttatagctatcgataattatcgatatggagacagtaacggtgtcaaacacaaacgacaaataacgtttttatgtaatcaactaatttttataggtgttgatagttattatcggcagtgaagaaggtaacggtggacgtggtgagtggtgaccgtgcctggcctacccgggagctggctcgctgctgcacgtggtgaggaccgtgccatccgcccaccccacgctaggccgtttagcggcaaaacgtccgggcgtgcttgg

SEQ ID NO: 78963 - DNA, 543 bp, Oryza sativa
aaatcaactgtattgaagtctccacccgcggtgactgccagcgaagtccgctcgggagagccggagaggatcactgcggtgacctcccaaccagcgcggggctccgcgtcgtctccctcctgatccggaagcggcctggcctggtagtccactccgtgtggataccctaagaccacgcacatgccccgcagctccaagacgaagccagtcatgtccaaaccacgacgggtgacgctgccggccatctacaaacaaaaacaaaaagaaaagcaagatttcaaatgtcagattttgatgataagtgaagcagcaagacagagagagactagacagttttcacaaataacaaaggatttttatttttgaaaatattgctaaagggcttttgggggaaattttccccttttaaaaccggggccttttccggttccccttttaaaaagggggggggggggttttttccccaaaaaagggggggaaattttcgtttgatccaacttgtacgaccggaaataacccaacgggcgttcctgacgtgcgtgc

SEQ ID NO: 78964 - DNA, 714 bp, Oryza sativa
  unsure (1)..(714): unsure at all n locations
ccgtgcaatgaanatcaaatgtctnnnnnnnnnnnnnnnnnnnnnnnnnnnnnnnnnnnnnnnnnnnnnnnnnnnnnacttgataatttgttatagatccctggtccttagttctaacgttgtgcactcttacttagaggacctcttaagaaaacaatattctatatgaagaagcgaaaaaacggaaaattgaaccgcgctctgaaaactagaagtttaggggttgattttgcaaccctcacccctttccccaaaccctagccgccaccattcctctgcctcctctcctctcgctccgctctctttcctgcccaagcgacggccgccgccgggtgccgtcccctcatgctcttcttcccgcagttggcgaccttccccgcgcactccctactgagagctgttgctgtcgccgcgccgtcgtcctgccatagccatcctctcgctcccgcgccgcatccgccaacgaggaggccgggactgtcggatccggtgactccggcctcctcgccggcagatccggccgccctgaagtgaggggaagccaggagccgccttctactcttctacctctatgcccggcactgcccctatgtccctctccctatacctctccatactgttcatttccggatcagcggatgcctgcgattaggcggccacggacgtgcgtgtgggacgtctaggagacggggaatcactggatcccagtaggcg

SEQ ID NO: 78965 - DNA, 745 bp, Oryza sativa
aaaattgcagaccacgcaatttcaagtcctacaacatgaccaacaattttgtagcctttgtatagcctaatcaaatcttcggattttgccaatgcaagatcgacatgaaccattaaaaattcatttcctagctcaacacctccaactctgcgtgttggatcacaacttacaatagtggcaagagccatgtttgtattccgatttttccaactttttaagaatactttagttccaacctgaagtgcataaatacatccatcaatattatcaatgtactttaagaaattcaagtatcataaataatttcacagtaaaatacctccattgaattgtcagtgataaagtccattttgctgcactgttgtttctataaaaaaaaatttggatcatggtttgcaatttaaccacaagatagaaagaaagaaagaccaaacagagccaattattgttctccaattcaatcataatactagtgaatcatgcatgttatagtttgaatggactgatatttgtaaacatggtgaataaaaaaacaaccttgtatgcaccaccaactttatgtgcatgtaccatatggctgtcctgattgtcaggtttcttgttctataggggagggcaacaaatcagtgctaaaattatatatattaagaaattttactttcaaacttttctatcaaataacttttgaactcaataagaagtgaaaactaaccttggcacaaataatctccatctgtttcccatg

SEQ ID NO: 78966 - DNA, 2647 bp, Oryza sativa
ggctaagcacaatttaatcctaataaattttatgtgcccacaattaatattaagagattaatatcatcttaaaaaccaacgtggagggatctcaacttaaataggccgctataagagagcacaagttgcgcagttaatatggtggtgggattgccacacgtgcgtgcgtggtgagcttgagccaagggcatggcgtggctggctgctactctagctaacattatgttttgatggaaaacataaccgacggaggcactcattattccattactccttgattcttctgttcctgcggttaacagacagaaaattctatcgggttgattcaccgacggatgcgctcgttactctttgattcttttgttcctgcgctgcgcttaactgatcgggagttcaattggattgattcttctattcctgtattatgcatgcctctgtatctcattgttttttccattgctacgcttaacggccggggaagaattcaatcggattgattcttctgttcatgcgttgcgcttctatatctctggtaaccgcggcgttgctcttctgtatctctggtaaccgacggaggcgctcataactccagcagcaacggatgcggaattgaatcggattgattctgttgtcactcctgtaacggatgaagaattcaatctcgatttgattccttccggaatgttactctctcgcgcactatataactcctacctccgagatagacagagtagatacaactcctctcttcatcctctcactctattttcttcttggcaaaacactttgtgtcttctgttcctgtgttgcgcttctgtatctcggttccaagcacccgcccgcataggttctcaggacgagcgcctcgggatatccggccgcttgagtacctcccacagtttggcatgcgatcaagttcttggagagttcattgacacacgactgctctctgcactgcatcggttactttctttgcatcgacatgtcaaccggcgtcggcaatggttgaaatggcggcaaccggcacaatgctggaggtgatggcaccggcactagtggggccagaacggcaacaccgatggatgcatcaacactaacactgcctcatccagtaccatagcgttctcggggtatgtcaattttattattgtagtagtaaacatgcatgttactagatgatgcttattttattatcagtatattcatgtttagtactatcactagattattctactacatacacgtcatacttagtatgatgtttttctggattaaaatataccgattcatgactatatttccaacaatctaaaaacttgataggtctttcccgtacttggctttgctgcatcactaaaatttcatgcatttgatggttcaaactataagagattgaaaccacgtgcactactgtggttgataaccatgcaatgcttctttatttttcatggggcaagacaaccgaacgacctttctcgcctgaggaggaggctaagttcgagtctgcagattgcttgttccgtggagcattgatcaatgtattagctgacaacataatggatgtgtacatgcacatgccttcagggaaggacttctgggatgcatttgaggtcaagttcgaagtcttcgatgttggcagtgagttgtatgtcatggagcagttctatgactactagatggtcgatgtctgttctgtagtagaacaagctcttgagattcaaatactggcaatggatcttgagaacaatagctgccgaacaagttcatggcaggtggcattattaccaaattgccaccttcttggtcagactttgccacttctctaaaacacaaagaggcaagagttcaatgttactgatatcattagttctttgggtgttgaggataaggcgagagcaaaggacaaccgcggcaaaaaggtcgagagaactcttatgcatctcaagataacaagaagatttcaaacttaatactacaaccaattttaagaagaaatgcaagagaaaggcatagcgccacagctttatgtgcggtgagtctggtcattggaccaagaatagtcccgatcgcaaggacaaaagtctgcaaacatggttaaatcagtgatcctactatatttgtaaaatccaaacaagagtaataatagccctatctcaacctacgtggtagttggtaagctgcacgtctattcggcaaacatgggctgtaataaaaaaaatattgaagcaggtttggagacgatattaaatattggggaataagagacatggggaaagaaaaaaacttctttaaagaaacccagtccagtaatttattcctgattgattgacatgaccggatctgcaagacaactgatcacaccaaacaccatttagaagaactcagcaaatttcatcaaaatttatgttgcgctcgaaagcataaactacgaggacgtttgattaattgtccttgaccttgcacaaatttctcgtctcatccactactaagtgatacctacttaggggtgaaaacggtcggaatcggtagcatctgtttgaaaacgacgctcgatcggccggtaattgaccatattgatcttttacactacgtaatatcgacattaatacaatgcaaaaataaattagaaaaagaacaagaatcataa

SEQ ID NO: 78967 - DNA, 1242 bp, Oryza sativa
ttataacaagatgtatgccggttgccacaatgcaaaaagtgaattctaagaatgcatactatctgcagaaatgctatgatagattgtccagaatagagctagcctaatactattgtgacaaataggacttgagtattttttcaagcttgcaaagcctcgggcagttgcttaatcatgggatcatagtgacatgtcgaacttttgtttacgaagtttgcaattggacaactctagattcctagagtttcttcggttcaagaacagaacccacacatcattgctatgatgctatctttttttaattgaaaactctgctatgtgaatttcatgacagtgttttggtttatctagcgatgaagtgcagaaatattattttcttgatgaactgtagtttctagaactcaaactcagatgtcatggtctaatgaaactttggtgtccatgtctaatagagtatcaaaagcagcgacgggaagagccccatagtggttggcccttggggtggcacaggaggatacccttgggatgatggtgtatactcaacggtacgccaggtcatcatcacccatggtgcagctattgactccataaggattgaatatgatctgaaaggaagttcagtctggtcagagacacatgggagcaccgatggaggttctgaaacagataaggtctagtttactatccctgctgcagcttttttaatttttttagcaagattgcaacactccgaaatttgcacaaatttaattggtactgtgcatgtctttagatctatataataaatataagagatttattacgttccttgaggagctaccacattttttagtgtaaattttggtagctcttggtggctcctatgtgttgagataccaggaaacagttgtacctcctcaagtaccataaaatcactacaagtataaacacctatatacaattctggtaaagttggaagatagttttaggccttagctttatgtatgaatctcatgtttattttggcgcataaaatcgatgacatgctgacttgtttttaatgaagttggtaaaagtttatatatcaaaggcctactttgatatccattctactttgaagaagcataatttagttttcatccctaaaacaaaattattgattttatatgtataatctgcaggtgaagctagatttccctgacgaaatccttgtgtctgtaagtggctattacgggtcagtctgtggaactccagttaggggta

SEQ ID NO: 78968 - DNA, 3012 bp, Oryza sativa
ttatataggcatataagtttacatatctcataaaagtttttgaataagacgaacggtcaaacatatgctaaaaaatcaacggtgtcaaacatttcgaaacggagggagtaatatataagtgagggaatcccttatctcattgactagcttttggggtgggaaataccctttacgatcatataaaaacatacttagtactccaccagaagcatggccccataccacaaaatgtttgataataagcatcgtgatacatgaagcacatgaaaaacatggtgagcattactgctgatattcaaggcaaaacaaagaatataaaaatactccctggtttgatttgtgaaaaaggttaaaattcatggggggttgttctgcctgacatgtttagagattttggtttgcagtagctgggtcagtcttcgtcgtagtaattggtgtaggggtgttaaagattcaaggcccatatattcttccgtaatcatacctatccttgaaatattttagttaaaaagcatttaaaaattaaaaaaacccaccctattttggacccaaccctcaaattctatagtcctgccctatagtaaaggttgatgaggcacattaaattttatatagtcctcaaattttacgatattgcatgtactcatacacattaaatggaccggcgcttgagtatatttgcatagcctcgtcacgacctacgcagggcctgacaatctgtccgctcattggcaaataggcagcgataggtaaaacataatcatctcgcaaagacaaaaacaagaaaataaaaaaagaaaaacatatatattcagtgtccaagcgggttaattggagaagaataagaattaacggtgggcaatgcgagacatggggaaggaacatcgttacacatcagttgtaagcaataaagatggcattcctaccgcacatttgaacaatctcagcgacgtccaagagagctgcagttgcggaaagctgcaggcaggctcactgctgttcgtgggatttatgcggttaatgtctaggaacactcaaaataatttgcctgctgatgctacgtgctgaactggtgaacatgctgatcctactgattacaagcggtgaactcaattggttagtcgatttatacagtgtgttagtcgatatcatattggttagtcgagctcataagaaaaaaaagggaagatggtatagctgccgtttagcaccagaaagaatgtttggttaattagcttgtttcccccttctgcctctctgcttttcagcttctttactttatatactttatctatcccaatttaatcattccttaagcaaatgacaccaagagctatgagaccgaaatatctatcattttgaaattaattcttatcgatcaaggtgcaatattgttttgtgtccaacaaaaaattaatttacgttttaaatgttgtatgcacgcaggatatttcacgatgcaaatctactctttacataaattaaaaagagacattttggtaggtgatgatcatttgcagaaaaatctcaaaagtattagatgatgatcaaattggaatgaagagagtaccatataaaattatcatatctatctattatatactattatatactaaaagtccattaaactttctacaaacgctcataagccgtcacgtggcgctcctataaacgctcctagatcgccacatagcattgtttaatctacttaaatttgtggaatattttagaccattagattggatatattattttttaaaaaactaatacttttctcatgttaactgtgggctgggaaagcatgcaaacaaaaactccgtatatgttgttatgaaatatttgggtgatctcatccatctatatggatagagcagcaatccacgacggttggtcgtgccccacacctcttctcgcctcacggcgattctagcaacggacgcgatggttcccaaaccatcgcgtctccggttgccaccactttcccatctatatattgtaccgcattgatcaataaagattccgctcattcattctctatattcttgtgtgcaattctctctctcactcaatccctctcgctcaatcaatcttatacactttcaacacgttatcagaactttcgctctcgcgaaggagatctcgaagtgaaagaaagaaggaagaaacctcgcttttttgatctacaggaaaagcgaagaacagaaggtatgtctacctttatttccatcctcgatgccattctcggcatccctcgccatgatcacgcacgccgtctttgccatcttcatcgacgatcgacaaggaggacgcgccgggatctcatggtgggggttggtggccggcgccactaccctcgccgccgtatgtctgccactccgatcgtgcctgccccgctggtccctgacgcgcctactccttctccaccgatcgctgcaccttctcctccaataactgcctcgatgaacgccggacctcctaaccgcgtccaagtccagggggtacagtattgtaccacccatggatggacggcggtggcctctcccggtggcgagctttgcaccctcccactggagatggagtcgtcgccggctccgttcgtcgctgtctccgacatccccgacaccgcccccacgacgacgctgattcccaactcccacgccaccggtagccgctcagccacctccactgccaccacgccgaagtcgcttccccactcccgagccgccgggctacggccggaccgggacacttgccatgcgcaggggggaaccgccgctcttcactcctccttcgtcgcgcccatacgccggtgccgccgctgcgcgccgtcccgtcctccgcgccacgattgtcgttccccacggatctcctagccggaccctagcaaatggggtcatggggaactgcatccgggtccggccggcctccgactccaatgaggaggggggggtgacggcctaacccggccggcaaatcgccggcgaaccgagggatggctgcggcaggagacta

SEQ ID NO: 78969 - DNA, 5046 bp, Oryza sativa
acccaatttatcatttttttatatattttctatttttagcagcaattttcatttaagtccctgtgttttattcaatttagtataagcagttcatcagttatacaaattactatgtaatgttcctttagaccactgatgttatatgttccttaacatatgtgcttattaaataccctgctttactaaatttatttgttgtcttaataacatgccttttgcatattatttcaagacacgctctacttcctcgctttattaatttacaaaattctataaattttgtactttgatttagcaaattctcttaattatgtacaacatgattaatggaggatttaatgcgtgttcgactgcacattttgactcagaaattactcacatgtagatggagtcctacaaattggccacactggtcataacttagggagcgagtatctcgcccatcatcaagtggtctacattttgagatgattacccgatggagtcctacaaattggccgcactggtcataacctaggcagcgaacatctcgcccatctcacagaggtctacatctcacgatgattacccacatgtgttattttccgagaatatgttttgaaaaatgagattatttgaaatttggttgaacacaaggtagtggagtcctaaacattggctgcggtatattcaccagaatatatttgcctagagaccatgttctaggcagcaagtataacttgcccactattaagggatctactccactatttaattacttggagattatccatattgtgccacctaatttcgaattctaactcaaattgtcaggtctgtaacctacatcttcaaaacattacagaatatgaaatcttatatttcgcattgagattacaaccacaatatcatgtttttattaatttacatctgtaaattaataatgttaatcatgattatagggacatggcaactatagagttcgacgaactcgccctcgatgggagtaactacccaatttgggcttccgatatcaaaataaatttttcttctagtgggatttcacatacaaataaggaaccaaatgattgggatccatcagttgagaatagaaagctatatattgcccttttccttctgaggctttacatctataaatatctcaaacatgagtacatgttggagacaagccctgtcaacctatggaaatctctaaaagagcgttatgatcagaaaaaggaacttatttggcctgaggctaattatgagtgaattcatttatgcctacaggattttaaaaattgtggcagaatacaatcatgttgttcatagcatttgctccaagttgaagttttgcgaaaaagagccaacggaagcagagaagatagagaaaactctatcaacaatgtttctagaggacatgatactgaaccaacagtatcgcactcaaaggattcaagggaaattcctcgaataaccctaagaatctgactggaaaacgcaaatgcaacaaaggcgcaaatccaatggtcgacagaaaggtaaagggaagggtaaggcaccacaacctagtggcaatagcaacaagcattgcaacaggtgtggatctgactatcatgtcgctaaagattgccgtatcccaaaaaacatcttgttctcctgtatcagaaatccctaaaggagaaaaagtcttctgaggaactaagatttgaagctcacttcaatcttacaaaagaaagacctgaggttgaaagttctcactaggctccttgaaccagagaacaccctcgttcttctcccaaaggataccgctacactttctgcaatggatgacatgctcatcgaatactgctcaacggacccacttagagatttactgtaatctcagtgcatcccacttagagataaagctgctttactctcagtgtgtttgagacattatattgatatcctatagtttgtcaaaacaatattagttgtaataagtagataagtacaaactcccttatattataaggttgtaagacttgacagtccttagagtatgtactataaacctatgtaaacgtcatactatgtgtttgatgttttcattattgtatgtatgtatatattgtggataaagaattcttcactaagcaattcttctttcactatagatgtctaaggatatcgctccgattggagaggaattatgtcttgtggacagtggtactacaaactctatacttagggagatcaaatactttcaaactctcaaaaagagagaaggcaaagttttgactatcgctggacgcgatactgtgttagttggctcaggacgagcaattattacactcccaatgggtacacaaattacaatcgaagatgctttattgtatcctgattcaactcgtaccctactaagttatagagatatccgtcaaaatgggtttcacattgaaacccatatggataatcaagaagaatttcttctcttaaccaaacaaaacggatatggcaaacgcatttgtgagaaaattccatctctcacatcgggattgtactatacatacattaagcccattgcacatgttgtgtacaaagtaatttttcaaaatgttgatgcattccacacttggcatgatcgacttgggcaccccggtatcgagatgatgagaaaaattattggcaactctattggtcatcatttgatcactgacaaatttccaaaatcctctgatttcgtatgcactgcatgtgctactgggaaactgattttgagaccatcttatctcaaaattagagccgaaccacttaaattccttgaacgcattcaaggagatatctgtggccctattgtgccaagatctggaccgttcaggtactttatggttttgattgacgcatctactagatggtctcatgtgtgtcttctatcgacacaaaaccatgcctttgccaaattaatgtctcaaattataaggctgaaggcaaattaccctgaacataggattcaatcaatccgtatggacaatgctgccgaaattacatcccatgctttcgatgattattgtatggcattgggaattcaggttcagcactctgttccatatgtccacacacaaaatggtttggctgaatcgctgatcaaaagaattaaacttattgctcgaccattattgatgaatttcaaattaccttcgtcgtgttggggtcatgcagttctgcacgctgctgaccttgtccaactacgaccaactgcatatcatgaaacttccccaatgcagttagtacgtggaaatcctccaagtatttcccatttgcgtaagttcggatgtgctgtatgcataccgatctcaccaccacagcgtaccgctatgggcccacacaggaaagtggggatctatgtgggattcaaatctccgttgatcataaagtatttagaaccgttaacaggtgatctatttactgcccggttcgctgactctatttttgatgaggaacatttcccggcattaggggaagacttcaagtaccagaaagaatgccaggaaattgattgggatgcccaaggtattcccgcctcagacccacgtactactgaaactgaacttcaagtttagaaaattatacatttgcaaagacttgcaaatatcctgccagatgcatttaccaattataaaggtgtgattaaatctttcattcccgctcagaatgcgccagaaagagtggaggtaccaaataaaaccactcaacttccactgactaaaaagagaggaagaagtatggccactcagcaagaaacaattgctaataagcaaagaaagacggtaaatgcaaaccaacctttagttggtgcacaccaaattgatactatatatcaagcagatcgtgatagtctgcaacctagctcggtggtgcacaatactaagactaggaattcggaagaccatagacacattgtttcgagagatcacaatgaatctataagggttgatgaaattgccatcaactactctgaaactggagaatcttttgatagaagagctacaattgtcgacactaatttttctgaacaaattgctgattgcctccaagttgatccagaacctaggtctataaaagagtgccaaaagcgctctgactggaacaaatggaagtacgcaattgacgcagaattagcctcgctttacaaaagtgatgtattctcggctgtaatgcctactcctcgtggtatctttcctgtgggatacaaatgggttttcgtccggaaacggaatgaaaacaacgaggtggtgagatataaagcaaggcttgtagcacaaggttttacgcaaaaacatggcgttgatttcaacgaaacttactctccagttatgagtggtataactttctgatatttaatatcattggcggtacaaaattgtctatttatgcagttgatggacgtagtgacaacatatctttatgggtcacttgattctaatatttacatgaaggttcctgacggaatcgacatcccgaatcagaaggtaaatcgtaacatgtattgtgttaagttgcagaagtcactttatggcttaaaacaatcgggcaggatgtggtataaccgattaagtgaagaatacatcacttaatagcagaaacttgacatgagagtgaggtcactggttatgacaatctagcatacatcttgtcgtactcacgtccaacatatacgtatgatatctgccgcactagaaccctcccccgaacctaaacaagaaaataatacttgaaatctaatttcaaacaactacgatgctacatactaaaggaaacccactattacttccctgatagagaattcttaaaaacatgttgaaatcctattgtctctgtttttgccataaaattaaaattgctatatctaactttagcttcagacatgtccattgagactattttcaagacaggacatgatatgtcataattattgcaaaaaaaaggattaaatggaatgaaaaaaataataagttaatgccatacaatagaaatcaacacagtaagtaggtaaaagtaatttcatcatcatgccaagcttta

SEQ ID NO: 78970 - DNA, 1086 bp, Oryza sativa
tgggttccaatcaacaatttaatttagcacatagtgactataaataggacttagacttttggaaaaaaaccaaataatggaataggtcttagacttttggaaggagggagtacggaatgagagaattgctccttgaaatatgtgttgtgaagtgagaagctcctctacttgtatagcctgcatatgatggttgtaatggtggtttccaacgttggttcacttgtaactgtcattgagagcctatggggagccgccatgtggaagatggcggttagaggtgccaaggctggttccgtcgaattacctccaccgcctctggccaccgtttttattgtgtgtatgacatgtgggctcctatggcggttgaggatggtttggctccactttaggtcggttttgactgacgtgtggtgcatgccggctcatttcaactttattttatttgtttattccttgcatacatagtatttctccaagacaagtgggactacataatatacatgtaagaaatgttagttctcccttcatttattgaggtagttgacagtcaaaatcggtacttaataaccgtcatatcctcctaggttaaccaaacttctctattttattctataatggatttagatcggttaggtacataaaaattcattttccatagccaaaacattcatttcattgaggacagtaggacaaggaacaatagctcaggttcaagtagatcagttaggtaagtaactagattagttatgtcaatttgctggtattatgttgctctatgcaatatatttttttgaagaacgctctatgcaatatattcacaactctcattttcaaaccaagaacacttactggtttcaaccaacctgagccatctaacatggttgtaatcctaccatgtcttagagagcaaacaccaccagttgcatggaaaaaggccaagagcaagataagggaaagccactatgttctgttgctcctgacatgccagctatgggcacaaggaacagaaataagagtcatgcaatgggcactagttgcaaaagaaagattatggagtaaattagagatatggctagctgattaggt

SEQ ID NO: 78971 - DNA, 4710 bp, Oryza sativa
tggtcggggggcatataagccccagcccgaccgttggtatgaaattccgacggtttctctctcataaacatccacaaaattaggggggaaggttttcgacctcaaatctttgattgggttccatataaaaggtgtagagcttgttctcctccttcatttgcttccatttttgtcagttttcatcggtggaatacgaagaaacttgcacttttataaatggaatagtgtaggcacctttttgttttttttatttttttagcaaatacataatgattccattacatgtttataaaagtatttagtacctacattgaaaagttgggtttgcctctattaaatttattttcatttggatgaaaggatgattttttttcattttttagaaatggacagtattttattaatgcttaaaatcactgtgcggctatttaaatagttcgtaaaactttaaattaccatgtgattcgttccctccaatttaaatacattcgtgtttgaatcgggcatggatgtattaatgacaagctttattgtaagtcatggatcagacatggatgtacaacacgaaaagagctcatccaacgttcttgaaggaagcagccaaatttgttgagctcgcaaaggcacatgctgtgagggagaatttgaggaacattttttgcccatgcaaagtttgtaagaatgaaattttgctgcaagatccgaataaagtattgtcgcacatcgtagaatgaggatttaagaagggctacgagatatggacctttcatggggaagtcaatggtcgtaatgaagagttagatgatttctgttttgatgatgcagaaaattttattgtcgaagacatgtcacagggaaacatcccggaatacggtggctctggtatagagaatgaaggtattgattttgatctggaagatatgttgcggcacgttgaaccagagatcctaactggtacaagacgagggttggacaattgggaagcgttggaaaaagcagcgaaggagcttctgaacgacgaagccaaaggatgcgacaaggactattcggtcctgcgctcggtgctcgaacttctcagattgaaggccagacatggatggtcggacatgagcttcaatgatttgatggatcttttgagagttatgcttcctaagctgaacctgctaccgacgaacacatatcaagcgaagaaattgatatgtccattgtctctaggtgttcagaagatccatgcatgtgaaaatcattgcatactgtaccgcaaggaattcgcggatttagactcttgcccaacatgtgggacgagtcggtacaagacgggcaacggagcctccgatagagaggtggtcgacaaagatgatgcaccggtggatgagaaaaaaaagattcttaggatggtgatgttggtacctgccagttaaagatcgcctgaagcggctattttccaaccatgacgacgccgagttgatgagatggcaccaggagggtaggaaaaatgacggtaagatccgacaccccgccgatgttcgacagtggaaaaactttgatgcactacactcggaatttgcaaaggacccgagaaatgtaaggtttgcattgagcacggacggaatgaacccgttcggtgccctaagcagcacacacagcacctggctagttctgctaacgatgtacaacttgcctacatggatttgccagaagcgaaagtatattcttttgtctatccttatacaaggatcaagacagcctgggattaacatagatgtgtttctggaaccattgatggaggacatgcaagaactgtgggaggaagggttacgaatgtgggacgagtaccgtagggaacattttactctgcatgccatcatattcgttacgatcaacgacttaccggcaaacttttcgctctcgggctagtttaaggggaagttcggatgcctcctatgtatcgacaagacgtcgtacaagtacctcacctcatcaaccaagggtgtttacatgcgtcatcgtcggttcttacctcagaggcataggtggcgtgcgaaggccagattattcgacaatacagtagagaacgatctagctcctgaaacacgaacatgtggctctgtcttcgagctgacaaagaacattaaggttgtcttcggcaagccaaaaaagaagcccgtcaagaggaagaaacggacggatcaggaaacaactgatgcacctttagaggaaagtaacctgccctttaagaagcactcaatttttttcaggtatcttgattactggaaagacctggaggttcggcatgccatcgacgtaatgcaccttgagaagaatgtgtttgatagcaccattggcactttactggacatcccgagtaagacgaaagatgggttgaagtcccggaccgacctcgtcaatttggacataaggcatgagctttacccaaaagagctgccaaatggaaagatcgatattcctccggcttgctactcactaacacttgacgagaaaaaatctttatgtagatgcttgcatagtgtgaaagtcccgactggtttctcagcgaacgtcagaaaacttgtatctttgaaagatttgaccatttctgggtacaatgctcatgattgtcacaagatgttaacagtcttcctaccgattgctataagagcggtcaagccagttcacactcgattagtgataacaaagttgtgctactttttcaatcgagtatcacagaaggtttttgatcctgaagagttaggcccccttcaaaaatttgcaatcgagacagcgtgccagcttgagatgtttttccctccagcttacttcaacatgatggagcatctgattgtccacatcgtacctcagattatcgagattggtcccctgtacctacaccagatgtgggcgtacgagaggtacatgtccgtcctgaaagggtatgtccataaccgagctcatccggagggatcaatgatagaggggtacacaactgaggaggtggtagaatgctgcatagattacatgaaggacgccgaacccatcggtgtgaccccccctttacacgaggggcggttagctgggatggggatcgtaggcaagaaaatgttctatgatgaggactacaaagatgtagcggaagcacgtagcagcgttttgcaatagctcgccatcgtcgagccatacattcaggaacacatgaacgagataagagcccacaaccctagaagaacggccatttggatttgtaaagaacagaaacggaaatttcctgaatggttgaaggagaaagatctgccgttgggtgattcgctgaaggaaaaaactttgcgcaggctagcaaatagcccaactagccttgtgacctcatggcaagggtacgacatcagcggatataggttttacacgatgttcaaggacaggaaaagcgcagctcagaacagcggagttcgggtggaggcgtttgacgcatcaggtgagaagaagtcttactacaggatcatacaagacatttgggagctggactatggccttaacatacagatcccagtgctacgatggcaatgggtcagagacacaataggcgtattcgtcgatgactacgacctgacggttgtgaatcgtagcaagctaggacacaaggatgatccgtgggttcttgctgagcgtgttgctcaggttttctatgtcaatgaccctccgacgataagatggccattgctgtaccgggaaagcaaaacatcattggcattgatagcattgaatatgcgtcagattacaatcaatacgacgacgtccctttgttcacagattttcctaaccggatcaaggaagttgagacaagccttgacgaagatctgttttcgtgtgtgcgtaccgatggtgtttccaaaattgtgaaacattagtacatattttggagtgtacaacttagcttgtaaacaattaatggatgagacttattttgcgaatgaatgtatttctcactttatctggtcaaatacttgacttatattaatcaatcgatgatgaattatatgcgaattaaattcatgtgcttaattctttgtgggttgaaaaatattatttgattaaataattacttgattactttattacataatttatttaatgtaggttgaataatttgtgggttaattaacccgaactatttttaattcgtggtttagtaatgtacattaaatatatttaatttgtggttcaataattatatggattaattaactacaatttatataagatttattaattaaatgtatttaattgtgctatattatacattataattaataaatgccaactaaattaaaattttgcaaaaaaaaaatggtaggagccttcccgtgtgggccacttaagcctattatcccgtgcgggcgtattaggtcacccgcacaggatgcccatgtatatatagaggaggcgggtagaagggctgaaattttctaagtccactccaccgacgctgccaggctgctgaaaaatccaaccgccaccgccctcccaaatccccctcgccctcgccgctgccgcctcctctcctcctcggccttgccgccgccgcctctcctcgagctcctccccctcgtccccggttgccgcctcctcgacgccggccagatccgggccggcgccgcctcttctcctccccccaagtcgccctccgcagccaccctcctctcctcctcccctccccgc

SEQ ID NO: 78972 - DNA, 754 bp, Oryza sativa
  unsure (1)..(754): unsure at all n locations
gtgtggtgtacttcggtagaatgctcgcaaggtcggctagaaattggtcatgagcttctttgaccattgctctgaaagcggaaacgctttctcataaagagtaccagaacgaccgtgtagtgcgactgaagctcgcaataccataagtcgtttttgctcacgaatatcagaccagtcaacaagtacaatgggcatcgtattgcccgaacagataaagctagcatgccaccggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcgggacagaattggtaaagagagtcgtgtaaaatatcgagttcgcacattttgttgtctgattattgatttttggcgaacccatttgatcatatgacaagatgtgtatccaccttaacttaatgattttgataaaaatcattaggggattcatcagnnnnnnnnnnnnnnnnnnnnnnnnnnnnnnnnnnnnnnnnnnnnnnnnnnnnnnnnnnatcgcataacaactaaatctaagtggataaccacatttcaaattaaattaaggggtattctctataaaaaaaggcgggtaatatatacttttcatgaaaatatgttactctttatttaggggta

SEQ ID NO: 78973 - DNA, 11508 bp, Oryza sativa
gttagcctaaggattaatattaaagctcggctgtcagtacctttctctgtctgaacgctcggttcaagaatttcagctttgcgttaattactctacgtgcagattgaagagatcatagaaaatcattgacagttgcatcacatcttgttatgtatgattccacttgagatatagtactataacttggttgatttcaggtcaactaccgtaattagatttgatgtgcctccaaactcgacggaaaaccttactctctgtttggggaggttgttgtaactgtagtttctcttgaaattttcagctcagcttttcatccgaaatctaaaaatacgatggtatagaatctaagacgtaaactagaagccaacagttgaaaaactcaatttatccaaattctaattagctgcttctcgaaatcttcagctcccttgaacatggtctaagtcagatctttatgtcatgaatttgtggtggtctagactctaggatgtttttcttactttaacacattacctgcttttaattttttgcgataatacatcacctactttttttcgataatatatatgttcataaatcgctagtagacttgctagtgtttgtaaaccgtcggtaattgttggaaggtaatttttcaagaattttgcagggaaagataaatgcaggaatttctgcaaagtttgtaatgaaaaccactttttgcggttaacacctactctctctgtgaaaaaaaaacctagtactaaatatgatatattctagtacaacgaatatggatagaggtatgtccatattcgtaatgctaagatttgtcacgtctagtactaggttgatttttatggaaggaagtaagttgaaagcattataagtctaggggggtatgtccattgttttttattatttgtcttgaagttaacaatgtccgctaggcgtgcaatttatgatatactatacaattaacctctctaggtgctagcttcaagagtgtgtgtgtgtgaacacaaacacacaatttgtgcaaaaagtcactgtaccgtatgaactcaaaaccatggaacttgtatatcaattactcaaaatttgactcttccgtgtgacggtggcacaggttgatggtgccgtaccgactaggcgaggtagaatagcactgacacgatcgcgatgcaatggttggtttctctcatttctatatcagaaaacacaattcggctgacctgtcaggaagatgtcacattggcaattggcaagtgctagtttcaaattggaggcgcctccaatccattttgtcttgatggtccatgcatgtatgatggtcatacatatgtgttggaaccggttctcatagctttaggctgtgggtgcactaatctttcccctcctttccgaactcacttccctagttttttacgcgcacgctttccaagctattaaatggtgtgttttttaatttaaaaatttctatacaaaagcttctttaaaaaattatattaatttattttttaaaatagattagctaatacttaaattaatcaatcgtgtgctaatgagttactccgtttcacatgggtagggattagtcccaacaccaacgaaagaagacagcctaataagcaaagcattgccttctgaaagtatgagccttggataaagatacaatggcctactccctcggatttttaaattaatagatgacacaacattcatcttaaaaataatattaatattaaaactgtaagtcatactaaaagatttttaataaaaaaccaagtcagaacaaaataaataataatcacgtaactttttagtaataaaacatatgatcaaacgtatggcaaaaaataatagcgtcatctgctaaaaaacgaatggacaaacatatgtgttcatccgtgatgtcgaggctgaaaaaaaacgcataaactttttcgatactaagtagaaattctcactataggggcatatttggtttcttttgcttaatcaccgatctagtatagcttattcatgtttggttttcctttgcctaaccttggcggaatctgccgcagtagagaacctatccgtgcaaaagcagacaaaaattatactcctccgtgagtgtacatatggtttgatggttgtgaaaacgaaagggagaaaagaaccggaaaaggttcaggccgttttggggacagttcacacgcacgcagggccagcagccacagccaccaattcagcgcctgtctttagttcgcgaaaagaaaatttttaagtgtcagatgtcgaaaagagttttcggacacgaatgaaaaaaactaaattcataactcgtctggaaaccgcgagacgaatgttttgagcctaattaatccgttattagcacccccgcaaaaaaaaatccgttattagcacatgtgggttactgtagcacttatgactaattatggactaattaggctcaatattcgtctcgcgatttccccctaactgtgcaattatttttttaatctatatttaatgctctatacatatgtttaaagattcgatgtaatgttttcgggaaaaaattttgggaacttaaaccaggcctcaatctgcatgaacaaatccaggagttaaaaaggaaaggtgagtagcagtagcagtagcagtagcaggtagctgagggtaggcaacgtgcgatgcactacactctcacatcatctcatcatggttggttggagcagagcagtttgccggtggttcggctcaaaatcgatcccttattcgcttggccgcttgctttcatggtggctggctagctcatcaagcccccgtccccattgtgccggtcgccgtcgatcgggtttatgttatttcaggacgaaaattaaaaacatttcagcatcaaaatttcaggcaaagattgaatatgtcataattttttaacaaattgttgacgaccaaatttagcgttggaacgaatttgtagcaagtttgaaccaaaaattttaaaaagatggagcttatgcgagaagaccggttcaatcttctttatggtttgagtggcagtatgagtgtgatccaaccgataaaccttaaatccgatttcaattgttgtagatcccgtgtttttttttttttgcttggatccgaggttttcttgagttctgattgatttctaaacttactggaatgtacaaaagctctggttttactagagcaatccttttatgtggactatgaccagcttaattggaaacaatcaaccagaatttcacacgattaaccttttgaatgatgtttttcatgttccatctagttttgtccctacttcatccatatttatcgatttgcgctataaacgttcatctttatcatgagagcgcggattacttcgtaggtttcaaaacctacctttctgctcacgagatgggtgtgttatgcttgtcccaatttatctaagggatgtttgggtgggagggactaaatttcaggaatttgtaaatttttggcaccgattatgtgtatgtgaaaaccgtattctgataggttcagtttgttcatggggaagagggcgggagttgaccttctcgaaggcttaccatttccttggtgggttttgaaagaatatatttgactctgaactccttttatcagttgacaacatagtttagtggtcatactctcatagcatgatatatcaagcaaagtcggatttttaattcgacttttcttcactgaaattatatggtgctgcaccaaaagcatgtactagctaccgtgcgcggaattcaccaatatgggctgtattttgaccacttcacaacgatcattagtgagatatcaggtggaacttagaaagtataaatgggacaaatggcataaagtgttcatcatatggttctctttcaaagatgccaaaaaaaaattatgtgaccaaaatgagtaaatgcatgggatagtaggatatacagataagtaccattctttttcccgcatccaataggggtgcaatagtagggaatacttgcaatacatctaaacgtaaccttatacttgttattaataaactgtctaccaaccctgtatttctcaatggtgatagtaattaataactgaattaaattaaatagcacaaaagcatgcaatggttgaaggtaaagggaactgaattatattgcacaaaagcatgggatggtgaaatataatgtttcccatgatggacaaaatagcgaactgattgagtataatatagaatattatcaacatctgatgacacatgcaaatacaccggttattttcttccaaccatggacaaaaagaattgaagattagtaattttactccatttgagtttgtaagtttttactcacaggatgattcatcacctgcaaaattttgcacttgttctgtctctactttccctgatattttgtaattttgtggtttgtgataaaaaagaattccagtctattaaagaaaaataaaaacatcatctcctccatataacctagttagaatcttctcatgggagatcttctgacctactgactcactaccttcctttttgccctgtttttcaggaatgaccatttaataaatttatatgccttaagacttaagaatgaaactttcagctctcacgtgggcacaagatgctatgtaaaaatcaacttatcttaaaactcaagcggagcagttttagttggtctagcttttctacaagataatacaagagacgcacatgctctttacaaatcgacgtaccctaacttgcgaattcatctttccttctcatttcctgagatgatgctttttattaaaaacaaaagctctgaagctagagaatatataaatgtgcattttctgagggcattaatgcaaataaaaggaagcattctgagaacagcactatatatgcctacatataccagaccagctcttccaaaatgataacgcctttgaggatgaagcaaatttaacatttaggcaaacatctgaatcatataaatgatgttgaatcatatctttggttgtaagcgtggctcttttcctgttaaatatcttggtatcccaatgcattatagaaaattaaataataaggattggaaggtgattgagcaaagaattgagaaaaaacttagtagttggaaaggaaaacatttatctgttgggggtagactggttttgattaactctgtgctttcaagtctagctatgtttatgatatcattttttgagatacgtaaaggggttcttcaaaaaattgattattatagatctcgtttctttttggcaaggggatgattataaaaaaaagtatagacttactagataggatataatttgtcaacccaaagatcagggaggtttaggggtccataatttggaaatataaaataaatgcctcttgaataaatggttgtttaaattgattaatgaggaaggggtctggcagaccttattaaagagaaagtatctttataatcagtctataacccaagttaataggaaacaaggggattcacaattttggtcagggctcatgaaggtcaaaaataccttcttaaatatgggttcttggattgtaaataatggaagacaaataaggttctgggaagataaatggctgggtaacttggcttttaaagacaaatatccatctttatattctattgttcgaaggaaaagttctactattgctagtgttatgagttctgttccacttaatgtttcctttaggagagccttagttggccataatcttacatattggcatgaattgtgtacttctattatacatattcaatcgaaccattcttctgattgctttagatggaattatcatcagagtggtagtttttttgttaggtcaatgtatctagctttaattaataatggatatatcgaaagaaataagattatttggaagcttaagatgccactcaagattaagatctttatgtggtacttgcttaaaggggttgtgctgactaaggacaatttggcaagacgaaattggaatggcaatttaagatgttgtttctgcatgaaaaatgagaccatacaacatctttttcttgactgtcattatgcaagatttgtttggagagcagtacaattctcttttggtttaaaccttccaagtatcatatctaatatgtttgatgggtggcttatgggggttaataagaagaaatgtaatctcatacttgtaggagcatctgccatatgttgggccctatggttgagtaggaatgatttagtgtttaacaaatcaccatatactttatatatgcaggtaatattcaaggtaatatattggctccggttttgggcaaagctgcaaaagtgtgaagaggatggtgaacttatgaaggttgcatgtcgcaaactcgagacgacggtgacgtaactctttgcaaactatggatggagattcacaaatagacttgaataaatgtgtactctttatcttggtttgctttttattttgttgagtgtgtttgattacatttgaactacactctttgtatgagtgatactttgtaataattggttgtaactctgttgagtcaaggccgggatataaattccattatctaaaaatataaatgatgttgatatatatgctagttgaagctgaagttaacaagcattttactccaattgtctttccttttccctcctcttttcacacagtgccaccaaagatgttgatacaaagctaccaaggtgaaaaatagcatgctaacacatgtggattaaatcatagtaagacacgtcaaagccattgccatcagcacctgaaaacaggacaatggtagggtctataacgtcaagaatagaggccttgttctggggaaaggaggatgagctgaagttgttaatcaaacaaaacaccaatgggacagctctagatgctagctagctgaagaaaaggaaaaaagaaatgtagtttcaaattaagctacagctagtttgaagtgctattgtgtattatactgtttgagctctaaatcatggtcacagtcataaagttagtagtaactagataagatgctaacctttcttttcctggatggaacacaggatcccagctcctatggagaatgtggtaaggtggttgtcaattgtcctcctgaagatcctgccccagtgtcatcttctgacaaccgccgtagaattttaagagcactgagttctggatcatacgccacaaagataaagaacacaagagcaaccatagtagcattcaccggagcaacctccaggtcatgcaaggcgatgagtcatgattcaagtggttcaaccaagcagcatgtgagtcgtccgcaggtaagaggaaatggcaaaaagaaagtgttgaggtaaatagagatgattaacaagatatctgtgatcccgtatatcatggttatccttcgtattttctgaatggactgcttgacatcatgggccatgagaagttcagtccaaaactcctaatatcttgttctgaaagatgacgactgaaaaattgctatcgctacttgtttataatcaagctaattttcatttgtgtatgtttctaaaatatagcggttgctcacatttgtctgtattgcatggcatttgaacacatgttttgcaaccataatgtaaatagacaacccaccaatggagaaaactgttgagaattactacaattagtcacacaatagtattatgtttcagtagcatgtggcaatggacttcacttactagttagaaggtacagtaccgctgttgattcctcatttagggcatacaaaagattcctcagatgctatatttgtttaatcctaagttgaatcaaatcctttcgaccacagggcagagaataatccaaattatataagacatgggtatgcattgaataccacatattcaaatctctttaaaagcctaatttgctactgggagtggcacttgttgactgcatgtatcatataatctagtgttaaacaactaagaatgggttcatacgtaaccgtattgaatgttcaaattaaaaatgagtatagcaaactacatttgacagcaaaaatgcactgttttcagtttcacatatatggacaatatgggcaaaagtattcatatgaaagaatagtaggatcacaatgcagacatgagaaggtattcagtcatcatatgaacagtgaggagaagcagtacagccaacatcaaaaggatcttccgatccacaacaatgccaatactggaacactttgcctgaatctggagtatccagagtcccacccgcatagacactttcaaattttctcttcgtttctcctggatagacagagattggccattcagatattagactaacacaagcagacaatgttaactagttcaaaataaacaactcagtcagaatttctgtctaggtcatatgccaatagcccctcggatgtttggattttccataggaacattggactataaaatatccttaacacaatttttcccctcaggattatgttgggagaaaacgttatgcacccaattctactgaaatctcttgctaaatctcgaattcgtttctctcaaagaagccctcagctacacatatgaatagctcgagcaatcaaatgaatctgaaagaaactactccagcttccttccatttctccgacgagttcctcacctccgaagtgggcggtgtggtggcggcacgccgaggggtggttcgccgccgggtcgtaatgcttcttgcagttcttgcacgtgcgcagctcgggccctcctccgccgccgactccggccgaggcggccacgggtagccggactagccgacggcgcgtggcgagctgggcggcggggcacgcccggggcggagcccgtagcaacggcggcgcgcgcgcttgcggcgtcgccattgggagggatgagcaagtgcggcggagagggagaaggggttggtgggatcgggtcgagaggcggaaccgagagcgacaaatgcgggtgggccgctagtctgtagttgggctcaaatgcgggtaaggatcagaagcagcccatgaagcccacgttggaatcgtggtagaggtagcccatatgcaagcctagggattgggtgctcggcctaaaattcagactatcaaaattgataaaatttgctatataacacttaaagtcaccgaaacaacgcgtatcttcttgtgaacagcataaaaatattataattagctagatactcaccgcattattttattattttgggtggaaacggagagagaaactttcataaaagacgacgagtttgcccgtggggtcattgtgtataaccctcacgccggtgaagacgttgacggccggccgcgaatcctcgccacggcgcacgggtcgacggcgacggtgacccagccgccgtcatgagcgccgcacaagcacgtgtcccagacgccttccaggaggctgaggtggcgggtgaagccggagagtcggagtagaggctgaagtaggacgatgtgtcgtgggacgggaggagcagccacgggagcccgcagtgcagggcgttgacgaaggccgcggcagtgcgccatgggcggtagacggccgtgaagccaatgcggtcgacgaggcagttcagttgcttgaagatgacgccgagtagcttgggcaggaggccatctgaccacggcagccgtgacgaatgcctcggatctgccctagctcctccgtcgcgcgtcgccggctgacggcgaaatttggcactggtcgtcgacggtgagcggcgagctctgaccctgcgcgtctctggcggggatcaaccgaccctgtgaccagcgtttcggctatcgccggtcaattcggtacatttatcgttctttctctctctccgttccaccaaaaataataaaataatttagcgagtgtcgggcaactaattttcacatttttgcgatgtctacaagaagatatgtgttctttggtgtcttacaacaaaaaccacaattttttagtgtcctgtaacaaattctgccatcatccccgaaaaaaaaattctggcatcaatttgacggattaagttataaaaaggtgtttagtcattgagacatctgaaacaagatatatgagaaattatcacaccacaaagctagaatacatagttaaaacatctttaaaaataaattcattaattggaacattataacattttctgcaggtatggaacatacaaaccaaagatgtaaaacacggttccaaacatatctctctcgtgcttgaagtatatttatttcaaaagtagaataatgtgaattgttgtttcaaatatttaatttaatacacgacataattagatcgcatatcaaaataatcccccatccctacttctaacccacccaacaacgttgcgcctccctctcgacctcgcacctgtactgctagctacctactcatctgtggtgcaccgtctcaggtgaaggccgccgactgctctctccacgctaaatccgtcccactgatctcctctgtttccaatggttcacacccacccactccaccttctaatcactctgcccaccacggccgccgccgggcacgggcccgccgcccgcccgcccgccgccagatgggaagggaggagggggggagaggggaggaggaaggggagggggaggaggagagggatctgtgaagaggataagtgcgacgaaggggaggaggaagagaaagggatttgtgaggatgtggttgcgattgtggaggagaggataagtgctaggaattacatactacgcattgaattttagtcccgattagtattaccaatcgggattaaagtggtgatctttagatccggttggtgtcaccaaccgggactaaagatcctcggtcccctgacaggggatgaactgggactaaagattgtattaccaacagtaacctcaaacagtatttacgtcagaggtactgttttacactgtagtgctaacttaaaaaaactgtgcgcctctgacgttaccgtccaaagtcagaggagccggttcccgaccagtgtatctatgggtggaagtgcaactaccaggataccattccctactttattttattaactggcgtaatacaaagcaacaattaatatatccaaggtaacacacggtagtctatagctaggcgcacttgaaaccctctggcacgttgcggccgcagtagttgacgaggagcgggaggtcgacagcgacatcctcgagcttgacgccatcgccgagcacgctggccttgatggcgaggcagaggcacacggcagcacactgctagaaaaagcattttcatcaatattgggtatttattttcacatacgaacatgacccttagagccaaacagccacctacaaaaatataaatcgggcgtgcctacgaaaatgattttcgtagacggaccacatgaggtgcgcctgcaaaaattagcgtggtatatatatatgacacatcagttgatatttttctaagtgtccttacctctccccttcaccctcctctcccctccccttcacctctcccctcccctcccct

SEQ ID NO: 78974 - DNA, 25924 bp, Oryza sativa
caacggatgcttaccgcaacctccctggtccttgatctcagccacggcccccttggtcctccagtcaacggactccggcagcgcctgttgtcggcggcgaggtacctgtcgctgaccttcctctccctccgcggcttgttcctgaggccgaggtaggtgtcccggtactcctcgttggtgaggtcggcgaagcggttgaggccgaggcggaaggagtggaccccggcgtcggcggcggcgttgtgctcgtcgatgtaccggaggttgtccctgaacgccgcgtaccgccgctcctcctcgccgacggcgttgtagctcttgccgtgctcggccttccactccgcgtacagccgccgcgcctcctcctcgctcctctccccgtacgacacgatcgacatgtccgccgctgccagcgacagcagcagcagcagcgcggccgccgcgagagccatggaaatcctcatcttggcgagctaggagaagacgaccaagaagaggaggaggaggagaggtagaagaggagtagatggatttgatggtggtatcgggggtcgctttatagaattggagaggacgagtggtgggcccagattccattatattcgtgcaattttcttccaatattaatctagtcgaccaccagtaggatattttttttttttggtttcgaatttgtattgggatcgtttaataaaggtgccactgaggtggacaggttggattgggttggggttaatttcaacttaatctattttttaaaacacatactctctcctctagaaaaaaaacccaaactaatattatctccgtacttaaaaacccaatctaatattaaatgagatgtttctaagtacaatgaatctggacatattactgcccagatttattgtactgaaaaaaatcatagcaacctatatctttttataaaactggttctaatcacatttgcacgtccatccccttctaatgagaggtttcatttttatttttcaaaaagtgttgcccacacaaacaaaacacttaatcgattgctaaaatagcccatacgacacatttttatttttttaatcttataagcaacacatgtagagacaagtcacattaaaaacagtgtaaactcatttcatctctttctttattaattacttatcatattaacaaaaatattgacatgataccctattcaatgaaaataaaactctcattgaaaatgaccttataaagattccacacgtacacactacgtagcacctctggaaactgggctgccatattttaaaacggaatcattataaacatattcttatcaacgatatgttgtttgtcacgaaaaaataattactagtaaatacggtgacatcttcctgtattagtctatctagcctgtagcctaggcaattatagtgggttgtttatttggaagattggggtaccgtgtcaatcgagacatgtagaaggaggtgacgagagaggttacgtggagctgcaagattttgactgttatgtttttttgctcctgtttaagctgcgatagttaattgcgccccggttgaattacgatcggtgatgcatcacggtgaaagagagagtttaccgtatcgtgtcgttttaaaggccgcgctgcagcgaaaagcgaggtgtttcacgaggcgattatattaaaagcactagcagtatgcatctgttcgtacaaacggagctttcagccgtgccaaagctaatcacgatttcccttcacgagagtggtagcaaactggcccaaagcagcagctggtgactactccttccgtctaaaaaaaataaatataagactgaatataatatattcatagtacaataaatctgtatagatgtatatctaaatttattatattatgatgtgtcacttttagtatcttttagtattttagtatctggttggttttttatggaacggaggaagtagctacaccatgtttagttacaaacttttttttttcaaacttccaactttcccattacatcaaaacatttttacacatataaacttttaattttttcgtcacacgtttcaatttcaaccaaactttttaattttagcttaaactaaacacagttctttgtttcttgcagacatgaagcatatcccacgatcggcagatcgggcggtggtcatgcagtggcgccgtcagtagtcatggtcccttgcctcccccagttgcctggaatttactgggaacgcgacgagatgggctggacgtacgcaggcaggaggggatggaaagggaaggcggccaataaagtggacggacgcaggatcgccaagcaaccggcggccagttcgtcctcgcgaccccaaaccgatccagagagacgcgccggatccatctggtagttgggatttgggaagatgacgatgataaggcgatggatgggagagatcgaaggggttcgcggtttcatggaatcctccgctagtttcgcgtgccaaaacgccgccgatacgcacggtagtaggtatctctatatgccctatgtctcctcgggtatgtttggagtagctatagattctgagaagcagctgtttgatacccagtttctgagaatctggaaaatgtttgaaacctagcttctccagcttctgacttcttagttcatttttcagaatctataactatatattctcaaaagctatgaattgtttggggcagcttctagcagaagcatcttcagctaggacaagctccccaaacagggccttcgtgacttcaccgatggaacgaggtggaattatcggcgtaatttaggattaaactgttcgaggaacgtgtgtgattatcaaggtttataaaaccgtgcggtaattaataagttatcaagtatagtatccttcttaatttttgaaactatgatataccttatgataactacccggttactacgataaccgtttaaacgtgaggtggtgataaccttatccaaaacgatctgataaaccctaattattcgtcaacgagttgtgttttttttcctagttatatccaaaatcggagcttagcaagcggggaaccaaaaatcccacattccggtgacgcacgcagcgagtccaatgggaggaatcttttggcccgcaaaaggaaagagcgcggctgcggccgcatcggtggacggggatagcagcggaggagggcgttggaatctctcgcggcggccatggcccatgggttggttggttggttggttgggtggctggcgtggaggccccgcacaccggaatcgtacaacaaaatcgtcgcgcggaaggatggatgagtgacgagacggacgacgagatgcgcgcggaaggcgacgggcgcgacccggcgagacagtgagtcggcagcgcacgccaccccgccggattggctagccgcagcctgcgctacagtggcagactgcatatccaagcgatgcacggaacaaaaattggcagaaactgtaacaagaattacaccaagacagaagaaaaaacatttcctagggtgatgaaatcgtcgatctttggtttggtttagttaatatctaccataagggtcggagtatttgattccaatgtatttaaaaactataaatgtattcaaaacttccagtgtatttaaaaattataaatgtatttaaacacgtgactgaatcatatcatttccatcaaaattcatatggaatgaatgatcatatagagattttgaataaaagttaacccaagcttcaatcttttaaaaaaatttcttcgagtttatctttctcctatgattcatgtgatctattcaaacgatcgtacatgtttcatcattctctgttgctcttgattcttataaaaatcttgtgttttttctattgctctaatttttcaatccggtgtttcaaaggtgtcctaagcattttctttggatgaagattgtgaatgagtttggatcaactactaggataggtaactttttcattttcatccatgctttccaaactcataaaatagtgtgcttcgtacagaaactttataaatagattttttctaaacaaataaatttattttttaactttgtaatagttaatgcttaattaatcactcgttactgatttatctcaattacaacgtgcaatagattatagctaggttcaaatgcaaccaaatgtatcttagggtctgtttgagtggaacttaatattttgataagtagatgtttggtagtcaatttataataatatgtagattctacagctataacttatcagaatctagataaaaaaatactaaactgtttagaagagcttctaattctaagagaaattggagtagttagaagcttccctaaacagattattaagctattgctaaatttgattttgtggcacgattgctaatcaccttgcgataagcggtcggcggtagcggcattggcttatcatttctcatgggatttctggaggaagagtatatttaggcagataattgtctctttcaacttgagaaacaagctaccactggagtaatgtactagcactacatacccgtagtaatgcttgtcacggtaccgcggctatctccttggtccatagtgcggatgtcgtagcagcacttgtgaccgctcactccggctaataatagcctgagaaaactaagccccatgtggacccacccacttgatgctgctgcctatagtaatctatttggccatggtgacgagaaccaggcaaaaactttataaaactagcgccgattgccgactaaatcaatcaaatgtaaaaaaaaaggatgaattttgatctagttaaatcagttatcagttcatcctgcccatagttaggagtgacgacaagcatgtgccagggataatacagcaacataaagtattgagacaggaaagaaaggccatgttagtatgttactgctacctcgatcatgcagagtacgttcataaacatgtgatgcgagatcactaaaaaaacatcaagaaatccgtcctgtgtcaagcactgctctgctggttcccctcccttgcacaactcttttttgtcagtggagtatttttacttgtgaagcacatgcatccactctcgtttttcttcccctgaattctcattgccatgtcgttcgtatcaactgcccagcacgcaaccatgcatcgacgtgccatcgaatagttctttagtttatgagttctttgttacggcactccagtcgatcggtcaaatagttctttggataaccatattgaatagttttgcactctttggataaccgtattgaattatagaagtagacgggttcagattgatgcccaccatggaatggacatggtcagtttctgagtttgtttgcttcacaactctgataaaaaaaaactctgaagccgtgggtcaaactttaaactctctaatttgagctcggagtgccacatacttaattggaattctgcagctattatgtaaccctaaactgtaacttcagattgaaggattcctgaatctatattttccaatagcgctttttccaataattgaagtcatggtccaataatgtgaactcagctgattcctgtatcatggccaagatagagccaacaaagaataagagaaaaaagatatcttcctatcttgaaaggaaattccaattagttaaacagtcaacgatctccttgttgctttcatttattatgtgctgaggcttacaatttcactgatatttcttctgcccttttgttgacgttgatggaatcattacaaaaaaaaaaaacagagaggtgacgttgatgaactgctgtctctgttcctgtggccattaattcggcctataatctagcaattcatttcggaaagtacagcccaacagtgaacagatagaagtatcagatacgtgggccaaattcacatgttcggtcgatatagtcccagcccagctagtataataataaactaacaaaggactgacgaaacgagatgttcaataaaacacgagctaaacaaaatatccaccgatcaagccaatcgggatctttacctaatttactaacatatataactaactctcacaaactgatagtaaaaaattaaccctaaaccaaaacactctaaacctaattaacgcccatctcaatttctagttgattcgaaggaatttcttgattggaccttccagctgctgcatgacggccttccatccagcctccgtggggtgcacatcgtcccagtagaagtacttctccggatcgttgcacacgctgaacaggtccttgccatcgtgtcccttctgcccgcagaagccgttcgggtccaagctctcgcagcacggctgcatcttgtgctcgaactggctcgacaccttgtgcttcgaacctacatatcaaattcgtcaatggacacatgtacgttgtaaacagaaaaatgaaagttcatcaagaaattaagacgaatcaacaatgcgtagtaattatatattaccttggtcgggattgacgatgttggagaaggcagtgttgaggtcgacatggtggacgtagtcgaggtgcgagagcttctgttggaggttgctgccgtggaggtaggcgcccatgttgccggtggagctgcagccggagtagttgcccggcctggttacccacggcgtgcagccgacggggtgcaggttgttcaccaggatcttcctcgccccgttgttcttcagcctgtgcacctgcttcgcgatctcgctcgtcacctcatcaacaaacttgatcatctgcaaacacaaagaacatgcaatatcgatcgatcagaaagactgttaactaggacgtactccagtagctaatgtgtgtgaaggctgatttagatgactatttaggtagcatgcacgaaacgagaatcattttccccgatctgtgtactgaccttgctagtgtcgttgacgttggcgaggcgggcgtagtcgttgccggagacggcgacgagggcgatggagttacggaggttccggcgggtgatggtgccgtcctgcaccaggtccctgaagtggtcgacctgcttgtcgagcgtcggcgcgccgctcggcagcttgaacacgccggagccgccggcggcgaagttcatgccgtgcgggtgcacgtagttgtccaccctcctgtacgtcggaggcgcctcatgacgccccagcatccgtgctgcaaaatgtacagccaaattattaagtacgcagtaacattttcaatctgagattgaatctgaaaatggatgctgttgaaaatttccttcaagatagattattcaatctgaaaatggataattaggttatagttagttagttaattaccgatgagatcggactggaccatggcgttggagaagcggccggttgggcggttgttgccacggtcacggccgtaggggtagtaccattcgcgcgactgctcgctcagtcggcgcttggggagattgccggtgtcggcgaacgaatcgccgaacacgaacagcgtgtagaacccgttgtcggagtcgccgaaagcggcaggatcgggacgcgcctccacatgaacagctgttatatatacgcacacgcattatcgatctcattaattcgtcagaaatgaatatttgatttgatcaattaatattaaattgataattgaacacataatcaagaacaagaatgaaggcgctgcagatggcacgtaccatgcagaacgaagaggatgaagcaggtgacgggaagtagcaaggagagcttcgccgccatggccggcaacaactgaaagctcctcggttgacggtggaaggtgtaactcgttgaattgcttgtggctttgcatgcatgggtgtttaccaccctatttatagacacgacgaggctgcaaatctgttccgaatatactattctcaaggtgattttgcgaggtgattggatcacgcggcgctggcgcccttaacttccgagtaacagttgggattaggaagtactccaacgacgtgcagcgagcagctgtgattttccaatgtgatcgcgtactcctatctaccagggccggccaaaatgctcccacacgaccagcccaatcatgtgggccgaatcacgccggccgctcagctcctacgcttatccatgtgataaagcagttcaatcttatcttcctgcttatatattataagaaaatctaattgtcaggagttttacactaaactaaactttatatactttttatctctatatatgccaataaaaatacgagactacccattgatatttcaatagatttgaagcttcaaattttacagaacttccaaccaatacatatagccatttttgaatgaaataaaagaaaagggacaaacatatagaaaatcataaatcttgagaaagaagctgttgtaaaatatgtttttttaatgtaagagtgtagttgctctgtaattaagtgtaaatactctataaccaaatataagtactttgtaactaaatgtaattgcaactttgcaagttgaattcataggaacacaaatcttgatacaagatcgtacgggtgaaaagtcagagtataagaactcaaaattctatcgcaagtgaaatagcaaaacctcaaagatcatactctgtactagttttgtaagttgggggatacgttttatccagttttacggttgaaaagcacgattttgtatctcgtgacatgatgagaggaacctcaggtataccttttccatctgactgattactgtagtcttctgtaattctgttcgcagttacaaaactttttttcaaacaagtttacgtactacgatgctcgttttgtttctctcttaaccgtgaacagcatgatattgaattttgagtaaagtgcattagcagtacttaaacttgtagggttgtgtcatataggtctataaactctcaaaatgtatatccggatcgcataacttgtcaaagtgcatcatctaggtcccaaattagcacatcccctctaagatcctatgtggcgctgatatggcaatgccacatggacgtgacgtgtccttttccttttttttcttctttttccttttctttttcgttttcttctcattcttatttttttccttttttctgcacgggtcacagagaaaggagaagaaaggggaaaaagataaaagaaaaggaaaaaggaaaaaaaattaaatgggtcccatttgtcagtcaaaataattctatatcatgtccgtgaggcatacacatcaacgtcacgtaagaacctgaagaggttttagtgatttgggacctagatggcacactatgacaagttatgggacttggatatgcattttgagagtttagggatctagaagacatacccctacaagtttaaagactgcccgtacactttactcttgaattttttatcgtcctatgatagatgcctagaatccaagaactgcattatttttttaagtttataacttattcttctcattttccacacgcacgttcttaaactgttaaatggtttgtttattttttaaaaaaacaaaagttgcttttaaaaaatcatattaatctattttttttaaaaaaaactaatacttagttatgttaatgagttgctccgttttgcgtgcgagaaaaattagtttccaacggcaaggaaggaacgaagtgttaaattgacgagtagaagatgtttctctgtgggcggaaagacgatagaggttgtgtttagttccctttaaatttctaaaaattccgtcacatcaaatgtttatacacatacatggagtattagatgtggacgaaaaaaatcaattacacagtttgcatgtaaattgcgagacgaatcttttaagtctaattacgtcatgatttgacaatgtggtgctacagtaaacatttgctaatgatggattaattagacttaataaattcgtctcgaagtttacgggcggaatttttgttttgttattagtatacgtttaatattttaaatgtgtgtctgtatacttaaaaaaaattagctgtgtaattaaacacggccagaattgtagtccaagcttcgaaagctactctctcccgccccctttcttctcaccattcataatggcacagtgctagttgtgctcgtcccttatagtgatgtactcccatgtttattattttcaatggaagattcagtgggaaagctctctcctccagtgatttctccaaaaaaagaaaaagaaaatcacgagtagctctctctaaaaaaatcacgagtagcgacaaatactaaaaacagttcatccaagaagctgccatagcctatgatccaagaggcgaagaccaatttacaaagttaggaatacgacagcttccacctaaccataatgttcctcacaatcttatagacacatcagacaagaacagacacattatggatataggctgtgttcggatgcctgagttctcaactctaacagtgcgcacggaaaacggagcgatccattagcacgtgattaattaagtattagctaatttatttttcaaaaatggatcaatatgtttttttaggcaacttacgtatagaaactttttataaaaaacgatccgtttaacagtttgaaaagcgtgcacgcgaaaaacgagaggtgagtattgggaacttggagttccgaacacagccataggaggagaatgaaaaatggattgttattatttcagacgagtatacaaccaatggtttaactcccagttacccacaccacatcaattcgtttttaaaagtccctgctctgatctatattacacaaaaacaatatgcctaatttgctatctaccagacaagggacagatggcacatataattaaacttttatctattttacacggtggtacaaaatatgcgcggtgatttatccccaagattacatgtactgtctatggtttctgtagagtccagagaaataatctgagctgagttacattatgttacttgagagcgtttggcaccgacgaggcatagatgcatcagtgaagtacttggggcagatctagtgagccatatagaggtatggtttcgatctgatttctattttccaacaaaaaatggcctctagtgctgaccttcagtattcaatagcgtggtccgcttgagtggtgtttctggtttggcatcctgttggcgggaagcgatggttaccagaggagggtcaattttccatctgcacaaaaatgaaggataaatttagtactgtggtttaagagaaacatcagggttaatctgatagatcttcaaactcaagcaaacaagaagggggtattcttttgattcttatgccatgcaaatcacaaaagacatataatgaatttataaacaccaaaggttacagtgacaggacatacatttcatattcaaatcaccacacaacagggtaaggttgattcaggaaagaggtttcatcattgataggaatgatgtgttaatggaagtgataagtatggccaattagagttgtctgcctctaccttttattgacacaacgcatgggacagctagatcaggccagaaagtggaagaaaataaagagccttttggtgaaagtaaggcgaatgtggtatcatatccccttccggtcctccacagattaaacaagttaactcaccacaaacatcatgaaacgatggcaagaaaaataacagttttaaatactcgtactccatcttaaatgatactccactcactactagattgttgacatactaaagaaaacccaatatcctggcacaatttgaggagtaccagcatatactagtaccatatgtataataattaatatactagtacaagaagacagacgtatttggtatatcagatgagttgcccaagactcggagactgagataggctggtcacaatatatgaacactgttgctaagaaaaaattggccctgttctagtgttgtgtctggtcggcacatgtgcttgagacctacacggatcgctttcagcgatcgtccccaccccaccgaacatattaggaacacaatgaccatcgtcgcctcgccaaccataatctgctcgacctaacgtaccttaccttgccatggtgtcgggatcaaatcctagatctgacccatgcaatttcgagctaactgctaacgtgctaatcaaatcacccgtaatcacgcggtaacatagtactagcatttggagatttattaaatttgggaggagtaatctggtgatgtagagagagggcaccgacgaaacttactcgtgtgggaatttgacctcgtggagggcatccgaccggtgggaccatgccagggcggcctggccgcagctggcgagcggctcgacgcgggcggcgtcggtgaccagcgagagcgggctggcggcggcgccgtcgtcgatggcgtcgatgtcgctcacccactcggggcgcgacgccgcgccgccgccctcccagagcgcctgcgcgttcaccacgaacccggcccactccagcctgctcgacagcagcatgtcgccacggttcgccggcagcatggtctcctccgacacgtggtagcccaccagcttcccctccgcgtcgcacgacggcgcctggaggaacgtctcgctggtgccctcgtcctcgcccagcacgccgacgggcacggcgcccaccgacttcaccttctgcgcctcgtcgaacagctccgtccggaggatgctgttctcgtcggcgaacaccacgacgccgtccatcttcctcttccgtatctccctgcatttggtggcaccagagagatctcaattgcaacatccgaggtcgcgaatcgagagcgagatctagctgcggtgattacctcagggcgtgcattcgcaggcgcgaggtggaggagtcgggtcccgtgatgtggaggaagttgaggttggagcgggacagcacggcggcgacggcgtcggtgtggtgctcaggctcgacgacgatccacgtgagagggccgtcgacgaggcggagggtgtgcgccatcgacgtgagggagggcacctggagcgcggaggtggtggtaggggtgacggcaatgacgggcctcggcggcccagccccgcggcgacggctgctgcgctgcgcgttctggacggcggcgaggatgtggtgcgccttgaggagctcgttggggtcagggtgcggccacgggcggacgcggatcgggtggcggccgacgaacaccggtccgtggtggtggtgctgcgggtgtgccccgacctcggcggccaccgtggtggtcgtcacggtcgtcgtggtggtggtcgtcgtcgtcgtgatggtggtcgtcgcgttggcggcggcgagcatgacgggcggggagacgagcgagacgaggtgggcggtggggttgatcggcgtggggaggaacagcaggtagacgatgaggcgcgagaacctgaacccgaccgccatggaggtggcgcagaagagcgcgtgcagcagcagccacgcggcgggcagcgacggcttggacggctcgggcggggagtccggcgaccccgccgccggcgacagcatcggccacagcggccgcagcagcgggagcttcatggtcacagcttattagctcggcaaatcgcttagaggcaagaaagcggcggtggggaagtggcaagtggtgaggtataagagagcagctggtggtcgccgccgcggctcgggtgggtgaataattgtgtggaattattaggaggaggagagggggaaaagggcaagcagctggtggtggatggtgaggtgaggtgttggggttccaccgcgaactcggcaattggagaagagaagaagaagcgagagagatgacacgaacacgaggtgaggttggggttggggttgggctggcggtggcggtggcggttgaggcgtgggattgggggagaaaacacgcccgaacgctgggaatatttcggccgttggcggccacgcggtggcagccagacacggttccccgttttcacgctttttaaaaagctcggttgcttttacctctctgacggcggtgtgggtatcttgttcactttggttggtgaagctgtctactccgtatggttatctgaagtaaacgcgagctgacctaaacagttgacagtaaaagtcgcctagtaaaatacatactgctatgaagagggagcagtattcattcatcttcctgtttccacgcaataaatcaccgctcaattatcttcccctcgcatctttcatccattattaatactcccccctacggtacagtaccactgtcgctgtgaacagaactattgcactccaagcaattctcaaccatccagatccttttgcaggaactctatggacagtagacatgagctctctcgctgccgatcagatccttgaacagtctgcagcgaccgatgtttccctgtttttttttctcttgcaggaatttcactgtgttgtcacaagccggggtgctgcctggctagtttgttgtactgccgttaataacatggcaagggacagtagtactacagtaagcttcctgtcgttggctaaaccaagatgtgtttgattaacaacaaaaggggttggctgttgcctaatgcacgcactgcctgtacagatttatttaagctaccaatagtacagcatcttcttgcagcgttaaaactgctacaggatttttctagtcggcgccctgaactttcatcagggatggtgctcacgtgcaggcaaagggcaggcagcccatgctggctgccgtaattctgaactgatccaacgtatggccaatttggccatggatggattggatgcttggctgcttgctcgttctggagttctgacctgtaatgtcattttcttaatcctttctttttctccccaaattttgttttcctgccaatgtcagtgtcaatcccggattggagtagaaccggcactcgatcatagttccatactcttgtcttgcattctgcattgccatgtgtgtcagatttcttgttcattctgaagaaagtagctttatgagcagtaagacactgtcccattcagtccagaacacaatacggtgaatctgtgaatctcttgcacgaaacaactgcaagaacgggcagtacaggataagttgataatatgatctgaaaagtgattaggagagtgtacaaccaatcatgttttgaactaagcttgaagaaacaataatccgattggtacaggttgggttgaatctgctacagttttattcaggtatgcttgtcctcgtgttcgacctgatgggtactgaactatctacctagatgcctacacatataaacaaattacagagattacacgaggaggaagaagtgcatgcaatgcaatgaaaatggacatgaaagcttagagctagctaaaccaggatgttgtcacataattatgaattgaaaggaacatgacataggcagtgttagatacttaatatacttggatacatactagtatatcatttccatacctacgcagcttggtggtgtgagtgtgacgctcaccggccattgctgaagactgcacttgaactaccagctagtgtgcattttaattcctggggctgcattcttaataattcagtacgattgccttttcgtctctctatataactttagttaaaatgttctttaaagaaaaaggataactttaaaatggacttcacactctgaagtctgaatatttctttctggcaacgaagtctgaatgtttgttgtgcctggtctgccgtactggccgttcggtgaaacatgcacataaacagcgattgcataacagtatacagtagcattatgctcctccttttttcatcagctttaaaaattgttaatgatggccgattaagccacatgtaattataattaccgcgtaacaggtggctacttaattatcagctcatgaggttaatcatttcctgacgctaaatcggcaatagcgacgtataggttgcagttaggtggagtccttttctttcgcggcgtttaagtattgattagcacctgctttatgtagtttaatcgtcagtggatggagtagtagttgcaacgttgtcgtttacactagaagccatccgtgcccagccaaattaagcacgaatgcatgcatgctttcagctcaagcgaaacagagcgaatcacagcctctcctgtgagactgtgactgaatctctgggttgttacttgttcaaagttacaacggtgactgtactgtaagctactcctaaaagttggagggaagtgaacaagcaaagcaatggcaggtgatgaaaggctgaaagcatctgcaggcatgcgttgcccgggcgtgaattctgtcagaaaggtaatataaagttttggagacgatttcacaataattcatgtggtcaggggagtaatcatgatcataggagaggttccattcaactaacagaaaaggcagagcggaatctgcactactttcttcagcactttgtggttgttcctccttttgccggtctctgcaatttgcatccgggtatgatttgctactgttgtttgctttgctccgtactactgtctactggtagtagttcactgctccactcttcacatgcagacatgctctgattgatctggcacatgcatcaaattggaaaagaagaaatggcatgcacaaatgaccaagatgcgtgctggtagtacacaagaaaccaaagaatttgggtcttcatagttaataccgggcctagttaactagcagttttgcaaagtttctagctcaaccaactggtagtctttcggacctcggatcatgctctctatgatttgtttttgaaaagaatggaatgatgaaagcttaatcttcaatccaccattttggtccagtttcatttcatgcagtccgaccaaaaatggcaactgaagatttgatcaaacatgattgcacattgatctgtgtcataaaataagacactagcactagctaaaacgaatgcaggattgagtcctttgcttagaagcgacatcagagatgacactcactcagttcattacaagaaattgcccataatcggtgcttctgataaaaatatccatggcttcctttgctgaatcagttatgtttgtacagattttcaaggagcacaagcgctagctactggattttctctaatttgtctctactaacactaggtgcacttgcattaatttgttgctagtaacactgatacctatcgattcaaccaaaaaagtaccatgtgacagcatctatagcaccaagaccagttgtgctatgaacttataagctaacaatctgaattagtatcagtattaaatcagataattgcacctaactaactcgatttttggtcatagtacatatgagaacttatgcattgtgacgccgaacgaccaaaacaaccaattctccaaatgaatgtgctccatttgttccagcgacagtccacctgcacaacaatggaggacaccaatcatttggggtcctagtacgccccatgcaaatgccataacaaacttcttttgacttaatgggcacctcaggccaaacctccagctatgcacaaacagttcccctagtttggctgtcccatagaagaattgaaggttttcagttcacgtttcatgttcttcttttgttcgacatctcattgtaatcagttgacgttacacaatttggggccattccataattgtagtaccttgacttgcagagagatatatcagaagatcctataggagagatttttgtcagtaagcagacaatggtagaacgctacaggaagcaatgtcaagaatatagagcaacgattcacccttgtaactatcatacatttcaaactgaagacagaaaattttagcagcagaaatatgattagtttgctaacaccacatggttctaccagcaaaaactggtgcttctaagttttaacaagtaataacaattctcccacatggttcacaactcaaggccagcagaaaaacgttctgcagagaaacgaagctatcccagctgtgcttttcagaccaggaaaggctctttgctttggtttcaaacaatggcaagaaaaggtcacagctacatgcaactgtagtactagtgatcaatgctcatgaacagatgcttaaagcagaggaatggaagattcctccctccagaaatccggcacatgggttgttgtctttgtttttattttatgaaaatgaaacaagaacaggttaggttagtcgaacgtcggcgtatgggaatcggacatctcctctgctgagagggcacctcccactgttttttttcacaagtcacaaaggtcagtaggaatcagggagctagcagttggaggcttggagcagagcccagtcaattagatttggtttggtcagattatgacaccgactcttcaatttccaatttgatactagcatggaaatcaagctgaaaactatgtgtatgctgctactaacacgcaaaagctagcatcctagcacatggcatatgaagcatatgcaacgcaatgccgtggaatctgttcaaagggaaagagcacttacgatagagtagtttgttcaatcagaaggtgacagaaagtttcagtctttcaggtgcttcctgcaaacgctgcagtggaaaggggaggcacatcaacttctcatctactgttgagctgaaatagccgcctgatctaaatttcaagtacgaaatgatcataccttgcataagtagactggtagttgcatgccatgcgcggtttgttcagctatgcaacagacaccgaaagctgagcctccatttcgaacgagaaattctcacacgaattcaaccgtttactgcaaatttcaatacaaccaagttaaaagaacaccaaaacaatcgttatttatttctcatttctaattgctttgcttattgatgaagctgatcaggtgtatgatttagcatttgatacaatgttcagaacagacaagtgaagaccaatcaaccaaccacgtgcagtcaaagcttctgaatctcctgcacaaaccgctccagatcctcgtaggagctcccaccgctcctcaccgcgatcgcggcatcggcggcgagctccttggcgcgcgcccgggcgccgctccccttctccccgaccgcgtcggccagcacggccgcgagctcgccggcgtcgggcgcgacgccggccccgcccgcgcacgcgcgcagcgccacgcccgcgtcctccacgagcagccgcgcgttcacgaactggtcggccgccatgggccacgccagcatcggcaccccggcggccaccgcctccagcaccgagttccagccgcagtgcgtcatgaaccaccccaccgccgcgtgccgcagcgccgccacctgcggcgcccacccgcgcaccaccatcccgcgcgccgccgccgccgcccgcgcctcgaacccttcagggaccacgccgtcgccgctcacgacccacacgaacgggacggcgctccgctccagcgcctctgccagtgccgccgccatggccggcgtcagcaccgcctggctaccgaagcacacgtacacgaccgaaccttccgggaaggcgtccagccacgcgctgagatcgccggctgcgacggccgcttccccaccgcgctcgccggcggcgtccgtgtccggcgccaccgggcccaccgcccacacgcgcttgaaccccaggtcctccagcggcgcgtccaggtacctcccctcgagtgcccggaaggtgttcgacacgaatccccagccctccagattccagagacaattctgcttcagcgactcgccgacctgctcttctacgaggccttctatgtaggccttgtacaacatggagatctctctccactcaaacgccggctcgccggggatcgccgggaacgcgaccggaaacccatcgtcgcaccccacgggccgcttcaccaagcggcgaaagagcgagtgcggcacggcggtgccgagcacgccggagggcgtgaagacgaccctcgggacgccgatctcggcggcgagaggttgcatccacccgcagaagaagtcggatacgacggcgacgacggggtgcgcgggctgcgacctggcccacgcgaggatggggcggtggagcgcggcgagcgcgtggatgaacacggcgatgtagacgggagggcagttcatcgtgttctcgaggccggcggggagggaagggtgggaggggaaggggaggacgagcgggcggacggagtcggggtgcgcggcgaggagaggggcgagctgggcggcgttgcccggcgtggtgacgacggtgaggcggagcccccgcgccgcgaggagcgcggcgaggtcgtagagcggcagcgcgtggccctgcgccgggaaggggacaaggaggacgtgaggcgtggcggtcggcggcgccattgctgcggtggtgaggaacggaggcggcgtcggcggcgagctcctgatttataccgtacagttaagaattttttaaattttattaaaatatttaaaactatttttttaaaagttttacaaatctgacctctcatgccctgtgaaagggcggatggcgtcccgttctcctcactcatcggccatgttttacaaacggcttaacaatgtattttttaaaataaatttctacaggaaaattgttttaaaaattcacactaacccactttttaagtgtttttacctaatgcttaaccaattgtgcactgatctaatatttcatttttggtgcgaaaggtgagagtttccaacccgcggtcggtcaccttgcagatagcccttttaccggcctcccaaagggctaggccgtctgcaaaacaatcgggtctaaccagtttacaggcagtcacttgtcgccgatgggtagatttgtaaaacactgaaaaaaatattgttaaatattttaataagtaaacttaaaactgaaaaaagtttctagttagtgggatcggaatgggctgggcctgagaagactactacatgggccggtggttcggcccagaagaaatcaggtagccgacgagtcatccacagcgacggcgagtggccaccggccgttctacatctcgcgcgcggcctccggtcgtcgtcgcgactccgctgccgccgtcgcccggcgccgccggtgatcccgctcatgtgctagtagaaggcgttcggagctctttgggagtgtcgcacgcatggagatgaccagaagccttacgctcgtgccgctcccggcgacgctccggccggcatccgcggcctgtcgccggcggcggaggcggcgagggcttcccttcggtgcactcttctcaccatcgcctccttcgaacgtatgtttcttcctcccccagctaattctgttccctgcttgaatgattcagtagttcgcaattcttcttcagcagcagcagcaggaaatgcacatcagggcgctgcagccgcggcaggattgggtgggggagtgggtccggagcaacgacacgctagtccgcggcctgcccatcctcggcggcggcgcctccctgctcgccgtcctcctcaaccgtgcggtttccggcattgcagctgtcgccgacgcctccaggtcatcctgtgggtgcagagccaccccaagaaatgcccccattttgcgctcgtcttggattggatttatgattactgaccaattggttaatttgatcttcatctcaatagttcgcagtcaagggctgacatactgactcttgctctctccgtaactgatattcttgctggccttgtttggttgtccatccggccgaaatccatttctcctgtgagttttttatcctttgcggcatattactgtagtaaattttttacaataattcctcattttgaaatgatcttaggttgttcctcgaggtgtcgagtgcaaacgggtaggaacgggtgtattggactcggctcttcgtgaactactttggtaaccattttactgatacacttcctgcttatttcaatcttaagatcttattttaattcatagagatcatggaagctcaaataatgaaatattattacttaaaaacctcgctaggtgttccataccgtgattctatataattactagtgctatgatcttccatgaacataactaaacaaatctttcagttttatgcatacacaatcccatccatgtacttcatgtcaaggaaattatgttgtgaggctggctgtgacttcaacttctcacaaataggacatgggattcccttacaactgcaacttgttgcaaatccttggttgttgtgtatggaggtaattgtgttcttcaaattggggttgctgctggctctccagaggatggtaatgcagttatggtggatgcacagaagttcatgcaaggttccctttatagaagtgccatggaatccaagaagcgtgagtgtcttttgttacttataaagttctttttttctgtttgatttcattcagaaacttcactttggtcttcttgcagaatcttacctagcaaatcttgccttatatcctggaaggactgaactaccattcttgccagctaacacgcaggtactaaaaaattctttcatcttagagaaattacatgtaagcacgcattggtgtgtttgtcaacttgttatacttcacgaaagctgatcataccatctttaaactaggaaactccagaatgcatcctctcttttgtttcattgaaaaagaagggggaaatcttattaagtctaaagatgactgcattcaacattcagatgaattaattgtatgaatgtttaaaaccaaagcttttgatatcttccctgatatacaggccctaatattgcaaccaattggtgataaaggaattgcagttattggtggtgacactataagggggttcactaatcttgatcaggtgctatttctaatctacagcctcctaacatatatagtaccacgttttgttttgggtgattcgcacagataatacagagaaaaacaatctatatgtgtaagctaaagatcacagtttttaaaaacaaacacaagccaaaactaggtcaactaaatgcttaacattggttttatgctcacttttgctgaagcatacaatctctacggtgtgtgtttgcattggagcatttgaagtattgacggtgagatcttgcattatttgcattgcagctacattattgcttttgagagcacaaaagaccgaatgtaatgaaaagcctgttggttgtaggttgcacacttgcactgttttaaattcagtatgacggttactgtaaaaaaaaaatcagtatgacagtagagagacaaccattatcctgttgattttccttgcaggcatggattgcaatgatagcagataaactggatgctacattgtcaaagtcgtaagaacgcgtagtttgttggatattgtttgtatcttgcaattggccaaactgtcacgagagatgatcatctgtcactgtacatgttcaagttacaggtagagtttgcaaaaccaacggataaaacagtacagggctggggttgaccaattgttttaagccaggctgtatgattaggcttgattaagtttgaccagcatgaattgattacaatgttagttacttcttgtaaccagtcactgttggctgaatgaatcacattactgatgctttcatttgtaagatctcatcacatttcaaagagtttgcagtgaatttacgttaagaatatcctcctggaccctctctaatactcgtgatcaacagtcgataaaatggaggaataaaatgagccctaacaactttctacagttaatgcctagcaatctaaagcgcacaaaccgctgaacaagaagagcgtctagagatcaaaattgttcctctcatgactcatggtgagatcaaaactgctcctagccgaatggtctcaacatccttctccagcttcattcatccaatctctctgcatctcaaaatcatccctccaaagatcttcattcagccactgatatctttgctttcttcttctcatgctttttaccagtttttcgctttttttgcttatccccatcattatcttcttttgttggttctacatgctcggtaggtggcggtctcttgtttgaaagttctgacttgtttagttgagcgccatacgccatctttcgtacatagaagcttgccacatccccattgtcgcgtttcagcagcacatttttttgaagtcgcccgctagagtcctgtgtgtttcagcatagtatagaactgagaaatttaacagcacattgatgcaattcaaccaatcaaatgataagcacaagggcaaaacccaattagtggaaaatcaaatggtataacgtaccttggcctcttggccatccagttcatcaaatgccttctctacctcatctctgtctccaaatgaaatacatgtagaataataatcaccccgaacccttgaatcaatctattgagaaggaaataaaaccattagactataaaagtacatgtgtattgagcaaatcataattagtatgcaaaaaccttctcatcaatactgggatttccagaaaataatttgagcagctcctgacaaggcaggtagactggaattttgtgagcaagcaacttcatcatatcagattcaggtacctaagaaatggaaataaacaagtcagttggcaactccctaacaatgctgaggtttaagataattgtttactcttacactatctcttgcaatttcaatgggatcattaaatccatgcttaagcttggcgagaactagattcatcgcagcttctgcatccttcaagcagttatgtggctccccttcttctcgaacagcatagcccaaaacagactagaagcacaaaaatcaacaaaaaaatttcagcatgcatagattcagagcatggggttcttcaggccttgtatgcattgtttttcttaagcagaacatcattcataaggaaacaaggctacgagtaaataagatgctatgcagtatccctttaactgtaccttgcacaggctgtttaaagaggctgatgcagtagtaggcaaatttgcatacttaaagatgtatgctgtatcaataacccgagagtagtcaaacttaagagctgcaaacgaatcaaaaaaatgataaaagctgagttacatactgagtaacaaaataaagcctgccaataaacatgatggatgcatagaatgactatatcaaatagattggaccgcattaatcacagattaccatgtaaatcttttgataggctatgaccaatcaagatctttcctttggacaagagcttcttcaacgatttctagggaaggaaaggaacaatataacttttgcaagattaaatcaaaccaaatacataaagaatttgtagaagcatacctgaacatcaactaatgagcatgtgactccttttaaatccttcttagacaaaccagtaatgcttgtcctatagtctgcaacagcttttaaggggtttacaagttcatctaacttcacctgaaaaagaatgaatttagtgtggtctaagaagaaagatggaaaattatggcatgattaatgattacaagtcaaaggacattgcatcaaatatacatgtgtctaatgtttaaaagatttggcataaactttatctaaccagcattaaaacatgtttttttgttgaaattatgtagtgttaggaaagttctgcttgttgaggcacgcagcagaagacaattcaatgcgtccaaatataatacctctagattgctgttgacaacacatactcggaccaaggcttccgtaccatcatggcaaaggaccatctcacagtcaattgccaacatagttgacttcataaaattggtaattttgccttcacgcagcactttccatccctgtcaacatgtcagtaaatctggagttatagaaaaccatagacatctctaatcttcgcaatgggtgacatgaagtcagagaaattctcctgtattaaacactactgaagtacagtagatagacaatactccctacatgtttt

SEQ ID NO: 78975 - DNA, 633 bp, Oryza sativa
attatacagggtgatagagaacaatcatcaggaagcaagacaatggagaaaatctattgcagaacatcaagagcatccatacaaaaacattaggaccattgacagcaccaattgacaagaaggaaatgaaaagagcacccatacaaaaatttctgaaataaaatacatctggatcattaagagcatcaggagcatcgtacaaatcagtagcatcctgtatagaacacttcatatcatgcacacaccaaatttcatttccaccatacatacaaaacactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagct

SEQ ID NO: 78976 - DNA, 1454 bp, Oryza sativa
ttaaacggctggacggttttatagcattgagcacatactaatacatgttcttttaagtaagtgatgtcattaacttttttatgatgtttgatcatcttatttttttaaaaaaaatgattcagtatcatttattttgttgttatttgttttatcattaacggaattcaagaatgactttttttaatggctgtagtaaatttttgaataactgaataagacaaatatttaaatttcaatcaaaagttaacaacgtcatctattaaaaatgagatggagtatcaatgacgtacctacatgtaactacccgatgtccttagacaccaggtagcttgtctatttctagctattttatatcatattaatcatcatataactcaaaaattagactataagtaatttttattttgagttcaccaacggaggatattatgtaggcacacgaattaattagttggagtaaccagtgatcaagaaaaatggtttccaaacggatatatgttgagtatcgtgtaatgtcccttcaggtcaccaactagctctcatatgattattcaacagagtattcacaccttgttaacgttccctttctgtttctattttacagtttctccaccagccggcttccatgatcatccccacagaggtttgtgatttcttaatccccgttgatacagctgtgcatagttttatatttacacgctaatctcatgaacaattaatttagcttaagttttaataaagtatagttattatatgttattcctgaattctgatcttacaattttcttccattttgtatgtggcacctgttccttcaggattcgagaatgttacctacatgctcgaggtaactaattaacagtttgattcatttccatcaacaatattgtagtattggcgtatcagttgtaataggaaaaccaccaagaatatatttaatctgtcacacaattccatctcattctttctaaaagaatatttagtgacaaattaactgttgttcttaactaattttaatctgttgttttcagggaggcttcagttaccatgacttttcaggccacaagggcaccatcaacacaggagatgttcaggttaggtctccaactgtaccattaaacttagagttggactactcagagcaatatcctttataacttgtccctgttttcctttttccttattttcgttgaaattaacagcctaacaacaactatgaatagtgttatagtactgttcttcaagtaattacttctccatttcaaattacttgtcgttctaactttatctaaagccaaacatttatatcattgacatttactttctaaaagttcatataatttaacatcataagtttattttttagattcaccataaaaaagactttcataatatataattcacttgtagttataatagctagacgaatttttagaaatatatattaatggcta

SEQ ID NO: 78977 - DNA, 2100 bp, Oryza sativa
agatcgaggtagcgctggattcaattttattatcgaaaaaaaactagcttcattctgagtacgcaccatatatatatatttcaaatacacctactcacacgcgcgcacatccatataagtatgtcataacacacgtctaaataagattaaagacctgatatcatgtactcccttatattaaaaaaaaactttattatgtcgagattcaaacctagaattagattttttttcggacggaagaagtagcacacaagcatgcacgcgctttaatggttgaacatactaccatatctcaaaatgtacaaatttattctactcactccatttctacatatgattatttctgagttgtttaaaaaaatataaacatttatatattgttttattttttttcctcttcagctatcttattggttaatttttaaatcgcttgcatttcactccaaccatttgatatgttggaatgcttagatttccatgtgatggatttagtattaaaaaatgtttatattttgtacaaaatttgaatactttaaatgtttagatttccatgtattggaattagtataaaaaatccttatattgtgtaaaaattggagtacctggatttaaactctgaaagaaaatacgagcagcctgtcgagcagatatcatacgtttaatcgatctgatgtctgaaaggaaaatacgagcaacgtcgtaactcgtacgtgtatagccgggcagatgctggtggacatgttccatatataaaagaaaagactccagctatcttaaaaagtactccctcgtaaaggaaatcgtttaggataatgtttaagtcaaaccttgaaaatataaattatgaataactcttaagttgttgagtttgaaaatgtaaaaattatgtgaatagatttgtcttgaaaaatactttcataaaagtatacatatatcacttttcaataaatttttttatagaaacaagaagtcaaagttgtgttttgtagaccatgtcgctgtccaaaacggcttcctttatgagtatggagggagtatgctaactactctcgttttggtttcatatcgttttggtttcatatttcaagacggtttgattttctttgtttcatcaagtacataaaaaaaaatctaataactgaataatttaattctgacagtaggtttgttttgcgttggaaatgttacaatgtttttctataaacttgattaatttttttagaaaacaacctaaaacggggaagagagtatgtcgttagttttctctatacttctgtaaaatcaaagtgtttttcattgttattctatgatgaacaattggcattgaagattattggttttgatatttgaagattattggcaaagtgattttggagatgattgattttcaggtgatgaacagggttactgtttttatcgggaccgggatgaacagggttactgttggaccggtcagaccggcggaacaacggcggtcagaccggcgacagcaacaggaggcggcgacaggttttggtgattagaccggtgatctataccggtcagaccgatagcttctagacagtcagaccggcgcttcaccttcggtcggaccatgatccgtcgaatttgagagtaacttttaatttcgcaaaaagtttaggttttgggtataccaaccattcacacctccctctggttaacttagttattgtgtttcgatccaacgagttcctctcctccacacatgtgagttacataaatccttttatgacaaacccatgtcaacaaccttcattgtaagaaatggctgttgagggagacatgagatatattctaaaaaaaatgaaagaaaaataaaaaaaagaaagaaaggaagggagacatcagacatgagatgcccaggtggattagggtcggccggcggccgtgatcgaccaacaacggcatgcatgcatgcaaggggtgacgtcatgacgagatacggagggtggggatccacggcgggccgcccccgttcacactatcgccatttactaatccgcatagggttggcggtgggcccaccctccccgccttagcgttcacacctgttcctttcccgcgcttccgattcggggc

SEQ ID NO: 78978 - DNA, 2471 bp, Oryza sativa
atttgatttgattgtgaaccactatgatgtctgttaatctgtgatgtttttgtgtatttgatttggtttgatgttgaatctagatgggggaaatgggaggagaatgagaagctactgctaccggccgaaacggcggtgggcggtggctgcctattttttttaatgccaggtgctattttcgcaggcggaccagttgtccgtctacgaaaatcaactattttaacagtcgttcagttgcagacggacaattggcccgcctgtgaaatcctgtttaggccgcctgcgaatttctagtagtggcgtcgacgtcggcgagcacggcgatgagcgggcagcacggctccctgctgggcggcggcgccgcccccaccaccgcgtggatcagcgcgttcagcacgctcccgcacacccctagcttccccacctccaccggtcacttgccattgccatccgccttctccaccgccggcggcgcggcccgcggaacgatcggtggcaggcagttggatttcccgagtttgcacgccgccgacggcttagcgccggtgaggcacagcacggccaccgccaccacggcgacgagggcagcgtgcgccgtgatgctgctccctgtttgcgccattaattcgctacagctaagctagcttttgcttgttagttgtattgtgcttattcttcagctaacttgctttgatagagtatttgtaggggattataggaggatatgtatggctaaattaggcatcggtgattagcctgcttaaataaggagtttcatccaggtattatgcaggggactttgtggcagtttttgccatcttaaatggaaaagattcagttgtcatatcgtgtatctgtggtaaatacacggtatgagaaccgaagcttttgcccagaagataggggtaattattcacgtaggattattttttgatgagttggagaagagacgatagaagagatagcatgggtaactataaacaggtacaatagcatacgataagccagttataaatatattttaaagagataaaagaggagagagtagagcagcgggctacagatctgtagccagctgcagcacggattccaagataaaacgtgtgtatgacatgtgggaccagattaatagtgtagtaagtaactattatacgaattggctattaatttggctatagatgatttggagctagtagttggctatactattaaacttgctctaattggtcgtgtggctgcacactcagcccaaggacggagtcctcaccggagtcgtcgatgttgcatcccacgggctactgccctcgtccatggacaccgacgccaacgcctacgtcctcgtctgatgtcaccaccgccatcctcgcccacgaacgccgacgctgccctcgtcctcttccgccaccaccttcatcctcgtccgcgtccgttactgacaccatagtgtgccactgtcgatgcccttgtcctcgtccgtcgtgtcctccaccgcgctgccgctgccctcatctattgttggtgccaccgtccttgtcctcatttgttgcagctgccgactccctcgtcctcttccaccgcgctcgtcgcctccatcagtcactgctgttgcgctcgtcctccgtgtcctctgccaccgccgccatcatccaccatgaccgctgcagccagcgctatcaccgtcttctcgagctggcgaccaccgagcataaagaagacaaggaaaacggtaaaaaagaaaaataggcactgaagaagtggtgggaggaagaaagagaagggacaggagaagatagcaggccccacaaaaatagtagactaatatttgtgtggtagtataatatttttattgtatctttacaatccgcttctcctctcttctctcctccaccttagtatttagctggcttatagcctactattatacttgctcttaattacaacagcctgcaggctagctgcttcatgcatgtcacagtgatagtcgtcagtccgattgagtatgcatagctatggtcggcctgttagtgtggtgacatggtgagtgtgtggctatcctgctcagtcccaactacaatctgcctccttccaatcaggccttcttctccgccaatcaactcgttgattatccccgtcgcttcgtggttgaagttctggtttttataaatacatgactatgaatctgtacagtctatcatcatgatctccaggtcccttctagccaaacataaatatttgagctctgttttgccaagatgctttaactctagttctcgatgcatccagttcctagcagattctcaccggtcactaccatctccttcctgctagcaccctcacttagcaaggataaatgcatgtaatgacaggaacaggctggtcaggctctatagttttgacgtgtttatatatggggccttccccagcattccacatcaactacatcactactacagaggtgatttttctggaca

SEQ ID NO: 78979 - DNA, 1320 bp, Oryza sativa
ccctagcacgtgctaaccgtggggggtaacctattatcctgtgcggttggtataatttgaccgcattatcccgtgcggtcggccttattacaccgcatgggataatacattatcccgtgcggtccgtataacccgaccgcacaagataatcgattatcccgtacgggcaggccgaccgcacacgaaaataaagattttcccagacgaggagctgcaggcgggccgggcaaccgcacgggataatctattcaaccgcccggaaaaatgggtattgtagtagtgcatatttagggcctcttatatataggcaccgggaacatgaggtacatggagtgatgtacacaagcagatcctctgatcacttacttcccactgactttgaatcactggtacgtgggttgttgggtagatggcccacatatcagtgacccacgttagagaaaagtaacttggaggatctcaatctgtaatatactacttctcataatttggtttataataacaatccattgattccaaatagttcagtgaatactacggattagtctacaaatgcaacacatatagtagaatcaaagtagcaagtcgatcatggcacgctgcaatggaacacttcgggctagacccttttgttttatgaaagaacatgcgacccttcttgccttaatgagcaaatataaaaaatggtgagtgcatcaaaacatgtctctggacgaggggttctgttttttctggaacttgttgatggatgtagagtggagatggctagggacagtgttgtggatctgagagaaagggtggtcatggcggccatacatggtgaagaagaggatgggaaagttgagggcaaactcttaccgaggcgattttggtgtgacggagatgtggagggcaaggtgcgggagtgtcttagcgatcatcgatgacattttagtagttagagacttagaggcagggcctatgtgcgaagagagatagagatagagagatgggggacttgacatgtggacctagggtatttcaaagaattcacatgatttctctcttcaatttaaccgaaaataaatattctaatggacgcggtgtccatgatctaattttcatgtttacagagtgtttctccccaaagtcacttcatgtagtgttctacagctaaaaccgtgaagtcatgatgtcctgttgttaacagtgaaatttggtaaagcccgaagacatcatcggctgagagtcagtgtcggcttccgagttctagagacagccaatggtagtcattaagtcgccatgctgtcgtgttcctggtggaatcggatcagtcaaagg

SEQ ID NO: 78980 - DNA, 18089 bp, Oryza sativa
aagaagaaagatggaaaattatggcatgattaatgattacaagtcaaaggacattgcatcaaatatacatgtgtctaatgtttaaaagatttggcataaactttatctaaccagcattaaaacatgtttttttgttgaaattatgtagtgttaggaaagttctgcttgttgaggcacgcagcagaagacaattcaatgcgtccaaatataatacctctagattgctgttgacaacacatactcggaccaaggcttccgtaccatcatggcaaaggaccatctcacagtcaattgccaacatagttgacttcataaaattggtaattttgccttcacgcagcactttccatccctgtcaacatgtcagtaaatctggagttatagaaaaccatagacatctctaatcttcgcaatgggtgacatgaagtcagagaaattctcctgtattaaacactactgaagtacagtagatagacaatactccctacatgtttttgttaacatttaatacagcggtagaagtgcgggcggaaaagaataaaatcatacactttgaattaatgaaagaacaattcagcttgtacctctttgtaagatgggaaattataatttttcctgtactccgggtgttctgctgtcagttgaacaagcttctgcattttgcagaatatacatcaaaacaattgttaaccaagttttgacacctttgtcttggttataaccagaacaatccagaaactacacaatcatgagatagcataaataataccagctgaggagaaatcttgtcaggaaattccttcaggaactgctcaaaagcacttcgttcgttcagacgccttatcaattttccgaagtactgtaatcaaaaaggagaaagacacaaattgtcagtatctctactcaaagagaaatttaaggatgcctgacgaaattcgtggaacgaaacccatcgaactgaatcaaaataccaccttctggaaatctttggagaaggttagcaggaaagcaagcagcacatccttggaccgcttcttggggtcactcacggaagctccgaacttcttgtcgttccgagccaagaaatccttccatcccccctcggcgcccttgagcccgttcttctgggtgaacctgacgatctcaacgagcacctgacaacgaacacagcaacgcagaatcaggggagaataactcacgccaggtttccgcttgctgctgccttgcttttacctctttctcggcgccggcgagccgcttgcccattagacgaccacgtggaaacaagcaaggaagagcaggggaagggagtaggaagcaaggggaccgcgggttgcggcggccgctcgttctcgtgggcggcggcggcggcggtcgggaagtggcggcacggagaaaaccgccggaaaaaaataaaacaaaacccttctctttgctgccgcaagcgaagatcggtgggtaagtagaaaatacggcccagcacgttaactgggccgctttggctaaatttgtgaaatcgatcagtgggttcagcccacataaggtccatgtagtaaatgagattttcttctttaaaagcctatctttttatgtaaaacaggtccatatagttaggtctgcaaattaattaagttattattagtatatgaaaaaaggccaaatggccccgagtgacaatctttatatttgttgattttagtattatatccactgagttagcaaaatgggatcgaattggttagtttaatgcagtgatccaatgcaaattgagttcacgttccggccgatccatttctttcgcgtgtcgattgcttcgaaccggctgaaatgaatcgacgagtcagcattctagggaggtcggaagcaggcaggctgcaggcatacgcgttgaactgagctggcctccaaaacctaacctagtaatagtaagatcatcgatgacgccatggacctgatcagatcgcacaacccaaaagctgaggcgtatctggaggctggagcccagcattctcgcaatctcgcccgtgccaatcgcctaatccacgcgtgcacttgcatttcttaatgcgattgatatccatcctgtcatggccaggttcttcgtagcttagctgctcgtgtcaacgctgacattgtcacagttcaaagtcagatacacgctcaattacacagccagtacacaaatcaaaccttccatctgacagagtagcaaaaaaacaagtactgtatgctgtactacgagcatgcgtggcaatctggtctggatgggtgcggacaatctgaagcatatccctgacgtgtcacagccaagtaagtgccagcctcatcgcaaattcgcagagcgatcggcttgtccgtgctcgatcccgtgtcgcaaaacgcgattactttgtctgacgaagtgagtgttacctccagcttattagccttatctccggctttgctattggtcaacacgatgaggtagcatgctcagctccaaccaaatggcggcacaaagaaataatttaacgactcgtgcacgcgcattatatttcttactcgtgccgataactacgttgatgcatgctaatgcttgtgtgtgacgtattcttccccggttatagcatgtgtgcccatgcgaaggtacgtgtttggttcatatgtaactgatcgattatccatcaccggttaattaagcataactgcaaaaataaagggattgggaaataacatgcccaaagatgtttctctcggccacagttacacggtggttgcttttttttccccctccaaacagtgaaaaagaccgatactatttgcagactatgacttgcaaggaacaaaagataaatgagaaaaaaaatatcttttcggttaagatttttaacggcaagtaaaacgatattcaatagtatatgattaattgagtataaattattataaatttgaaagatgaatttgtttatcttttaaaagaaatttctatatagaaagtttttgtaaaaaaaacaccattcagcagcttgaaaaacgtgctcgcttgaatcgaggaatttactaagtccaaaaatcaaatagaacacaacttgaggccccctttgattcaaaggaaattcatagaaattttaaaggatttcattcctataggaattttttctatatagccctttgaatcaaaggaatgaattctctgtaatcccatgaacttcctatggaatgtctcttctcatgcaagttttggaggaaatttagcatgaggttctacctcgtgttaagaatcctttgagtctttatctctccttaaattcctgtgtttttcctgcagctaaattaaacggtcattcttatatttttcctgtgttttgcaatcctctgttttacacttgtattcctgtcagaatcctatgtttttcctattcctctgttttttcattcctatgattaaaaggggccctgattgtttaatatcgtgaatgggctgttcgtactccttctctctcaaagtaaaagcatttctagaatggaattgccaaatcacgtttgacagaaaaatacagttaaaaatcttgtaaatttctgatcttcaaattcacttcacagcatgtgtcaagcctcctcctcgacatcgacaaactctggcgataggagatggcctgacgagttaaggtttaggttggcgttggggttagggtgagaggggagtaagggggaggaggaagagatggtcgtgagaagcaacaactattgattagcttaattaattagatgatcttcaaaaaaatattggaggggtcctagcctctgcatgttcctctgtttttgccttagcactgctcaagtcgcgagatagatagtgggtgatagatcagcgttgacagcaactcagcaagggtaaaactaatctaccagttaggaggcagggacggtgtggttgcaactggaacacattcccgccctgtcctgaaagccatacggtagtattgtagtactctagtactctctccgtaaaaaaaaaaaacaaaccttatgtttatgtgtcaacgtttaactgtctattttatatgaatttttttataattagtatttttattgttgttagatgataaaatataattaatactttatacgttatttgttttttaaattttttatattattttaattttaaataagaaggacagtcaaacgtcggagtcgtcttttttggaagggtgggagtagatcgtttaaacgtttgaggtttcagctggctggtagctagagagatcgaggacggggactggcagagcaacgagcacagctagcggaggttgagttatggctgggctggacgagcgggccatcgagtcgcaaaagtagcggacgttcgtacggggtggatctgggaggatcttggcactggggcacaagaccttcttggggagccgtgcgtgcgggtcatcaggtcaggtccaccaacgacgccgggccgccttgtccgacgcgaaaagtgggggaatccaccgcgccgcgcggccccccggccgaccacaactggagggaaacggacggccgttgcttggttggtttctgacgcctctgcctctgcttcctgctcgcctgcgcccccgcgtcatgtgcggtcgaaaagcgcggcttgcctgctgcctcgttgtcctcctcgtgcatcccgatgctcacggccgccatggctttcagcgctcggtacactttcgcatgagatggagtcgtggaggcccaggtgtgtacaccgagcaattctacacaaacttcaatcgcgatttctaaaaacctgtgtaacaacatggttaacatggagaattaagcaggggacctttgtctgcttgagttaaggtctttgtactttgctccccgtttcttgccttcaaaaatggcttgctatggctggtgaaattccgggggacaccagccgcatgacaaattgacaataggcagagggacaaacaactcaaaacaagtcgaccattgttctatagctcgtgcatgctctaagagcaggtacaatagcagactattagccggctgtaaatatattttaatgaaataaaagatgagagagaagaacagcgggctacagatctgtagccagctgcagcgcaaactccaagacgcaatgtgcgtatgacaggtgggaccatatattaattacatataaaaagcaattattgtatgaattaactattaaattggctatagataaattagagctagtaatgggctatactattaaacttgctctaatctctatagtcaaatcaaccatttttctatgcagcctgcactttgtagcagtgtgcaatttgcaaatagacaatggcagtactaccactagtactggaatgaatctgcgtgagagtcagtgttcactgcaccctccactcgacagccgtttcaaaacttgcatattcctccagttagcttacatacatgcgcgcgcgtacgtgtggaaccaactcagcctagtacgtttccttaattcttaatccaaccagatcagattaaataatcttctccatgctagctgctcggcgccaaggcggctgtctgtcttgtctttcctccctaatttgattcattgattcttagctccagataattaggatctgtctgtctgccattcgtgtgtggtgctgcacgagtacttgagtggtaattgctactctcgctttccattgcacttgcaaagttactgtgatgaaaaggaagggtttaacccaagtaaattttggttttaatctctggctcatcgagtgctcaaaagctttgcatcagactggcctctcggctcatgaagtgcccggcagggctgcgcgtggcggcccgtccatcgggagggagtgatggggagccacacgtcagcctcagcatacagttccccgggcccacatggcagcgaccggcacagtgacgccggagaagagggcctagtgccacgaatctgcatctggctgcttcctctcacgtgcgtataccagctggtattactcctactacgtactgtactgttgcataggccctgttgagattcaaaattttctcttcaaacttctaacttttacatcacatcaaacttttctacacacaaacttctaacttttccgtcacattattccaatttcttcaaacttttaattttgacgtggaattaaacacagcctaagcttctctctcttttttttcttttgatattcatggctaccgcactcgagtacagagcagtttgttgatggagtccaaagattcggatcttggagggaccctgaagacgacagcttttgcctccgtttcaacatcagattccaagatgcacattggcagagatagatgccggtccaggacgcaacgatcgaatcaaggctcgccacaaacaaaggattccagcaggataagcagtggtccagccccgggggttgatagtggctcttcgccttgttttcctagtgaaattgctcacgtcttcagacaaaaagagtgaaattgctccagaaaatggccgatccattttgaaagtgcaatagtgtcaaaactcaggtctgtgacttgattgcatgagaacagtagtgttagtgaaagcgaaataactaaaatgaatatatgtagagacatgcttatgtgcaactttttaatctcagccactgatgatctttaatttccgtgtaatttttttttcgagcacataagcacatctcgtatctcgtgtatgtattaacttcgaaacccgataaataaatctttatattgtcacttttgtggaatagtatgcgcttactgttgtatggtgatgacatgtaggtttgaggttttcaactacagtggcagtcactctagaaatgtcagtgtcttgtggaaaatgaacatgtctcggaacttctaaaatttttagggttgttcagattgataccgttttcaatcatattattttttagtaaagttgtcaaaaaaatctacgtttaatttgttgctaattttggtaaatacataagaaatcatgctaaaattttagcaatattaccatcttgctaaaattttggtaaaatttattttggctacaatctaaacatgccctttactccctccgtcccaaaaaaagacaaaccctggtttccgtatccaacgtttgaccgtccgtcttatttgaaaaaattatgaaaaaattaaaaagagaagtcacgcataaaacattaatcatgttttatcatctaacaacaatgaaaatacgaattataaaaaaatcatataagacggatagtcaaagttgtacacggaaattcagggtttgtctttttttaggacggagggagtatgtcatatgtgtgttgcttgctggagagaactgataccagcatccactcctttgggacgcaggtgaaaatacgaggcatctctcactgtccctgatcaggacatacacctggatttaaatggttattagatcagatttaacatgcaacatgcacacatattcaaaaataaaactaaaaagacgaaagggcactaaaagcatcctttatgtgggacaggccaattactatcatgctggagatggaaagcaacggattacagttttaactcatagtgtgcctaactttgacatgaatttgcgggtattttatcctacgcgttaacccctagccagtaaaatctgctaagtgctaacgtaatccttgaggacaggatattctgagagttttcaaggaaagtacgatgctaatgtcaccaatacgtggaatattcatagtaaactaaactactattggtagtggaatcctgaagattcacttaataatgctcatggaatgacatcattcgtggaaagaaaccagacatcatcgcgcagtatccttcctttcaggtttggagggattgcagtagctaatttcattttgctgactaaccttgactaaaagagttatttaatttgtaaagcacaattgaagtactgaaagattgcaatttggagtattgaaagttcagagcgcaccagcgaggtctgaattgtaaacacctttttattacccctttttttttttaggaaaagcactagcgaggtgtcacgtctacacttagcgtagcagaagcgttcactgtaattgcgatgaaaagttgacaggccacgttaattctgcttgctccaatcgatcaggaaatgcgctattgtgcatgtcacgtccttagttggatcgaaaaagatgcaagtgcgtcaccgattcgtttggtctgaaactatattttgcttccgaggagattaaaacgaatctgggaagaacatgttcttgtttatgcctcgttccaccggatcagctactattgttcgtccaaaaagaatgcaagtagcagattaattacactccacgcccttaagaattcgatcaaaatcacgcacgtaattactctgcagtttccacggaatccttgtttacactttcctcattgtgacagatacgaatcagggtgctaaaattaaacccgagattacagcggagtatattccgaagaacaggaatcttctgagtttactccagatataagcatttattccttgcctttaaaggcctgatatctcacagaatccattagtttcattttgagagtggaacggctgccatttgtaaacaaccttccacaatatttcgctgtgtactagtactatactactatacacagaaatctaatatgcgtcacaaacaggaaagaactggcagaaaaatatacgcctcccactttccttgcaaaactgtaggatatccaaatgcatcgcgaatcgcagcaaaccgagaaatcccacgggaaactattttaatccctcgagagaatatcccctcgttctttgtatgtcactcaaatggtcatgaaaaaaattgaaaaaaaatgagaatgtgtattaacatgtgatataatactctacaaacatgtaagttcaaattcaactcctatatatcgtaacgaaagaaacaaattaaactgtagctagttaacatatatttagagtcaaatttgtttttttcattgtgagatgtagaagttaatttttttacttgcctgtttgtacagtgatatatcacatgttaatatattttcttaaatttttaaaatttttttcataaccatttaagtgacaggcaagcaacgagaggatatccgtccgagggatcaaaatcctcttccgaaatcccacccaaatttcattcctgctgaaggaactagaagctttataaccgcgataaaaaatacaagcgacagcgatttaggcagtagaatcccccgcgacccgaggagattagtctaattaacaagtgcagattccctagcatctcgtgctgtgtttaactgcgtgagtgcgcatccgcccctgattcccaacttgcgcctgcttgtctggattccacagaatcacgcctcggatcttctgcgccaacgccgccccccttcccaaaagaaagaaaaacaaacaaacaacggcgttggctacagttgggtgtcgcccagcctggctcgaaaacacacacgcgacgcggtcgcggtcacgcacaaaatacacgacccatgcggtgccccctcccggactcgagttctccataacccaacccagcggcggaaacccctcacgtccgacccctataaatacccaccatctgccgcgccatcccatcgcaacgcacgcacaattcacagcaacacaagcagaagcacagtagaacgcctaggaaatactacgtcgatggcgaggtgggccattgcgatccacggcggcgccggggtggacccgaacctgccggagcacaggcaggaggaggcgaagcgcgtgctggcgcggtgcctgcaggtgggcgtggacgcgctgcgctccggcgcggcggcgctggacgtcgtggaggccgtggtgcgggagctggagagcgaccccttcttcaactccgggaggggctccgcgctcacccgcctcggcaccgtcgagatggaggccagcatcatggacggccgcggccgccgctgcggcgccgtctccggcgtctccaccgtcaagaaccccgtctccctcgcccgcctcgtcatggacaagtccccccactcctacctcgccttcgacggcgccgagcagttcgcgcgcgaccaggtaaattatctttcgctaattaacccacacccaactaataaatcccttccaattaattatgctaatttcctggttaatctaacctgcctctgcacgctaattaacaaaacatttttaatgtggaattattctgtggacatggcacgagggaacgacggatattaataccggacagccaaaatctaatggtggtaggaaataattaaaaactgggacatgttcgacacgtgtaaatgacgtccgggaagccatgtacaagtgtgcaacatgaacctccaaacagtaaacagagcagcaacagctctgcattaccaaaaatggctccttgtttccttgcacagttcaatccagcaagattccattccaacacgacaacacatgcatgtgaatcctactacggctttacatgaaaaaaaaaagtaaccttttttctgttagcttatttgtaggatataagtgcaagaaatctttagtttcgtttttttctatatcccttaatcctattgagtcatttgggtgaacatgtcatctaactatgtgagttgcatgcttatctagctttacgtgatttagtgggaaatacaattgatgtgatagaggtttaattcaataggccaacaagttaagcaatcttgcttaacaatttctatgtttttgctgcatgtgcatacaaatacatccacgcatctgaaaatttttctgtgtttttgctcacgagttttaccattttcctttttgtttatgcttgtgcacaccttcacgtgctgtcgccttttcgtccccgggtctttggagaaagctgtggaccaaaaacgagctggtttctagtagtatcaatgaaagcaacagcggcgcaactgcctcctgctgtgcttgaatttccctatcaatcgctagagcggccattagcttgtaggtgtagtaatttcttcgttagtgttggcgaaggtattcatttctttcccttacatcaagtgctgagaaaaaagaaaactaaaaaagtgccacccaacatgcatcaatagccgccatgcaggtttgcacctaccaaatcctttttttttcatttatttggtcgacacgattcgtgttaaaccttcctgcggtattttgtatcgcctagtagtatagtcgttcgagtcctcaagtcaagattgtgtagcacccagccacccacaccaagcaaagcctaggagcactgaaaatgaaatgaccagtccgatgcatgtgccggaaaaaacatttttcttcactaaacaaaagtaaacactagaaccaactactccgtggcactgtagcaactactagcatgtactaggatggattctatgcacagctaggcaggctctccactgtgccagattcggcgctgctcctgtttctttctgcccggtcgaattttggcaggaccagcagctgcaggaggaatccgtcctaccagcgtggtccacccgaatcctgcagatctcacggtgtagtggtggctgcgtagccaagtacaggagtattagtagttaagaaacgtttttaagatagatttgattataatcaaaatggatttggactggtctgattttttttctctgtggtcactgtttgcagggtctagaggtcgtcgacaacagctacttcatcaccgaggacaacgtcggcatgctgaagctcgccaaggaggccaacagcatcttggtccgtcgatcattacatttcattgactcatgtacattacttgaaaattgctgacatctaacggtgattaatttggtacgagcagtttgactaccgtatcccgctgtccgggtcggagacgtgcggcgcacaggccgtgtcgtcggacaacagccacggcaacggcatggtgatgaacggcctccccatcagcatctacgcgccagagacggtggggtgcgcggtggtggactccagcggccacaccgcggcggccacgtccacgggcgggctgatgaataagatgacggggcgcatcggcgactcgccgctgatcgggtcggggacctacgcgtgcggcgcgtgcgcggtgtcgtgcacgggggaaggcgaggccatcatccgctccacgctcgcgcgcgacgtcgccgccgtgatggagtacaggggcgccgggctgcaggaggccgtcgactactgcgtcaagaagcggctcgacgaagggttcgcggggctcatcgccgtgtccagcacgggcgaggtggcgtacgggttcaactgcaccggcatgttcagagggtgcgccaccgaggacggattcatggaggtcggcatctgggagtgaggtgggcagcctttgtgcgtgcgtgcgtgggcctgtggccatcatgcgattgccatagagtggtgtcttggggtcatgggccgcctcccgtgtgttcgtgggctagaattagtgggtattaattagtggattggggagattggaggtgggcttgaataatgacgatgatggcgataattcgtctggaaataataatgtgaaaagttatattgctaccgaggtgtgacatgttttctgttctgtagctatttcctcactgtctctctcaattctgtacatcaaatcgctctaaactggagttagcgtgtgttgcgctagtttaggatatgttcggttaatcctgaaagggaggaaggaattggaggggatttattccacatctattatggtgtggatttatttcccctcagacaccttcaatccccttcaaccccttccgaaccgaagaaggtcttagggagaagtttactgtagagcaaagggtttctttggttggacttcctgctattgattcctggactgtgatcttgtataggctttccaattgctccggcccataattggttgtcgcacatagatataaggcccatctatcttacctgctctgactttcaagctctcatcatttccttattcagcatcagttgccaacatttaaattttttaaaaataaattagagttgatatcaaagttttctcatcaaagtttattttttgacattagaatttaaaccgctaagagcatatatatatatatatatatatactcacaaattattattactttgctaatattatccgtattaggctaaacgatgggggcctcaatctttttctcatctccatttttctggccccactttgcctctggcatctacgcaccatttaaactgtaagttgttcgtggcagtggcaatttctgtgaatgtcccaaccggttcttgcgttagttcaacttttctttttgttatccaaggaataccatatgatcatatgatcgtacctattccgacagttcgactgagcacggcatgcatgttgttagttggatgaaataccaaagggcaagttggtgctcaagtgatgtcatcacttaggtggcgaaaggatttgatgaattgcagacagcacaccttgccagcctcatcctccctctggattagtcacgtacttgttggccgcccgtgtactactccactaaatcccctaatcagtagagcatccgatcagggcagatcagccatcaggccatcaggtgtattggatcacggattctacgactaagccatattactgtagtgtttagtgtagcaatcagaaccgacaaactggtagctatagctttagctaatgcggcgctaaacaaaaaattagtcggaccgaagattccaacacgactctttgcttgtttattgtatatggccacttgaggcagacaacaacaatcgcgtccatgtgcaatgtaactgtgccactccgcagtgagcccgaaacctctccttttcggcgtgcagatgtaatgcgaaatcgcgaatcgatcagccattcagccaagccggccgtcagattcccgtcttccaacggctccgcggccaccagcttgcgctgcgcggctgcggcgatcgcgatcgcccggcgcttctgtgttttgaccccgtgctgcgattcgcgaagcgatgcgtttgttgttgtgttatgtcgtcgcgcccccgcgcgcgcatcggcatcgggccgtggccgccgtcggtccagccagccaccaaccgcccactaagaatatctcgtctactttcttcgtcacataaaaaacgaatataaaacagatataacatattatatatatttagatttataatattaagatacgtcatattcgatacttgattgtttttttaaaggaatggaggcagtactcggctagggtgcgtgtgcgcgcgcgtggcccaccgttttttttttcctcttgagcacactgacgtggtggaccagaagtggtgctatttctcagagggaccggaccacctgcgtccgggcctcctgccattacgtgatgatgtgtaaaggacgaggctttttgagcacacaggggaggaaaaaacctcggcaaagtaggcggcgctgggtgcagatcttttccgttttgttggtaggagaagaatttgccttgcacggtttgcgcctcgctcgttcagcatagtagcataccacctaccgcagcaatggacgtaccaacaagcgtacgagtgttgctcaccagagctactactaccggtctgtcacgctcaccctagtataaggatcaatgagacttttcatcctcccaggagacttttccccttgccaatgtagcagcagctcagcaaatttgatcgtgtttgtgtgtatgtccaatctatcactgctaagccaaaatattacaatactacactactatgcagtaccctttttttgttacgaaatataataatttataattagatgaaacgtactttggtaccatgaaactagatagatcatctgttttgttatagtactacgatgatttgcaataccaactaggcagttttaaatttgccattttgctagtacttgaccagccaagcgagtgaccccaaatcggcctcctcaatcaaggttaggtaggtgccaatcaatttgatctctcacctcactctcgtgggctcaccacctcacctcgctataagtaaaagcgccgcacgcaacccaccaaagcccacccacatcgccgcctcctcctccttcctcggtttcccccaaaaaccccaaacccctcctcctcgccatggcggcgccgtcccagaccaccgccaccaccacccaccaccgcgtcctcctcccgtcccaccaccaccaccgagcggtgcctccctcgctcctccgcctcccgctccgcgccgcgcgccggggccgcctctccgccgccgccgcggccgcggcgcccgccgcgtcgaccgcggcgccgtcggagcccgccgcgggtgccgtaccggggaagccgacggtgctcgtggccgagaagctcggcgccgcggggctcgagctgctccgggggttcgccaacgtggactgctcctacggcctctcccccgaggagctccgcgccaagatcccgctctgcgacgcgctcatcgtgcggtcggggaccaaggtggggcgcgacgtgttcgaggcatccgggggaaggctccgcgtcgtggggcgcgccggggtcgggatcgacaacgtcgatctcgccgccgccaccgagcacgggtgcctcgtcgtcaacgcacccacggcgaacaccgtcgccgcggccgagcacggcatcgcgctgctcaccgctatgtccaggaacatcgcccaggccgacgcgtcgctcaaggctggtgagtgcgcacaccctcctcaagtctggaaaagacacctctttaaaaaatgatactgtacttgtctcgatctctgtttaaagcattaaaaaaatcttgcatcaacgtggcacctgtaacagtggatcgtgctagaacgtctgtttgatgaattgctagcaaatcgagaaacacgaatgggtgctttttcactagaagcagtcctcagagattactttcgttacttcattcaatttgacataatcagaaaaagttaatatctgcttcagttgacaaagctagatgcatgaagatgtgaaaatgtggagtaagggtagtcttagatgaagcatctgccatgcaatcttcgaatggcatcttcggaagaagggcaacataccttttcaattatgatgagttcccatgttcttaacaatgtgtcttgtataggtaaatggcagcgcaacaagtatgtgggtgtatctctcgttggtaaaactattgcaattcttggatttggaaaggttgggtcagaagtcgctcgtcgtgctaaaggtttgggaatgcatgtgattgcacacgatccgtatgcttctgctgatcgtgcccatgcaattggagttgagctagtgagcatggaagacgctttgacaactgctgactttatctcgttgcatatgcctcttacccctgcaacaaacaagatgctcaatgatgaaactttcgctaagatgaagaagggtgttagaattataaatgttgcgcgtggtggtgtaattgatgaagatgctctagtcagggctcttgattcaggaatagttgcacaggtatgtttgattctcttagtctacatccttttttcatttcatgctgacatccggtgaattatttttgaacagcttgtttcccagagtcatgctaatttttttgtttatccctctgctttaggctgctcttgatgtgttcactaaagagccaccggcaccagacagcaaattagtgctgcatgagaatgttactgtaacaccacaccttggtgccagcacagttgaagcacaggtatgcgaattagctcagaatgctatccctttgtgttctgttatactagataccaaaatgataaatatctgaaaatcccaggaaggagtggctattgaaatagctgaagctgttattggagctctgaaaggggaacttgcagcttcagcagtcaacgcaccaatggttcctgctgaggtatgaatctattgttttctgctaaatccaacttattccacatggcatttgatttttatcttacatccttgtgatttgttcaggtgctgtcagagcttgcaccttatgttgtgctcgcagagaagcttgggcgcctggctgtgcagctagtggctggtggcggtggtatcaagtccgtgaaagtgacctatgcttctgcaagggctcctgatgatcttgacacgagacttcttcgtgcaatgatcaccaaggggttgatcgaaccaatctccagtgttttcgtcaatctggtcaatgctgacttcactgcgaaacagaggggagttcgtatcactgaggagagaatcttgttggatggctcacccgagacacctattgactacatccaagttcatattgcccatgttgagtccaaatttcccagtgcaatatcggagagtggagagatcactgttgaggggaaggtgaaggatggcatcccccatctgacaaaggttggatcattccaggttgatgtgagcttggaaggaagcctgatcctttgcaggcaggtcgatcaacctggtatgatcggcgcagtaggaagtgtccttggtgaggagaatgttaatgtcagtttcatgagtgttggaagaatcgctcctcgcaagcatgccgtcatggcgattggtgttgatgaggaacctaaaaagagcacactgacaaagattggggagattccggcgattgaagaattcgttttcctcaagctctagattcatgcgttgtatgtttgaagctgcaaacatggtgtgcaattttgatgtagctagctatttaatcaggatctagaggactgatggttctcgttggaataagccttttttgggttatggtgctgtttgtcgagtttgatgcagtgtcttgattaatctggcttaggtttgaacatggtgcttattaataagaagccctctgttaatctatgtttactgtgttctatgtgatatattttttgcttgccatttctgcttttaggctttgtgaccggataatctgttgatagttttaagtaagcctagcttatagcctgctt

SEQ ID NO: 78981 - DNA, 11052 bp, Oryza sativa
agagagagagagagggcgcccgggagagagagggggggccggggaagagatgggccgagcggaattcggcccatcgaacccgggggaggcaaactagacttttgcggagggattcgatttggaaggaattggattcggaattgatctcgacgatcgatcgcggattgagatcttgagatggcacggacactagacaacaagcaaagaaacaaatttcgcaattagggtttttaagagataattttcccgctaggcgccacgacggaacgggcgctacaccagacgtggccattctgcacgggctgggtgatccgggttagtaatgttgagtaggtaaagtgtaccccctctgcagaggttattaaactgttcgaacaactgtgcccacggtcatgggcggatgtgaggtgattcctagcgtagttttgtttgactactgcttgtgaaattgctgttgtggaatgggttcgatgtttggaaaaatctgcggtggatgggatcagccaggcccgggtggccgtttgaaaagctgttggccgggagccaaccttgatctaatcaaagactgatacattgtgtcgacgtttgatgtcgcaattctggtatttgcatggtatggggatcgtcggtgctaaggtatacgtgagactaaggtaaaagagatggagacagggatttttatacaggttcggcccctgagttgtcaggtaatcaccctacatcctgttggccgaagccggtattgctcttattcaccataatcacatcagtacaatatttggggtagccaatctaactgttgtcgacatggcggtctgacgatctgactcgtagtcgacaacagggtagccttcctcctcgaatccgtgcccggcgagatcagagatagcgctttcgtttctcctgacactatccggagacaccgtagggtattagccgtgcttatccctgaagtcgatatccggcggcgtgtcttggcgtatgtaggcttctatgttgattgtgttgggtgttgatcctgtcgggtgttgatcccgttgggtgttgattgtcttttccccgctctcctcctaggggggcctgtatttatacccataggtgtccccttgtccaagtagaactagggaaaccaatatggatacaatccgagtagtccttgtcgtttccatgtagaactctggttgtctttccttatccggaactccctcgaggtcagtttccgtataagacatggtatgtagtggatcctgccgagatttagtcaactactattaggtatgtcgtatccataacactaacagtagcccccgacttcgatgcaaatgaacgagttcatattctcaaccgcagactttggaggaactgttatcgagctcacatgaccgttctcggtgagtttagagataacgttagacttcctttatcagcctcgtgcgggcaccgaaagggtttgtctaaatcaatctccgatgtcgaccgagaaagtacagagcgtacgactaagtctcccgtcttgctgtaatcgagaatttggattgaagttaagaaattttatctcggcggtacaccatctcttcattccgtattccttgtcgagatccagcaaccgttctcgagtgatcgagaaggcgtagagtctgcgacggaaccttgtcgacatttgtcgtactcgccttagtcgatcttggtgtagaaccatagagacatggagtcttcgataatgtcgaatagaattttcctgaaatcaatactcagaaaagaatattagatagaaatagcccccgagcgaatgctcaaagggtgacatgttataatatgacagactagtgaattgaatgtacagaccagtgctttgtatatgagcgtcttctttcttaccgactccgatcagtcagtttgtagagtcatacactctccctagcccccagccttgtcgtcggagaattgttctcggatgacaaggctcttggacctttgacctgcctcggttgaacaagcactgatcctagcccccagtcatgaagttggaaaattcaatttccgattacacggcttggttaatacgcacggcgagaactcttacacgaccagatcttacatggtctttcgtctctgaaggatccgacaaggccttatcagctctgggcatccccagccgaagttccctcaggttcctcggaggccttgtcaagacggagtaaagggacagtaggataggtttcaacgctaggtgtcatctgggtaagggatctctgggtaaaacacttagcgatcttgtgcacctgatatcaactttgttgaagcaggggtaatgggagaatcactacatcgctggtcgaggaccaggcagtagtcgtaactcgaccacttaaagtggaagtagtgggagaaacgctacatcgctggtcgaggaccaggcagtagtcgtaactcgaccacttgaagtggaaatagtaggaaaattgttacaccgctggtcaagaacctggtgtagtctaaactcgaccactagaagtaattgtacgagagatcgctacgattgactggttgagaaccagtgagtaggtgtctcttgatcatttgaagtcgtggtgcgaggaccgctgcgttattactgtagtcgtacctcgaccatctgaggttgcggtacgagagattgctacgtactggttcgaggaccagcgaacgagtagaattatctctcgaacaccaacggaagctgcagtgcgagagattgctacgtactggttcgaggaccagcgagcgtgtagaattatttctcgaacaccaatggaggtgctagagttggtttattacatgtgcgtctcatgtggctagcatgactcacacacccaacttgtagcatatccggatgtccattcgcaatcatgtcgggtgatcaagccgacggcgttcgtgaggaattatccgttaacaaccttttctcgagtagtccagccatggccggtgctatgagataggtcgtcggtcttcgttggtaggtcggttgcgataactccgcatttgtcgagaatgttctcgataatagagtgtactcgaccacaacctactcgagtgctcaattgttcctgaaaaatattttctagaagacaagacatatagcagataatatcgagtatgtactcaaaaaactgcatggatcttctagtattattatgacataacgagtagatgtaaatgtcagggcattatgtgaaccgtaaataagcatgatttatacagaagaagacagcgagcccccagcgttagatcgtagtcgatttaacatcggggacacccgcgcaacagatattattgtataaagaacatgctctaggtaaacataataaattatagatctgacaatactgtatgatctgaataggtacgataaattgcagataaaatattgcgtacctttgtagatacatgccagatgtatttacgaaattagtagattgatttaaaaaaccaatctaccaattaccttgttgcgtactcgttcgatatcatgcgatctgacatcttttggtacgccgcaaagcttgaggcttggatgatctaaatagaccaagttgtcaatgacgatgatggttccgatctggttaggttggatctccccctcagctgaagtcgtcgagtagctcattgtcggagaatccatcttttgaacccatctcgtcgaaatcctgaagcaccaaaatccccctacctggcgcgccactgtcgacgtttgatgtcgcaattctggtatttgcatggtatggggatcgtcggtgctagggtatacgcgagactgaggtaaaagagatggagacagggatttttatacaggttcgggcccccgagttgtggggtaataaccctacatcctgttggccaaagccggtattgctcttattcaccataatcacaccagtacaatatttggggtagctaatctaactgttgtcgacatggcggtctgacgatctgactcgtagttgacaacagggtagccttcctcctcgaatccgtgcccggcgagatcagagatagcgctttcgtttctcctgacagtatccgaagacaccgtagggtattagccgtacttatccctgaagtcgatatccggcggcgtgtcttggcgtatgtaggcttctatgttgattgtgttgggtgttgatcctatcgggtgttgatcccgttgggtgttgattgtcttgtcccccctctcctcctagggggccctgtatttatacccataggtgtccccttgtccaagtagaactagggaaaccaatatggatacaatcctagtagtccttgtcgtttccatgtagaactctggttgtctttccttatccggaactccctcgaggtcagtttctgtataagacatggtatgtagtggatcctgccgagatttagtcaactactattaggtatgtggtatccataaccctgacacattgcacatactccgaccggacgagacgcactgtctcatccgtgtcgtttgagaagcactcatctagttatttcaaaaatgagtttaattaaaatcaatcgcaaaaacaatagcccttcctttgaagcatgcatttaaacacttaattcccatgacttgctgagtactcttgtactcacccttgctctatataaataatctccccccagttgctgaagaagatgaagtggatgtcacgaccggaattaacccaacgggcgttccttacgtgcgtgtattattccttgtcccaggaggcaaggtacaccgaaagttgatatatttcagagtttatcaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaaaattgagcaagactgagtacaaccaacgtactcaacaagacacacccacaagtgcaggataaatgcaagggagtaaagggggttataatataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataacggagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccctgggacaggtaggcaggactgagcccctagcagcaggacaccggccctgtgccatgacatctcgactaccgggccgcagctcgtgtagccttcatttgtcctagagatgtccatcgacccccaacttcgtccatctccatccgtgtacttttgtttataaccagactgagccacaaactaagccttactgtcacgccccgaactagtcccgaccggaactagcccgtgacgctccaatttagcctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccaggacttggaccaaacatcacaggcgcgacttgggaactaggccgaaaccctaaaactcatcgtagccggcttgctcctggaagaactcctcatcagcaggatccgcttcatcttcttcagcaactggggggggatatttatatagagcaagagtgagtacgggggtactcagcaagccaggggaaataagtgtttaatgcaggcttcaagggaaggctgttgtttttgcaattgattttatttgaactcttttctgaaaacaactaagtgagtgcttctcaaacgacacggatgagacagtgcgtctcgtccggtcggagtatgtgcaatgtgtcaatctttaggattgcaacaaagttggcacccggccaacagctttttaaacggccacccgggccaacaacttttcaaacggccacccgggccaacaacttttcaaacggccactcgggcctagctgatcccatcagctgcagatttttcaaacatcgaaccccttttcacaacagcaatttcacaagcagtagacaaacaaaactacgctaggaatcacctcagatccgcccatgtccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaagctcccccgattagcaatttactcagccaggggcgtcccattccacccatgtggtcgtacttgtcttatgttcggatgaaattccaaggaaacggtccttaagtgcaagagcgggaaaccgtacacccggtaggatccccggtccgcggttttggaaattcatttggttcggaggcaccgacccaggtgtcgggttttccaagtcttttgtaaaactccagttttacccaagttgttactcagattttaaggttgaaggcgaccgtcgatacttgcacagagtgcacgagtatcgaggcgcaactgggtggttacaaggggacatggtatagcaattaacaaaggaaggatcaaatgcgacaaattaggtaggtccgccaatctgccttgtagacgggacaaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactatacgcgaaatggaacaactcaacaaacggcgaaaataaagccctattaatgacctctaagcgtgccattagatagatctcgagatttggggaattttggaagttgaacggagtcaaacggatttacggttgggaagatattgaatttctaagattattgaatttttgatctaaaggaaaaggatttaaataaatcctttctggaaaagaaaaagaaaagaagggagggagggaatatagacttttctcggatggctagggcgcggcccaagagaaatggagcggtccggccgagctaaatgggccggccggcccaaggcagcccaaactcgcgcgcgcgcgggaggagggagagagagagccggtggaccgggctcaccatgcgcagtcccgggtgggacccgcttgtcagtggctcggctcaccgtgcggagggagtacgcggctcatgcgcgcgggcgggggagggacgcggtgcacgcgcgcggttcgcggtggacgcggatgcatcgggcccacgcacagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggaacgaaccacggcgatacgagcaaaagctagcacaccgggcggttgctcgtgatgaggggagacgagccatcggctcggatttgccggaggaagcttgacggcggcgaatcgcggcggcgacaaccggcggggagggaagagggaaacggcgacgaggtcacgagaggtcgattcccggcagtgagagcatctacgcggcttcgggaactcgacgctagcgtcggattgggcggaactacgccgagcgaggccggcgacgagtgggtgctacggagctcgggcggcgacggcggcgagcacacggcgagcgacggcaacggtcggggcggcgccggctaactacggggagtctactcaagctactaccgaaagctagggggaggagatggagcgaggaggaagaacggagagagacactaccgtgcgggacggggcgcagtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgaggcagagcacgggagcggcgacaacggtgaggaggcgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaggtgacgccggcgagaggggaaaaaggggagaaaaagaggaaaaggagggacagaaagggggctcgcccctttgccgattcgggaaaaggaggagggagcggggcgactcggcagagggagaggggctctctgcctccgccccttggaggctagcgcgcggagtggcgggggccgggcgatgacgacggcgatgacgacggggcggtttggagcggcgcgacgacacgggcgacaggcgcgggctggcgcggcagagggtgacggcggcggcgaccgggcggttggccactcggcacgcgcgcgcgggaaacaacgggcggcgcggctgggcagcgggaccgggcgacgcggacggcgcagacgacgcggctcgggcgggaaaccacgcgggcgcgcgcgcgagcgacggtgcgcggggccggctttgcgagcggggagctcgcgcgagaggagggggcgctcggcgcggctctcgcacgcgcgagcagcgagcggggggggaaaacgcgccggggaaagcgagagagagagagagagagagagagagagggagcgcccgggagagagggggccggggaagagatgggccgagcggaattcggcccatcgaacccgggggaggcaaactagacttttcggaattgaactcgacgatagatcggggattgagatcttgagatggcacggacactagacaacaatcaaagaaacaaattttgcaattagggtttttcggagataattttcccgctaggcgccacgacggaacgggcgctacacttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattcaaaagtgtccaggtgatgagaatattcctaaagtctagagttgtaaaaccacctaatgttgcctaatgaaccagcgaagcatttacctaaaatcatactagtggtaccatgagtagagtgtccactagttggggttttgtttattctaggggaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcagcttcaacttccacgaagagcggatcttccgaagctacggcgtctacacgaccaacggaaaagaaaaggcttttactctaataaactccatataacaagctggaacaaagcacaaaaataggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggcttattgcgtcagccgaggggagggggcgcgcggaccgggtccacgggagtggggcccacgcggcagcctcacggtccacggtggaccgggtgcacctgggctcacaccgaccggcgccatgggtcccacgcgtcagccgcacccgagggcgcgggcggctgacggccgggccccacgcggcagccactcggcgcgcccgagggcggccaagccggcgtagccggcgggaggcggcgcccgcgcccctatggtcgccggcggcggccataggcacggcggagcggcggccgagagaggggaagggaaggggaaaaagaagcggcggtccacggctcaccctaggtcgacagcgacgacgaaaaaggcagccggagcggaggaaggcggcggcgcggctcgggtcgacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcgacggcgacggcggagagagagcgacggcgcgagctcgattccggcgaggaggaagggcggcgagaggcggaaacggacggaggaggtgcggggagggtttaaatagagttggaaaggggagagagcggccggcggggaag

SEQ ID NO: 78982 - DNA, 3994 bp, Oryza sativa
attcctgcagcccgcacaaatattcaagcagatagggtgtttcaaaatatataagaaattctcttcattttctgtcgaatgttatttaacagttgtctggaaccaagaataaagccaagcagtactactagtactagtgtacttcgatgacattggcagctaaccgtgtcaccggtagtttgattctttaagataatgaaaaatcacagcctttgcttccacagttacagcttattattaattaatactacaatgctcacagcataaaaaactgaaagtgccaaagtattaagatgacaagataacataccaaaacactgaggtaaaaatttgtatgaacgtcgagatccgtcatgcaagctggatattgtccatatatatattcttaatgcttagagatattatagcaatataagatgggacccatagtcctatattcttttatgtatagcacaatatataatgtatatggttttcttttgatcttaagttagggctcactaagaaaagggaactctatttagcaggattaaaagagcaatatgttgcaaaggcttaaatttttttttatggtctagctttaagtttaaggttcgtcatagcaatattctctcatttgcttctctcccaatgtataaaggtagaaaaaatattactttattgcttgaggtactttttatgcaactagaaaggtagcccgcgcattcgcgcgggcatgtttttatttcgtttcgaaaacagatctatcaaaataagtttaaattaaagtgaggtattttgcttcttaactgaatgttcattgtattttttctttaaaagtcttgagaaactttcattgctcataaatatataatttttaccatcctactatctcctttttagttgatcaaatatacatatcttagatagtgcttcttatacataggaccctacaatatttttaagaaaaatacctagtccatatgagtcttaaaataaaaattagtaggaaatttataatcatatcgttatacgaaatgctattgattttgtattgacaccttagaggcatttacatgcaagtcgtggaatttagtgtattcatttaattattattgacctttgtctcttgatgtgtcaaagggaaatatgacttgtatgactaaaatagttcactgtgtaaaagcttcaacactatcttgtgggttaagtgctccactaaaatagttctgtgtaaaaacattacaaaagttatttctacaggtagcccatgagtccgaggcaaaaggcttatcacataggaggctgcacatttgaggaacatgtaaaaagtcttctcgtggaaatcatttgtttaggagtgtgctgaacataattgtatattcaattaaaaaagttggaaaagtggcttaaagttgtcatttcacattgattggttatgaaaataatggtatatacaaatctttgtgcccatatcattgtttcgcaacaatcaatagaacttgatagttacttttggtattccttttggtatgtagcaaattggctaaatattttacaacttattgtatcgtttacaaagatgcacctgctttatttctctgtatactggattgtctcattgtttattaatggatgccttgggcgcatgcgacactatatatatttggaaaaagtacgaagcttgcgcccgccccctgcaccgccctgcctcgccaccgctgccgcctcgcctcactactgcctctgccgtcgcctatgttggagagaagagagagagtgtgtgtgtgtgtgatagattgggaaagagatagaatagagactgacaggtggggtctatctatttttttataaaagaattgctgactggactgccacgtagaccaaaaccaccgtggattgggtcgaggggggtatttcgtcctgtttgcataattgggggtgaagaatgtccggttttcggattcaagggggtaatttcggtcgaccgcgatagttcggggggaggggggtaattcgtactttttcctatatatttcaaataaaaagccttctcgagtctaaattgatttcgcagtgtgggaaactccacgtagcttagcaggaacataatttcatagctaaaaatactccacatgtgtgattataatgtagtgtggtttgattgttgtcatgatttaaatattttttactctaaaatttatgattaaacattaggaatttacataatgcaaacgatcacttgtgtgattttattttagctaacatgcattgggcctttagttattatatttatattgcataatcctaaatacgaagcatacaatgcttatcctattttatctttcttgtttgaaagaattagccatttatacaaccatggtagtttaaatactaaataacttttaacttttaagtttctaaaataattggtacaaaaaggttttagctcggtcatctgtggtacacatatagtcccaagcaaatttgccccctcacgctgacagtgtcccgggtaatgtcgatggggataaaactgtgaccgattaggagtattaattttttcagttccagaaagaaaaatgaatctcagttttttagaccactgtctaatgttttcttccgtaagtgtacaaatgaagctatagccgatctcatatcctttacattagatcgatgtatatggtccacatcattatattattttatatagatctaatggttaaaattaattggtccatcgatttaaatatttttattttttcttagaatttgcaggattttttctaatttatcagagagccacgtgacgatttagtagcgtttgtagtatataatataagacacgtataattatattattttgacttatgggggagtaatttcttttggaacatttaggtttattctaatttaattattgtgaaattatgtttgatgataaaatctatatcattatttttttcataatattttagaactatttaaatggcacgtaaaagtcagaaattataaccataatgtgacattctttttgaaagtttaaatacaagcagtttagatgttatattttttttaatcatcaactgtgcttgtctattcttctgtctaactaatatattaaataaaaataggaataagaaataagagagggaacaaagaaggagagagagagaggaggcataccggctgtcaagtacgtacgtacctacaacttcacgtatagtcggataggaggattgcttttttttttaatagattgatctaatggctaaaattgctgggtccaccgaattaaataaaattttaatagattgatctaatggctaaaaatactgggtcctccgaattaaataaaaatcaatggtcagatgttttgcttttttcctagaatttttaagaatttctctaatttattagagtgacatgtggcagtttaagagtgtttgtagggtacacgtggcagcttaggagcgtttgtaggaagtttaatggacttctagtatataatagatattgtggatgtccttatacttttgcaactaagtttagattgaactatggtactttttgtacaaaatgtggatgaccttatatttttcccttatgtattaatagtggtgtatcaacattttgttcctcggggtcactggatcacagctaactaaattaattatatcatgctaactagtactccctctatcccaaaataaatgcggttttgcactatttatgtccaacgttcgatcgttcatcttatttgaatatttttatgattaatattttttattgttattaaatgataaaacatgaataacactttatgtgtgactattttttttaatcttttataaatttttcaaataagacggacaatcaaacgttggacacggatacccacggctgcacttattttgggacagaggtagtactccctccatctacttttaatagtcatatttcatcttggcacacagaccaatgataagtaattctacttatcatccatttaaat

SEQ ID NO: 78983 - DNA, 1356 bp, Oryza sativa
aatattctttagatgattgtccattctataggaatttcgttggatagaataggatccaatcctttgctttaaagtccttcatagaaaatttttctacaggattaaaatcctcaaaatttatatgtttttcctacaaatcaaaggccctagtactgatggtttatgatctcagggttcagaaacctgaaaaccccatgccaattgatggaacacaatttgtggcgtgtctattgaagttgtcaagttgagtgaattccgtgtatctccaaattttacccaaaaagttactactagtagctagctaatgggtaaaggcggacgattcatttagctcatttggagttcaacgctcctcacgtagaggttcccaagttgtaagtggactgtagttgtttttcatttacaagttgtaagtgtacattattttatttaattgcgctggtcaatattcaaaatggagaactctggtttgatatcacattgtgatacattcttcgatcgaaaagcttaagccgatgagcaaatattgacaaatcaatcatacttgttaggaatggaggagattttgtagaattttcacatcgatcagtaatgaaaaaaagggaaggtatacgcagttcggacctttctcttttgccaacgagttctcgcggtgattagtacttttatttcatgatatatgtatcctcgctgcacgtaggaggcctcatttggaacgtggaattttagagaatttttgcggtagtttaatttatcatatactcccttcatctaaaaagaatcaataatgtatctaaacaaaaagaatcacatactcttctagattgatttttttttaagcacggagggagtactccagtgcagcaaaatccatgtgttctaaaggagcttcgaatctgttttactggaggttttcatgaccgttgagattgttgaattgaggtgtacgggtatgtaatgttcgttcttcatttctttccagacaagaagactacggtgcagttatcactgtccagtcctctcctcgctgcacaacagtaagtgtcctgttcagcactgttctatcacgtctgtgaggctgcttttctcgtactacaaaccgatccgaggtgcagttgacattagcactgccatgccacgccacgcaggatgcgactccgatacgcgtcctcataaacagaagggtgaataaccaaatatgaccttgaactttcacttaaggatcaatttagtccttcatgtttcgtattgtccaaataagtccctaaactttattgtgtgatttgatatagtccttggacccactaaaaatgccacgtgtgcatgccacatcacctgcgcatgcaaattcaacat

SEQ ID NO: 78984 - DNA, 2539 bp, Oryza sativa
tgaactttttttttaaaatttttttaccctcttccttttatttttgaaccttttaaattttttttattataagttcaaaatgcttatttcaccttcttatttttccttttttaaagttcaaaatggatattttaccctcttctttttcctttttgaacttttttttttaaaaagtcatcacaagttcaaaatgtctgtttcaccttcttattttcccttttatattaaaaactaaaatggttattttaccctcttccatttatttttgaaccttttaaaatttttttatcataagttcaaaatgcttatttcaccttcttatttttcctttttaaaagttcaaaatggatattttaccctcttctttttcctttttgaactttttttttaaaaaaagtcatcacaagttcaaaatgtttgtttcactttcccttttttaaattcaaaatggttatttaccctcttcttttcctttctaaacctttttttttttacaaaaagtcatcacaagttaaaaatgtttgttttaccctcttatcttttatttccaagttcaaaatgcttatttttaacctcttattttccctttttttaaaagttcaagatgcttatttcaccctcctatttcaccttttctaaaattcaaaatggttattttacccttatcttttcctttttgaacttttctttaaaaaatatcataagttctaaatgtttgttttaccctcttttttttttcctattatcaagttcaaaatgcttattttaccctcttttttttcattttttttcaagttcaaaatgttttccttttttttagaattttgtaatgcttattttaccttcttgttttcccttttttctaagtccaaaatattaccagccttccctctcaagcaccgtcaacacagtctcacttctttggggagcgtctgtgtcatggccgtttggatctagccttcctactagtggatctagggccctaccaccactctgcaaccccagagcagttgttgtcaagccctccaccacctctaccctacgccgctgctgctctttcgctgagatgtcgcccctccctcgctccagtcacgcactagagcggttgcttctaaacaaggacaataaggagcttctatctcaggagagaaaggagaggtagaggaggataagatcgaaactgagtgttgggggagggcttctatcgtgggacttagagagtattttatgtttgttaaccatgccacgtcgattcgttggtcattgcaaactctatatatactatatagggtgttgcctgtaaaaattgattttgacagacaattccttaagagggccgcttataaaactgttcctatttttttcaagcagtcctcttaaaactaccaggtagggctagaattatggggtcttcagttattttagaagtggaaattttatagtccgccttataaaaatcaagcctagatgctgtgaaaaatcgtttttctggtagtcttctcttcatctttctttttttggctaacaagttcaaaatgttttctcttttttttacaagttcataatgcttattttactatcttattttccttttttttccaatttcaaaatgtttattacagctcatacagttttattgctgccctctttatttcaagttcaaaatgcctactattgctcattcagttttgctggaattgtcagctcaaattcaccatgcaaaaccgggacgaatgcaaagggagaaaaaaaaatcccctacgcctgctccatctgggtgcccaaaatttccgcccaattcttgggctttggtacctcagccatatcggttatctgagcccaatcaaaacgccctacacatctcccatctccacccgtccatttttccaacgttctagatccatccaccgatctgtggcctctccctcacgaccaatcatgtcccacctctcccctctatatatcccccctcccccatcccataaatcaatccccacaccatgtcgcaacgcatccacttcctctctcgttgccaattcgagtcttctcaacctctcgatccgggcgtgatggtgccgaaggcggagaagaagccggcagagaagaagccagcagaggagaaggtgcccaagggggagaagaaacccaaggcggagaagcagctaccgacgtccaagtagggtggcaccggtgacaagaaggggaagaagaaggcgaagaaaagcgtggagacctataaaatctacatcttcaaggtgctcaagcaggtgcatccagacataggaatctcctccaaggccatgtccatcatgaattccttcgtcaacgacattttcgagaagctcgagcaggaggccgcgaggcttgccaggtacaacaagaagcccacaatcacctcccgcgagatccagacctctgttcgtctcgtcctccccggcgagcttgccaagcacgccgtctccgagggcaccaagggcgtcaccaagttcacctcttctaaattggtagcccttttcctttcggtttgtaattgtcaaca

SEQ ID NO: 78985 - DNA, 5216 bp, Oryza sativa
acaacaaatatttaccactgttactgtggaagcagcagctgaaatatcctcaatttctgcaattggagacatcataggaatcatcaatcttgttaagtcctcttccttcatgcccactgagatgatcccagaaccattcctgatcatgaatgcaatagattctgggtctgccagcgtagctgccatgacaagatccccttcattatcaccgctttcatcatctacagcaataacaaactggagaagaatgaatagttaactttgtagctaaatttaactacacaagggaaacaataataatgtgactgtacaacagtacaaatgaaacaacaataatgcatatgcatgggtactgtcctgaattttgaagtgtgtagagccttgctagttgctacacgaaaatttgagtattacagtatttctattcagcttatcattttgaatgaaaatgtggatgaaaattgaaacagcattataaggacagcaatatggtttgctattgcataaatgcactacagcttggtttcacctcaccaagcaaagaatattgtgatggaaggctggattgctggaagaaactaatgtcactgtgcatgtatttggagtattattgtgcatgtagaatggccttaactttggtcttgaccatacatggtccatgtccaagaagtacatgagtggaactattttgtcttaaactaggctgagattggtaagtgaaaagagaagtactgagtacacagatgaaaggttaaagacgtgaatagatattacatacctttccttcatgcaatgcgcctatagcctcatcaatagaggaaaaaccatcagttggtttgtctgggtcaccctctgcatcgctaacaaagaaatcaccagtttcctgagtgattttagcaccaacagtccgaaaggaagcactagatccattgaatccttgcaaaacaggtccattattgctttcctttaaaggatcattcaaattctctcctcccccaagtccaccaattgcataacatctcaattttaagctcccctttctgataacagcaaatcctatgctgttgataccaccgcttccttgttgaaccctgaaagatcagaataaccagaaaattacagagaagatatgaaattttatgatcccagaaaatttcaacaagaccttttgcatagacaaaacaaagcgggagaatcataccttgtgttaacaaccgtttgtgatgacaattgagagctcagaagaacacggtcatttggtgatcccggtaaaaccgatccacgctcctcaggcttgtcctccgagatattgcttatatacctttatcttctaaagtgtcacaacacctctcagcctatcatttggagttatctgctcatgaggataacacagggaaaatccaacaatgtggaggcaaaagcagccacatattcagagctgcaagatagcagctgccgaaccggcacatcacacactttcaggagatgccaagataatggcatttgattgtactcttagactccagtcaaatgcaactgaagttggacctgataatgacaggcaggttcatctttcattcttttttggatgatttatgccccccataatgacacttggaggccaatggctcaatgcccatatgatgatctcaagaagttattagggacttgagaatttctccagattaagccattttctgaggcaacagaagatcaccagattgccaaatgagtactcaaaactttcagaggcacacagcgagagagccaagcgtcccatcgctctgaaacttgcatagtgtgtcgtcctagtactacttcccctaagaaatgcaggtaagcgaggtcgcgccccgccgcacctgccgatgccggggggcgcggtggccgtgcgctgagccagccgcgggcgtcgactctccgagggcggcggagagagcgcggcaccggcgatggccgccgcgccatgggtggagaaggcagcctaggcgccacggcgacgccacgccgcagcatctccggtggggggaagaggtggatttcgccattttggcctttttgggagagaaggctctgcttgatgatgcttcgatgatggatggggaaatcaaaaggggaccaacaaggattatcgcaaattctgtgatatcatacgagataacgactcaccagatgaacctttgattctgtacatgagttagactggaaaccttttttttttctttttggcaaaatgtgctaaaacttgcttcctctgtttcataggataagactttctagtattgcctacattcatttagatgttaatgaatctagacatatgtatgtgtttagatttattaacatctatatgtatgtgggcaatgctagaaagtcttacattgtgaaacagagagagtaagtagtactccgtttcatcggatgctttgaactttttctaagtcacttcttttactttgatctgagtttatagaaaaactaatttgagtagtagattctaacacatactaacactgccatcatattagagggtgaaactccactctgacaacgattagtgaacatggatttgtaacagacattgatcgctaacagaattatcatatagaacaagtatcttgcataatgttattcatgttctaaagatcaaaagaacctctcaacaacataaaataaagctagagaacgctctggtttgtcataagccttctgctccggagttctggctgattttaggacctgcccattgtttgctggcgagtgacttggtccatggatcaagagggacccgctgaggtggctgtggtgttgcaggttttgcctctcgaagttcattctcccggtcgacaaacctgtgtatgatgacatggccaattgaatctcatcagtcatcatgacagtttcctgattgaagttggttcttttacagtttactagttaaaaaacaagatgaagaaaacaaaaattcatttcagagagtagcagtgtagcaccactttctaaacatgaacaccacaaaaagtaaaccagtgtatcgatatgaacttgaagtcgataaacggatttattagaaagaaaacacaaaaagggatgcttgccttctgcaattcttgatttagtgaaagaaacggatgattttttttttgaatgcctgaaacggatgaatagaatagacatgaagggtacttgtctgttagtccaatagttacaactttgaaatgaatatgaagaaaacgaattgcatcagaccagaacacttgcaacaaacagcaatgagaaattcaaatgtaaattttgaattttcctagttatggtaaacaaggaaaagacatactcaatgtatgccattggtgcagcatcgccaacccgtatcctagtccgcagtagtcttgtatatccaccagctcgatctctacaaacaaaggaaacataatggacatgcataaggtaaatcttgacagccaagttcctttagacatgctagccagaacaaaaatcaaaatcaaaagtgaaaccaactcatagcgggctaaaagttacttgtagcggtaggcgagttctgtgaataacttgtgaacaacattgtcaccccgaacaaaggctgaggcacgtcttgctgcatcaagcgtaccctatagaataatagaactttctaatgttaacataggaacggctttgacagtaagaacattaagagattaatatatctggcaaggacatttagctcatgatgctctagacaacataaacgatatttcaaatccaagaaattccccacattagaaatctgtggactctctacctcattctgactgagcaccacttggataattggaatgtgacaagttagcaacattaagaaaaccattttccaagattccttgcttacatggatataaagtactcgcatcgtcacaaaatcagttacttttgaagcctattttttcttaagccaaagaatttgaacaatatacctcacgttacatagtcagaattttcatcgatctgaatcatttactaatggcaggattaccaacaacttgtaagtaaggtacaatcactctatattatccggtgatatttttttctttccttttgttgtggtcaaatacataaggtcaaatcatgtaagtctgctaccgcctacggcccagcaaaggatgagaattcagaacaagagttgcacaagaacgagaatttccagcttgagttttcatctcgacagaatgtatacctctttgccgagctgcaccatctgatccgctttcgtccgcacctccttcgcctgaaacgtcaagaagcaacacacagaaaagaaaaaaaaaaatcaaatttcctggcgcagaaaacctgcattcccaccgctaggtgttcgacgaaatgccggaaccacggagagacaggacgcgggctaccttcgcgacggtggtctcgatccgctcatgcttcaccagctgcgacaccatagtcctgcccagggaaagggatagagaagggcaaagagagagatagacggacagccgtgggtcagggccatgacttcagcgtgggtgcgacgaggcgaaatggagaccggggagatggggttggagaggcggagaagccagacctgagcatggagacgcggtgggcggcgtggcggcccagcttggcggaacttccccatggcggcggcggaggggggcggcgccggcgggagagcggccccggcggcgagcgatcagacagtacagtgtgaaattcaccaagttgcactttggtaggcctcgtcgccgtttgtgacagagtgctacgtttcatgggcctttacagggcccaataattctaattgggccatgtcctaatgtacagccaacctactactgcctctatctcagtttgatcatcgtcaaaaaattttaaggtatttttttcaaaataatcatcatttaacaaagtgtctattgcttggttttgcaaagagtaaatgtgcatcgtggaatgcccggtatgcgcgcaaccaaccaaaaataatttctgttggtttaacccatgcgatatttagagtgtgaattaatttctgttggacacgatcactttcatcgatgatgattaattttagaatgattgatgttttagtgtcattgttcttgttgttctttacttaagggatgatcatactgggatagagggagtatacttcagaaattcagattttgtttggattgaagcggggg

SEQ ID NO: 78986 - DNA, 2634 bp, Oryza sativa
catgcaggtacagcttcatccacagaaacgggtagactgccagcacagcctgcagcatgaggaaggtcagctagcgatcgaattgcatttccatcagcagtgttgcatgcttcagtttcatcacattatctgaaaaaaatgtttcagtttcatcagacattcacaggctatggcttgacctaccactaggaaggaatggtagctcatggagaacttcccaaagaagccagagtagagtttcctctccttcacaaatgggagagcttggtacatagtccacactgcggagatggcaagaaaagtatatttacagcaaaagactgcaagattagtaggtgtaaagagaggggaagtttggtgggtgagaattttggaattggcttactttctcctgggcctactccaattggatacagcggtataaaggcagtgtacctacatggtgcaaataagtagaaagggttaattagtctctgatcaggagaacagcagtcacctggaaaaaagaccataagcagcgcggtaaaactagggactggtaagcaacagtagtactgcagttaaacattgtgatccattattatatcatgtaaagaaacaaaatcaacatagcagcgatgtactggcgattttggagtaggaacaatattagatgaacctggatataaaaatgacatgcatggtgattcattttaatatcccagttaatagttccagctcagtgatctttctgtagcttactcaatacggttattgtaatttgaacaacaagtttgcaattttacaacttcttttagaagacagaaggtaaaacaaccatgatactgtgtccatctttctgcttcctatgctggtttcagtgcaaggtgtctttaaacggaaaataaaaatgacctgtgaccaaaaatatttttgaagaatggagaattgtgtaactttctaccaaaaacaatagaaaacaaccagaaaatagtggaaaacaagaggtgtactgggcaccgagcctaagagaagctactaagaaaatactgtggatgcatccttggatgtgggaactggagttcatttgcaaatcaaacctgagatatgttagccatggtggacaaacttttaaggttgtcagagcataatgtgagtatctgatgacctgcaccatgaagaaattagacttcagataaaagactgaacaaaaatagcattgtcttgcgaattatttcaaaataaggtaagtactgagtaccattgagttaaaccaaaatgtagatgcctaaataatgcttttcgttcacatgcacggaggttagtaaaagggtattttcgtgtcatagaacttggaaacatatttgtctgtcgtggatttcagttggtacatgcacagacagttctattcatgctagcatttccttaggcagtagtaccagctcaacttatcctcttaacagctaaacgtagttgtcagatcatccctttcaacacgtaattgacattttaatatgaatgaaacaggtgaaataatattagctccattggcatagatcattgtgcagtaaaatagaaacaaaatatgtgcatcctgagaaggttccaccagaaatttctcgttatatcatgagattgcatcatagaaaatcattttttaatgtactcaaaaagcatcagtattgtttttatgagaacaaggcaaaccacaaaaagaggagaaaatgatgtagtatcattttgtgccacacctcagatatgctccaagccatgaacgttatgaacacggaagggctactctgaacctgcatttggcacaggagactaaattagtaaacctaagttgaaaccttgagaggcactactgtaaaaaggtaataacagaaaatgtatcattggaaattttataataaggaagaaatttccttcttcactaggtcgaagtgcaaattcgtttttgcggttggctcttccatttacacatgacaaaataaaaaacacaaattctacgggattttcacatgaatttgttcaattcctccaagaatcccgcaaaattcatccgttccaaacgaagcagaaatttgcagtcctccccacctcggggatttgccgaaccacagcgagaacgaagtgagtcctccctccccactgcaagaaggcaagaagcggcgacgtgtgcaccaatcctgaatcaaacagcaacgaatctcctcgtcaaatttcacatcaaagagagcggcgcgcgaggaattcagcggctcaatcaacccaccgatggcggcatggatcgtttcaagaatcgcccacgtctgcagcaagccttgaaacaacaagaaacgaatccccaagaagggggaaaagaaaaacatcactccctccgctcgtcgagacgagaccaaatcaaagacatacgaggaagggcacggaggagggatacacgcacatacgaggtcgccggcgacggcgtatgacgagtggacggaggagggaggggcgaggcagggcagcaggcggagcaaggcgacgaacctgcagaggaggaagccaaaaagaaaaaaaaaagaaaaaatcagagcgaaacgagggattggacgcacgaacgcagcgaacttctcggctgcgggtggagtaccatccgagggcctggacgga

SEQ ID NO: 78987 - DNA, 1977 bp, Oryza sativa
cagaaatccatcgcgccattgtaagtacatttatcacactcacgctcgctgtcgtcatcaacctctgcaaatctcgacgagctcttccgggccgtcggattccgcggcggcgatcttggacgccgccgacgagaggaaccggaagccggcgtcgctggcgctcttcctcaccgacgccagctgctgcgacctcttgcagtaggcgatcagcccctggatcgggttctccacctccgagctcgcgctgctgctcctccgcagcgccggcgccgccgcgccgccgtcggactcgctcgacgtccgcaccgacgaggaggaggagcacgacgacgactgcggcgcaggggacgtcttgttcgacgtcgagtaccggacgatgacgctggagaaggacctcctgtggccgccgtggtcgcgctctttgtgcttccctcctccgaccgaaccacggccgccgccgctctgtgaggaggcgatgcacctgttgcttctcatctggccgaacgggttcctcctccatgctctgtggtggtggtggccaccatgggagagttctttggtttctctcgtcgcgccaagaatggcgtccttgtcgtcgtcgtcgccggagctcgccggtttggcggcgaagatcgtcttgatgtaggccttggaggccttgagcttgaggccgaggttgagctgcctcatgaacctgagcttccgcgaccacggcttcttctcgcacgccgccgcggcggcgtcggcgagcctggccgcgtactcctggaagtactcctccacgttgagctccccgctggcgtagcacgagttcgccggcgacgcggtgcacgagtcgtacggcgtcgccggcgccgtgcttatggcgagctgccgccgcccggcgccgccgacgacgacgcgcccgtcgagcagctcctccaccatctgtatccgcggcggcaggtgcagcggcagcagcttccccttgtagaacagctcgtccgccggcgacgccagcggctcctgctcccaccgggcgccgccgccgcccagcggccccgacatgtggaagtcgaactcgaactcacccggcgccgtcgccgcggcggcgctcgtcaggtccatgtcgatgtagtcctcctcctgcatcgcctcctgctgccccagctggtgcttgctcgccattgccaaggtgagagctcgtggctccggagctgaagctgagacaagagggcaggagacggtggctgcgtcttgctacttatattagccgcttaatcatggtggattaatgggcttagagcaaaaatggacacttggacagtgtcatggcatcaaatgaggcttaattacaaagtataaatactttctttatccttatttaatcatcacctaagattttcgaggtcttttcaaaataatcatcctataacaaatgtctctttatttgtttgtgtaaagagtaaatgagcatcattgaatatgctgcatgcaaccaatcaagattaatttttattgatgcaactacatgcaatatttaaaacttggtactattcacgagacacgaagcaacataccatcttaactaatgagaattaattatagaatgatggaaatttggttgtttcagtctctgtgtttaggtgatgatcaaaaataggatggaaggagtatcttgtaactttatatgtattgtgattacaggcgttttagcacataacacgatattccggatgccatgatcatatatctttaaaaaatcatgccgtaaatcaattgttctttatttcaccatacttaaaatcaaatcaaatcttgaaattaagattctttttattaaaaaaaatttagccatgtcagttaagattctcttatcttgcttaactttaatagttttgcacaacttaaaccatataaaggggttaatgaagtatgaaccggattaatcatactattatggtgggccctaccattagccgtatgatctgcctcttg

SEQ ID NO: 78988 - DNA, 713 bp, Oryza sativa
cgtcgccattgacagaaaaaaagtgacgtcgacagaaaaaaaaaaactgatttaattgggctattttgcaaaaggtcttgagctactaaaatgattattattagtttattactacagtattttattttatggcatcgaatatttcgggtaggcaatattgagaacaagtgatattgatggaaatatatttgcctaaataaaagcttcatgaagtttaggcaactgtgacaaatccgaacttcttctaatttctaaaacgaataaaaatcaccaattaccttagaatagtttccaattccaattaccaaccgcagatatatatatatatatatatatatatatatatatatatatatatatatatatatataaaatccctttcatgtgaaaaatccctcaacgtcaaccgcgtgggacccaccagtcactttatgggaccccacacctaattggcgggaacacataacaaaaaagaaaagggaagaagaacaaacttgctaataacattttcccgcgattccaaaagttaggtacgaaatccacccggggggaatcgatccgacggcccagacacactcgggcccacacccccctcccgcgtgtgggaacccattcctttcttgtcgtcgcggtggccgttaccgttacgtgctccgtcttccctctccgtctcgcggaaccactttttgcagtttcccccctccacaagccgg

SEQ ID NO: 78989 - DNA, 13688 bp, Oryza sativa
cctcctccctctagtcttgatcgggacgggcccgacccccaagcgcggaggggataaccgccactccaccccgggcgccatcccctcggggaagtgccatgtgggtctaggggcagcctccttcctccaaactcggtaccctaagctgggagggggcggcagccactccacccgagcgccacccttctcaagagacgccacgtgagttggggggggggcggcctcctccctctaaacatgatacccctaggcccatatcaccgatagacatatacccaacatattgtcatgaaacaaactcagggcccctttgaatcacagggttgagaaaatgcaggaataggaaaaatgtaggattttaataggaatgaaagtgtaaaacaaaggattgcaaaacgcaggaaaaacacatgaatgatcgtttgattgaaccgcaggaaaaacgtagaaattggatgagagagatagactcagaggaaagttaccaagaggttgaagttcttgctaaatttcctccaaaatctctataggattgtccattccataggaatttcaaaggattggataggatttaatcctttgtttcaaagggctttataggaaattttcttataggattaaaatcctacaaaattcctatgtttttcctccaaatcaaaggggccctcaatggttctaaatatgaattctcaaaaaaaaatattttgctgcattgcttggaccacttatcgtaaggtttatttcataagatatttaatatattcctataatcgaatagataatatgtgacatgtgaataatctgtttcaaactctaccttaaatctacgtaaaactagaatatgaccatctagatgcttggtccatttatttccactatgttcactttagagattaaaaaaatatcacattaataaaagaaataaaaaaaatttcatcactcgatcgtggcgggttaagatgataaagccataaaggcgatgataaagccataaaggctcatatatattgatcgatatggtcgtatataaaatatatttatatcgaaatggaaacaaatatatttatctattcaattccacttttgaatataaaatctagctcgtgtataatcatggaaaatggtttgctagttacacaaatgcatgacggatggacgatgcatttaaatatcttgttttaaaaggcagagagaaaaagatgcgtaccgtcataattaatcaaagcttaaaatatatcgtattgtctgtttaggcgaccctactcgtacgtacggccggattcgttaagtcaactatcaaagcgatggttgtgcttgtttgctggtcctctccgtcgaccaagttgtatgtttgcacaatttatatacgaatgatcttaccctcctgagaagtcaccggaatacatcctagctagtatataaattttggtacgtacaaaaatctctctttggttatatgagaacatatcctatgcacgtaaaccatcatgaatacaccatgtacaccaactataaatatcataaaaaatctagaaaaaattgttccaagtggcttgcgcggtcggcgccggcagcagctggaggcggcgtccacagcttcggcatgcacgggcgatgggccggacagcgaccgtggacgggaggaggactggccgtggtgggtgacggcggcgaggtgaggatggcgacgacgaggtggctgggcgttcagcagcagcggttgcggtggtggtgaccgtgactgcgatcactggaggtatgacggcctcggacggctagccgagggcttggcagacggctgcatctggccggcgcggcatcgtttggaggaggggttggagaccggcttggcgcaaaaaggcgtagccgatggcagcggaggccggcttggcgcgagaggcgcgagcggtggagatgaaggtcggcttggcgcgagaggcgcggccaatggagggaggctggattggtgcaagagacgcgtccggtggaggaggccggcttggcgcgagagatgtggccggcggtggaggaggcgacctcggtgcgaggaggagctgccggtgggtgtggcgtggtctttggcgcatgaaggctggccggcggggggcgccggtgcaggggtcccagatgtcggcagagcttgagtggtggtggagcatcggtgcgtcagcgtagattcgcaggtggtgagcggcgggtgaaaacccagtccggccttggccggaccgacaacgatgattcattcaccctcctgagggtgttgtcgtgctgtctcacacctcaagggtggttgccgggtgaaagcctagtcttggctcatttgagccccgacggacggcggcggcggtttttccgtcgcttctcttcttgaaaacgtcattttggcataccctaagggacgatctcgtctgtgttcctttgttggtctagtggcggtcggtcacgcttaacggtggccggtcctgtgctagccttctcctagacttgtgtgttggcgttatcggtgtgtggggtggtggcatattttttcctttttcctggttatgacccttcagggttgtaatcttgtagtttttttttctctatcgatagaacttcgtatcgtcttgtgcaagtcgttaaaaaaaataaaaagacaaaatttcaatagacttgtagtcttaaatctgtcagaatttttgtttttttacgactaaaatgtaatgaatttcaggttaagatgttataagtaagtgtaatactattgattgattgtttttggatttttttatgatatttgttagttgatgtgcacggaatgtacacgtaattaataaatataaagttgtacttgttatactgttgtaattttagcttttcttacatgaaatgatttatgaaattcaaaattaatacaaataaaattgtactcagtttgtaccaaattacagtttttcataatttaataattctaaaactcaaacgtaaaaataagcatggagttgtagccatcttggtgttttgatttattactattttaatttattagttcttataaaattcaattaataattctcaagtcataattgacatggacccataaataacaaatatatatagttacaacttaaattccttcttgatatattaattccgaaatccaaagttcataaatacagttgtacttggcctgtcatctcagttgttttacctaataatttgaaaatcgtaatgaatagacatgaaattttaaatattttggactttcaggttagcatcatattgatttaatttacaattagacatcaatatttgggaagatctaactaatgtaaactcaagtaaacaacaataatttagtcccagtgcacttagatgaatagctaaatttattcactgttctttttattaatgtgagattcttttaaagtccaactaatatataatatttccgttccaaaatattgcaatctaaccaaacgagatatatagtccgaggaatccagatagatctctatcttgattcgtgatattaggattggtttttcagattcgtagtattatgatatgtctactccggttttatgttgtactacctccatatcaaaattaatggtcgttttgattttttttaatgtttgattattcgttttatttgaaacattcgtacaaattaaaaaaatcatacttaagatacttttgataataaaacaagtcacaaataaaataaataataattccataatttttttaaaaagacgaatgatcaaactttacaaataaaaacttaaatcgacaagtattttaggtattttaggacggaggtaataatattttgggatgcatggagtatatagattagatagatcaattttcgttgacacgttttcttactactggagtaaaatactccatagtagtaggtagtactagagtaaaatatagccttcactgaattatggaatggcagtgcaggcaaagcttaattaagcagccgttgacttcaatgtgtggtgagcatcaagtagccaattagccaaattggtactgaacgtgctgccatgcatgcatatatactgtactctgtgttcatgaggcgatgaggattctaatttcttcccctcatatgcttctttttttttcctgtcaaatttaacgtaaatggtggagaaaatttcacaatatagagcataaatttagattgaatagtaccgatatgtttatacattgaatttgttttttaaaatatttcttgatatgttaaactgagtttacatttgattttctatactatttataaaaatttgagtaaattttacaaacaacatatattttgatcaaactatcacacaaaactacagatttaaggtgttctatcacaaaactacatatttaacaaaaaaaaaacttgtcataaaactacatatgaaaagccaagtatcatataattagagattctagagttcaaatccctaacactatctttatgttggagctatataaatggtgtagttttgtgattagattggtgctaaacctatagctgtgtgataaatttgctacctaatctttattttttacactccatcttaattttatttgacactatcttaaatatttagttttgtgagaaatttcatgctaaatctgtagttttgtgatctgacactttaaatttgtagatttgtgatagtttgctcgaaatatttatggttctgtgaaatttattataaaattttgagggactaaaagagtttccgattatcttgggtatatagtttatgaaaattgttgtcgtacgacatccaacgtaacttgccacccatataaggtgaaatattgcaagactacaaatttagtaacaaaattatcacaaaactatatgttttatatcaactttatcacaaaacttggatattaaaccccaacatgtttagttttgtgataattttattattatatatgtagttttgagatatttagccttaaacatgtagttttgtgataagtttattgttaaatcagtagttttacgatacaacaccttaaatctatagttttacaataatttgactaaagtacctatagttttgtaaaatttaaatatttataaacacaaacacatatatatatatactatctctccgttataaattgtcactacctaatgaatctgtctagattggtagtcctaagaagtatcccatcctatacaggaataatggaacttttatgaattcatgcatgtgcctgtgcttgtgcatgtgttgccggtcaaatgtcaaaactattgtgtcttactgatgccggtcaaaaagtcaatagtcaagaccactagtatatataccgtgtttagttttcattgtttctactcgtactccattaagcaccatggacgacgcagacaaagctagatgtatgtacctttcagtacctcgtctccatattttggaaacgaaactacgaaaggaaaatatttgtcttcccaatggatgacgaaacaggagctttccgtgcaatttcattgatcgagaagaaaatgtcgtgtatattacggtgatatcatttatgcactcctagcaaaaaaaatagatcaattatgcgctagatgacatgcgtccacaaacacaattaatatagttgcttttatgcaatattctaatgacagttaaggatgcatgtatctgaacaaattatacgtcatctcaatactgtgtattttatgccagtactatcttaattatttcaggcacacaaagttgaattttacttgttattaataaacctccaactctgatcctttctacggtcagataccgtaggtgatacgtgagatcgagctacttaataattatgtagtatgataattaacataccgtatactgaacgggtacgatattttttgaataaacactacttgatcgatcgagacacaataatacgagatatatatagaagtgtgtcaaagttgtcctatgaacttcaaaaactgtagaaaattaaaactcgcagaacggaatatatattcagatatgtttgtatgcatgtgctaccaaagttttaatttttaattttctcctgtatcgtccagttataatatcccctgtgttctacgcaagggggcttactaaaatgcgcatctttttttgtcgtaaccagtttatctttgagagcggacacgaaatcgattgtttcggtgtctatcattgtcaatgaatatgataatcaactactgaccatgcatgcaaactgatagattaatcagcacgttttggagcaagttgaaagtgagttaattaattactgaggctgcttgaatttgtccattgctgcatcatatcgcacgccagctttgctccaattcgtggagactgagagctagcttgtcatcattatcttgctctcgcagcggagatcgaccagtttatctagctagttacttgggcggcttggagaaggtcacgtgacacattcacgtaatcacgttgtgctagcttggctaaaggagcattatctgaagctgtacgaggctagtagaaaaggcaacatgaaattacattcctatttacgcactccgtctaaaaatataacagtatttaaaatgtcatgttaaccaatattacagatcatccctatttaatttctcatcttgccttaatccctagtatatataaaagaaatctaaaagtagctactatatccgcctctaagatatactctcttcatttcaaaccatttcaggttataaaatgttttggttttgataaagtcaaactactttaaatttgactaagtttattgacaaatgtagtaatatttacattaccaaactagttttatgttaataattaaatatatttttagaataaatttatcttgggtcgaaaatattactattttttttgtcaaacttaaagaaatttgactttgaccaaagtcaaaacatcttataacctgaaagggggagtatccttttaagttatgagtctgttaatagatatctatccgagataccgcatccgttccatcataattgtatttttaggattcaaatttgtcccaaaataattatcataatagagtagtaactatttcattaatcacttttgatttgaatttctctgtaacgctccgtttttcgtgagacgttaaaaactaattcggcaaaatcctaattgcgaaaatttcgttctttgagtgttgagtctaagttgtgccaaagatctcaatttaaatccctcccttgtctcgataccctgttatcaaagatcgtctcctcaaaatttccatcccaatatagtcccgaagctcgattccttctattcggaatcccctcctggaaccccatccgtgaactttgtcgaatgcccgaaccctaacttcatctaaggattcaccttcgcgtcataagctctctccttggttccttcaaaccgattctcaaattcgaattcaacctctcaggttttgattcatctatctttctccctgtattggttcatcaatctacccttgttctctttctcgaacttctgatccaagtctgaatatgcaaatcgagatcacttccacccttgaactcaaaatcccaagattcaatccctttcgccctgagttctccccaaaatgatttccgttccgaaataatctcgaagtccgaacccttctattcagacttctctccaaaatccttacccacatatctcgttgagtagtcaaactcaaactcccaagttacactctctttctctaaattatccatccccttttgactcgtctccgaatattgttcccttccttgactccttcctattctcccgagaccgagtatcaacctcgaaattcgaatccagactccaaccctaaaacctcccaattaaatctctctgtgaaagtctatttaacctccctcataggttggattccttcatcctttttccggtccacctcttccttctcttccatcccatctctctctgagtctcgatctatctatctatcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcgtgccgccaaatataaatccatcccaaaaataccaaaattcccgcttttgaagcccttccttgacccctcccttggatccaccttgaaccctcgtgtacaaatatacaaattgaattcaaattcaatctccacatcaaacttctctccaaatcaaaccttctggtaaaagtctattttacctccctcgtgatgatttgggccgaaacatgccgctggcccatctcttctcaactccctccatctccacgtgcgccgcacgtgaccaccgagagagagagagcgctgtctctctctcccttccctctctcggacattctctcgctctctcgtcctcttcctctctctcgctgtctctctctctcgttcgatctctctctcccgcgccagcgctgccgccatcgccgatttcccgctgccgccattcgattttcggctgtgccgctcgttcccgcgcgcgcgcgcacgctcgtgaccgacctcccggtcgccgcctccgtcagcgcctgcgctacgctgccgctcggccccgctgcctgccgcgagctctgcagcgcgtgcccgagccgctccacgtgtgtcctgccaaaaccgtgaggctgagctcccgctcctatccctctccctccccaactcggcaaagagaagagctcacttttttcccctccttttctacttttgcccgacaccgccggcgtcatcacctgtcgccgccttggctgcacgcgtcgatgaccgccagctcgctctccttgaccgccaatgtcggttcttcctccctaaaccgacattgccatctattaaaccgagccgccccatctccctctcgttcattccctcgccaccaccgtgcccttgccgccttgctaccgccgtcctcgcttccctcctccatcgcgcgtgctggtgaagccggcgtgcgcgcgaggagctgacgcgggactccaggcgccgtctccttccccttccccggcccgaggccggagagctcgctcccgcgtcgtcggccgctcgtcacagcgtccgtctcgactctgtagtgcatctcccgttctccctccttgctccctctcctctccttagctctgggcagtagtgcgagtagccttccagtagcaagctggcgccgccccgaccgccgccgctgctcgccgtaggctcgccgccgtcgctgcccaaactcggtagtagccgctcgtcgccggccttcctcggtgtagctccacccaatccgactctagaaatgaactcaggaggtcgcgtagatgctcaagtccctaggaatcgagctctcatcgcgtcgtcgtcgtttccctcttttgccgccgccggcaagcgccgccgcgattcgtcgtcgccggcctccctccggcgaatccgatccggtggctcactccctctcgtccgtcccatcgttcaggtgtactccctctctctcgaatcgtcgcgacgagctccggtgaactcggctgccgtctgccgtccatctcggccgccccttctttctcctcccgccggcccgcgtggctgccacgtaggcgccatctcggcgccacctcggccttgaccgggccaagccagtcagccgccccctccctccgtcttccctcccgtgcgcgcggtccacggcaagccgtgcggctgcacgtgggcccgccgccatccgtccacccggcgcgccgcgcccgaaccgcgcgcacccgaaaccttagcgcccgcccccgtgtgcgccctccccaccgtgaacccaaccaccgccatgtgggtcccgcgcggtggaccgcgtccacccgcgtcggcctctctctccccgcgcccctaatgggctgaccacccgcgcccgcgctggcccaatggcctgaccgcgctgcgcatgaccccttgggccgagcctaagccgcctgagtaagtctaaatgacatccctccttccttttcttttccaagggatttgataaatccttttcctttagatagaaaatccaaataatcttaggaaatccatatctccccaaccgctcgtccgattgactccgttccacttgcaataattccgtaaattgagatctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgctgggcttcggtttgcgtgccaaaccgacggacctacccagtagtcgcactaatttccgtaggtcgtactaccctgattctttgtcgctccacccttgtggtacctcggtattcgtgctctctgagcacgtataccaaatatcccacatacatcgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgagacaccctggctaagtagctagtcggttcagggaaacctcgcatgccaatagttgggaacgccggggcggggtcggttggagccaaaccgggttcctggtaatgcaagaacgagaagcttgctgaattaccgatcgaggtggttggagtttgattggtgaacgcctaaaatggcctatgtttatgtgaggatttgatccttctatgtggcatgaggtatccctgggtcggcttgggaaaggctttgtcgcgaacctctgacaccggccagtgtctggagtaagttcgggtcttgtgggtaaagtgtacccctctgcagaggttaactaactgttcgaatagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcctgagtggaagcggattgttgtgctgctgggtagctggactctgggagtccgagaaaatgaaaaaggctctgggagccgattaatcaagtggaatggctctgggagccgagaagtaatgatctgacccgggaggtcggtacattactaaatgagctgttgaaaaacatctcttaaagtcgaattgagacgcaagtctcttttcggcccaaacttagaaagaaataaatcacttagtgatttcaaaatgtcttcaaataaaagatttgcaaaacaaccttgcctctcttccaaacttgcattaaacacctaagttcccgtgacttgctgagtacgaaagtactcacccttgctctatataaatatatatatatatagttcctccgccctgaagagaagataaagtgaagtgaagattagagtttcgtcctggttcccagccgtcgcctgtggtgttgggtgttagaccgttggttctgctgctgctgttgttgttggtgttcgcctcatccgtgtcgtcggttgtattctcgggctgtctgagctgcaacctaagttaaggtaaataagtactctatttattttaaggattgctatgattcatatttgtcaccgtgggtaccaacactatgtcctgggactggtaccgagatcgcggtttcgtaggaagcggttcgcgccgttttccctacgacacgctcctgtcaggtgccgttgtacggcggtatcagattggggtgtgacattatccctattctatcctcaggcatcatcctactcttactagctatgcaccatttaatgaagggtatcttagtttttcttctcaaatcttaatatatgataagtaatctagaattgtaattattttaggatcagtttgggactgaggtagtagtatatagattttggtatggggtaattacaaggggaaacctttggtgccggcgattgagctaaatttggggcctgctaaatggatgcgccgttggtattgaaatgtctcaattttccttttgcgggaaaaaagtctcaaattaaaccaacagggctgtaaaatgtagagaaaatagaaaaaccgatgaactataaggactgtgaatgcttgcatgcacactttcttttcagatatacaagagtacaaagtagctagagtacaattcaaacctcctaattgtgggtaaacaccaaaacagttttctttacctgattaaaagaaaagccaaactatccatcataagcatggacaaccaaccataacaggacaagaaactcatatttaccacttgttttgcatgcatcaaagaacaagtccagagtctttttttccctttcaggaacaagtacatatatagagccaaatgatgtttatatgtgtgtagctcatataagggtgataaatatatatcattttatttttgtcaaaaataacatcatcgagatcaccacaaaggctatgtcgcctaaaacttctatttaaatcctaaacatgtttctaaagtgaaaaatattttggatatatttaaatcctaaatattccttaaggaggcgtgcatatttttccatggccatagcattcgacagtccgcaaaatattcagagcttatcaatggataaacgaattattgtagtactttaagaacataataaaaggtttggctgtacatgtacacacccacttttgggtgtagaggccaggtttaaatccattttctaaaaaaaaaaagatgacatttaataaaagccgtaatgtcacgccccgaactagccccgaccggaactagcccgtgacgctccaaattaacctgttaatcgataccggccccaggaaatagtgttggtatcacaggaagacagattatcacagcaacagaggtctctttattacagagtaggagtacagtcatgttgggctacggacagatcccgagctcacaaatgcattaaaaagggaaagcggaagccaagacttggaccatttatcacaggcgcgacttggaaactaggccgaaaccttaaaactcatcgtagccgacttgctcctggaagaactcctcgtcagcgggatccactgtcacgtcccaaaatgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaaaaaagttaaaatgattttataaaaag

SEQ ID NO: 78990 - DNA, 21395 bp, Oryza sativa
agattaaaaaaaagataaaaaaaattacctgaattggattctaggacctgttcagattgctaccgaaatgaaccttttcaaaatttgacaataccaaaatttggacaagttaacaatattaccagattttaatattaccaaattttgataggatagattaaatgttttgttaccaaaattctttaggcagtaccaatatttgataacaaactaaatttattaacatatttattaattttactaaaaataatatggttcaaaatgccatcaatctgaatagttgttcaaaatggcatcaattcctacacgcacgatatgcccaccatagagtacgcatttcatcaattcctacacgcacgatatgcccaccatagagtacgtatttcccgtagggaggtcgaatttcaactggcagaccggcaatagtagaggacgattttcggtggagtaaaaaaggactggatattttccgtggagcaaaatagggctggatcttcactgtttgtcctcgccgcgaatacatcgttcccatccagccgctgaaccgcacagctcaccccagccactcacccagtcaccactcaccactaggatgaaaacggatcggatacggtcgaaaactagctttattatattcgttttcatatttttttctcggaatcagaaacccggatatgaaaacggaatcgaatattatcgaatacagatacgaagcgaatacgaatcaaaacgaatacggtaacgaatattaatcggaacataaaagcccctcaaaccgaccttcacaaatcaacgaataaatataactcgttattttttctaatagaacatatcaacattttcaaattttagtgttaataattttgttgtattcgattttttggttgagggagacgattcaatcaagagtaagacattacgatgctattattgtgttctaaaattatgttctatcgagttattgtgttcttactgctattattttggccatattttcttgtgactttgttttatcaagtaaaaaatttgaatttcaaaaaatagcaacttcaaataatattttgaagcagtaaataatttcaactgaaaaagttatgaatataaaagttgtagaactcgtcaagagctacaacttttattttagtcatttcttcatccgaccaagtgatagtaatattgtttataaaatttgcatatctctcttatatcttatgaaaccatatacaagatatgtaaattttgtaaacaatgttactataactttgtcggatgaaaaaatgactaaaataaaagttgtagatcttgataagttatacaactttgttgttggtgactttttcagttgaaatcatttagtatttgaaaatgttgtttgaaggtgtcatattttgaaatccaaattcaaactatttaaacaaagtcatatagaaaaataacccaaacaaaagttgttgatctcgatgagttatacaactttgttgttgacaactttttccatttgaaatcatttactacccgaaaaattatttgaatttcttatattttaaaattcaaaatttatatagttcaatcaaactcggatgaagaaatgaccaaaataaaattggtagatctcaataaattctacaactttgtttttgataactttttcacatgaattcatttagtatcataaaatttaattcgaagttgagggaggacatatagacttaatagctaattcttaggcccgttggcccatttagatggagggatatataaacctaaccctagtttctcccacacctcccaatctcctcccagccgccaccctttcctcccggctcccgcgaccaccacgggggcggggcccgcgtgcggcggacggcgacggcgacgacgggggcggggccgcgtgcggcggacggcgacggcgacgtcgggggcagggcctcgtgcggcggacggcaggggctcggcggcgcgaggcgacgacgtgcagcgaacggcgacaagcggaaccagccgcgccggcctcggggcggccgggtcgtggcgacggcgggaactcgacagcacgaggcgacggcgtgtggcggacggcgacgccggactcggggcggccggatccggggtcgacagcccagcagttgcgggattcgacgtcgtgaggcgacggcgacggatggggctcggcggcgcgaggggacgacgtgcggcgaacggtgacgagcggatccggcgtgcgacgtgcgacggtgtgcggcggacggcgacgagcgtttttcgatgtttgttaatttggattttgttgtttattttgattcggatatctggcaaaaaaaggtcggatagtttccgaccgaatccaatttccgacggataccatcgctactgtattcgaatttgtatccgagaaaaactatccgaattcgtatccgaatccgagaatatccgaaaaaaattcgaccgcaacaatccgcatccgaaaaaccgggatcggaactcagaaattatccgtaccactttcatcctactcaccaccagcaagcaaggcatcctgttcccagctatacttgcctactattcccttccttcttttgcccgcctcgaccccaatacgccgcaaaaaaaactttccgagcagacacacaaggaaacccgaaacccaccccccccccccccccaagcgagtcatctgccgtccatcctcaccaacggacggcccacgacgcgtccaaaccacggaataattagggcaaacccaacaagagccctgtccgcccacgcgccgtcatactcgcccccccttccccttttctcatcctcctctccgcgtcaagtccaagcgaccaccagagatctctctcgcggggcggccaggtcctccccatcccgcggccaccacccacctccgaatctgccttccccagaaccaccgcgacccctctttctttccttcttcctcctcctcctcgtgccgtctccaagctccctccagcttgcgaggcgaactataaatagcggcttgggagcctcttcctctgccaagacgcagcaaacaaacagcacatcggaagccaagccccaggaaagaggaacgcacgagcagcatatgtcacagagggccagcgtcccacactcctcctccatagccttcgccctccattcccatctcctcgtctccagtgagatgtgccccagctcctattggcagcaataggaatagaaaagattgctcctttcttttgagctttcttgcaattttggtcttctttccttttgatttggtttctttccgtccgatttgtgaagaggaggagcaatggggttcaagggatttgtggagggtggcatcgcgtccatcgtcgctgggtgctcgacgcacccgctcgatttgattaaggtgaggatgcagctgcagggggaggcgtcggcggcggcggcggcggtcgcgccggcgcaggcggcgctgcggccggcgctggcgttccacgcggggcaggccgtggcgatcccgcatgacgtgattgcgccgccgaggaagcccgggccgatagccgtcggcgcgcagatcctgcgggcggagggcgcggcggggctcttctccggcgtgtcggccaccatgctgcgccagacgctctactccaccacccggatggggctctacgacatactgaagaagaagtggacccaggagaacggcggcgtgctgccgctccaccgcaagatcgccgctgggctcatcgccggcggggtcggcgccgccgtggggaacccggccgacgtcgccatggtgcggatgcaggccgacgggcggctcccgctcgccgagcgccggaactaccgcagcgtcggggacgccatcggccggatggcgcgcgacgagggcgtccgcagcctgtggcgcgggtcgtcgctgacggtgaaccgcgccatgatcgtcacggcgtcgcagctggccacctacgaccaggccaaggaggccatcctggcgcgccgcggccccggcgccgacgggctgggcacgcacgtcgtggccagcttcgccgcggggctcgtcgccgccgcggcgtccaaccccgtggacgtggtgaagacgagggtgatgaacatgaaggtggcgcccggcgcgccgccgccctactccggcgccatcgactgcgcgctcaagacggtgcggtcggagggcgtcatggcgctgtacaaggggttcatccccaccgtgtcgcgccagggccccttcaccgtcgtgctcttcgtcacgctcgagcaggtgcgcaaggtcttcaacggcgtcgagttctaaaggccaccgccacgatgatgacgacgaacaatccacctctagtattacttctgctagtactacctctgctgctgatgctgctgctatgaataattactactacagcctggttgagagattgtaccttagcctgcctccccatggcatatgttccttctgttcctgcattcgaacgaatttggatggatttgatcaaaaacttcaatggaatccgcatttttaaatttcttgtgtttaaaacgtttccagtgtctcatattatttcgtcagtaatacagtaacctccaagcatgttggatcttggaacgtggcaacctcaagccctcaaagcttaaactgaattgaatattccatctcggtatttttagatgcagtgcacacaaccaagaccaaggtgatctagtagtgtttgaaacagacaagaactattctcaaacgcaattgaataatcaatcaacaaccaccctcccccagttcgaccctactcaatgatgatggagtaaattgctaatctaaaaatcataggattccgcgtgtgcgagtgagttccgctaattcagcagcaaccagtaaccagaaacgtgtctctcgcgccgttaaacatttgggcaggacagtgacgtgcatgttcctggccataggaggcttggggattgggacctgggggtatggcagtgacatttcttcttttttcccctcttgtatgattgcatctttgtatctaaatcatgtgtccatgttcacgctgcaaaacaaaatgtcaccaccacgcttggtagtggataccgatgcaaatcacacaagcctataacaatggtggtaagtgcagccatgacataagcgctttgctgtcaattagtacaaggttagtaccaactaaacacgaacagcacaggagccgttcgccaatgctttgtctgcacaatggatgccaactttggccttgtcagcaacagaacaagtgcaggaactttaaaaggctagacaagatatccgctgtaacaaattggatccacctacggacctaccaaccagcaacaggcaaatttggccgatccggcgatgacctactttgaaacacgctagttttaggcagcgttcgttctgggagattggaggtagaatgcacatcgttttccgcgtgcacgcttcctaaactattaaacggtgtgttttttgtaaaaattttttataggaatgttgctttaaaaaattatattagttcattttttaaatttgaaataattaatactcaattaatcatacactaatagctcacctcgttttgtgtatctcccaaatcttctctatctcccctttctcaaacacagccttaaatgccaatgcttttttaagacatgctttttagatggactcgagacacgtctgaaacactatagtttctaattctgaaatttcacaggacatagggaagattcatgtgttacaaacaaggactttgcatcagagctttctagtcagtaataaaaaaaataaattgcatcaattgcagcagaggttaaaatctgtactagttttgcaaatataactggtagtcatatcacatcttagaagaaaatgtagacgaggttagctattcaccttttgtgcggagtttgagcagaaaccagttgtttctcttgagaaatcacatgattgtccttcaagcacagcatcctggttcaaatttagcctttaagctttggcttcccaaccttgcatgcaaacttgttctgaatcatgctgaacaggaaacacatagcgtcgatttagatgcaaaggactacttcttggacatgtaacaagcaacagaaaattgtctgtcaacttgcattagccaattgtgggaattaaaaaaaaaagcaaaagaaacaagcggcaactgatgacatcataccaaattgaccggtaccataagaatatgcacaacgaaagcagtttgagacatgatggactgattttccagatgcatttgcaggacattagcagcagtgttttgatcggccatacctttttggaactcttacagtaaatttagatcaacagcttttcggagtcatcaagaatatttaggatctcactgacatgccttattaacaacccattttcacgtcagtgtggttggaggccattaaactcagtagagacctgccgcaagtgcagttttgcaaccccacctgcaatacatcccggcacctgagccctgaaaattacattgtcttgcttacttaaagaacaagaaaatgatcgtcattctttgatgcatgtgaactgagaggcatattatcaaggaggttaactttaacctcttgccctaataggttcaagtcctaggatcaacttggatgaccatctcatttttaattgaatgacaatattcacattatccaagccagtttttcttttactctttatcgtttcaataaaagaagattctggaagcacaatattacctcccacagtcccactagagcaatcatgcccatcactcaacatcagaaaatatgtcaaactcaacatatataacagtgtcagcttgataaacagcttgcttcggtaagtggcatattatcctgcatatgacagtatttcatgacatattacgtcatataagttatggccaggctgtactacaaatatccatttatcaagctctaatcagttcaagctagaaggtggcactggccagtagcaatttcatacaaatggtaaatgtaagcttgttagcaaaagattatatatatatatattgtttaataggagcatgagattgatatttaggcatgaactctctctagtctcatttggacaagaatatgattgatgtagatcatgtaaaaccaataaaacagtgattcagaaatcaaatgatggtgaccacgaacctacaactggtcctgtatcaatttgatttatctgaaaattctacaactattctggtgttaagtggatgctgattgctcaagaaattaggtatacgcaaatatctgaaaaatggagggccacaagtctctagtctacagcataattggagtgggcttcacaaatatttaactgtgatatatttccactaaattgcctaaaaaggaaattgtttcattattgccaatttgatgctaataaattttggccaaattaaagtgtcatgtcacaacataactccaatatgcctcaataaatctttgcaactgttagaaaattggctacataatgtatttactcttatccacataagtaggcattctatgtgcgaaccagtaaaaacagagttcacaccacaggtccattgcctaccattttgatgaaggatagagatgtgtacctaaataattactgaatggtttccctgccaactccaactgaatttctttgtacttgagagccaatcatgatccttgactggttctatcattccactccacgatcatgataacatgatgttgaagatggaacatgcatgatgcatcagtaaggttaaaaatctgtgcatttgcggaaataccagaaagggactgatactctaggattctagtttctacaatacaactttgaaacaggtgcttctcatctcaacacaggtaggggcttcaaagaagcatactgaaatgagaaggataaattacgcaatacaagtcaaatttaactttgaataaaagaagcgtcaagttttaccttcagcaggaacatatgtgagaaatctaccagattataggtgcaggttctgcaatcatgagaacataaagcttcctattagttggtacaactataacagaattctgaagtttgcatcttgcacttttgcagacacttgaaggatcacactatttgggctaaaattggcctccacaacttgttacccgattggacttggcccattaaaatgttttttcagttgccaggaacccagactggtaagaagatggaacatgcatgaagcattagtaaggttaaaaatctgtacatttgcggaaataccagaaagggaatgatactctaggattctagtttctacaatacaactttgaaacaggtgcttctcatctcaacacaggaaggggctccaaagaagcatactgaaatgagaaggataaattacacaatacaagtcaaatttaactttgcataaaagaggcgtcaagttttaccttcagcaggaacatgtgtgagaaatttaccagattataggtgcaggttctgcaatcatgagaacataaagcttcctattagttggtacaactataccagaattctgaagtttgcatcttgcacttctgcagacacttgaaggatcacactatttgggctaaaaattggcctccacaacttgttaccctattggacttggcccattaaaatgttttttcagttgccaggaacccagacatccagacaaaagatcgtaatcttttcctgtcttacaccaacctgttacttaacaactattcaacatttctaagacatgttgcaatatttttttatcagctacaactttcctaggtaggcaagctgacacttattcgaagagttctcacatgttaataccataaagtcaaacaaaccccttaaataggtcagaagtagagagaaaaaggttaatcttatttcaacttttcacctaaaagccagagcacacgtggtaatttgtgtgcaactgtgctatgggtatgcaaacaaacaaaagccatgcacatcaaatagcaaattactcagtgatacaaattttattcgtaatgccatctgttactttcaataattcaaggcactctacttaaccttagaagactcccttatgctaattctgcaatttcagaatggttacagcaatgtgggcaccatggtttgattatgccaaagacatactggtgactggtgagttctgtactggccataagcatagcttctcaacattactacctagaaggccattatggtacataagttgaatagtactgtaccagtttatggtagtattaaactggtcaagaatatttcagacttctattctattggcattcatattcgcatgtactagagattaaaaaattagccatattgaaggtggctgcaaagtttcaaacaaaaaaaaaggtggctgcaacctgcaattatagcagattaatattggaggatgatattcaagagcaaattcaaaataggtacgtcagcataagaaaagaagtgcattattgtgcaacaaccttatgttggtagcacctgacaagaaagcagctggtgtatttggtacttgtaaagaataatggaagcttcaatcttggcgcaaaccaagtttcaaacctggcgcaaacagtgtgtgttttcagaaaaaaaaaacgttttatataattagcaaaaacataaacgtttcacatcctccaggctacaagaaatgcttgcagcggtattcaaaggggtaccatcaagtgtatccatgtgcacacgctgaagtgcacaataacataatgaagaaaacaatcaaattgacaaccatgtggaaaagctatttcctaaatcaaaaggccggggtactgccaaaaggatctgtgggtttttctgctcaagtgcaaactgattatagttaacctatcaacttctctgtcaaagctctacctttttgataaataataaagaagctctggtgacttccaaaaagagtcctagactactagttatctagtaggattctaggtcaaagctgaattcacaatgtaatgtgactttagaatggcatgtcttcattgaacagactaggaccactaagaaagaacaaccgtccttcacattgctcagaataactaaaccaggaatgaggttttaatagccgacgttctttttctatcaatgccagtctggattgaggtaacttttaatcaaaagaagaactctaacatgcctagaatccatcccaaagaaaggaatgacgacctcatgcctcaaactgatacaccacccaccatcaatattcaattcttcccatcaggcgtcggagctgtgagaggcatatcccacctaaacaacaccttacacctacagcacgatgacccaattcataaaccccccaaggccccaactccccccatctccaggacgcgaacgcgcttgaccctactgccgcattacatcgaacacctagcgtgcgccccgcccgccacaactccacccacctatccgcacatgcggcgcgcgggcagccgagtaaatcgccccgcccccgcatccccgaacaaccgccatcgctgctggtttaagcacatttgatgcatcggtggtcctcgcgcctggcccgcgtgcgcgcgaaaagggaccgcgaccgaatctctctggcttctctagtaaagttggtggatgatccggagattaataaacatttaaacaattgggatcgaggtcggtggtaggatgggttgggtagccctggtaggagttgaccgatcgatcgatcgatccaataaacaactgtttgacttggggaaattaaaggagaggagaggaagagatcgtgcgtgcaaaatgtgatgcggcggagtccaaaactagtcgcctgggttggttagggcgactagtcccgataggaacagcaagcggtggagagaatggcgggtagggggtgaaacgatcaccttgtttgtggccgccgacgctgccggcggcgatgtcggcggccggatcggagaatcagccgtggtggcgtggtgttggtggacgactggtagacggtagtggcgggaaggcggagcagataatgaattgtgtttagggcaaatttgaattaagacaattgaatattattatccaattgtagtgtaaattaaggcaaattgaataatattattatcctacagtctgcaaattaaggcaaatttgaattcacctatccggttatcaaattgtactataaaagaatattgttaagacgaaatcggataggtgacactggtacttttataaatttgaattgatctattatcgttaaggtttctgtcaatatcttgctcccgattatttcttctctatctccggcgcgcatagtacaaaatgattgtcatagcggctgatggcatggatggccgtggagaagcagagtggcgcaagcgcatcgcagcgatgtgggggctcgagctcacctggcgaggcaacgatgtacggacttaagctcccaagggcgacatcgatgcggctttgagaggcagacaaagctcggtcacactgaaggacaatagtgatagtggttgctggagcgagctcctaatagcgatggcaatacaacttggagaggttaaggggagctcgatgacagtgagtagaggcgattgtggttgctaggacgtcagtgcatcccgttctgcctcgtcgtcctcttgccattgtcggatcccttgcctcctccaacaactcctggatctcctcctgtcacacctcttccacctgtcgctgtcaaatctcgtctttatcatgtctactctggtcgccattgttggatcccttcccgtccatctgtcgctggccacctcaagaggaagaagttacatgctttgacagctattgcacgtttcttattttagaatagtgaagtgacacaaatatactttcaattttgttagtgacatttttctaatacaatgtttcagtggcatgatcaaatttaccctcttgtttacgatgaagtctactaatcggacaaaaaaataatgaatgaacattcaattaaaggatatatgatagattatcttattctacattaatatttagagggtaacggagttaaaagttattttaaatactatcccaagaatgtatgtatttttttatggaaatgctaaataccgggataccgtttgctagcgttcaggacgggatcttctcccagcctcacacagctacagataagaatggtgtggagacaaccaggttccacggcagccattgcagtagagacagtctatttcacgcgaggttgcggcatggcgtctgtcgccgtaggttgtgggcgtcgccgtcgtgctgctcagctactcacgccaactgaggacggcgatggcgcgtggggcttggccgccgttgctgaatcgaagagaggtgccgtgttgaggagcagcgcgagctcgacatcggagctgatggatgtgggttgtcacgacgatcggggatagagctatcgtcgaagtggatagacgcggagcaaggaggacacagccgctggcgatgagctccgacatggcatggacggtggaggatgcggccatcagtgacgagcttcggcgtggggcctggatgacggagaggacacgaccgccgccactgagctccgacgtggcgtggacggtggaggatgcagccgccggcgacgagctccggcgtgagacgtggacgatgggaccaccggcgacaatgccttggtgcccggctcctgatacctcgcaagtatcacctaatacgtggtaagaatcgcttgatacttgacaggtataacctgatactttgcaagtatcacctgatacgtggtaggaatcgcctgataccttctaggtatcacatgatatctcgcaaatatcgcctgatactggttaggtatcaggacatgatacctcagaggtatcaggacctgataactaattggtatcattctgtcctaacgggattccgttgaatagcagccccgtttttaagaaatcatgaatcctacaaacttagcgaatataaacatgatataatctatgatatgtaagtggaaaagaacgaagaaatttgaataattttttttctcataaaagaatgaatttgaatagggttgacatcatgtcatcactcttaatgtctttttcccctatgatgcaagtttcacctattcgtgaattatcaagacataacaatgcgatatactaatcttcaggtcatgataatatattatttgactcacgaatggtgccaactccatggacggcataatgtatgaactagccagctaggtatatttagtttggcacacagtttcaaacccagccgcaacaaattctttcgttatcttctccatgcaacaaagaacaaaacagaaggaatcagctaacttaaaatacaatcaagcatggaggagaaaacgtgtgtcgccatcatctgacggtcgcaggttagcgatggaaatatggaattatctgaaaccttttcttcctgagccagaattctgtacgcaagtaataaaaaacttcaggcgattagcccccaaccaatgctctctcgcacttagctgatggaccacataagcattagcatatcaaagaaaagtgtttatctgtcccagaatggcaagagaacaaaaaaactgaaggaacttggcaacaaaaaggggcaaaatgcatccggtgagctttacagaactttatgcactgtaggttatagtctgatagagactttggtttaatctgtagagataacgtgctgcaaatacaagttaaaatactcttatacgaaaaatacaagctaaaatacagtctttctaaaagttctagcagaaattggtaagaaatagtcatgacttgttaagacaataataataaaatagttgaagaaattagataagagatagttgtaattagctgagatgaataaaataagtagaggaatggttatactgcggtacaaattttcaatctaaaaacagtttggagaaatgcttatattgcaaaggctgcaattatcgaaacgaggaggttgcttctgcaaacgtaacctgaaaaaaaaaatctcatattctcatttgttacgcacctaatcccgccaaataagtttgatgagaagattcagctcggtgaaatttcgctaattgcggaaacaaatcgccctgctggtcgttgcatctaatcgactgaccacaaccgtggaaagcaaccggattagttgcgaaatcaatgaatggtttgattcgtcaggcttttggactcccactgaggaaaaaaaaaggtcagtgcatgtactagaaaacaacgcatgcttttgctgcagtattcttcagcacatgtacatgttgaattcgttggaagctaaaccaccccacaagctattggttttcgggaggaaatttcttcagggtacgagcttgattagcagagctgaatcgtatacaccacgtcttggcatgctcttggacttccatgttaacataattcaatgttgccatgttggcataatttcaattaccacttttacctgaataatctcgtctgttactaggctagcagattcctgagcagagtattagctggtgtgttgttcgttaattgggtggtatgaaaatttttagttgtttcgacgtcgcatcatgctgatagacagttgttatacaaacagcgatactacggcttggttcagttcccaacttttttttcaaacttttaattttttcatcacataaaaacttttctacacacaaacttccaacttttttgttacattattttaattttagcgaacgaaacacaccctacagctcgtggaacagatcgtgtgatcgtgtcgcaaactaaactactggttagaagaagaaggccggtgtaagttgaaacttcagaccaatagcaatcagttgactgtaacaacacactgatatttcgagcgagcgagcgtgaggagaagtggtgaaattcgcctcttgttcccgtcgtccactcatctcgcgacgacatgctcgagtgcttctgttgatggaaatcgatggattcttcccagaactcacccgctgcctaattaattaaaaatctagctctgatgcttgatgattaccaccaattggtctctttgatctgatgctatttagagtccagatcacaccatgtcaccatgcagcatgattaatttgtttttgtgatcgagatgcagtcggcgagtcggttgtctggaatttggtggccgcgctttccttcagggatactccggcgccgacgtggcgtcgcctcggcgaaccaaaccccccgccgtccgccgaccagccgcatatcacatcggcgcgtcgccatcgcccgcgccgccgcgtccgcccgcggcgccgcgaagcgtcggcgccggcgcgcgaggatggcggtggcgcgacaagcgtgtgtgtacgtgggcgacgcgccgacgccgccgcccgcgcgcgcgccgtggcgtggcgtgacgtgtcgcgtgcgcaggggaaaggtacgtgggggaaagccaggtgaggcaaaccatgcctacttcggacgctgcgaatcaggaggaggaaaaagggagaaaagcgtcgcttgtttggcacgtatttgccggttcgtctcagctgctgcatttgtttgatttctctgtttttttcttccctcgtcgccattgacagaaaaaaagtgacgtcgacagaaaaaaaaaaactgatttaattgggctattttgcaaaaggtcttgagctactaaaatgattattattagtttattactacagtattttattttatggcatcgaatatttcgggtaggcaatattgagaacaagtgatattgatggaaatatatttgcctaaataaaagcttcatgaagtttaggcaactgtgacaaatccgaacttcttctaatttctaaaacgaataaaaatcaccaattaccttagaatagtttccaattccaattaccaaccgcagatatatatatatatatatatatatatatatatatatatatatatattaaaaaatccctttcatgtgaaaaatccctcaacgtcaaccgcgtgggacccaccagtcactttatgggaccccacacctaattggcgggaacacataacaaaaaagaaaagggaagaagaacaaacttgctaataacattttcccgcgattccaaaagttaggtacgaaatccacccggggggaatcgatccgacggcccagacacactcgggcccacacccccctcccgcgtgtgggaacccattcctttcttgtcgtcgcggtggccgttaccgttacgtgctccgtcttccctctccgtctcgcggaaccactttttgcagtttcccccctccacaagccggattattattcttttattattcctttccctcctctcgagtccgccggcttctctctctccgtcgcctgcctctccgtcacttccaaagaccaaacaaaactcgagtagaggagagagatagagagagaaggggaggggaaaaaattggaagccctagattttggcgggttggctacggcgaggtgcgggggaggggtcggggtcgggatcggcgggcggatccggtgggtggaggaggttgggcggcgagatctatgcggtggggaggggaggggaggaggaggaggaggggagcggggtgagaggggaggaggaggtggtggatggcggaggcggcgggttcgtcgtcgtcgtcgtcggcgtcggcggtggtggtggctgtggtgattgcggtggtggtggtggtgtgggttgtggtgcggcggaaggtgaggcgcgccgcggcgcggagggaggaggtgctgcggctcacgcggctggcgcaggaggagtcggagatggcggaggtggagtgcgcgcgcgcctactactcggagctgttcccgagcgtcgtgcacgcgacggagatggtggatgaggcggcgtggggggcgccgccggccgtggttccggctcaggcggaggcagaggcggagatggaggcccgggcccagccgcagccgcagccgccggtgggtgccaagggggtctgcgcggtgtgcttccggccgacgacgttcaggtgcaagcagtgcaaggctgtcaagtactggtgagttgtctgaattctgaaaccctcttctgagtccccctttgcatttcgtgaaatttcaccgggtgaaaggggaatcggaaagagagttctgcgattggtagtgcggatttctgtatttcgtagtaatttcggtgttcaaccttgaggagggctagtggttccagaaagcctggaatttgcgtctagttttggtttgcgcataacatgaccatcttgaataactgattggcaagtgagtttggtatggataaccctctatttagtcttttctttgtgcccatttgttgcatttgaagaatctaatgtggacatatggcattgctaacagaaacacagttttgaaagacattagcctgtgaatcgctcatctgtcatattcccaactaggatcctaatggctcaattctttctattacttttgttgatgatgatcttcttggaaactttactttttttagcctgacttaaagttgtccgtccattggctcggggcacatatattattgtcttttatttatgaatgaacttaggcacatgaccgggtttaagatgttaggatctcaatgtctaaaatgttctctagatgagaaaagtatcattttcacaaagcaatattatttgttgtgatggaatttactggtatcgttttcatacatgatgcttcctatgctcagatgctctacatcgaggcaacaaacatagatgatttatcaaaccatgttcaataaatagttgagactctgaaattcatagttattttttgcgggaaaagattcataccttttttttttgcggggagggaaaagattcatactgcttaacagtggtgattcttcacaatatttgtttcatgcgcataagcttatctctaatcatatcctttaaatttcactaaattgcaaatgtttggacaaaattatcacaaaacaacatatttacgccataataaactgtagatttagcatagaatatatcccgatactacagattgaagccattttgttgcaaaaatataagatttaaccccaattttatcacaaaactatatatttttaagatgtacacacatcaatcatgctaatctgaagggtattcagaaaattaaattccataatttcagaaaattaaattccataattttcattgacaaatttcatcacctgctacacattcatgagtatatttatgtgttaacccatgattatggattaaacgaatctgaagttttcgaggttgatagtcgtaataagaatttagcaaactacttatggaaccgttgattacttgagtttatcagtagattttttatggattagtttagttaatcatcctaacaaagatcattattggattacaacaactatttttattctgagttttatcctttgattctaaactcataatacttaacattgaggcttaatttactggatatgatatcaacattgataccttttcaaactcttaagttattatctttgttacattgtatacattgaaaattctgagctatagtgtaatgttgtgcatggcattagaatgtgctacttgttcaacttcaatgataccttcattttttttgcagttccttcaaatgccagatagcccactggagacagggtcataaaaatgaatgccgcccaccaagcactgatgctaatcatgatgatgtggctgaactttctgttgcaaaggaaaggaaaattgagcagacaagtgcttctgaagaaaacatagctgaaaccaacacggcagccaccgtgaagaatttaaatgataaaacaaaagatatgccctcagaagtacttgcttcggtggaggttcctgatgatgaccattctgtcagtgcggtcaaactccctcaaagttcttcacaagtagcttctcttggcagtagaaagacagaatcaaatatgaaacctacaactcctgttgaaaatggttcttacacaaaggacttagatgaggcgttggtgtgtagatttcaaccttctccaccaaagattagtggctctggaagtcttatcaacaaagagtccttaattgattccaagaagcaccaggattgctctcaaactagtaacagcaaaaaatatgcagataacaacaatgctcaagctgctctacctgttgcagtagaacctaaaacttccaggactgctcttcatgtggaagttggacactccaagacaaaagctgctggctcagacaacattggtgtgtcaaaaatggtgccatctgttttgactgttgataaagtttctcctgttcccggtggacgttctgttacacctaattcatcaaaaagggctgataatattgctgaaaggaattctaaaccatcagagaaatcaatttcaacagcaaatagcctggcaacatctctgaaaaaaattgtcaggcagcaaacagcaccaaaagttgtgaggcattatccatcagagccagtaagcaaaactgaactgctgtgtttatagttagtaggagttttctatctgctaatagttttatttttttcagacacattttccatatgagcttttcattaagctctatgaaaaggttgaattgcaaccgtttggtcttcataaccttggcaataggtaagttttggattatttctggatagttggaacacatatatgtgtttcttttttgcttatctcattattttagcatttctctaagatttataacttagctctccccatccttttgtggctatcaggctacatatcacagcttgcatcgaattttatgataatttgtggtgtttatgcaggaattagcttagtacagtgttctgtgttcaccctgtttcaccttgttttttcctctctcttgcagttgctatgcaaatgctgttcttcagtgcttaatgtttacccgaccacttacatcatatcttttgggagggcttcattcaaaaaattgtaatgttctattactgtgtttattacatcattgtttcccataaagcatttctttgagtaattatttaatatatcatactctctaggttccaaaaaggaatggtgcttcatgtgtgaatttgaaaaactcgttggggagggcagacaaggcaagattgctttgtcaccaactgggatactctctcatttgcctgacattggaagtagctttggtcctggtaaacaagaagatgctcatgaattccttaggtaagttattttttttaattgacagtttccagtttaagaagttaagaattagtttagcagaagttaggaacatttatgtgcctcaacgaggaatgcactgggggataagagcgggggtatcatatcacatattcatgcagaaaattaaagttaataggcctacttgaatatttgagtggtagccggagtgcttattaggttctgtggtctgtggtctgcatgaagaatctaatgagcaatgacaacctttttccctatcatctggattcggagttttggtggtggtttgcatcagtataatgttgtaatcctggtagaaacaacctaaacatattattttgggtatgaattggcattgccaatgtccttgttttgaattagcttagttaattgtgctcaaccagttcttttcaacaatagtgtctgatggaaccgcactacctgatctgttgtaggtacgccattgatgctatgcaatctgtatgcatgaaggaagccaggaaaagcggcactcatcggttacacgaagaaacaacacttatgcaattaatatttgggggctatctgcgatctaaggttttcttcacagttcacagaacaagtttaaatttctgttgtttgtactcaattacctgagatcagctgtgtaatgaagccccactcctattgactgcttttttccttcttctagataagatgcacaagatgtgatgctacttccgagcaacatgagcgtattttggatcttactgttgaaatagatggcgacatcagttcactggaaggagcacttgagcgatttacatctacagaagtcttggatggagataataaatataaatgcagcaggtttattacttagttgacctctatctttctctgccagctcttgctgttccttttgtgctcatatgcgttcatacagtgcacatcttttttgccactttccaaaatcctcaaaatgcttgtcactgagaccgtagtaagttaaggacctctattatagtgttgttgtaatttcaaaacgaattataggcacctcagacctgtagcctaagttcgtattcactttctgggatttagggatcgatttttttcccatgtcactaatcaggatttaagaggggaatgtgtaatccttag

SEQ ID NO: 78991 - DNA, 2184 bp, Oryza sativa
ctgttccgccagacaaagagccaattggggcttggtaaatctcctttgtgtgcaaaatcctcgtcataccctgggccaccctagagtccggctcagaatttagggatgtgttttgtcagatcatgagcagttcatccacctgagcctggcagcagaagacagcctgggagcaaactgctcgctgaaagctccactgcaaacctgcgccactgggaaactattttgattccctcgagggattgaattcaatcgtttgtttaaaaattatctacacagttatatttttttttcaaaaaaaaattaataacttttatacaacatgcatatgatactttacaaaatctttcaagcttaactcacgcatttagatataaaaaacatattcagtaaataaatagcagatgtatttgtaaacaaacttagtaaatgtatacttatctgaatttgttttttttctcaatgtgccgaatttgaacttgatttaaaatcaaaggctgatagaggtcgctatattatatatttggcattttattcttatttttttataactatttacattagatttaggagagaaaaaaaacacgagagacattctcgaaggattttgaatccattccaagtagtagccgtagttgcatggatgggacgccggaacgggatggcatcggtagcagcacgggcatatgcacacgttctgtctggtgtgggcaaacaccgtcccgtgctgatttatcacgatctaacccgtactccccgttaaaaaaaccaatctagatgatgatagaatactactagatagatatgtccagattcgttgtactagatggtgtcgacctatctccatataggttgaattttgtttggacggagggagtacgtgttatcccatctgtaagtacaactactaccaacaattattcctaaggtaaaatgtatgatttcgctcccttctcttttgaatggtggtgaatctgttaacccatcttcttccgtttggaaagtatgatcattttatacgtttttcttgtgagaagaaaaaactgcacacttgcattgcatctcatgttatgtaaaactggtttgttcgtacacttacatacatacctcgcatgttgcaaataaagaatgcagaaaaaaggagagagaaaaactttggcaatttgtgggcaccggagatgccgggaaggtattaagctactataaactaatgcttgtttcagttcatgcttatcagccatacctgcagtgctcagcaacaccaatttggtgtctaaaattgcttccctttggctttagtttttctttcctacctttgattggcaatggcacgcggacgctaaggactattcgtttctgcattttctttacgagatttccgcttaaagcagagaggaatggaattatttttctccttcagtgggatccttttgatctgatttaggacggttagatgctgacaagcagtgttctttatgggggaatcattagcttgacgtgttaataaattatcgaattattctgttgtagtttcacatcatgtgatgcttagccatgaggagaaattctggggaaaaaaaaccctattgctgtcttgcagaattggtttttatcagattatcaggcaatggtgatgtaggatagatgatcctgtctgttgcattgcagctttcatgacccaaaacatgagtaaaatatggaagggaactggtccttgttttctgcttttggacttgtcccctcgaactaccaatctctctttgttttatctcacatctaactacaccttagtttggtaagactgaatgtctgaatcactaatatctgatagaaaaacaagggcaacaccataagaaactactcgaactagcaagtagcaacaaatctatggctcactgtcagggaaataccatgcaaatgtttatgatttttttttcaaaatatttgacaatatttatatagcataacatatacaattccacgatattccatgactcgactccacgttcttttccacttacgtattatggatgctaggctttcaaaacttctgaatggtatagttgttacaaaaactttcttcattggcgtttcttaaatattttttgaacaactttttaatatttaattccttcgtttatgtcctcgaataacttgtcttttaactcaatttcatccataacccat

SEQ ID NO: 78992 - DNA, 5321 bp, Oryza sativa
cttacgaggtgagcccatccaaaaaagtgtaatcgcgaaaataaagattggatccagcacgacgctgcaagcgaaatacaccctaagctacaaaataaagactggggagtatagtccccaagcatgtcgccctcagcgcatcagtaccagcggcaaaagtaactaatcaagcaaatttaaggtggcaaaccatgcattgaaaggatcaaaaacacaagacaggaggtttttaacacagaactaacaccatgatgtttagctggataatagagtgcaattctagtagtagggttctacaagagtaaactcaacaagacaatattgccatggacttcatgaacttggagatactctatttcttcttctcggtgtgagcgtgaccgccaccagacctgcatatcacaaaagaaagttagtttaaattgaaaacaaagcacaaggctaaagaaaatataattgtaccaatactattaaaactcatcccgaatgtttcattttcatgaatttaagtttgtcaactttataataccattataaaatgataaacaatgaactgtacacatacaaaagtgatccttcctaaaacatatagtatatctaagcaacaatctgcactgtgccttaacattcattctttgtttaagacacacgacaggtccaattatgttacatatgatttattatttcctgcgcaatacaagaaatttgtacttataatcacaaatgaacactacctttcgaaaaaacacacatacaaagacactaaacaatatagaataaataaaacaaatggtagcacagttctgataataaactacaaactaacaattacaactaaactagttcaaacaatattaataggcacaaattcaattgcaacggaagacaaggtaaccaatagaataataacaggtgtttttatcaaggctggaagattacacacctcatcttcctgaggacaccagccatctcctctctcttcttcttggccctcttgtgggtgccaagctttctctttgccaccttcagtgcacgcttgtccttgccaactttgagaagctcagtgatacgcttctcatagggagcaaatccagcaacctccctgatcaagttcctgacaaaggtcaccctcttggtggatttctgcaaattaacatgccaacaaggtaagtgcaaatgcaataggaaataatggccagtaaactgcaaagcagataatataaagcaggatcaaatcattgaaccaaacaacatataatagaaaaatagcaaccctaggttttatgtaatgcaaacaaaaaaaataacacaagtgcaccttggatacctcagagaggaaattctgttgatacagaagcatgacttcacacacagaaacatggcaaacaatatcttgtcagctgtaagaataacgaactaaaaccactattcccatcattttaatgaatatctaggcatacacatgtagactaattgctgaaataaaaaaaaacttgctcccccacaaatacaaaggcaaagcaagaatagtacaaggggaaaaaatacagtaccaccgccatttctaaatacaaactggaaaaaaagacagaaatgaaatgcatactaggattgagaaggttgaggggtcaactatatcagtcaatactagcaggcatcacgccctctgcagcatacataggatccatgcaaaaatctcgacctacaacacgaatctacggagagaaacgaagctacgcactaaatccacacagatcaaacacggacaagcatcaccgcccagctcgtcgggctgaaacagctcgtgctacgggatcagaggcgcttacccccttgcggtcggacgggcgaggcggcagctcgcgcttggtgacgacgtggcccttgttgatgcccacgaagagcccggacttcggtgcgacggcgccatcggggagccctttttcctgcacgacaagcagcgggagaagatctacgtgagcggcgccgagggaggagagaggctagggtttcagatcggaggcggaggtggtggcggcggcggctggcttaccttacctgggagaaatgaagcggcggcggctagggaggaaaccctagcggaggagtgctcttatataggcgcgcgccgcgtcgcggtatccagggtgatagacgggctgggctaaatgggcctttgttgtgggcttgtggccatgtgatttccttgtgtttttcattttattttgggatggaataagtctatattacctccgttatctcttccttctcgttgaatcatctctcttaaccgcaaaacctagtataacgcctctcctatcttcgaaaaccaatgcaagacgatcatggttgattcgctgagtcagcaggtaaggcacacatgttagggactatcctctcctctagtttgcccctcacccacgcggtcttcgccttgtcgtcgtcctccttggccgatatgaagtatgagtccagcataccactatcggcattatatccgagcacgataacccacccccctgcatggttgtggagcaacgggtcggcactttgcagatttggtggcggtggcgatggcccatcgtagggcggaccacatgttgtcgtagcaggcggggtgctccggcgtgaggcagtaattaactaacaacacgaggacacaccgtcaggagtagaggcagttggcaaaccagtgctatagtgcatccatgggcgagccgatgatgaggttgtcgctatggaggtacaagacaacgggtagtagtttcttcttgccgccgcaaccatcaaggtcgagggaagtagaggcgcacccacggttcgatgcctgggtcgatggggatatcgcctccccgcgacgccaagggcaggacgtgagtgttcgggaagaggcactctacgctactgctttgatagcaccggataagcggcacgaacttggacgtgatctcgtcgttgctctatcctatatgcgcgacgcagagtcgcgcatatgcactttgtgggttagtgaggaacacgttgtaaccacgccctccctcccgatggatcaattcgtccccaccgagccctgctccaccgaccacctctctttgccatcttgtccttttcgtgttctcaccaccgtgccacatgtccacacttggggtggaacgaggaggaggaaaggagagaagtagatgaagcagatgcagagctgactagtggatcccacacaacccacctccttgatttacccacataggaagaagacagagtcctgacatgtgggccccacccactaacttagcgagtcaaccgtggtcagcctgccacataaaaaaaaagctctccgcaaaccatcgaaggagttgatttgcactaattttcgatgataggggaggttatttctggttttacggttgaagtaggctattcaagcatggaggaagagatgagagaggcaaaatacactttttacttttgggacattagagaggtgggccacctgttgattagggaagggaaatatgaactgggctttctcgttgagctttcctcgagcaaaggcctttgtacgtcattgatgggccgtcaaatcactacagttcaatgtgaggtgcttaactgcttaaggccacatgattgggcgtaaaatcaagagaaaatctcacgtgtacctgaaattttacccaatctcttttgtgccccggagttttgcttattttcttatgtacctctgaattttagtttgcatatcttccatacctgtttcattagttgatcataagttgactattgaattcttatcaaaaagtccattttgctattgggtatgaagaaacatataaatttatcgagtactataattatgatttacgacaaaaacgtagataagacactataaatatttatttattagttactaaaaattgtttatgtagcaaataaatagatttgtcttataaaaaatatgctgcagtatcgccatcaacaaaaatatgcttacttatacaatttaaaatttaaaaaatagttataattattttattttatatctaaaactaaattttatcgtaaacaatatctcgaacaacaaattcatagaaataaaagtctcataaaaaaaattctatactccaatagtatattttataatttatacatgtttcttcatatcaaaggacaaaatagtttttcactaagaatttaacggttaactaaacggaaggggtccaaactaaatttaagtggtatgtaaggaatgagcaaaattcagaaacataaaaggaatcgagcaatgtatcataggcatacatagaattttctctaaaatcaaacatctatattagccatatagattctcaagttctcaaccgactatctttttggattacgtgacttggtagctcggtggaatcaagaagtgaacttaaaacatctgtgctgtttcaactatggttttccagcgtcggaacgtgtacttaaacatctgtgctcggtacaaaaaaaatgctgtttcaggattaacgtccgttctacccccagagaaacggagagacagacagaagagcgaacaatctgttgcaacttgcaagcatcaagtataccactgcacaatatgcctatgcttacctgcaactgaccagcaatatcctttggcactactcttcttgtttacgggcacacagtagtaacagtggtactgatcagtaggcacgggctgactactagtcatccccattaacactaaccactgtttcccatcactggtgtagtagtaggccgctgggtttgagctgtgaacccctaatcatttcgtgagcgagacatggtgtacgctagctgtttatagtccagtagtacaattattattatggcaccggctttggccctatacaccacgtgaccacccatacgagaaaaaaaaaacactctccgtcccaaaataaatactatacaattagtagatttatgtgttctttactggctgtcttatttaaagaaaatttatgaccgatattttgattgttattatatgataaaatatgaatagtattttatacgtgacttaatttttaaacttttttataacttttttaaaaagagaatagtcaaacgttgaacatagaaatacgttaatgaatttattttacgatagagggtaaacctgcaaggctgcaccccgtgcagtcgtacttgcccaattgcgacggcttcccaggatagctcccagctaaaaccaagcacgagaaagcccaaataagccgtatatcatatatggacatgggcgtatatacgcatatacttcctccataaaaaaaactcaaccagctctctta

SEQ ID NO: 78993 - DNA, 5295 bp, Oryza sativa
taagcccttacttgtttgtactccacaaatcaagtgagaaatcaagtataagtcttgtagaactgttaggcctaggggtggaaacgagccggctcagcttgcaatggcctgtaacaaactaggcttggcttggctcggcttggttagagaaacgagctaaaatatgagctcggctcggctcggctcaagccagatcgggctggcttgcgagccttcccattgaagcatctcttcatatataatttgtaatcattaagaaaatcaagaataaatcatcgacatatataattaaaataagtccatatatttaattttttcaaaatctagatatgataaatttcatattgacaaataataacttcacaataaaataaaatcatccatataaagtacatgataaatttcatattgacaaataaaatttcatattgacaaataataacttcactataaaataaaatcattcatataattacataatagcctaggctcgcgagccaacccgggcttgactcattttagcaacgagctgaaatggagacttgggcttggctcgtttggcatttaagctgagccgagccaagcgagctcgagccaagaccgagctaagctcatgagtccgagcttctttcccgcccctggttaggccccatctttttttctcttacatattatatattactattacaagagtgttttctgaacttttaaatggctatttttttcctaaagaaaagttatatgtatataagtttcttaatatagttaatttaatagtttgtacccccaagtttgttaagaaaaccagacaatcaattatatacagacaaaattgatcaaaataaaaagataacaaaattaccccgagcagtcaacctgaaagtaagattattcagtggcggagctagaaacgctagaagaatttagttcaaggggaccaatattgttagtttttctatgtttgctagagttataggaaattcggtgtaaaatttgaagcctggggaggccaactggccaagcccctcctgtctccgccccctgagattattgttcattagcaaaatcaagacaagacaaggacaaccccagatgcacggactgaaaccaaaacaagaaggcaatccagcctccactctcgcatctgacgtcactgctttgctgctatcttcgcttccctggcgaacaagtatattatccaaacccttcctagcaacggccgttccttgtttgacttgttcttctagtaaagaaaaccaaaaccaaactataattaagcagcgtgaagttctttcttgggaaacaaggtcgtcggagatactagcagcgatgattaatgaattcacagtacaatatcttttcatatgcagctagcctgaaatgagctgcttttcctcatgaatgacggcctatatattccatcgccttttcaggttgtaagttgtaacaattggacgttggggttacacgcttcagcttacatagcctccaatatatttggtggcaccatgagagatgtggttataatcaattttcatttacaaagctatctatttttacatattttttcttcgtatttaaatgcatgatgctattgatttttgacaaactatttataatattaaacaaattaatataaatacaaaatatataagtaatgtttaaattaccttaactgtagatgtcaaacatttggtaacgaaaatatagtatttattagattttcagatctaaccattgatttaaacatatggtgttatcttgatcattgatctataccgtttatcacatggagaatttgtgttaaataaaacatggcattgcaaatactataccgaaaaccctctttgattaaacttttttttacacaatataaaaagtttaaaatgttacttttatcatttatacacaatgttactttttatctgagtgtgcgtgcgttgtgagtgtctacaccgtactgtgtaattctaaaaataaaatgtacgcttcctgaactgctcaacaatgtgtttttataaaaaaataattttatataaaattacttcaaaattatattaatcctttttttattttaactaatatttaattaatcaaattattcagttttacgtgcgaaaaggtgaagtttctaacctcaatctccgagcttcaacgcagccagggtgttaccctagctgatgggacggaaaatgttaaaaaaagagagcccaacacacgattcggcgacctcacaccgtccaacaatttcgatccgacggcccaaaccgccgcaacgacatcccaagagagcggagctcggatcggaatcccgtgagcgcccccccaccgaaaccgcggtcgccttcgtccgaatcgtctcggtaaaacgccttctccccctcctcttccgccgccgcggcgatccctctttcacctccacctccacctgctcaggacgcggccacgcagtagtcgcggagaaaagaaaccgaaaagaaaaaaaaaaatctagctacgcatctcggcccggcccccccgccgccgcgcgctcggatcccccgacggctcgccgccacggcgccgccgccgccatgagcctcgcctcgctcgcccgcgcgctctcccgccgctccgcgccctcctcctcccgcgcgcgccaggcaagtctccgccctctccctcttatcttccctgaatcttccgccaccgcgtctgggtggggggctgattgtgtggatggcttttttttagggtttctccctcggtgggctaggtgggaccaccaggtcgccgccgccgccgtcgtcgccgctcccatcgctccatggcggggagggcggtgggctgggattgggattcgtccgcgggtacctgacggcggcgctggggaggcccgccgcggtgaaggctgggacagactggaggtccatcctcgcgaacccgcagttccggaggctcttctctgacgggtccaagaagagtgagtcccatccgcccttttttgatcggttcggatggatggctttaggtgctaaaagtttgtggttgtgtttttgtgtgtgtgtgtgtatttttatgatttttagattacgagaactactaccccaagggcaagaaggaggcgccgaagggggatgggagtaacaagtctgattcgaagcgtaagttgccgtcttttttttctcggttgcatcatttgtttgtgtggagaatggtgatcatgttgtgaaattaatagaatgcactgcacagcttttaatacaatagcatgtaactggtgtactgattgtcattgaaccaacgaggtgaataatcaggacatgttatttttcttgcgctgcaagtgcttggtcgactgatgccaaatggaaaaatagcttgtgtagtgcaaccaatgatggcttgtgagcctatggtgtacaaccacttacttgtcagtgttcttaaaaaacgaatgcaaactagatccttgttcagttttaaaaaatgcagggatacactgtaatttagtataaaaactcagaacctcagtggttatctaacttaagaggctgaaccgctgaaccaaataaacacagtagcacagaaagttccagattttggtctttgctagatcgttagttctctggaaattaaaacgtgccgctgacctagcactttcatcttaataatttctttgggagattagtacgggttttgatggagattggagcctagattttagtggctggaatgccaagagtccttttgagggcaacaaaataataaactcttagtgcatcattgcgtgtgggctaatgtctggtttgatatgcagaagattcaagtacagacgatcaatggaatttccaggagactgcctcaaagcaattgcaaaattttctggcacctctactgtttcttggactgatgctctcgtccttgtcgtcgagctcatcagaccaaaaggaggtaatttttcactcccttctgagttctgacagattatattcacttgttctgctatgcacatgaatctcttcctatatactagaaaaaagtggatggaagaaaactatgttgcgattataaggactataaaagttgtacttaccccaatcaaattactgcaatcagctattgagcattctgtaataaatagttcaatacaagcagtactagatccagatggcagcaatacattcttctcaccgtgaagttttatcttaaactgacaaatggtagagaaaatacctgccgctcctctttagatggtttcaccttatgcctgcaccagtcaacatatagcagacaactgattttgtggttgcatatttattctttttaaatctatggtgaacaattattctcgatcttaaatggaatctcaagatattttgcttcaaatttctgcagataagcttccaggaattcaagaataagctactagaacctggtttagttgaccgcattgttgtttcaaataaatcagtggcaaaggtctatgtcaggagttcaccacagtcgaacagccaaggtcagaacactgatgccatcattaccaccaatgatgttccgagcaagcatactcccagcagatacaagtattacttcaatattggaagtgttgattcctttgaagaaaagttagaggaagcccaggaagctttgggagtagatccacatgattttgttccagtaacttatgttgctgaagtgaattggttccaagaagtaatgagatttgccccaacagtctttcttgttgggctaatatatttgatgagcaaaagaatgcagagtggttttaatattggaggtggacctggcaagggtggccgtggtatttttaatattggaaaagctcaggtgacgaagatggacaaaaattccaaaaacaaggttagttcattctcttcttctgttctactttgaaacgactgtcaaatatgaaatatatacatgcacattgattctcaagctctgctagttccacctattcaataatgcagtagctactgcttaaacgttgttaagttacaataaaaactgtataatgacaagcttttctgttggtccaggtgttttttaaggatgtagctggttgtgatgaagctaagcaagaaataatggagtttgtgcatttccttaagaatcccaagaagtatgaagagttaggagctaagataccaaaaggtgccttgcttgtgggtcctcctggaacaggcaagactctgcttgccaaagctacagcaggagagtctggtgtgcccttcctgtctatttctggatcagatttcatggaaatgtttgttggggttggaccatccaggg

SEQ ID NO: 78994 - DNA, 1379 bp, Oryza sativa
agattaccatgcaacattttgaatctgcaattgatagaattattggtggtttggagaagaaaaacaaggtaatgtgaatatgtgattatgtgccagtttgaagataatctactccaaactgttaaagcaataaatgcaacctgcaaagctgattagtgcctgatttacacattactccagcattgtgtagttctgtatagtgctctcatgtgaaccggttatgctctattttgatacacattttttgctggtttaatgactatggaagttttgtttttttaaaaaaacaaaaacaaaagaacggtacataatgactagtgcattcattaagttcctgttctaggtggaccttaattaagttaagtgatttgtgaatgtggcatgatagttcgtgtagatcactagatggttgatcatgcatgaatgtttaggtgagagtgctgtaaacaaggtaaactatataaaataagtagtggatctacatgcaaatataaaaaactctaggtcttactcagaaatggatggtcacttaagtgtacgcaaaataatgatttctgaaatttgtggctttgcacacacaatatctgcagtatgtttcccttttggaatgcccaagccataactgttttttcacctttaacttgttccatagtaaatatataaaatatctactttcagtaagggagtaatgcacagatcaatgcttagtaacttagtaactttcttttatatgaaatgacttgttctcaacatgtgatagtcatgtttccccatttatttttcttacctcttagcctgttaatcaaattgcaggtcatcagcaaactggagcgccgcactgttgcttaccatgaatctggtcatgctgttgctggatggtttttagagcatgcagagcctcttctgaaagttacaattgttccccgtggaacagctgctttaggatttgcacagtatgttccaaatgaaaatcttttgatgacaaaagaacagctttttgatatgacatgcatgacattaggtggccgagctgcagaggaggtacacactaattcttttacagtcttatgactgatttatgttaatagctaccttttgtggatatatctttcaaattcctactgctgagtgctgacacaccatttcttttcagtcttcttatgacagcatgcgtgttatgtttttatgactagaacgaatacaaggtttttctgcatttgacagctgtaaaaaaattaaaaaaaaatggttaactaggttacagtttacacattcaattatgatgacttggtgaatacgagtaatattatcacaatttggtagtcaaactcttgttggtttggttacatcaagacttcaaccatttatgactctaacca

SEQ ID NO: 78995 - DNA, 1246 bp, Oryza sativa
ttaacctttttctggtaagatagctacatattcttgttggcttcaatactgtacttagtctagctttgtttagttcctttcatttggtgatggcctgctcgaattaatactcgatcgattatctttggatggatatggcatgatacgagctgggttgcctgaacgtcgcatgcagtgcagctagctgcaccagccgatcgagactcgagaggttggccatgcaaagcattctctgtagctagctttggagtgtggctaaagtcaacctgcagggtgcatgactagttgtatatagtttcattacattgaatagttgtttaagattcttcattgccttaattatcacgcacgatcttaattttctgatgcaattatttatcctgtaactaaacacaagcaataagtataaatgaaccggtacaatctaatatccattaatcatgtcatattaaggatagaaattactctgccatccttaaaaaaaggttgatttagaaagtcaaaggcatgagaatatatatgtaatactattggaaacacacgtatatttcttctataatttttggtgatatgtgttagtcagtgtgcatgatatatccatctgaaacatgtgtacacatgatatgttcttattgatacataaattaaattggtacccttcatgggttacctccatcagtttgtgaattgcatgcacaaactaaaaagaggaaaaaggcaagcaccttaaagtcacatgctctcgtttttcaatgtcatttctaagagcctcatcggttgctcatattatctaatagaccattttggcttattggggaataaaaattaatttataggtaagacttttacatgtgttttgctaaaaaaaatactacgttgaaaatacattaaaatcaagtttgaaaatttaaattttggctttggttttggcttattaggccaaccgatggggctgtaaaaaaaacatgatatttctggtaaaatatgggacataatctattatctataaattggatcaacctgtgtgcatatgaagagagagagagagagagagaaatcctactacaacatataaatcactctaattaacgatgtaacgttatagtgtatattatcaaattttaagtgaatatcttataataactatttagatttagatgacatgtacgaaacagaatttaaaagttttatcctttaatttacataagttagcagatataggaagaaatgacgggggatttgagca

SEQ ID NO: 78996 - DNA, 8736 bp, Oryza sativa
ctttatatgtatgtatgattaaaaaaaattaagtgagaactatatgatgttcccatagttctgttgccaatagcgaaaactcaagcccccgtcgtccactgctagatccgtccctgagcacgttggcatatattagagtttgtgtcgaatatgtgtatgtagtcggttacagtttaggattagagtatgagttggattctatactaggttctctcataaataaaggggcgtgcctgttgtaaccgcatggcgacttagtatagcgagaggaagcggctgccggcggcgaccggccgtgagtcgttgtaactctgatacgctgtatatgctggatcggggaggagcacccgtaatcagtgcctcggagatgtaggcctcggctgaactccgttatcaaatatcgtgcctcggtgtcgtcatcatgtttggatctatggtgttttcttccgcgtttagctaccgatgtcgatttcagggctggttttataacagcatatttgtggtgaactcgtggccattaaaccgagccacgagattcgcaaaggccgaattcggacgcctgagccgtcattttgctcccccaaccataacctattccttggatagcaatcaagcatagcataacacagagacggacaaaaagcatgttggcttagcgagtaaagtgtccttgttaagtgactgcacatatagccggtcttttcatatatatcatgatcaaattgtgtgagccccattgtggatgatgcaacccatgcgtgtcagcgtgtatatggcttctgatggcatgggagtaagtaaaaaggtccgggtagtaccgatctgtagtaatttcgtttccggtgtgccaagccgtttagccgtcgtcgtgcgctaaccgcatgcccagctctccctttttcttcccccaagcatgatccaacaatgatgaaaaagatgcttgaaaaagatgaccaaagggggcttatcaccatttcttgttttagctgtgacagttatgtgcatcctaggctcctactctctctttatctttttttaatattgtaagacttttttgatttttttagtcaaaacattttaaaatctgatcatgttttatagaataaaatagctacatttacatcatcaaaatagtttaattaaatataatattgaatatattttgatattttgtgctgaaaacgttgctacggttttctataaatttgatcagagttaaaaaaatgtttgaataagaaaaagaaaatcaaaacataatggctatgttcggctacactgatatttaccagctgtagtgcagcggctgtgtagagcagctgaacagacccaatatgaaacagagagagtaggtagtagctccatttcttcgtattcctctgaatattattcgaaagcacgggcatatcactatttactggtaaaagggcatggtttttcttttatttatccaacatattagtactgcagccatttgcttacatcaagttgcttagacaacttgttttaaataatatactataaaatttaatctacttttataaataagttgatcatccatcaatcttcatccgcatgtaagagcactagatcagcaaacggttcagagaaacaattgcctagggtttgagtggaactcgagtattgattgagtgaaaattgcctatggttcagataaacaatcttgaatgctcatgtgttggggagttagccatcagccctgtattgattgacggtactaagctcctacattatgtcggcaactgaacctacttccctaactctatgagtagataattgccgtttgatcagggaactatacttatggttgacattttgttctaatcacccaccaggcttctacaacatgctttccagagaactaaatttctcgtgtgcatgctaccaaactaaaatgtagacaacaggtatcaaaagtgagaattttgttttggggaattgagaaaagttgttaaggtatgcagttcaatgaaggattaatgtactatacttcacatccatgcagccatacacacctaacaccttcaaagggaaagaaagtgaagagatctagcgtggatggaggcaagtagctcatcctagtgacagatatgagtttgttcaggcatccttctctgaatccggaagaggcttgggggaagaggaaaacatgaccaaacttcacacgcgacgagtacctgctaagcctatctcacacgaattctcccttgattttgatcgagcccatgcatgctccacagactgtttttttgttggccatttgcaatgcagtcatccaggatgatgatcaacagagtaacagactaccttcctcctcgtcaagtcactgtcttgcgagtcttttgttatttgctcaattgctcgtgcagtcgcttggcatgtaagaataaggttaggaaaacctatgctagctcagctagctgaagaaaagttgtggcctgactagcagtggatgcactgcaccagaggcggtcactcccttctctgaacttttcccaaaaattcctctctcaaagcaagaattcaactactgttgatttaacatgtttctgatgggttggagcgagagaaaaagtttcagataaaaccacactgttaattgatcaataatcactgttccttctcaagtagtcaatctaataatcctgtatatattttctgtttgttaagcacttttatggagctttaattgtgagctactgttgtggtgccgtcgttcggttccatcaatcaaatctagctaaccatgccggcatgcccaataatgctgttccaaatttagattttgcgtggtttccactacaatacataataagaaagtagtagaatttaatcttagaaatttaagtaagaggcttcagtctattcttcttcttttcttccttatcacaaaaagaatgtagtacctaattattgctgtgtttagttataggataattgcagcagagaaagattgtgcgtgatgattaaggcatgaaaatcttaaacaactattcaatgtgatgaagcagcatacaagtatacaactagtcatgcaccctgcaggttgactttagccacactccaaagctagctacagagaatgctttgcatggccaacctctcgagtctcgatcggctggtgcagctagctgcactgcatgcgacgttcaggcaacccagctcgtatcatgccatatccatccaaagataatcgatcgagtattaattcgagcaggccatcaccaaatgaaaggaactaaacaaagctagactaagtacagtattgaagccaacaagaatatgtagctatcttaccagaaaaaggttaatgaacttccttttgtgtagataactttgcatgcttctggccaacacactgccattgcaagcatagctcctcgatctcatgtatatatacacacctcgagttatggccataccatcacaagctgagctagctaagagcgagcttcattaacatacgagacagagaggtcagtgaaggtagcaatggcggcagcctcctctgttcttcgttgctgcctcctcgtcgcagcactgatgacgctgtccgcaatgggagctgaagccatcacaaggcagtacctattcgatgtaagtgcatgcatatccacggtgtggtgtatcacatcgatacacaagtttcgccaaaaaaaaccaacgcgaatttgccgtgacatgcatggcaggtgcaaacgacgagcgtgacgcggctgtgcagcacgaagagcatcgtgacggtgaacgggcagtacccgggccccacgctgttcgcccgcgagggcgaccacgtcgaggtcacggtcgtcaaccactccccctacaacatgagcatccactggtacgtacgcctcgcgatttccaccgtgttttgacgccaaaaaacccagtgttttcaccgtgtgtgtctcacgtacgtgtgcgtgcaggcacgggatccggcagctgctgagcgggtgggcggacgggccgtcgtacatcacgcagtgcccgatccagcccgggggaagctacgtgtacaggttcaccatcaccgggcagcgtggcacgctgtggtggcacgcgcacatctcctggctgcgcgccaccgtgcatggccccatggtcatcttgccccctgccggcgtcgggtacccgttcccggcgccgcatgaggaggtgcccatcatgttcggcgagtggtggaacaacgacacggaggcggtgatcagccaggcgctccagaccggcggcgggcccaacatctccgacgcctacaccctcaacggcctccctggccccctctacaactgctcagcccaaggtgattaattagtgactgattttgtttaatttagtcgtgtcacaatgtgtgacaatgtgtggtggtttggctgtgcagacacgtttaagctgaaggtgaagcccgggaagacgtacatgctgaggctcatcaacgctgcactcaacgacgagctcttcttctccatcgccaaccacacgctcaccgtggtcgacgtcgacgcgctctacgtcaagcccttcaccgtcgacacgctcatcatcgcgccgggccagaccagcaacgtgcttctcaccgccaagccgacgtacccgggcgccagctactacatgctggctcgcccgtacaccaccacgcagggcaccttcgacaacaccaccgtcgccggcgtcctcgagtacgacgacccctgccccaccaccgccgccggcaagatcgtccccatcttctcccctacgctgccgcagatcaacgacaccaacgccgtctccaacttcaccgccaagctccgcagcctggccagcgccgggtacccggcggcggtgccgcagcaggtggatcaccgcttcttcttcaccgtggggctcggcacccacccctgcgccgtcaacgggacgtgccagggacccaacggctcccggttcgccgcctccatcaacaacgtctccttcgtgctcccggcgacggcgctgctccagtcgcacttcgccggcaagtccaagggcgtgtacgcctccaacttcccgtactacccgctgaacccgttcaactacaccggcacgccgccgaacaacaccaacgtgatgaacgggaccaaggtgctcgtgctgccgtacggcgccaacgtcgagctggtgatgcaggacaccagcattcttggcgccgagagccacccgctgcacctgcacggcttcaacttcttcgtcgtcggccagggcttcggcaactttgaccccatcaacgacccggccaagttcaacctctacgaccccgtcgagcgcaacaccgtcggcgtgcccgccggcggctgggtcgccatccgcttccacgcagacaacccaggcatgtactctgaaccacatcgattcccctgcgattccacatttgcaccaacttaatttagctttagttaatcagtttgcaattataactcatcaaagatacttatgccgatacgattgcacgatctcaggtgtgtggttcatgcattgtcacttggaggtgcacatgagctggggactgaaaatggcgtggctggtgctggatggcagccgtcctgaccagaagctcccgcctccaccgttggatctcccaaaatgctaggaataaaactcaagatcaatggtcaatgattggatcacttcgcactgcccctgctcacttgtccgtcagatatttttctgcttcgatttctcgtcgttaactggcttgcttaatttgttgcttttttgataaacttatttctcaggcgattgacagtttgtttgtcatcagttagctccggtgttttgcatgaagtttaaatctttggtgttgtgaggaaatttgatttctttgattcgcagggcttgactcttaggactgcttactgtaactcaaagctcgcgggcttttgcatcttgtaatgtatctcaatgtattttgcactaataaaatgtacttgttattgaattctgtcaggcgcatgagtccatatcaattttcagttcatttacctgtttagttatagcgaaatatatatgtcatctttagaactagcatggtggctcgcgcaaattgcgcggttagcatcattatattttctctcatataataacatatatgttttctcattatattattaaaatatattacaatgacaacataattttaaattttgcaataactttacgaaacaactaatgtgtaatattcatattgtattttatatacgtgttagttattaattatttttaatatcaaaatttagttatttgtaaattatatatattcctatatggactctagacttgtgttttaatatttctttttttaattctgaatttttattatttctaattatatttctatgtggactctaaactcatctttcaataatctttaatttttaatttcaaatttcagttacttctaaattgtattcctatattgactttaaactcttcttctcatgtttttcttaatttcgaattttagttatttgtaaattgtatttttatatggactctaaacactacttttcattttattatgtttattccgaattttagttagttttaaattcctatatagactctatactctacttctaatattcattattttttaattccgaatttctatttttttttcttaattgtatttctatactctacttataatattccttatttttcattccgaatttctattatttcctaattgtatttctataagtactctatactctacttctaatattcctaatttttttaattccaaattttagttatttcctaattgtatttctatatggactctagtctcctcttctaatattccttattttttaattccgaatttcaactatttctaagttgtatttctatatggactctagtcttctcttctaatattccttatttttttaattccgaattttaactatttcttctaattgtatttctatatggactctagtctcctcttctaatattccttattttttaattccgaaatttaactatttctaaattgtatttctatattgactctagtctcctcttctaatattccttattttttaattccgaatttcagctatttctaaattgtatttctatatggactctgacttttctttttctccgattaatgtgagaatttttagaccatgagagcgaacgtggaggctcctttttctattcctttaataatataatagatttgggactctctacaactttgtgtgcttaatatttgaacaaataattcaatagacaaaggcaaacaaagcaaagctagtacaatctcattgttatgtataggtgaattttcaatgttttgtcattagcttaattaatcgcttggctaaactggttggtgcacgtaatacagttcacttttggtcttcgcttccgctgctcttcgattgctatggaacacttgagatcttaacttttttgttgatcgattgatttttattttgtcagttatttccttttctcaaaggaagctctcgcattttttttccccaaacagactgaaacaaaggttatttagttacacgggaaatcatggcctcatgggtagcggagaattacgggagtttttatgttaccatgggagaaaattgcaaacttctcaagcagaccctaagtgaatttgttgtaggatcgagctctcgtcataggtccaatttaaatcaaaattgctttattatatgtgcatccacctttttattcaaaatagcagatcgctatctgccctcaaagtagctctgccagatttctgaaacgccattgaattcaattaatgattttcataataagggtagtagtagaaacttctggattaattacttacgggatttcgtcatataatagaccccgataacttatccagcttcataaccacgtcaaacgtcagattggaaggactctatctcgagacttctcgtcattgacatcatgaaatcacaatagccaacaacgaaaatgtccgaaagtctgttgaaaagctgacgccaggacaagctcaaatcatgatcctcgactagctcttcgtattcatttaaaacagggaaacactatggccggcgaaaagccaactgggttcccacatcagagattaggcgagggcgttaatttatacaaattttcttatgctgcaacaacaaacaagaatctatcgaataggagtgcaatttacagctgtaaatttgctgcaggattacgtgggtacaacctcgccaagcgagggtgttccgtcatcatcaggctgaggggttttggccgcctcttggttcttgctgtcttcttcatcctggaacccttgcttgaagaggtcgtagttagttggctcggatgccttgaaaggccgttctcctaataccctaaccaaatcgtcctggtggaggacctccttctcaagcagcatttcagcgattttggcgacttgctccttgtgctcagttatcagttccactgtttttttgtacgccttgccaacccattccctcacctcatcgtcgatgatggatgctgtttggttgctgtaaggtttggtcatttcaaagccatcgtccctctgagggaaggacagaagcccaaccttttcgctgaaaccgtatacagcaacctgcgcataggtcattttggtaactttctccaggtcattctgagcaccagtggagatccttccaatcaaaacctgtaacaaggcaatcaaaacat

SEQ ID NO: 78997 - DNA, 1204 bp, Oryza sativa
ggtcatttttctatataacttttttcccaatagcttgaaattgattttgaatatatgacaaatctaaacagcatttgtaaatactaaatgatttcaaataggaatatggacaacaaaaaagttgatcctctcatcaagatctacaacttttcttttggtcacttcttcatccgataaagtgatagttatattattcacaaaaatcacatttctctcatctggtttataaacatcaacacatatatgtcaattttataaacattggtactatcactttatcggatgaagaagtgaccaaaataaaagttgtagatcttgataagttatacaactttgttgtttatggctttcccatttgaaatcagttagtatttacaaatgctgtttagatttgtcatattgtcaaaatcaatttcaagctgttgggaacaaagttatatagacaaatgaccaaaataaaagttgtagatcttgatgagaggatcaactttgttgttgaccatattcccatttgaaatcatttagtatttacaaatgctgtttagatttatcatatattcaaaatcaatttcaagctgttgggaaaaaagttatatagaaaaatgaccaaaataaaagttgtagattttgataacctctacaattttgttgttcaccatatttcgatttgaaattatttagtatctaaaaatgtattatgactaataaaatgaattattatacaacagctatatattttgtacgcacaaatataaagatttgtttggaaaaatggaaaaatagtcatcggtgacgggccttagttaaagcccgatagagatttatctatctctatcgggcattatcttagggcccgtcacagatgactcatctgtgacgggcctgaatgtcatctcaatcgggcattagtatggagcccgtcaccgatgagtcatctgtgacgggccctacggcaaagcccgatagagatgactcatcactctactataactagggtttctcagatcggatcgaaaatttttctaagtcccgctacagtttcccgcctccttagaaccctagcgccgccgccaactcctacttcgccgccgtcgtcctccctcgccgccaccgccaccgagaccgccaccgccgccaccgagcccgccgccgccgacaccgagcctgccgcctccaccgagcccggtgccggctccaccgaccg

SEQ ID NO: 78998 - DNA, 1044 bp, Oryza sativa
ccccctcccctatactccatatactcctccctcctctcccctcttcctcctccccttcttctcttcctactacagtacaccacatgaattttttaaaaaaacaaaaaattagaaaaatttatgtataaaaatactatatataaaaatttgaattcaaatttaaatttgaatcgggtatgtaaacttttgacttataaactttaggtgtataaactttagatgtatagaaatactatatatagaaaatatttgaattcaaattcaaatttgaattcaaatttgaattcaaatcggctatgtaaacttttgacttataaactttaggtgtataaactttagatgcataaaaatactatatatagaaaatatttgaattcaaatttaaatttgaaattagatataattcaaattcaaatttgaatcgggtatgtaaacttttgacttataaactttgggtctataaactttaggtttataaactttagatgtatagaaatactatatataaaaaaattgaattcaaattcaaatttgaatcggatataaaaacttttgacttataaacttttggtctctaaactttagatatataaacttaaggtgtataaactttagatgtgtaaacttaaggtgtataaactttaggtatataaatttagtaaaatagaaaagtaatgcggtgccaaaaaagaaaaccaggtggagggagggggagggggattgatcgctacccccgtcccaggcgatcaatcgccgattaggatttccggtccaaacaagaacgtggttcgtgcatgattgtcctgaaacatttcagagaacaagatgggccaacgaagtggcccaagctgagccctttatcgttgaattcggtaaatcatgttttgatgtccttctggcattagtccactctcagtttgtgatatagtactagctaaagacccatacgttgcagcggatcttataaaagataaaaacaaaagtaaaaaaataaatttatagtataattagttgattaaacatataatgtcatctacaaaagca

SEQ ID NO: 78999 - DNA, 1839 bp, Oryza sativa
ggagaaaatatttcgctgatcagcatgcttacctaacctagttgagtgtgaagagaatacagcagtaaacgcccaatataagttacctgacagcactaatgtatgacggccacctgcagctacttccactatcttcactcctgtattaaatgtcacaacacaaggtggtgctgaaagattttcatcactagatgattcactttcagccccgtgtttcgatgaagataacctccgtcgctttgtgctatcctcagaacttcggctttcagcaggaccagatgctgccttggtgcttgtcctagacacctttgacctggggctcactgtaatcgagtttcctatattacctctgtaaacaacggatgtagaaaagcttatattttttatgtagaactgtaaagaaataagtagtaagcaccaccaccttggtcagtggcaaccccactttgccttttatcacaatccatagccccagttgcagaatggtctgcaatgacccttccagttggaacgcattctttccaaccccatgtgtagacatcacctttacctgcttgagtggaattcaatcagtgtaatgcaaagttatgtgcagttttcactaaaatgcatggatcaatacacaacctgttattgcaacacaatgtgcccatccagcgtcagcccttacaattgcaatatcactaggaagaggaaatgcctccggagtttcctgagaggaacaagatgtttacttcagtaacagtttataagtttatcaagaacacgttggaaacaaacaattagcccaaaggtacagagatacctcatgcttcccagcagtcacgtaactttgtcccatatcatcggtagagccccaagtgaagagttttccttgctctgcatcaggcagatacaagctgtgtcagtgtcaagctcagttgacgtacggagtaaaacgctaatagcacacaatccgaccaagcaaaaatgcaatcttctaatggttgacagaactacctaaaaacatagaataatccttggagtaatggagttgttatggaaaattagtctaactaaaagcaattccacaaaaatacactagctgacaatatcacataacacattcccacaacacaatacggggcaaaacagtgttctgatattctctgtcgctcgaccaaaaaaaaaagtcgaaatcactagctgcttgcactatcaatcacaacttagtcagacagcatattccaccctgatcaaccaccaatcaggaaaatagtcatacagcacattccaccctcatcaaccacctatccagaaaaaaaaatcggcaataactgaacacccggcactaagctgctcaccaatcaattcacagacaatcactcagattcttaagaccttttttatccaattttatactcgcgttttcatggaacccaccatatacacaaaaatccgcacaactaactactaaaccactgcacgctaatcatccccgataataaaaacctcacacaaaccacaccagcaccctactagatctcccacgaccctcttggtgccacagatcgaacgaactcgaacgcaacgataacatcaagcaatggaagcacaggaacgagagagaaaggcaacatcaccggagacggccatcgcgaagccgcacccgccgccggccacatccctccacgcatcaccggccgccgcggccgcgtccggcatcctcacgggcaccggccccagcagcggcgaccgctgctgcgacaccccgggcaggtacccccacatcagcaccacccgctccttcctcctccccgcgcctcccccatcctcctccatctcctccccctcccctcc

SEQ ID NO: 79000 - DNA, 16062 bp, Oryza sativa
cgtggctggctgtgacagtagcacccgccaattttttaagtgtgggcatgttcggattaggacggtgatttggcttaaagaaatgttggacttgtatggttttgtaccctactaataagttgttagtgtcaaactctagtcaagttttggcgctactaatattttgataggtggaattgtaaatgtgtgtctttgaatttatgctaattgagagataaattttaaattatggtaaaaaatattctagtattatgccaaattaagtataagtattaccaaacatttgtcttcaaaccaaatcatcacatttactatttatactaaaaaaattggtatgataacactttggtatcaaaccaaaacgccccgttaagtatcagtgtatcacagtggctgcagctcacgtaaggggaaaaaaaagtataatcgctgatttaactctatgcctcttgactctcggtctctcgggtataagctacggagtacgagaggagctgatcctgctattacgagtcgctaaagtagcactgttgttacgagtacgtaataaatgtcgtattaggtatgcgaattttagtccgaaatgcacataaatgtactgttgaaatgctaccctagcacgaaccatgttgaatgcattgctgaagcgtttcgaaatgagcattttaaatgcgggaaaattttcgattctaaaatgttacggtacggtgtggagtaagagcaggtacaatagcatactataaactaactataaacatatattgagcagataaaaaaggaaagagaaaagcagcaggctacagatttgtaactagctgcagcacagacttcaatacacaacgtgtatatgacagatgagactaggtattagtagtgttatatgtttatagctaactattatatgaattggctattaaattaactatagataatttgaagctactattttttttgaacagtcagggcgttgccgatgttttatataaaaaaagaagtgttccattttaagaagagaatgggaccaaaccatacaatgcacaattaattaggaaaactgggcaaaaaccatggctatcgagacattccaccagctaaactaagctaccaaagaaacgagagcaggacaaccaggctcaacactcaacaaaaaaagttcacatgaacatgcaacaagctgaaaagaaaacaagtttcccaaacattggcaaatacgcaacgttatcgtcatcatatcaaaacttgggcgactccgacttcgtcaagaacactagggtcaggacagcaacctagcccatgccaaagcacaaatcaactaggctcatgtcatcgttgccacacgtcgagccccaccgacgtcgcagctccaacttcgcgaccaccagtctcgttaaagcaaggcctggccaaatcgacaaaccttgtagcctaaaagcttgtaaccccatactagaacgaaacacaagagacggaattcaactcgggccatcgttgctaagctcgtcgaccgcctcgacgcaacaactccaacttcccgaaggccctccttaggtgtcaaagcagggccaaactagagattggctcggatttccagagaaaccgtaacacgatagaacatgaaggtataaaaagacgcctcgagggaggaaacaacgctcgcgggcgtcgccgtctacgccttggagcttgttgactataagatacaatcgtagagaccaacctcttcgataaatagagcctgcgagggtaattatatgcccttgaagagtattatttaatatgtcctaaaatataaaagattttagttagatatgatatattataatattacgaatctaaactactggaatatatctaattcaatcaaaatcattatgttttaagacaggtgatgtactaatattcaacagtaataaaacttcaattagacgcctctttctagataattctcggaggaacgaaaatctaattcaaagctacgagaattcaagaacaagctagaattaatcgatatgatcacttggcgtttgatccatgcgccatcttgtcacaagatcgctttggcatttccaaccaaagcatcaacgggccaagataggccaacttccgaaaggaagtagcccatggacgtttcatttgaaaaggaaataaggaatcacatcagcacagagtattactcttgatactcttgaatcgttgtagaacgttctgggctccccgagacgtgcgatccatgttctaatcggatcgaacggcctagaaacgccgtggttgagagcgctctggcagtttcgagctgacgactcgatgaccttcactgctaaaggatgctttccttgctgcaatattaaaggaggacgcttcgatcgactcatcatcgtattcttgtagtactgaagactgaagtcgcagcaggttttggtttggtcttttttgtgaacagccatgtcgtcgtcgatggcgtcggcggcgccggagccgccgttccggccgagggagaagctggtggagaagcagaggtacttccagagcgtgcacaagccgacgtacctgaaggggcgctacgacgccatcgcctccgtcgccatcccgctcgccctcgccgcctccagcgtgttcctcgtcgtaagtcatgaatcaaagcctgaaactcgagacgcgtttcttcccaaacctgaaacttcgggtgtgtttagttcacgctaaaattggaagtttggttgaaattgaaacgatgtgatgaaaaagttgaaagtttatttttttttgaaggactcgcacaagacggtgcgaagttctattgatagagcaggaaaaaaattacaagattacaaccctggaggatcgtaaccaggaaaaaagaaaaaatgtaccaccacccacacaccgacagcgccaacacacaagcccgggagaaggctagcaccggaccggccgccgctaatcgtgaccgaccgtcgctagaccaacaattcaccaccactcaacctctgccgccatgtgggatcactgcaccagcgccccaccgccggccagcctttatgcgccaaaaaccgccacatccaccggcagctcttccctcgcgcaaaggtcgcctcctccaccgccggccgcgcctctcgcgccaagccggcctcctccaccggacgcgcccctcgcgccaatccggcttccctccatcggccgcgcctctcgcgccaaaccggcctccatctccgccgctcgcgcctctcgcgccgagccggcctctgctgccatcggctgcgtctctatgtgccaagccggcctccgacccctcctctaaacactgtgcgccgccggatgcggctgtctgccatgcccccgctagccgtccgagattgccatgcctccccataccgtggtgacggtcgccaccaccacagccactgctgcccttccatccccgccgccatctcaccatcctctcgtcctttctcgccgtcgtcgagctccaatggcacacggcgcagaccacccaccgtggtagcccgcgccgccgtcgccgcgagctcgtcaccaccatcgccgcgacaaacagactcctccggcgttggttccgccgccggcgcggccaggttcgccacaccgacgccatcccctcgccacctccgccgccaccacagcagccgctgctacccttccatccccgccgccattttgtcatcctcccgcaccttgtctctatcgtcgagcttcgacgacacacggcgcagacggcccaccgtggtagcccacgccgccgtcactgcgaactcgtcgccaccaccgtcgcgaccgccagacctccgggcgctggatccgccgtcggcgcggccaggttcacctcaccgacgccatccccttgccgccctcgccgtcgtcgccatccccgccaccagacgccgccgccggtcgccgtcccgccagatccaggcgcagatctggcggtttcctccgccgccgccgccaacgcctcgacgccgctgccaccaccaccagacaccgccgccgcaccgctcaaccccgccgccggctgctccaccgccagatccggccggcggcacggatctggccagttccgccgccctcgagcaggtccccctcccatgcccgagcgcgaggacaaagccccgccgccgccgtccttgtggccgcgcagctttgccggcagccgctcgagcggtggcgaggcagaggaggaggaaaggggagacgagcgccggtgaggtcgtcgcctcccggtcgcccgtggggggaggggcgacacgagaggaaacaggtcaatattttgttctcgtgttttagttggaagtttatttgtgtatgaaagttttgatgtgatgaaaaagttgaaagtttgaaggcattgacgtgcattgagatttcactccaggcattgacgtgctgttggttctgcgttttcgtgtatgcttgcgtgcaggggcgcgggatttacaacatgtctcatggcatcggccggaaggagtgatgaggctaactgattagctatgtgtaactggaggagctgatcttgtgttacagtgacagactgacagtgtgtcagctacatgtaacctctcttgtgtgtaattataggagtattagtgctacttatgtaaacgtgttggactccaataggagtgaatactgttgtccacttcaattgagcttgagtgagtgattgaagcatggaaaaaaagaagcttgatttaacgaatacgatcatgatcatgcaccaatcacgcatgtccggtaagctttcattactcattagtgtttccaacagagaaacacgtgagatggttctgtcggaaatgcattcgaggcggaaggaacagatcgccgaaccaaccgtccttcgttggttgcgtaagttcagtttaatcgagatgcgatgacgaattatctaatcgctgatcgcctcaatccacgtcgcaaattgctttaattttcttgttctgaccatccaccaatcacacgagacatgatggtctcactaagtaaattctttgcgacgatgatcgcaggagtaaattaggagggaagaagtgaaaaaaaatagaggaggaagagaataagccaataataatggcggatcacggcaccggccggcggagatccacgacgacgacgctcacgttgtcggcgctccgccgggcgatcgcgagcttcgcgagaagcaatgccgcgtcggcgcacgccttgtcggactcggccttgtcgacccccttcaccacggcgtcgccgccgccgccgcctgacgcgccggcgggcggcgggagcacggctttggggcgggagcatcccggcggcgacggcgggccgttgctccggaagcacgcccggacgacctcgcacgccatctcgttggtcaccacgtcccacagcccgtcgctcgccaggatcaggcactcatcgtcgtcggcgcgctccgtcaccgtcacctccggctccgacgtcacgtacggcttaggtagccgtcccctgcatgcgcgcgccgccggccaccgcgtcaagcaccacggccaaattgctccaaacttaaaatgatctaagcgcgaacgcagcgcgtaccgatggctcgagacatggcgaggacgccgagcaccctggcgccgtcccagtagatgacgcggccgcccgccgccttgatgcgctccagctcgtccggccggtccggctggagcaaacagagaggtgaatacgcagaagcaagcgaggaagacgacgttggattagtgctttgctgcttaccttgtggtcgacggagagggggacggggacgccggcgcggcagaggacggcacgggagtcgccggagttggcgacgacgacgcggttaggaccgacgaccgcgacaacggcggtcgagcccacgtggtcgcaccgtgctggcgtctgcagctcgcagcggcaggccggctcaccgccggtgcggctcttggcccagatcgtcgcctcatcgtccatccgcgcgaaccctttctccatgacgtccttccacgccggtgccgccgccgccgcctccttgccggagaccgccttcttgtacgcgtcgacgacgagctcatgcatccggtcctggcacatcctcgcgacctgacgccacaaattaaagaacgggctccgcttagcaacacagctcgacgtgcatttgctggatttggtcataggctcatgtgtgcaatctgtttcttgcgtgcgcgcatgcatacatgggagcaaccatggccgtcaaagacgccgaagaagtggtgcttgccggaagaggtggagccccgcaggaagtccggcctgatggacacggcgtcctccatctcgcgccgccggccgaacacggaggtgacgccgtacctcggccaccacctggacccgaactccgcgccggccgacggacggcacgggcctgcggtcgccgcgcctgcgcccgcacgcgcgcccgccaccctctgccgcttgccgcagcgcgccacaccggcgtcagcatcctcctgcggcggctcgagagagccggccgcaaagcggaagccctccaccctacggcgccgcctggcgatcgccgtggcgccggccgccgcagccggcatcgacttggccgcctcctcgcggcagatctcggcggccatggggcgtcgtgccggccgcgcgcacgagcacgagcgcctccccccttctcctcccgcgtacgtcacgccaccgccgctagcccacgcacgatagatatttcgtcgcaacaccgcgcgtcgccgtcgtcgtcgccgtcgccgtcgccctcgggggggcgctaaaacgagacgagggcgaggtggcgaatcgcgacggagcagagagcgcgagcgcgaggtggcagcagacagccgtgtcgagctcccattccttcgcttaatttcttcgcgggaacacgagcgtccgtcgcggcggtgcggccacgtggaaggggcgaggggggacccgctggcggttgggatgagtggggcccacctgtcggccgagcggcgggatcggtggggacacgtggcgtcgccgcgtgggcggggacagcgagccgacaggggaatttaaaaggttgggcctcgcacctaccaaccacgtggtccgtccgacgcggcgactcacaaatatcgtgtggctttgtaatcacaccgttgatctcgtggctaacctcactgtcatgtggggacgaaattacgtgggggacccatggcacagttgcacgttggaggatgcagcacgtggcatgtggcctgcgggccgaatcttgttcactgagccaggatggatgaaatgaataagttcatcggaggtccctcaccttaacagcgagttttttaatcccttaaccacaaaagcagaaatatttacccctaaactcacacaaaccgtgcactcaaagtcttatgatagtatatatgggtggtttcactgacgtggcaccctagttagcaaaagaaatataaaaagtacgtgggccccacatgtaagtgagagagtgatgtgggccccacatctctcttcattttctttcttctttctctttctctctcattgcttctcttctcgccggcagcggtggcggcggcactcttccccactgcgtgcggcgggggcgacctcccccaccgctagcagcagcggcgacgctcttcccctccgcatgcggcatcggcgccctcgcccaccacgagctgcagcggcggtcgctcccttccccaccgcgtgcggcagcggcggcgacagcttctcgtggaggagggggaaggggaggccgacgagccccctctccccgttgctgctcgtgcagatggcacagctactctgtggccgcgggacgccgcggcgatctgcccctcgagcatgccgcgattggtgtcaagccgcgacagcctccgcggcacgtcgctgaggaggttctcaagctcctccacacgtaggagcgctgcccgcgtctggttgttgtcgtcgctgccgtccatcgtgccgtctgccggtgcccaaagcaggagcagctactcctccgccacaccgccgtccaccgtgaaccacaacggcgaccgccgccgcacgcacgagaccgagacaaccggctccatggtggcgagtggtagagtggaaacagcgacgcgcgccactcctctcctccctcccaccgtgcgctcctcctctccgccgccgagctcgccgtcgcaccgactgcctcctctcctcctcttgcaccgaccacctctctctccctctcccgctgccgccactccaccgccggccgcctctctctcccctctgctgccgcgcccactcgagacaatcatgagagaagaggagagaaaaagaaaaaaaagaaatgtggggcccacaccattttctctacttacatgtgggccccacatatttattttattttttttctgactaggatgccacatcagcgaaaccaggcttctatactacctcgggacctttttttggacagttttacaaagttttttctggtattgcggttaggggatatcaaacaaactcggtgtaaagttgagggatggccggtgaacttattcctggatgaaatgccaagttaaatgggcttatgggcttccaatttatctgtgttacttcctccgtcccatattatatgttgttccatttatctcaaaataaatttatttttcgagtaatcattgcattggtgaaagtagagaataaaattattgggagtacataaagtgatgaaattgggatttgaaatattaaagacatgcctgtttggtatagctacaacttctaaatttagctccaagagttgggtctagagtggagttgtggaactgcctaaatccagctccacaactctaatttattttgtgagagagctccacccagctccactcccagttttggtggagctgaaactgtttagctgagctccagctccagaagaggtggagctagagctagagctgtgccaaacagactagtcttcttacttttatatttgtgtttgatagatgaattttggatggaggtactactaatctcttctactgatccatggattgagattctctgacataacttccttctaacttagtggctgacatgtgggcccaataaatagtggtgggtccatatgtcaggcacggtgaatagtaacatcagatgatcctcttccgtgatccatacgaccatgtgtttttcttttcgttgagtctaaccaacaccaaccgagacaagttgagcatataaataagcagaaagtaaagcgaagctagaagatttagcgaatatttttttttattcagaaagagcgatagaacttaacatccaacagaaaacttaatttcattttaagcaaaaattgccacacactgacacgcatgctctgtgcgatttaattcacagggaaataaacataaacacagcgccacagttgtttcgagtgatgtatggtaacgtcttcaatggctcacattgtaaacttggatataaactttttcttcggcctcagctgggaaaaaaaaaagaacggatcagatataatagaatgaaagaatcatatcaggctatcagctgccacacatcttcatatcaaaaataattataacatatgcccataaatgatgtataatctgacggtatataattaaactttatctttctctttttatatgttaattttgaaagccttaagttgcaactaaagccaagaacatgcatggacataaagaaaaggggaataaaacacttttgatgcatgaattgagatcgatgagaagaacttatatatggctctctatcacctcattgctgtggccgcacttctttttgcggcagttggtagccctgagaggaaggcgtgcatagcacctgcattaccaaacgcaaattcaggccatgttaatttgaaacttgaaagtgcaaacgaacgccagtacgccacacaattgtattaagtatgcatcaatattcgagtctgtatggtgaaatcatcggcagatcggtcaattgaagaaaggcaataatgggaaaccgtgcgtacttgcggcagatcatcttcttctcgttgtacttgagggctaggttctggagtctgggctcgatcatggggggtagccgcctctgccgccgccgcggaggcggagcaccaggtgaagcgtcgactccttctggatgttgtagtcggccagcgtgcagccgtcttccagctgcttccccgcgaagatgagccgctgctgatccggcgggatccctgcaaaaatttgagttccagacagtggattgagatgatgatcaactgaattaccgaaagaacacgataagaggatcgaacgatgctccaatgctctactactgctagagttatacttactccgtttcagattataagatgtgcttaaagtcaaactgcttcaattttaacaaagtttatagaaaaatatagtaatatttacattgctaaattagttttattaaattaataattaaatatattttcataataagtttattttaggtcgaaatattactattttttcaattttaaatagtttgattttaaccaaagtcaaaacatcttataatctgaaacggaggaagccctatgtaactatgtatatattgtggaaggccctacgcttccggcgcccgatgctttgggggaaaaatcgggcgctgacgtcatgctaacgtcagcgtccgatttacgtgcaaaaactactttaaactgatttttctcttaaattacttatccaaatcatgatctgattgcaccattaaattcgttgcaattaaatcttcaaaacaagaccacacatggatatattccgacgaaatttttttagcttattattgaattatttttaaatgttgcacgatgttccaccgggtatatcggaattgtttcactaagtaaatcgaaaatgtttcactcgtttaaatcgggtgttgtttcaccttatataaaaacaatgtttcagttcactgcaacatttgatctatacatagtgagacattataagtacactaggtgaaacatttttcggtagaacaaaaaataaaacgaattcccttaatagggggtttccaaaatatgtggggtttttttttgttgcaatggagtatttcagttcactgtaacattagatttatacatagtgaaacattgtgggtacactagataaaactttttttttggaataaaaaataaacagaattcccttaataggaggtttcaaaatatgtgatttttttgttgcaatagagtatatggtgaagatacgtggcaaatagtagggacacatggtggggtcctaatagaagcacatgaacacgttgtggagggggggaggggaggagcgcccgattttctccccctcccccgggcgaccgagcggcagcattttcgatatattgtatgttagtataccttccttgtcttggatcttggccttgacgttgtctatggtgtcgctgctctcgacctccagggtgatcacacgaagatctgcatcttgcctctcgcctcctcgatcgactggtggtggtgactggagattttcggtagtgttcgtggtcatctcaatttatatagcgcgtacgaaactcgaccgctacgaaacccgagagttccaaaaggaattagaaaagggaaagagaggaagaagtggcacgatcaacacgtaccataattagggtgtacgtgacccttctgagttgaactcgacagcggcccagatatccgtccaggccagcctgcaagctcagcccataatccaaacggcccgtgcatgagatcccaggccggaaatacacgggccgcgtagccatgcccaatgtggtttggaataagttcatctgaggtcccttaacttattaacgaatccgattttcgaccttcaaccgaaaaaccagatacaacgggtccctcaactatcaaaaccagtgcagatgaggtccctcggcggtttcgagggtgtttttggctgacgtggcgactacgtggcaaatttgacttggtcttcatctgatgtggcattgatgtggcaattcgatctggaagaataattaacttcgtgggacccacacgtcagtctcacacataaattaatataaaaatggtgggcccgcatgggccccacatgtcattctcagcatctccctctcttcaactagagcccctcttcctcctcctctctcccccttctcccatccccgaggcggcgggcggtgtccgggtgagggatggcagctcgcggcggccgggagagaagggaggcggcgcgaggcggccgggcgaggagaggcgacgcgccgtggcctggcgaggagggaggcggcgctcggcggcctggcgaggagaggcggcgcgcggcggccaggagagggaggcgacacgcggtggcccggcaaggagggaggcggtgctcggtggcccggcgaggagggaggcggcgctcggcggcctggcgaggagaggcagcgcacggctgccgggcgaggagggaggcggcgctcggcggcccggctaggagggaggcggcgctcggcggcccggcgaggagaggcagcgcacggctgccgggcgaggagggaggcggcgctcggcggcccggctaggagggaggcggcgctcggcggcccggcgaggagaggcggcgcacagcggccgggcgaggagaggcgacgcgcggcggtcgggcgaggagagaggcggcactcggcggccgggcgacaaagggtagctccgacccggatgtgacaatcgaggactcggcggaggtggccgggcgaggagggaggtggcgcgtgcggctaccgagcgaggaggggtggcgccgtccggctgggcattgcgggcggagcggccgacggagtgtagctggcgcgctcgccggcgacctcctcctctacctcttcctcctccggcaacctccgtcacccgcggcctgccgccgctccgcccgcccctccgcctcgccgccgctccccgcaaggacgagggagagcgaagaggaagagaaacgagagttgagagggacttgtggggcccacgtgggccccaccattcttttattgatttatgtgtgagactgacatgtgggtcccacgaagtttattatttttccggatcaaattgctacgtatgcgccacgtcaatgccacatcagatgaagaccaagtcaaatttgccacgtaggcgccacgttagccaaaaccaccgtcaaaaccgccgagggacctcatctacactggttttgatagttgagagacccgttgtatctggttttgcggttgaaggacgaaaatcggattcgttgacaagttaagggacctcagatgaacttattccatgtggtttttccatgatggaagcagtgatttttttttattaagttcactttagatccctcaacttgacagcgagttcgattttgtccttcaaccgcaataccagatacaacgggtgcctcaactattaaaacaagtacaatataggtcctaagacggtttggatggtggtttcagctgacgctaccactagcacgtggctcccactattgtttgattgacatatgggtccatatattttgttttaatttttaaattattaaattttgcttaatgtgccatgtcaataccacgtaagatgaagaccaaatcaaattagccacgtagacgccacgtcagctgaaaccgccatccaaaccgccttgggacttatattgcactgattttaatagttgagggacccgttatatctgatattgcggttgaagtacgaaaatcgaactcgctgtcaagctaagggacctaaagtgaacttttttttttcaaacgcaaaaaagctagcgcggaagttttccatcaattcagtatatgaagagaaaaagagtacatctgcaatagacggtcatttcgaaatactatatcataagtcgttttgactttggtcaaagttaaactactctaaatttacaacacaaacaccaaattagtttcattaaattagtaattaaatatatttttataatacatttgtcttgggttgaaatttttttatttcttttttctacaatagtttaactttaaccaaattcaaaacaacttataatctaaaaaaaagcttaaaaaggcaattacaaccacatatatcggttgttcggtcggtgtgaacatatataccgtcacgatcgatgtgtcatactgtcagtgtcacatgtgttcgttggatcccgatgacacggatcgctcgcttgaggtgcatggaagtatggcaccgtgcgtcaatgcacggggacgccgtcgcattcggagggagtaagacgacgtacgtgcagactccgtgcagagcggtgcagagaacgacggcgacgacagaatgtgagcctgcctcctcgtcgattcggccgcggctcgtgtcaatgcaaccgttctagtccccgtcagtcagacggcagtacggcacttcctcaggtaaaaaacattcggtgtgatctgggcctgtctgtgagggggaaaagtgtgtggatcaatggcaatggtaaatcgatagtacttccggttgtgatcaactgatcacgtacgaggctttttcttttgcttatgctaccaacaaataattctgttttccttgtgccagagagggaaacattacccatttctatttctgatatccgaaatgatcttacggtaatatgacttttaacaagctaacacggtctttcgaagatgtttatatggctagagtatacgtttgaatttatagtggtgaatgcgcatacatatggaagcgtctaatataatgttgtgtttctttgaaaaatattatttgcaaaattatttaatcggataaagtagagtatatatatgatataaagagaatctacactacgtgaggaccagaaatatcgcatgccccatgcatgccgaaagagcaacatctttgacacagtacgggtgcaattttgctatgaacagttgacattccacccaacgaaatcgaacaaccgggttcgctgttcatcccgcggaggcgtccgatgccgactcaactcgactgaagcggttgggggtggtcaacacgcttatctagctccagtcctccttccaaacaagcggaggagcaaccaatcatcaattcatttcgcagcaatccaactccctgattattaaaaccgtgtcaccctaatcatacataaaatcctagttccacacggagatttaattattcagaacccccaacgcctgaactgttgttctttaatcgagaaagataaactgttcttgctctcgcgttctgacaaacgaagtgatccctagactagaagtcttcagatttggctgtaaaatggactagcagggcacacgtcaataatagcagtagaaagccagaaacgcatatgatcggaactgaacgattctcatttgtccatatcgaccacgttacacatgagactttactccaaacacgcaaatacgtaaaacgaggtggttcatcagtacgcgattaattaagtattagctaatttttttaaaaaatagattaatatatatttttaaagcaactttcgtatatattttttttaaaaaaacaccgtttagaagtttggaaagcatgcgcacggaaaacgaaacgtggtgtggttgagagcacaagctgccgaatgcagcccaagtatatacggttatctctctactgtcataaatacttgatgtttagaataaaattaaattaaacttttaaaatttcaaacatcaattttatataatagaatacatatataaaatcaaaagtttacagtcaatgtgtataatttcttttattttaaaactaagcatttgaggagctattgatgatcggaattttgaaaggctaaccgaattatattctaaatattaaatatctaggaaacggggagtactacagaaacaagtctgaacaattgtgtgaaatgggtcacccttggggcttgtttggatccttcgggctattaaatatccctccggaatcttgctatttaggagtattaaacgtagattattgataaaaaccattccataacccctaggctattt

SEQ ID NO: 79001 - DNA, 16105 bp, Oryza sativa
agttggcatggaatatataatatatattagttataactccatccagtgttgatggatgatagatatattcagtatttctctgagatagattaatgtaaaattttcctcagaataccaattagtataaaatatactccaagcatataataagtataggagtagatatggatacatggagcattaattatatgtctgatggcttttgttttctcagttctttgttctattttatgattattcattgtgtggaggagctaggtactctaaaaagcaattgataattaattagtcagttagtgtgaaattgaaaaggctagatttttcaggttgtgacttttagttcattttccttttctgaattatcagaatctgggtaaaaagtagattacccgttatagatgaaactatgtacaagaaagggatgaaatttataagaagaaattaaagagaatatacacatactgagcatatatacccacacttagcatgatctaactatagtggatggagagacgggagacatgaacccaagtgttgtaccatcgtgcattttgtggctgtttgtgcaagaatttacgacagtgcgagagactgaatgcggctgatttcaactcaaacgaggggataaatcgtcgttttcaattggaagatcgaaaccagaaccagacatgaaagctaatctaatggttgaataatacacgcaagttgaggaaccattgtacgcggaaaggatcaaagtaggcatggcaaacgcacttgcatgctaaataattaaatcattagctggtcctgtgctggagttgaaaacgctatccacaaatttcatgccgacaaggaaataaaaaagaagcatatatatacaggatgagagagagagagagggggggggggggcaagtagaataaaagaataaaaacatgaattgcacaacaccatccaatgtgaggttacatcgatcttgtccctacctctagcttagtttgagagacaaatcagagcacaaaccaacaggcacaagatgggtacacgattttcatcccaaaccgatcgagagtcgatatacctctccacacgccacgaacttgtacaagcacccactgaccaaaaacaccgctgatcaatccgcaccgtagactacgagcacatggggatatcggacggcggcggcggcagcttctgattcggcagcggcccgtcgttgacgagccacgccatggacaggccccagctcaggtgcacgtctaaatggcaatgcatgatccaaacacctgacacacatgacaaagccaacagtttatggcatagacaacgcaaattaatcctagtcaacgaatagaaccaagagaacaaagaaggtaatgccccctgtacggatgcatagtcagaaatgtattttttttaaaagataatttttaccttcgttaagaataaattgggaggtaccatatttctctaatattataaaaaattaaaggtgtttttgtctaaaagtttcgtacgttgtccgtttccattatcgtatcggtttcaattcagccgccgtttgctcgctcggactgaatatgaaaattgaatcgagcgatacgaagacgaggattctttttttgcttgacgtatgcaaatctaattgggctgtagaaagctggcccaactaacaatatgggctgtcaacttaaggggaaggaataagtctattttacctacctaggtttttgcctatgatcaaataaaaaagtatccggttttagtttggttcgtctggtttatatttttgtcgccattttttcttcacgcggaacttttttttttcccgcgcagggtaagccttttcttttttgtctttttttcgttctctggtcttatctgcatgcgcatagcgcgtcccgcctcagccaccgatcttccggttttcttggtcctacacgaaacggtttttttccacgtatgcggtaagtcccttttttttctttttcttttttttccattttccctgatctttgatccgatctgcacgcgcttagcgagccccgcctcagccgccaagcttccgctttcgttggtccgtgcggtttttttttgtcgcttcttttcatatggtttgtttcttcgcacacggtaagtgcgtttttttcttttttcgatctcgtctggtctaagccaaaccctagcgttgctgccacgttcgatgtacctcctgtatgttttctactctaactgattgtaaaaatcgatttcacattcctccatcatcattttcccatgatttcctggactttaatttactgaatttaatctctatttaaaagtcgttgatcatggcaggtcgataagcttttattcgattcgattttgggggaaaaaagagaagaggagattgggtggatcaaaaagtcctcaaccaatttaattttggaagatcgagaataatttgaccaaatttggcattgtacaagcaagggactaccttttggaggttgatgaccgaagaaagacagggcgaatggagggaggtagcggactgggctaggactaggactaacaaagaaaaaaagattgtgctttcggtctaaaaccaagaaaaaaaatcatttacttttttaattatagtgtataatgattccaatgacttagctcttaatagttgttgtttcattgaaaaaatatatttacccgttgcaacgcacgggtatttttttctagttttatataaaatttaatatcgctaggtattagatatattaaaaaaattagtgtaaaatttagttatcttaagatgttttctcgatcataaaaattccctttttaaatgaaggtataagtatagagcgggtaaccaaccggggttgtcggcgacgaagcggatggcgacccagccggcggtgggcacgctgatggtgttccgctgcacggggtcgacgaggttgtacttggcggtgtcattgctggcgtcgtagttgccgaacccggtgccgacgacgtagaagtcgtagccgtgcaggtgcagcgggtggctctcggcgccgaggatgctggtgtcctgcagcaccacctccacggttgtgttgaaactgagcggcaccaccctggtgccgtgggtcacgaacgtgttgttcggcggcgtgccggtgtagttgaacggcgtccgcggcgccgccgggaagttggccgcgagcacaccgttgtaccgccgctggtagtgcgcctggaggagcgacgtcctgggcatcacgaacgacacgttgttcatggacgccgcgaacctggtgttgttgggcccctggcacgtcccgttcaccgggctctggcacgggtcggcgccgagcccgacggcgaagaagaagtgcctgtccaccgtccgcggcacccgcgccgggtactgcgcgctcgcgaggctccggaagctcgccgagaagttggccaccgcgccggtgtcgttgtacgccgggagggacggcagcgggaggctccggagcgcggcggcggacgtcgcggcgccgtagtactcgagcacggcgacggcggtggtgttgtcgaacgtgccgacggtgttggtgtacggcgcgacggcgatggcgaaggagcgggacggcgggttgttggccgccgcagtgaggagcacgtccatggtctgccccggcgagatgacgagcgccgtggcggcgaacggcttgacgtagctggcgtccgcctgcaccaccatcagcgtgtggttggccaccccgaagaagagctcgtcgttgagcgccgcgttgatcagccgcagcaggtacgtcttcccgggcctcaccctcagcttgaacgtgtctgcgcaacgagaaaaattaaccacgagtcgttcgtacagtgtcacagtactgggacgtcgatcaatacgggccgtggcgtgttaccgttggaggaggagcagttgtaggttgggccagggaggccgttgaacgtgtaggcgtcggagacgttgggccctcctcccgtctgcagggcctgcttgatcacggcctccgggtcggcgttgaaccactcacctgccgttcggtcgcgtttcccatcccatatcaaaacgtcagatcggtcggggaaaaaccaaaaaaaaaacgtaacgagaaacgcacgtaccgagcaggaggggcacctcgcgatggggcttggggaacgggtaggcgacgccgcggggcgggaggatgacgagcgggccgtagagcgtggcgcggagccaggagaagtgcgcgtgccaccacagcgtcccccgctgccccgtcacggtgaacctgtacacgtagcttcccccggagcggatcggacactgcgtgatgtacgccggcccgtccgcccacccgctccgcacctgccgaatcccgtgcctgcacgcacacgcgcacgcgcccgctcggttaatcaatcagcgatacgatcgttgtgacatggcggcgcgcgtagctgcgtacgtaccagtggaaggtgacgttgttgttgatgttgttggtgaccctgatcacgagggtgtcgccctcccgcacgacgagcttcggccccgggaactggccgttcaccgtggggacgctcttcgtcacgcacagccgcgtcaccgtcgccattgtcacctgccattacatattgtagcagcagccaaagatcatcgtaagcaaacgtgacactgcgacgagcatgggttttacatcgcccgagcaaatgcaagacacggcatattatgtatttttacattgaaggagtagcggcgggtgcgggcggcggtgaggcccggcatagcgaggaggacggcggcggcgaagaggaggcatgcaggggaggccaaacaaaggagatgacgacccgtactactacccattgtgatcgatcttctcctgcagcagctgtaatcaagctagctagctgcttgatcgatcgattgatcgatctcgagctgtttctgtgtgtgtgtggctggccgggtgttcgatcgatatgatcttggagggaagtgagcggctatttaaacggccgtgcccggtgtcgtgcatggtaggaggtcacagagtgatagtggttggcttgagttggtggacgttcataaaaaattcgcgcccgggccgactctttgctccctctccgctcctttttttttcctcttctgcggctgccgtctctatcgatgtaggaatttataaacctgagaaaaaaaatgcttgtaggaatgtttagttaagcactctgttgattttattagccagctttgtcttgattcgcttattagttaagcttatactcaagcactctgtgcgtgatggtgcaccaaagcgcatgcaggcgtgtgttcgaaatatcactttcgttttcacaaaagggtgtatttgtctccctgttgagtaagaaataacctcagatgaactgtaattatgcagaaattaaacttgttgtttctgatgataagttgaacagagcttatcgatcgattgattcaacattttctgtccctagcatgtatggaactatggatcgacttgggtgattaatatagttgtatgcatgcagaggttggaccggaaaggtgggctggtggggttactgaagagttttccctgtctgaatatatggacaaactgtttcggagcttaccctgttgtgtgccattaatcattggaacacacatgataatctcataatcttgcccctagtaataatccaataaggtgatatatcaccttctgaaagcattatgcatgggaccttaactgtgagtgccaaaactctctaacctttttaaggctggttttactcatttttcttttccatagacgagtgctagataatactatcctgcttcatcaactctgcagaagaatgcgagttcctttgtgaacttctcaagtaaactatggaccccaacgtcaattcatgatcttttaaaactttttttttgccattttttctttcccaggataccaaaattgaaatgatactgttagggaagaaaaataaataaattgaagcacgaggtgtgtatggttctcggtgtgttgcttagagctgtggggttgttgcagtggagcttgttgctttgggcagattggatgtgtatgctaccttgtgatctgatatgatctgtcggttgggacccagttaaagtgtctcattatgtctgtcttagtaacaaagggaggctatggaggttagggaaccaacaactagtacatatctgaataacacacttaaatctcatgctttaaggcgagagaaccactttaaatgcatatatttgtattccatactgttttttttttgaaaagaagtattccatactgtagtttagaagagatactaccggtgacacagtaatccatctctttcttcaatggtatggctattgatttaaaaaagaaactaatgccctttcatttgtagaaaaaatataggaaaattgaaggattttaatcttgtagaaaaaaaatcctatgaatacatttgaaactatcctattctttcctttgaaattcctatgaaattgacaatcctatagaatttgatggaaagttaacaagagctcaaacctcttagaaaattccctacgagtctatctctcttatcccattgcaatgtttctatttctatttttttttgtgttttgcaattatctgttttacacttgtattcttgttaaaaatatgtgtttttcctattcctctcttttttcaacgcattgttttaaagaagccctaaaagatttgctattgttatttttttatgcagaagatctgctcttgcaataaatttagtttgatgttaggtttcataacccacaagaaaaatgcaaagagaagataaaggaaacaatgttgtatgatcgatttagccatttaggtgtcattgcacttaacaataaagggcaaaaagaatacaggaatgtttagtccagtttagtccaagattaagatatacgcttggtgttaaaggatcagcttaaccaggtaggcaattcagggaaataaaaatagcggttgatttgcaccaccatctgcacgtaaatcagcaagatttagctgttggttggcgatgtgacaaaaaaaaagtattacagccaatttagttgcgacgcaaacggccggttgattcatctgcgactatctggcttcaaggtgaagcattaccatgctaaacttctttcagtctttcaccgttctccctagctagcgatctcgtagtctgggcgtttggcttcatggagacagtggttgcatccgtttccgttggatccaacgaacccacgaaattctcactcgatctcgtgactcgtgaggcgtcagagccaagcttacggccggctggctggtcgatcgagacgagcagcagtattaaactgcgatttggtcagtcttgagttgctgtccaagtatcgccctcctctcgatcttcagattgatgagtagtgcagagtgctcgagtcaggtttctcatcatcattctcagtcgggaaaactactcgcgaccggccggccggcgaaacatggatggttacacttacaaacctcatttgcgacttgcgagcatgatcaggttcgagacggaatgatataattaactttattgtgctctagtgcagttcttggtgaacgggtgtacgtctctgacagttgcaaactgaaacgtttccagctcgttacacacacttgcatgaacttgtgctgatcctggtttggcaagtgatcaaatagactgttgtgatgaaaaaccggcaagctttggaagttcggatatggacgcctggccaatccaacactagttaacggaacagtatgtttgtttcaggaatagtgaagcagcattacgagatgtgacgggagaggtagctatggtatctatagctaccaggtgctggctggagttctgcaggcaccaaccgtaccaaactgccagcaaggctgcccaaatggtgaccgtcctggattattcataggatctctgaattctgaattctgaagtctgaactctgaacctgtcttaaattttcggccctgtttagttacgagttttttttctaaacttacaacttttcatcacatcaaacctttcatacgcacacaacttttcagtcacatcgttccaatttcaacaaaacttccaaacttcagtataaaaacacagccttcgtgtgttctttcttggaccctgtacagcaagtgcagcactgcatacctcctgcagcagaaaggtactccctccgtttcaaaatgtttgacaccgttaactttttagtacgtgtttgaccgttcgtcttattaaaaaaattaagtaattatttattctttttatatcatttgattcattgttaaatatatttttatacacatatagttttacatatttcacaaatttttttaataagacaaatagtcaaacgtatgttaaaaagtcaacggtgtcaaatattttgaaacggatggacatccgtacacgtatgatcatcagttcactgctagtacatctggcaagagagcgaggctttgctatctgaagaaattactgtgaccgcgactagtgacacagatcactcacttggggtttgtttgtttatggagggaatatggccaattccttcgggtgggcagaaactttcggtactcctaatggacgggtgattgctccctcccctcccaagcgataacccgcccctccccttactattttacctccctttcttctcttactactacaccatataaatttgaattaaaatttaaatttgaaataggcatgtaaactttttacttataaactttgggtctataaactaatatttgaattcaaatttaaatttgaaacgggtatgtaaacttttgacctataaactttgggtctataaactaatatttgaatttaaattcaaatttgaatcaggtatgtgtagcgcccgttccgtcgtggcgcctagcgggaaaattaaattctaaaaaccctaattgtgaaatccatttctttgcttgttgtcagtctccgtgccaatctctaatctcgaatccccgatcctccgccaaattcaaatcccaaatccaaatctcccaaattccatcccctctgaaaaagtttagtttgcctccctcaggttcggtgggctgatttccctctcggcccatctctctctctctatctctctctccctcagctctcccctccctcgctctgctcgtgcgccgcacgcgcgcgtgcgtgcgcgtgagccgacgccgagccgagcaccctctctctctccctctcgttctctagctctctctcttctccccgcctccatccccggcaagctctccgcgcgccgttgcctcacgcgcgcgcgcccacgcggtcgccgcccgagccgcgcctgcgccgcctagccctgcggctctgccgcaccagtggccgcgctgccgctcggacccgcgagccagcgcgcgtgcccgagccgcgccgccctcgtccgtccaaaacccggagacagagctcccgctcccatccctctccctccccaaattggcatggtgcgcacctcatttctcccctcccgtttcccgccttcctctctcggaccgacgcctcgccctccctccgttccctcgctcgattccagcgcctggacgcagaggagcagccgcgccgcgccagccgtcgcccatgccgtttgaccccgcgcccgtgagcccttctcctcgaagctccctcgccccagcactgctccgaggtcggttcccgaaccgacatagccaccccttaaaagccgcccctccccctctcgctcgatccccccgtttcgctccgagccgccgcgccattgcagccatgccctgttctccgtcgccgttcgtcgtcgcgcgtgtcggaggagccggcacgagcgaggacgcatgacgtggactccgggcgcaccctctcctttctcttccccggcccgaggccggagcgatcacgccccgcgctgtcggccatcgtcactgcgccccttcaccccgtcacggtactgccttcctccgttctccctcctcgctccatctcctccccttagactcgggtagtagcacgagtagattccccgtagtcagctggcgccgccccaagccttgccgccgcccgctgtgtgctcgccgccgtcgctgcccgagctcggtagcgcctctcatctgtaagttcaagtgccttaatttggtttcggtgattaatgataaatctaattatatgagactaacgtttttatgagcctttctttgactagtctcatttggatatggaagtaaaaatgatgagaggtatgtattaaacttcacatattctaacttggtctctcttgtggatctaaaatatagtgtgagcttcctatttgatctttattgattatgtgcatatgcgttccttcatatccatatgtatgcacatcttgagggggagcttattctatattttgtttattataagatttctatcttgatttgaaatcatttttcatctcatctctctatattgtttatatcgggttattatccatcaccaaagagagaaaagattgaaatatcttggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtatatgttttatgttggtctacatcattactacatatgccttctctatatgtatagaataaacccccattggtcattctataattatgcatacacttgcatctcttgtatatttatttgtatgcatatatttagggggagcaaatcctatacatttattgtgcatgttctagatctatgttgttcacctattatttatatcggatctttgcacttgagcttgcatacgagtatatgacacttgtgatgttaatgaatacacaacaaacatatccatatctttcatatgcaaccggttggtcatcaagtgaaggatgacaaccgatttgttgagactaatgttctcctttgaggtgtgaaaagaaataggtcccactacgatgaggctaatgaatgacaccatgggttagtggtcaccaagccaaggacatcgtcatgttggcaagaatgaagtcaagcttgtgatgagaataaagtcttgacaaaggatggacaagacctcggcataaacatggttcaaccggatggtcacaagtgttgatctcggctcaagcttgaccccaagatggatggtgcaaggcaaaggtataatgtagctaagaatgttttcttagtcttttcccggtcttggtgtttggtgtagaccggatttgctagataggcgctgtactatcaagaggggtctatgaagcgagcttgtggatgatctagtgtcatattagttcatatgcatgtaggtgcattttgtgggcttgtctaaccaagtgtgatgagttttctcaagtcctaaaccaagagagaagtgggcatgtccaataggagtgagtgacatcttgtaggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcaccgttttactaacggtcggttgagcttaaaagtgacctgcggtttgaccgtgggccttaggccggtctgaccgggtctgttagcgtggtaaggctggtctgaccggccccactggtctgttgcactggtctggtttttggtggcgatacagagccgccagagccgcaaccggtcagaccgagccgacggcggtctgttccgagtcgtggacggtctgaccggctactacactgcggtcagaccggccaggttgagtgggctcaatgattgccctataacggctagttttctagccgttacaaagtagtccggtctgactggcctcacaacggcggtctgaccggcagagcacaaagttggggatttcggttccaacggctagttttggtggttgggggtatatatacccactccccaccagcaagggtaagtttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgtcgcctcctagacggcttgtggaggtgttgcccggtgacctctccgaggagattgtggaggaggcccggcaccgtttgtgagtggtttggagttcaccacctttggagtgaaggaagaactaccccgagtgatcgaggcttgggtagtcctctccgtgggccagctcccgccttgcccaccccttgacgaagggggcgtgcggtggcttcgtggttgagctgtgaagttgggctcgccttaacagggattaggaaaccggcgagtttttgaacctcggtgaaaaattccttgtctcttgtctcatttatttgttgcatttacatttgtactatttacattcatagagacatatttgagcccatatcacttaggtttgcaaaacttaacttagttgcttagttaaccttgctcctcaccttgcctagcaacttaggttagttttgtttaagtgccattaagttttaaaaccgcctattcacccccctctagtcggcctccttgatcctacatcgtcgccggcctccctcggtgcgtttcctcctattccggcgcaaggaatggattcccggagtcgcgtagatgctctagtgcgaaggaatcaaactcccgtcgtgccgtcacccttttccccttctctcgccgctagttgccgccgccgcaatccgccgccgtcgcactccctccggcgaatctgagccgttagctcgtctcctctagtcccgcgctacctcccagtgtgctcgctttcgcctgtatcgccgtggttcgccccgccgttcgcagccgccgtccgccgtccgttccggccgacgccttcttcaacctcccgccggcccgcgtggcagccacgtaggcgccacctcggccaggaccgggtcaagctgaccccggtccgccgctcccctccgcctcgctcgcgcgcgcggtccaccgcgagccgtgaggctacgcgtgggcccgccacatccgcacccaccgtgagccgcgcgcgtgcaccgcgtccctcccccgaaccctagcacgccaccacgtgctccctccgcacggtgaaccgtgtcaccgacaagcgggtcccactcggggccacgcgaggtgagcccggtccaccggctccctctctcctcccctcccgcgtgcccttgggctgccttctcgggccggccggcccattaagctcggccgagccgcccctttctctcgggccgcgccttagctgcccgagggaagtctattcctcctccctcttcctttttctttttccaaaagggtttaattaaatcctttttcctttagacaaaaatccaataatcttagaaattcaatatcttctcaaccgtgtgtccgtttgactccgttcgacttccaaaattccccaaatctcgagatctatctattggcacgcttagaggtcaataatagggctttgttttcgccgtttgttgagttgttccgtttcgcgtgtagtttcggagcccgaaagacccgcagtgcgaggatttcgaggatcaagctcaagatctcgagcaaggcaagtcacctttgatcatcttgcacctataatttaaatctaagtatttcttttgcacaaaaatattgcataaataggattatcacgagtatttcggccgcggcttgcgagatagcctgccggccccaatcctaattgctgcaattaccctccttgaattattgaatacttaaacctcctttgtcacctgttgtgcttcgatgcacgggccctcaggcacgcgcatcggaacacctcccctcaaattttaaaaaatccaacgatgggtaaaacttggggttttacaaaaagacttggaaaacccgacacctgggtcggtgcttgcgaactaaatgaatttccaaaatcgcggaccgggaaacgtaccgggagtacggtttcccgctcttgcacttaaggaccgtttccttggaattttatccgaacataagacaagtgcgaccacatgggtgtaatgggacgtccttggctgagtaattagctaatcgggggaatcatgatgccaagagacatgtggattcaacggggtggtgccggggagaacccccgggtttcctggcacagtatggtctgggacctaacctggtgttggtctgggacccctctcgttggcatatggtgaacctgtgtcggctttcgaaatgccttgtcatgaaagcctcaaggtctccagacgtggccgttctgcacgggctgggtgatccgggttagtaatgtcgtgtgggtaaagtgtacccactctgcagaggttattaaactgttcgaacagccgtgcccacggtcatgggcggacgtgaggtgattcctagcgtagttttgtttgactactgctttgtgaaattgctgttgtggaatgggatcgatgtttggaaaatctgcggctgatgggatcagctaggcccgggtggctgtttgaaagcgggtggccgggtgccaaccttgaatcaattcaaagactgatacatcgcacatactccgaccggacgagacgcactgtctcatccgtgtcgtttgagaagcacttagttgtttcaaaaaggggtttaaataaaatcaattgcagaaaaacaacagcctttcctttgaagcctgcattaaatacttaattcccatggcttgctgagtactcctgtactcacccttgctctatataaataattccccccagttgctgaagaagatgaagtggatcccgctaacgaggagttcttccaggagcaagtcggctacgatgagttttagggttttggcctagttcccaagtcgcgcctgtgatgaatggtccaagtcttggctttcgctttcccttttgtaatgcagttgtgagctcgggatctgtccgcagcccaacatgactgtactcctactctgcaataaagagacctctgttgctgtgaaattctgtcttcctgtgataccagcactgtttcctgggactggtatcgattgacaggttaatttggagcgtcacggactagttccgttcggggctagttcggggcgtgacagtatgtaaacttttgacttataaactttgggtctataaactttaggtgtataaactttagatgtatagaaatactatatatagaaaatatttgaattcaaattcaaatttgaatcggacataattcaaattcaaatttgaataagatatataaactttaggtctataaactttaggtgtataaactttagatgtatataaatactatatataaaaaaatatttgaaatcaaattcaaatttgaatcggatatataaacttttgacttataaacttttggtctctaaactttagatgtgtaaacttgaggtgtataaacttgaggtgcataaatttactaaaataggaaagtaatgcggtgccaaaaaaggaaaccaggtggaggaagggggaggagggggggcgggttacccgatcgctataggcgagcgagggcgatccctcgctcagtagcatttccggaaactttcggtttctttgtccatcaatctgtccaaacatggggggcctaatgggcgatcgatcgccaggcaatcgcccaagcgatcagcccccctcccctatactccatatactcctccctcctctcccctcttcc

SEQ ID NO: 79002 - DNA, 16884 bp, Oryza sativa
  unsure (1)..(16884): unsure at all n locations
acggaaccggagcaaattaagctgctgcgttacactattgaccggctatattagtctatcacgaccgtccacatcgccactcaacaacaccatcgctgccgcgcgcggcacaaaggtggccgtcgccgactcgccggtgtgtgcggtgttggtgagcgttcggtgagaacgttctcggcttccctcccccctcacgcacgcgcaatccacagctagctagcgcgggcggcgcgcgcgtccaccacgaaacccccccgcacgtagccatcggtgtattactactacaaccggttcacatcacacctcgcccggttatttccaacgcgaggcataaatacgggagagggaaggggaaacccgacgcgacacgtctcctcgattccgctggttttttaagtttggtgaaactcgatcgcttaggttaaacctcggtagctgttgggtgcgaggttggccatcgatcatctctcgctggatcacgccactttttcgcatgcaaagcgtaggatttctctctttgtttttaggatttcttggtggttgcgagccgcttacctgaacccagaaccccccagttgccggtcaagccaaaccctgcccactgcgatcgcctcccatataacacatactctcttcctctttctcttcgcttcatcaagtagtagtcgtgttcattaatctgcatctctcgcttcacgtactttgaagtggtggtgaactgtgttttgtgtcatcgatggtgaccatgtcggcgtcggcggaggcgaagagtcgacgggagaggcggtcggtggtggcggagctggagggggcgctgctgcgcgacgcggcgacgttcccgtacttcatgctggtggcgttcgaggcgtccgggctgccgcggttcgcggcgctgctggcgctgtggccgctgctgtgggcgctggagcgggcgctggggcggggcgacctggcgctgcgcgccgcggcgttcgtggcgacagcgggcgtgccgcgcgcggaggtggaggccgtggcgcgcgccgtgctgcccaagttcatggccgacgacgtcgacccggcggcgtgggcggcgttcgggtcctgcggcgggcggcgcgtcgtggtgacacgcatgccccgggtcatggtggagcggttcgccagggagcacctcggcgcgcacgaggtggtcggctgcgacctcgagtacagccgcctcaggcggtccaccggcttcgtcaggggcggcggcggcggcgagcgcgcggtcgccgaacgcgtgcgcgcgctcttcgccgatggcgaccggccggacgtcgggatcgcgcggtccgagtcggcgacgcgatccttcttgcccttctgcaaggtactaccacgtacacaccgtgcacgaacactcccggaactcgtccaaaccactaattaatctgcatcatatagcaaaaaactactgaatttgattatagtcagcaattttttttcataaatttgacagtgatttaaaagtgtcaatggagggagtagtagtatactagaacacgcacttgatcgatggagcaattaatgtgcgccattttcctaggaagaaaaaataatgtgtatattttcctaggagtagagctttagaggtgcttgcccataagcatgcgcgtcggtacatgttcccgtctaatatgtgcatggaatttgggcatatgcatgcatggacgaggatgaaccataccacaactaaatgcctagctagattaattctgaaagtcgtttacgcatgtgaccgccacagccacaagagtcaaacttaacccatcaatccatgatgcatctccaaatctgtgttcgatatactccacaacatgcaactcggtgcacatgaaaggatgtcatgatagtcggcaaaagttctttaaaaaataacccaagttgtcgggacaaatttagacgaataaattagtagtttagtactcgtgtcacaaaatttaaatttgactgtagaaattactatgtacgtatactcgtacatagtgagtgatcacgtgaaccttacatgtagaagtgtgtgtctctgtgtgtgcgcgctaagccatagctttcatctgaataactctgtttgaaaattgaaatgcgcatcgctattgtggttttaatttgtggccaaatacgcatcacttttctccaataattatgttaaatcgtggctcgttcaggtgttaattatcatgctatagttttgttgggaccaacatggcgagaaaccgcgaattaaacctgtaatttgattacgtgcatgcagaagcaactccggccgccgttctgtgaggacgacggcgacgacgtcgccgccgccggcgagcagcacaaatgccctccgttccggccagtcatcttccacgacggccgcctcgtgtgccggcccacgccgctcatgtcgctcgtcatcctcctgtggcttccgcttggcgcgctcgtcgccttcgtccgcatcgccgtcggcatctccgtgcccatccagatcatcccccgcatcgcgccctacttcggcggcgccgtcgtcgtgcacggcgccccgccgcccgccgccgccagcgggccggcgtccggcgtcctcttcgtgtgcacgcaccggacgctgatggacccggtggtgctcgccaccgtgctcggccgccgcgtggccgccgtgacgtactccatctcccgcctctcggaggtcctctcgccgatcccgacggtgcggctgacgcgcgaccgcggcgtggacgcggcgcagatgcgcgccgagctgtcgcgcggcgacgtcgcggtgtgccccgaggggacgacgtgccgggagcccttcctgctccgcttctccgcgctgttcgccgagctcagcgaccggatcgtgccggtggcgatgaactaccgcgtcgggctcttccacccgacgacggcgagggggtggaaggccatggaccccatcttcttcttcatgaacccgaggccggtgtacgaggtgaccttcctcaaccagctccccgccgaggagacgtgcgccgccggcaagagcgccgtcgacgtcgccaactacgtgcagaggatactcgccgccaagctcgggttcgagtgcaccaccttcacgcgcaaggacaagtaccgcgtgctcgccggcaacgacggcatcgtcaacgccaagccgccggcggcggcggatccggcgccgtggcagcgccgcctcaaggaggttctcggcttcttgctccactaatcgatcacaaattcacaatactttcgtggccaaagtgctctgctcacaagattaatttgacgaattttaattgcgataccccccaaaaaaattgcgagttttaatttacatgcgtgtgcatgtatgtacgcaaagaaatgtaaatgaagacagcagccaccattagatatcaaacctacacctacggttgcttttccttgctttttcttacgaaatttgttcatgattcatttgattttatttttgttgtaatcaaactatactgctgtatatatatatttacacatccattatcacaagttgcatgctcaatctattttactcatacgtagattttgtgttggtctagttgttgatcagtcctccctagctagtgcctattaattccattttttttatcttatacaacagagttcattgattaacaggtacttgctccgtttcgaaatattttataccgttgactttttagcaaatgtttgaccgttcgtcttatttaaaaacttttgtaagatatgtaaaattatatgcctacataaaaatatatttaacaatgaatcaaatgataggaaaagaattaataattacttaaattttttgaataagacgaacggtcaaacatgtgataaaaagtcagcggcgtcaaacatttcgaaacggaggcagtagttattaggtgagcaaattcttcctacgaaaaatagcgactgattctttggaaaaccagcttgttttgcacgcagagtcttttccaatttgttcctttgacatgacaaatgaaagttcgcgatttaccgctttgataattaagaccttactcaacgcctcaatttattggctgtgtttgcagaggccgaaaaatttattccattagtaaaaataaagtcagcacctcaattatggctgtaaacctctatgatgtggattgtcaaccctaacccttgatctaaaacccttttaatttcgttgtgttaaaaatagtcgaatgaattatatcattatactcaaatagttaactgatctatgggttggccgttctgatccacctaaacagaactgaattttaatttctgaggttatcaaaacacgcgacatgcatgagatgactcctttttaaggtcaactaatttgggataatatgttcagctggtcatgtacgaaacttaattatcagcaggacggtaagctgcaattaagatcgtatttgccttttgaaaaaggatcgccctccctcgttcatatgcgtttagcgtcggcaacacgtacttatcataaaaaccgtacgttaatagacgtgagactgattaagaatttgcggtggtttatggacttagcaaaggccacgtacgttcccggccctaatatgaaagccacgcatatatgcctgaattttcggaagcacatcattttactgtgtttgagtaagcacccatgtgaatagaacagaataacatttgtgatagtattaaatactaaggaggcaaaaaggacatgaatcaagttttggttttattgctgcgagtgacctgctgggtgcacggtgccacaggcgtatacattgtcaaatagtatttcttttcttttacgaggaaaatcacaagtattcctttttaagtgggttctcgataataatttaataagattagagatgtatcgctaatttctatatctttgagcatgtgttaagcaagacattcgcagatatgtgttactgatgtgtgtgcatgtacgtctaccatgtaataaaaataaaataaaattccaaataataatgaaaaatcacaacaatttgtttcctttgtgaggaaaatcaccaaatatccattttcttttgtgaggaaaatcacattaactcattttctattgcgaggaataccaaattgatttattttgtttagcgagaaaaatcaccaactattaccttaatttcttttcccattcttgacatttattccttttcattgtgttaggatgtatcacatccaaccaaaattccttatatttagggacgaatggagtatctagaaaataaataaataaaattggaaaattaaaaaagtaaatgtcaagaatgggaaaatagtaactagaagataaataaataaaattaccaaatattcattggaaaattaaaagataaataaataaaatcaccaaatattagctggaaaattcaaaaagtaaatgtcaagaatgggaaaagtaaataaaatcaccaaatattaattgggaaatttaaaagtaaatgtctagaagataaataaataaaatcacaaaatattaatgggaaaattaaaaaaataaatgtcaagaatgggaaaagtaaataaaatcaccaaatattaattggtaaatgtctagaagataaataaataaaatcaccaaatattaattggaaaattaaaaaaataaatgtcaagaatgggaaaagtaaataaaatcaccaaatattaattgggaaatttaaaaagtaaatgtctagaagataaataaataaaatcaccaaatattatctggaaaattaaaaaaaattaaatgtcaagaatgggattcgaacccatgccctttcggaccagtacctgaaactggcgccttagaccaactcggccatcttgacccacatcaggaatcgaacacttaacatttaaatacaattaacttaatcatgggaacatgacacgggcaatttctgcgtaggcaccgtgctaaccccgaatcaaatttgggacgcaaatctctgcggacacgtctgataaaaatgtgtgaagcaaacgggagaccccttgaaagccattttacttccaagcaagttcaaccgttgtttccattagttccttaattatcgtgaaacaagattacatcatagtagaccacctacttgcaccaacgccatcaccactcaccgggttcaacagccatgcgtgattgagtattatcaacaattaatcactcgatcgttgtccacgcttgagccagtcaccgcgtttgtttaatcaaaccttgccggtttgcacgaaaccatagtcgacgtagctataaccaacctcctccacggacattccaagccaaagattgtttacacactaacacccctactatcaatatcttataatcatatcattatcttaaaaaatatctcttaatcgtatacaacacggcaatggttaaagattcaccaaagatattctctccgtcctaaaataaatacagttctatactattcatatctaacattggatttggaccgttcgtcttatttaaattattttataattattatttttgttgttattagataataaaacatgaacaatactttatgtgtaacttattatttttattttttttataaatttttgaaataagacggatagttaaacgttagacacaaatacccatctatatacttattttgggatggaggtagtacattgagacacaccattaacgaagctactaattacaccaaccatatccgttatagagtgatgaaagataccagtacagttcgagttctaaacttttaataaggtgattgtatttatagctaattattctttcattcgtagatgatatacccgtcaacagcaagacatccgtggtgatttaatcaacttcaagatataccaaaccagtcttactgagatgttcaaaagaaatagaatgtgtgtatgcacgtttataggtgtgagtgtatgttgtaagcgcatctatactttttttttttaacaaacgaacttgtagtaccttcaaacaaacaaacttgttaggacctctttgtttaggcttagatttattggtttatatatagttataagttaatttattggcttatatgattccctatatgatctataagccgatgaatttaatgtctaaatttaatagtagagtcataccttcacctcatataagtcaaaaatattatccaatctaatctttggtttaatagagctagaatgacttatggcataaaaaacagaacgaaaaaactgtttgattgtttaagcttagtttttttaccttataataaactgatttataagtctacacatgcatttttggctttttttttctttgacaccgttctctccctcgcgacgctgtttctccccgcgaaataaagtgacgtcaccgaacgcaggcccgccgcctccgcctccgcttccgctcgcccggacccgcctgcgccggccgcacaagggatgcgctccctcacctcccgccaccggccggaaccctaaggaggcgcgtgcccacctgcggctgcctccggcttcggcgatggggcggccgggttacctgacgctgccaatcctctcggtgctcgcggccatcgggtacgtctactacaccacggtgttcgtcgccgtggcccggtggctggggctcgccacggcggccggggccgcgaacgccgcggcgatcaccgccctcgccgccgcctgcgtcgccacctacgccgtcgccgtgtgccgggacccgggccgcgtcccgccctccttcgcgcccgacgtcgaggacgccgagagccccctccacgagatcaagcgcaaggtgcgttcgcgctgtcccatcggtaggcttgcctattataggatttggatttctggagtagaaggtttgctcggttatggccattgtttgactcaggagttacattgggacatctctgctttatatatcttcgcatttctattgagaaatgcggcaaatagccaaatatgcaatctagttcgtgaaatttgaagcatttggaggagggactgtctcgcactgtcgctgacacgccgacaggcaatttaagatctgagtaatcaagtgcatccacagtatgagtggatctaacctgaatattaaggttttgtcgattgatggtgccttggccacaccaacatggattttctgtgcgtttgagatgaacagtttcaaaatacgttcattacaaaaactagtagtaagctaaaactatttggaaagagcggaattcaccggtttttgacggaatcagctagagcacctctgaagtttcctgggcaattgttgaagaatggtgggcttggcgtgcagctaacctaggaggcgtggtgatagaagaattaccgagtgatcactaataacctctgtgttggggcaatgtgtttaatgctcaacgagtgtaggacggtgtggagtccgtagttttcccaacccctaggggctggggttgtaaaacaacaaccatgtttgttgtccaaatattttaaacttctccaatcttaataaaattagtcggggcacttcgccgctggcctggcaaaaaataagctagaactaaaccaacgactctgacttcagaatctgattgagagaattgctcctttctgatagtggatagtgcctattagaccattacagttctttagggtaattgacctttgcggtcttgtaatttttaagtgtatgtgctatggaatggggacaaaaagatagtaagctgaaagagggtgaacaactgatcactcatgctgtacgcatcgacctttgttatattcttgatgttgctgacaaaacattttgtatctatacttttttttttcagggtggggacttgagatattgccagaaatgtggccactataaaccccctcgtgcacaccattgccatgcttgcaaaagatgtgttctaaaaatggtgctgatcagtactaatctgtcttgtatcttctgttaattacccacttacactttttcagcaacttcttatgtgcaggaccatcactgtatatggattaataactgtgttggacatgagaactacaaaatattttttatctttgtattgtatgctgtaactgcatgcttctatgctatggtatacttaagtttctttgatttacctttgcaaccatgattgtctgggtatagagcactgagaaagtttcatgtttatttcagattcttatcatagggagcgccatgtacagtgttcctgtagatgaacattcaagcaatgattcttctaggacatcgattgtaagtgtgctgggagtgtaattttgagttagtccgtactatgatattccctatttttctgaaccatcactaggattgttgtaaactttgaaggatttttcaaattgacagatcatttgtgggatcattctatgcccgctgactttggctttgacagtgctctttggttggcatatctacctcatattacagaataaaactacaattgaggttggtatttactccctcaattcacaaattaggttgcttttttcacttttccgtctgtgcaatatttgaataaaatatttatcaatatatgctaaaattaataataaatattgcatatcatggaagtattttgcaaggcaaattcaacgattatttttgtgaagttaacctatatgatttttatacatatattagttgtcaaagtttgagaagttaattgtgcaaaatcaatctcaacctctatttaaagatggaggattgcttttaacagtggctgtcgttaatataatttgcagtatcatgaaggtgtgagagcaatgtggttagcagaaaagggtggaaatctttatcatcatccgtatcatcttggtgtctacgagaatcttatttcagtaagaactattttgttcgttgctatttgtatcttctttcagagcataaacattctacatatcctaatagaaggcaataagggaacaaccgaatacttgacttttgagaaacaatgtcgaagattgtccccttttcctctgtataagacatcaaagcttttgccactacccattcatccagtagaaacagaaaggaaacagaacatgagaatgtcaatccattaaatttcagcgtagtcatcttatgcagccttctggtacttgctttaacattgcatttgtctcagtaattcaaaattggttgcatatttcggtgcattaatattcatgcttcctgaccaaggggaggtattgcttgttattgatgtcccaactattgtcattattttatacaggtgctgggacctaacatattctgctggctttgtccagtatcgactaatacgggaaatggcctccgtttccgtacatcacatgatattccattatctacaccatcgatgtgattaacacgagatactgttatttatttattcattaggtagttgctaatctgaacatagacctctggcttcctattagattgcccatatgtgcctctttttttttttactgaagcattgtgttttggagcagtacagataatctgtcaaggtcttgaagctcctttatgaaatgtgctataagtgtaacgtacaggacctccccacggctccaagttaggacatgggctaggctgctcctttgttttcgtggtggttattttacatacttgatgaggcagaacatgctgcctcgcctgtaatttagtgtagtctctgattgcgtttattaggagatttgaatgtagtcaattctgttgtagatctccccggcaggaaaaaatggggggctgctgtaaatccaacatccatactttgttctcttaaagagccacttatggcagcgaaaggccacgataggaatcatctgagattgttcgcatacatgtttattaagaacagaacttatatttatttgtcatacatcgacgcagtttctttgtgtatacactgctgacatatgcttgttaatattaacacgatgatacgatgtttgggtaatgtttggatgattctacttcttcaaagctctggttcaaattcttctgcattgtatgttagatcgcataagcagtcaccgtataaggtgcacaataatgcatattgtggttcatcactcttgcatggctatagtcttcctgtgtgaaaatggcgcatgtcaaactgcaacacctttttcgaggttgatgcgtagcctagccagtaaattctgttactatgcagcattgtttaaagggcaactcctcaatatccgataaaatcgtgtaagttgagcattaacttacagagacgcggtatatcatcagatatgaagatgcaatcattaaccaataaccggtcaatgattgcatgtgatgatttgtgaaaacgttaactacaattttgttctatcagtacagccatggtgtcaaacaggagcaacaacgcagcatctgatgaacagtagccaacaagcaatcttgcagatgatgatttgttgcggattatttctaggttacagtagtcagaagcaaatactagtcatctattttccctttccttttcccttccccttcttcgcgtcaagtttggcttggacacgagctgctgcagcagccttcgcttcttccctcttctttttctcttcctccttggtggcagcagctagctctcgctgcttctttagttccctaaggaaattcatgtattccgcagatattagtcttcatagctcaagaaggtagaaaataagcaattatctcgagataatttcacaggcaatcagcataacagttgattccataaagtgattactgcattcctcctaactcctacctctccagcattatagttttgactaaattatgatgcacgtgatatattaaccagttttctgtatcttgtacagctgtgctatttaacataataactgggaacttcatattgtaatcataacaagaagacatttgaaaacatcttactctagcctggctttctcatcagaaacactgcccaggcttgaacctttcctaggcctacaagccactaactccacctcaaaaatgagtgttgcactgcaaagacaaagctgattcaattatagacaccaggaactcaaatttgcatcgcataggagaaatagcaacagacttgggtggaatctctggcggcgaccctgcacttccgtatgcgtattctggcttgcatgttatttttgcaacttcaccaaccttcaatattccaatatgtcactccatatcagcaaaatctttgaaagaatcagaacgagctagcaataagaatttagaagttttataccttcatagttcttaaagctatatcccatgctttaatgacagctccttgcccaatttcaaatgagaaaatagagttgtcttcatgagtggtgtcgaaaacttcaccattttcagcgagtgtgccttcataatgaactgtgaaaggatataaatgtaagtgggctaagtattgtgttatgtcttgtattatgcacatactcaattactagtaatatacataaatagttttacacatcgacatgacaaacgaaacacaggcattcactgtgtggtactgtcactgataaaaagagtggaaacacggctgaatgagaaattattaggatttaggaccaattaaccaacttataaatgtaactcaactgcctagagattgctaatcaagcagaaggaatttcatggaaatgattggattgagaaataaatatatgaactgcagtaccatcaaccaagggaagactatcagttggagctatagcatcatcctttgcttttctgaccaccgtcttaagaacacctccatccccagttaaatctgcaacctctgccatgaccttgctatgctatcaaagctccaaaggagatcctgggtgattattcatcatagtattagagtatgtattataacagatccaatcttcatcaaatcataaagtacaggcatctagaaaattgggggaaaaatcactttctccacttatttaaattcactgctttcacaatttcaagccaatataaaggtgccccgtactttcaagttgaaccttagcgttccagaattccacagaagaggacaccacagctaatgacctttaacttgaagagggacagctgtggaaatatcctaaccaaacgttggtaatcaagcatgacactcattctgcactccccacagcagcataatcaggtatgtcactttccttttctgaaggaaaacacatagaccaatcccagtctctcctaaatacacccaatccaactatcgcctaactgggactgcattgatgcaaccaaaaggttgccactgctgtggacgtgtgatcagacgttgctgctcctccccaaccaacaagcctaatacagacctacaccttctagcattccatgcgtgttatcatgatacagaaccgcgaatccctcgttgcaaagttccattgggcatcattcggggcagtaaaacaagccggatagaccaaacagcgggggtctcgcggcatataccctcacggaagatcgctcgcgaaatcgaactgttcaaggtacaccagattggaacacgcccgaatcgaaaagagccaatcgagccagctggggggcaacagcagacacgtaccgcgagagcgctcccaaggcgggcgctaggatagctcgccgccccccaccggagaagccctcgccggctcgccgccgcccgcgggagaaccgagcaatcgccgtctcgtcgcctctctctctctctctctctctctctctcgattattcgcgagattgggaagatagtgatgcgaatgggatgcctccccgtagcggtggatgtctcgacactcgactctcgactcgagcagtgatgatgcctgctgagtggtgggccatgggagaaagtacgggtgggaatattcgtatgggctttggggccttgagtagtgagacacggcccactatggaagttcgcgacctaactcctaagggctaaattcacggcccatcttgagaggtgtgcaatgaaactgaactgaacttttggcctgtccatgggtacgggcaggtatttgacgtcttgctaaggctgtgtttactaactttttccatcacatcaatctgtcatatatacataacttttcagtcacatcgtatcaattttaacccaaactttcaactttagaaagaactaaacacagtctaagttgctagacaaaggcctgaacttcttttcccgtgcgtaagacgatttggatagaatgtacagtgcagtttactactctctatccaaaataagactacaaatctggatcgtcttagaatagttacattcttatctagatacctaggtgcacttattttgggactgaggaaatatataacagtggccaggtataacggtaaaatggtgaatctagaacaaaaattatcaggtatctatacgcatacttaacatgtagggcttgttcactttgctaacattctcaacattaccaagttttagcattatcaaattttggtaaggttgtcaaaattttggcaaagttgcaaattttagtaagattttatatgtatttactaaaatttggcaacaaactaaatgtagccacttttttataactttacccaaaaaaaaaggtaaggttgaaaatgttagcaaagtgacaagcctgtataataggcattagaggtggagtaatttgcagtgataacacctgtcctgtgtactaaggttaacgtggctttgcccccgcccccgcagatatacctgccgtccaaaaagaaaaagtttgggctttgaacctctatataggctatgttcaaattcataagtatttttctttttttttaaacagaggagcaggctaaggttgtaaaagtacacctttttcttatcttgtcctactgtccgaagaagctagtctgtggactgtgatggctgggctggcaagttgctgccgatggcaacaggttgctcaggtacggacgtgtcgtttagggtgcgacgattgacgattcacgacgacgacgactgtgctgtgctcaacagtgcagacgctcagctgcagcatgcagagccatagctggcctgatcagaacagtaaagcaacggcgctcgatctgctcttggccggcctctcacaagttgtgaattgaaacctgcgtgatttcatttcgtttctgtaacgtcaagaagaactagaaagaaaatgtacaaatacgaaccgagagaacgaggcatatatataattacagagaatgtatatgaggagtacgtagtttcacatatttcgtcccttacattttccatctagcaatgcaatacacttttttttcgaactccatttagcaatacatatatagagctcccctgtgctacggacgtggttgcatttctctcgatcggaacgtgaagagaattaagcagaagagagaccggcttaagcttgtaaaaaatgtacggtcagaggtagtcgacgtcgcgccagcacgcgagcatggtgatgcatcggcgcacgatgtagagccgcgcgcgctgctccttcacgagacgcgcgcaccgtcgcgggaacgacgacgacggcggcggcggcggcgagcaggatgcctgatgcctgctgccattgccggcttccgagccggcgcccgcggttctcccgatcctcttcttgcacggctccctgcgcttgacgccctgatcctccgcccgcgactccatcgcctccatggacgagaccaaacgcgcgcgcgcgcgcggccttctgcttggtgcgcgtgagctcagttagtgttgtgatcagtggagagcgccgcgggtgaaatcaagcgatcgatcagctataaatagctcgcggcgagatgggtggcaaactggcaatgctacctagctctcggcaaggaagcgacttgtagctagctagctatagctatagcgagctctgcatcgtgagtttatcttggcaaaattggttatatagcatcgaaagtttacgtttttttattttatagcaccgaaagttaccggttcactttaatagcacccaaagttcaccatgttcccatttttaacacttccgtcaattctcaatcgttttccgtccgtcttgatccaaccacacacacgatatgacgtttctacccctcacaagtacaagtataatgcatgtcaatgaggggtagaaatgtcatatcatgtgtgtggctggatcaataacaatcaagacggcggaaaaattgacagaagtgctagaaatacaaacatggtgaactttgaatggtattaaagtgaaccggtaattttcggtgctataaaacaaaaacgtgaactttcgangcnananaaccaattttgccaatcttatatatcacggagatcatcgcggagtggaggtgtgtggtgttgcacgcatcgcgtgcagtgcaggacctttggtatatgtcccaccggccggggccttttgtaattgtatcagtatgtattgtagtactagtttgtacacgtgcgagtactacctttttttagttggaagtatctagacatcacaagcgcctgaaattttcaaaaagaaaaatcctgttctttagatggcaatacaatgattctagttactcccatgtaaaaaaaaacgttgaatgataaattattgtaacctacgaatatttataaaattacatgaaataaatttatagctcatgaaattttaaataattagatcaaaacaattcaaacatatatagataaaaaaataaaagtaaaaccatataaaacaacaaaattagagttaaatgattggtcattttatagcactgtaaaactatgtttatcagtatgtaactttaggtgattgaagatttacaaaattgcaggtgcttgaaaactagcaaagttctttttaattatatagaagatacgcgtgctcacacataccacaccatgcact

SEQ ID NO: 79003 - DNA, 979 bp, Oryza sativa
aactttatcaagtccaattctcaaatcccaaaagtcaacaattcatcataaaacacaatcatatcagtctcaacagtatatgacaaaacataatctatgaaataaatgatctatgtttaagataggaatcatattgataaatcctaatacagaaatttaggtcaggctattattgtgttgtatgggctatgctatgggtctggaaattccgagaaaatttccagaagtttccaatcgatttcgagttccgacgaaaccgctcttatcattcgattctgtttcggagaaaatattttcaaattcaattccgtttctgaaaaaatccgaccgatatattccgttttcgaaaatagctttatgatctgaaaagttttcataccgtttttacccctaacgactaatgtcagatgtgacaaatttagttacaaacaaaatagaccctaattaagtctctttgataatgtatccaaaagtgcttatacttagacaaaggtgagttttttttaaaggagggcaaaagctttgcctcgtatattaatagagatagagaaaaaacaaaacaaaatcagatagggaaatatttacagggcaagccaaaagatagacaaaggtgagttaactttcgatatccacaaagtcataacttcttaggctctatttctttcagcttgggattattataatccagattattgggagtaagctgaaagaaacagataacttattgaagtagcttattataatttggagcccaacttattataatttgataagctcatttaggtgagttttttctagattattgggtgaaaaattacccaccatgccacccccactctctatttagacttgcaaactcaataatctaggctctaataatctaggaaagaaacagctaaccgtttattctactacaaattataacaatctagcttatagtaatatgactcaataatttagattataataattccaaact

SEQ ID NO: 79004 - DNA, 17913 bp, Oryza sativa
ttaacgaggtatattaatctatgattagcgaatgattactgtagcatcactgtagcaaatcatggattaatatacctcgttagattcgtctcacaaaatagcctaggggttatggaatgggttttgtcagtaatttacgtttaatacacctaaataacaagatttcggagggctattaaatagccatctggatccaaactgatatgaacaaaatagacgctgcgaattatctaatcggcaatgacgaagtaaaggctcaatcatacattgacagattaatgcaaatgatcagccagcacccagcagtaacctactccctccatcctataactccatcctataatagtgattttaagattttacttgcaacatttgaccactcgtcttattcaaaaaaattttaaaattattaattattttatttatgacttactttattatctacagtattttaagcacaacttttcgtttttttatatttgtaaaaaaaatttaaataagacaagtggtcaaacgttccaagaaaaactgaaaatctagaacggagggagtacgatgattgactattcgtctagttgcattgacagggcagcaaaagccggaaggcattaattagtgaggtggggagagtggactgtagacttcgaattggaacccggaatactccagtattcatctcgcctgcttgtttgtacgtggtctaaactcataaatgttggctgacatttgccttttcgtttacacagcttaacgtaaacagggctcgacgatttaactatcaaaacagggctcgacgatttaacgatcgaaactttgtcagatcacggccctaaatggaccagccccatggaaaatggccggcggtcaacacaaatttctaaaaggcacagtttgcaatgtatatactgagctgaccattttcagcatttttatatagcaataggataattttatatccttaagagttatttggaggtaacatattttatagtgtaaaatttgatacctctgagtattaattatctcaaggtattaaaaattttaatgtaaaatttagataccttaatttactttttttaagtactataaaattcctcgtaaaaaattaccttatcttagaagaaacgagatagagtcattaattaaaaaaaattgagtgaaaaccataactaaaacaacaaccaactaagctaataactaccaacatggaagcaagacacaaccaagctgaaggaacaagaaaactccccacaccccggccacaacccaacatcatcaccatcacacgtctccgactacgttgggaagcataaaacaacgacagcaatttaaacccgtgccaaaacacaacttgattgggctcatgttagcaatgtataccagaaacatatttttttttgggcatacatcttgtttaaaacaacgagtatcattgcttttttttaaaaaaaggtgatagaatatgcatgaggatagtattcatgtgccaaaagctatatttgtagaagtaagatccaaattagaccccttatatgtcaacacaaacagcttgttagttgcattcatgcggatactagaaagaaagatcacgttcacatgtctcaaattgaaggaccttgttagttgcatttgcacatagatacaaattacttcatataaatctaccatccaatcctaggttagtactcgttattaagattagcaaccaaatatatatcttctcattattaagagcatacccaacaaatacctaaaatccatctctaaaatattgtctttggaaattcctggtttgattttaaggtgtaaattattatttttatctccaacagacatcttaaagttaactcccaataataaaaagtgaacccaccatagtaacagataaaaaacagaaatcattcattccatccccacacatctataagagaaaatttggagcaacttgttaaaacaaaatataatttagaattaggtttcacttcggggtgctgttagctatactttatcacccacctaagttaatcctggccttgaaggggatctgaaaaaaaatagtgtgaaattattcgcctcagttccccctctcttggggattaaacaaacaagaccttatatggaccgtgcttccaactaccccaaacttctaattttctatcatattacatcacatccaaaacttttctacacacacttccagctttttttccaagcttataattttccccaaacttctaattttttttaggaactaaacacagcaatggtctagccctgtgctttatccagtcaatttcccttagtgtatctaaaaaagattgtaaaatgtactactttcactggccaggtttatctaatccataatctaaaaggaaccgtactatcgcatctccaagactccatgtaaccactacacacgtcttacgtctacaccgtggaatccaacagcgagatcagtgcgaggcgaacgccgcaagaatctctcttgacgcctaccttcccagatcgaacgttcccaccctcatcttcctcctcccctcccctctcctctcctctcctcccgctactccggagaccagatgcgccgcgtcgccatggcctagtggagatcgttcgtggagatctcctcctacgtgcgcgcgtgaatcggtcgggcggcgatcgagccgaggtgaggtgtgtccatggtggttaccaagatgcggtgggcagacgacggcggcgaaggcgacgacgacgacgatctccggctgccgggcgccgggaggcgttcgccgtcgctcggcatcctggcgttcgaggcggcgtccacgatgacgaagctcctgtcgctgcaccggtcgctgtcggagaaggaggtggcgaggctgcggtcgaacaccatgcgggcggccggcgtggagtaccttagctcgaccgaccaggcgttcctgctccggctggcctgcgccgaggcggtggcggcgctggacgccgcggcggcggcggtcgcgcggctcggcgcgcggtgcgggctcgacttcgccgggccgtacgcgagcctcaaggccggcgcgcccgacgcgcggctggaccagttcgtggcgaaggggctcaaggtgaaggccaagaggatggagcggctcgtcgccgccacggcgaagctctgcgccgagatggaggcgctcgacaagctcgaggcggcggagcagaagctcgcccgacgtgggtggggccgcctcagcgtgccgatcccctcgccggccgccgccgccgtcgacgcggtgggctccgactcgctccggctgggtatcagggcgcagcgcgccagagtgcggcggctcaaggaggaatcgctctggagccagagctacgagaaggccgtcatcctcatggcccgcgccgcctgcgcggtgttcgtccgcgtctgcgtcgtcttcggcgcccacgtccccggcctgcccccgccgctccctcccgccgaagccgtccacagccgcctctccaagcttctgctccacccaatgtcggcggcggcgcagcccaggtcgttgtcagggcccatccaacgtcgagacgtgccgctgcgcatcgagatgagcagcaactcgtgcccgatcatacgctcgcattgccagcagccatggcagacgtcgccgccgggcgtcgactggaggaagctcctcgagccgccgccgggcacggtgggcggcgcggggctggacctgcagtacgcgaacgtgatcaccaccgcggagcggctgctgctggagacggaccacgccgaggggcggcagcgccacgaggaggcgcgcgccgagctgtacgcgatgctgccgtcgaagctgcgtgcggccgtgcgggcgaagctgcgtggatggtggagggagcgcggcgccgcggcggcggtggcggtggagctggacgcggggctcgcggaggggtggaggtcggcggcggggcgcatcctggcgtggctggcgccgatggcgcgggacacggcgcggtggcacgcggagcggagcctggacaggcagcggcggttcgaggtgggcggcggcggcggcggcagcgcgcgggcgtgggcgctgcagacgctgcggtgggccgacgcggagaaggcggaggcggcggtggtggaggtgctcgtcgcgctcagctgcgtcggctggtacgacgagcggcggcgggtcgcgtcgctccgtttctgagctagccgcctctttggcttccacgccggtggcctcgccgcaacggcgcagcaccggcaacggcacgtaggtacgtgcatggaacggtgaaaaaatttagaagaactagtttgccccaaatgggaccgattctttgtaaaatactagtattttttttaattcgattctttgtataataatctgttcatatacgagttccaagagtaacaccacgaaattgtgtcccgccttgcctgctggactttttaggctgttcccacttctcagtccgagcacttcgttgatggccacttcgaagtcgacgcgttcacaagcatctctctctagttctcgtcagcactgggtagcggccgtttaactgtttgctcattgctgctttcttcagggtcgatattactattacgagtaatttgagtaaaacttactgcctctatagttttatctctacttcctccatcctataaaaaacaatctaataccggatgtgacatattctagctgttttcaaatttatcgtactaaaatatatcatatctggtactaaattcgttttttatgggacgaaaggagtaaatctagaaatgatatagaaatgataagtgtcagctccatttggtcgctcaatggaagtagcggcctagcgggtgatgttctacgcaaataatagagcttaacattatctatattttaaaataattcattaccaaacacactccatttgctagttacaaaaggcgacatacattttcaccaaattcgctgattcacttaccgaaaatagttctaaaagcaaaatctacccatggctatcttcataattagttcaacatttcaatcacctgctgtcatttacaaatgtgtgaaacaaataaaaaactatggctgagttcgaggagaaggaggagacagagaagatatgcaaaacgatatgagccattaccacacgattaattgagtattaattattttaaatttaaaaaatggattaatatgatcttttaaagtaacctttctatagaaatttttttaaaaaacgtaccgttgagtagtttgggaaacatgcgcatggaaaacaatgtctttctctccaatcacccaatgaacgaacgcagccagttattgtggcatgtacaaacgttaagtgcatgtacaaacgttaagtctgatacgagctcttagggtgtgtttggttgggtggatgagcctggatgggagatggccgtccgaatttttgtggtgtttggttggagggcagggtggatggggcggcccagaatagggaatattccctcaatatgctggatgagtgcatccggcctatttggttggatgaagccatccagttttagtctgggtgatgtgtcatattctaattggctgtggttggtttgattttctgttaagcaagctttaaatgattttttctactaaaccgtttatctaatttatggtttgattacaccattatatttgttacaattaaatttttaaaacaagatctcgaatgattatattatgattaaaatatatatacgacaaatggatcccactaacttatggcttctcccatccatactatatccatctaaacaaacaagaaattagatcgccatatccatacaaatctaacaaaaaattagatcgccatatccaacaaaatatggatggccatatcccatcatgcatgaccgtgaaccaaacacatccttagttaatacatactatttttctgcaatagctaagacaataaaagctctaaaccattaatgcccatgaatttttttattacttttttttccttttatccaccccatgcaataatttttttctttaataaatgctaaaagtcaccactgagccattttcatgcgtagcaaccatatttttctttcctcccctttctctcatccatgttaccaaatttattcaaatttattttgcatggcaacggagaaagtccgttaagcactgttgtacatgctctagagcaataaatctcatttatgcaattagggtccgtgcatgttaaattcttctaaaaacagttaggcgcaaaattctgaaggagaaattcatatatatattggtgcatttacaggcttacaaccgcagattattgcatagtaccattcgttagattgtggaggctacatgaccctgccgatccgggtatcaacaactgttggttttgaaggtcctgaaaattccaaggcttcagctaatgttaatctactattcctccaagcatgttctgcccattctttcatccgttcaccttcggctcttctatttgactgaataagcaacaattctgcatactctcctgaaagttgaacatgtaaagacaaattcagtatggcctcaactagaatgggactatgggagtagaagcatccatacaagcaacatcaacatagaaatcaatgagttgaaaaaaaattgctgattatttgattgctgccagtttaaaacaacaatcagcatatgattgcgtccaatcgactatataaaaaaatgttatatttgttggggcttagaaaatcgcagctcggtctagcatttgtgcgcaagaaggcactacgcctgtttgtcaaatctaagaattgttttccccgatacaaaaattattagaaatttgtgttcacacatgacacatcccttgatgagctccaacagaagtaatatatcacgaaatcctactttactaaacaaacaggcagggcagatttggatgccatattgttaggttatagtgaagttagctgtcaatcaatcatggtgacaattttctcaattttaaactatatatatgccataatcctggatgcaccacacaactagttctttaaaagttgcatttgatgtaatgatcttatttaagagtttggtgcaataaattaaagaagggattaataggagcgatagttcagagtgtaacctctagcaagggagatgatgtccctccaatccatctgcttgctcacacctaaaaaataaaataaaataataaaatcctcaagtggttaaaacgagccatatcataagagattattgttttaccctcagagttaatggcaggggctcttaatacttctagggccttcctgtataacccctgtaatacacagctggtttgataagctcaaagtcccaacccacccagactgaaaaaagtttactcacagcatctgtactctgtagtctgtagagcagtgataattataactgcgagcaaactcgttcgagaaagtacatgaattgtctcatcattaaaactaaagatcaaaggaacaaggccattatagtttctactgatggacaacagggcaagcagaacaggaatgagatatttactgacctcctgaaccattattgagctagaaccttctgcttttgctttcagtttgtacattctagctacacaagtcaatacaatgccaacctttgggtgatttgcccctgcatggattaaaagcttgcagtattggtaacttataggcaattgattctgccattatttattattatattatttaataaattagcttgacaaaccaaattgatcttcagccttctttagcgcccttgtgagataatcctctgcctcactgaacttcctggtttgaaaggaaaaggcaagtgctctcagttggaagatggaacaaaagggaagggggaacacagaattgctacatttcaaaagccaaatgctcccaagtttatcaagcaaacattaggactaaaaaggacaacataaaagattcagaaattgtcatcttaccctgaatgtgataaaagctggccatatgaacaggtggccccaagagaaacctcctcaggaaccatgttacatgtggctaaaaaatttccagacatgtcttccatggttaatgcctccagaaccctttcatacatttgagtagccaaaggaaaatccccaacacagtgcagatattcacaatatgaaagtacagcattttctgtaaggaacatcactattgtgtatgaaataattgcagggaagaatgtgaaaggccaaattgtctcagagacttccataccagtttgtttattgcctactccagcacataggtccttgcacccgtcgaagaacagctgggctggtaagaacagctgtaaatcattttggacaaaatgccttacctatgatctacaagagataggccattgtaaataaaaataacctgattccgtctctccatttagaagtgcaataagccctttgatagcattaacccgacatttcagatggccctgatctgaccatttgatattatcatccttgattgatagatcgaccaaatcatctggggacactgaggtgttgataacctgtgtttaaggtaatcatgaaaataattcacctaaaaccatacaaggctaaatgtgcttgagtgctgtggaaaacctggcccgcttccatgcacagccccattgttgcttcccatgctgcaactgcacattatttaccaaaatatataacatcagttaagatcaaaagcttccctctcctcaactctttccatatcaaatgatgatttacattcttactcgacaaaagataattgtaagcttgtaatgttccagatcaaagatatatcaccgtttaactgagtgctagacaaattacacacaccaacacccttccacttcatatagaagggctaacacaatggtagacatgcatttgtccgtgtgttcataacttagtatgttggtattatctactcaattaacaatgtggcactaaaatgtgctcccgagcggcaatttttctattgggtctaggctacaataattgaataaccatcagatcatcaaatgataagttccaaatatctgtagtttttccttgtctctggtggctgctaaaatcacaagataaatatgagacttgggagacccatttgtttgagaagttcacatagctagtatttcagcctgctcccaatacagaatgctacttagtaaactttagtatttacagaaaggactataaaagcacctctgaaagctgcaggagcaacttggttggttgccttgagtttttccattgcttcttggcgtcttccactgtaccgagaaactaacatgatgttactcaaactactcaactgggaaggtaaaattagaaaagttaaatccagtataaaatgggagttgtgggcagttaaacatcattatctaaaggaaatggatattaatttcccacaagtgataccaatcctgctagctagcataggattctgaggtgtagtgtattacgtttcgcaagattatctatatgcacaatcctcttttcctttctgtaatgcttgttatgtctaaatccttcctaaatgtcaacatataggtaaaaaacgagtggctaaaaccagctatgcagatcagggaccaaattgaatcctattaaagggcaaatttacgagcagattagatagaaacgacccaaactgctcaatataaagtgtttggattacaaaatccagatgtctagcaccggacctccgatagagcagcgtagacatcgcgagcatgagcatcccgacggcctcaccgcacccctcgccgcctccctgcaggttcgaggccccctgctccagtatccgcatcgcctcatctggcacaacagcaacagcaattcagctcacacgacggagcgaccgagtgaggctaaaaaaccctagcgctcagcggcaccacgcagcaatggggggacaacctggcgagctaccgggcctggctccgccgagggcgtagcggaccatctccgccgccacgctctccggctgcgtcgcgccgccggtggaggaggttgcgtagtggcgggcgcgcggcgggcggggcttcggggagaggagcgccctcgcgagggccgatcggatcgggttcatggctgcgcctgcgcctgcgccgccgccggccgccgcgagtcgccgcttgaggagggaggagttaagcggcgagagccgaggggaagaagtgcctaggaggctagcggctcgtttggttggagggagtttctagcagggattgggaggttagagggaagagactattaagtgttttgattggttgggagagaattttggtgagatggggatggagaattgagaaaggaactccctcctttttaataccttggtaggggcaggtaattgggagggaattcctcctttactttgtctaagcaaatctcagtcatctgtttttattaatgacctaatctccaactaaactccctatcaatttccatcaacccaaccaaacatgatattaggattaaaaatcaaatttctatcttaatctcatcataaattcccttgtgtaaactcccaatccccttccctcacaagttaccgaacaagccgtaggagaagtccagaagagtggcagggtccacgtgttcaaagcacccgtgccacggcccatgggcccttttactgaatccacaggccttgtaggcacgaatttgcggatccctattccctagcgcatatactacagtcgttgagtagatacgatgaggtaccattttttggtatctcttgatacctagataatgtgaggtatcaaattttatattatcttatggtacctcttcaagaactataaaatctctacttctaaaccctttttttaggggtaaatggcaggagctctgccaatttcattaaggagagtagagaaaaagcaacaaaggttttttacaaacctagattacaaaggatcccaagtattcttctatcaaggcaaaccggggagataaggggctaaaattttaagaaaatgagaagcaactagaaggagagtacgggcactactcatctagaacatgtgcttcaacgtaggctttgcacatagcgataattgaatcaaccacttgcatcactgtactataaatgccattgaagactcttgcgttgcgctgtagccaaatgccccaagctatgtagatgaagaggtcataaaaatttcttctttgttctttggccatctctcttctgcaggctgaccaccatcgtagcatatctccatcgaaggtggaagccacatgcatgtggagcccgccttttgccaggtgtgtctccatacctgtttagcaaaggcgcattccatgaggaggtgcgttgttgtctccggttctactccacacagaggacaaatgtggctgttgtcccatccacgaagctggagtttgtcggctgtgaggatctttctatggatcatgagccaaccaaagaatttggatttgttttctaccttcgccttctagaagaaatcagacatattgtcttgtatgcctccaacgaactggatcctgtaggcggagtttgcttaatatggtccatttggagtccatctccaagctatcgcatcgtctatgccttcctgcaactccacctattggatttggtgccatagaaggatgaattccctaacctgtgttgtggtattcatttgtctcatctttttcaaccagttgttcccttgtatctcctgtgccactgatctgttctttctcgtggctaactgatagagggaacggtaaagttctttcaggggtgatccgttcaaccatctgtcatgccagaattttgatttgttgccatttccaagggttatcgtggtcgaaactctgaacagctgcttgtctgtttcatcacaaagaagactcgatccctgccaaggcttgttgacggcggtccattcctgccaaagccagcggagtcttaaagagcgaccaaaaagttcgaggtttgttataccaaggcctcccatgttttttggtctacagaccctcctccagttaactaggcagtgtcccccctgtgcctattctgaccctgtccagaggaagcccctacgaattttgtcgatctttttttcaacccattttttaagggggaaaacagtgaggtgataggtcgggagggcagagagggtagactttatcagaaccgtccagccagtcttgtttagtaactttcctttccatgttgggagcctagccgagaacctatcgatgagaggttgaacatctgattttctgagttttctgatgtggagtggaagtcctagataggtacaagggaagtgtttcatctgtgccgggaagggggagagaatatcctgtaagttgagggtgccacatctaatggcatagacttcgcttttggataaattggtcaccatgcctgtcgcgaggccgaaattttgaagaatcatttggaccgtttggaattcctgtttatctggtctaaggaacactacaacgtcatctgcatataaggccatattgaaacgagcagtcggcctgtggagcggttggaggagacctgcttcctgtgctgcggcaaggagtttttgcagaggatcaatcgctagaatgaagagcatgggtgatagagggtctccctgacgtaatcctcgtccatgcaagaagatgtttcctgccttcccatttaggaggatctttgatgaggatgttgctagaatggaaataatccatccaatccatctgtctccgaatcccaatatctgagtctgtctaggagataaggccagctgatcgagtcgaaagcttttgcaatgtcgagttttagcagaatcgcgaggattttggacgattggaactcacgcaccatgttgtttacgaatagaaagttgtcttggatgtttctgccttttatgaaggcactttgatttgttgagaccatctgttgcaattttggggccaatctgtttgctagtaacttggagaagagctttccgaaggcatgtatgaggctgattggcctgtaatcacctacccttagagcatcagtcttttttggtagaagggcaatgtaggctgagtttaatagccatagactatgagtgtcgtgattagcaacctgatttactgccatgacgatatcttccttaattatgtcccaacacttttatggtgaggacttttatctaaaaacctttatagaaaatttcagtatggaaaagtgtgcgttagaaatatacatgtgtcatatgttaatatatgttaatatcacaagtctagtttaaataaagatacacacagatatattgaggccgttcagttcaactgggttgtgggtgtacaaccgcagcgctgcaactctcctacataattttttgcttgctggtccgaacacaccatttatagaagtccatacaaatttgttcttgaaagataaactgatgataaacaaatatattccgttccttgaagtatcaattgcttccaaacagcccgtgtagtatcaagtggggattaattatcttatccttaaaataaacaggtatttttaaacgcagcaagtgttgtctgaagtcgattccttcagatggtgctgttcataaaacggctgaaatgaacagatgacaagaaaatcgaacagtaaatagtttcttgactccagcaagtgcacccatcgcggggactccgtctttaattccatgcattgtgccgtctccaataatgaacttaccatgaccatccttggtggtgatgatttacagtacaaccaatctcttaattctcgataatgacttccaagaaaattaactaagcctgatttttctacagagcatttttaggaagtcaaactcagacaacacaagttgcacgtagttgcagtctagcttcagaatagtgatatatcgcatacagtactgttaacgtcaaaatttagcaagccccagagttatcatcagcttacagtcactatcggctttagcgtcttggaatcatccaatggaaattatcaagtcttcaatagttggattcttggtaaatttggttaaggaaattaatcaattaaagtaagtttatcaaggatgcggcacgacagtttatatattaattaggaagagtctattagtttcgtttcatctttagggaagtgtgtttagcattcgataaggcctatgtttttctttttatctttaggaaagtttatatcatgtccaataaagactagtatttacccatgggtataaatatatacacccggggttattgtaaaatatcctcgataaatacaacttcggcatatcgccaccttttacatttctactttttcgacgagttcttgcttcgagttaggcatcagcttcgatcttctgacaagaggtatgacttgttttagcggtttgcattggtggattagggcatcgttttagatgttctaatctatcttctacagcctctggttatcatatatcttagttaatctagcttagcatattaatttgataacatcggatagaattcgttttagggtttatgctggtatcggctaaattacttgttagattagattaactaagatatccacaaccctgaaaatcagtcaaatgtttgattgtcagtgatgcatcagttaagtttgatctactaagtcgtgcttagaaccataatttctagcttgctttttaattgccaataaagatttcatcagggttttagttgataagttatccatgtaaagcgggtaggagtcctctcgaggacataaccacatccaagatcgtcaaatcgatacaatacctggcatattataattcccaaatagaaatagagtattacctctcgtcgaaagggcttaaatctgtctaaacctcttgtcacaacccatctattttagctctcgtgtggtatcgcttttcatatttcatattcttagtatcgacaatgaacattatgcttatgcatgagttagtatccaacttctcttgtgtttttactcatctcctccggttaataatccaaattgtaccaaccagcttctaactgaattactatagaaacttgtagaatccctgccgtacaaatattgcaaatactgttcagcagtagaaggggggagattgacgtgagattaagggagatgaaccctaataattatggtgtgtcatcaagatttagatgctataaatgccatatgtcgaaaccggaatatttaagctcatgtgcacgcatgcaaattaagttgtcaagactcaaaagagatggttgacataaacttatcaaacagaacctttgaaagattagcttgataatgcgattaagtgagagtgagcgtcttcttagttttcttttcgttaaggattttatggaacactatacactggacagttatagcagccatacgtacagatatcagttaccatcagacaccaaacatgtcgcactcgaccactccagcaacaatgacatataatcaagagcttaagcctgtgtgtaagtcaacagtgctggtaattaatatctccaaacccagaaaatcataagcgaaaaaagtcctgaattgaaattatctggctaccgatcgatatggagtattaccttttaatcttttaatagatgacgtcattcgtttaactattcgttttattaaaaagatatataactataatttattttatttaatatttaaaatataatttatatcttatatatttatataaaatttttaaataatacgcgtgatcggcaaagtcgacgacgtcatgggttaaaaatctcagaggcacgaattgtctcatcgatctgacccagctgaccagaattattaccaccgggaaaatgatgtggagaggcagcagcttggcgcttccgctttcagatggcacgtcacgcgccacgtgggtagctgcgtcatccttcccgagatcgtcggaagctgtgtggcaaatcaaaccgcgacgctgatctgatccagcaggttgttttcagagcaatcaaattctagcaatgcaggagtgactaaacgatgaggtggagagaagaaagatgggagggagatagtcatctctcatgtaaggggctacccctacataaactacaataaatatgtaagagtgctagagatattagagattgtgtggtagagataacctcaggtcattcccaacccaatgactacaatgatgtcactgcacttaaaataaaaaatgatgtggcaagtgaataaatgaagaaagagaaggaaaccagatcttgcatgagacatgatttctacacaacatacaatgcatcatgtgagataagtagcattaaatttaagtatgaaagagtggtgtttgcattgaaagagtagtgtatagtactatttttttatgacgtgaagtttatagaaactatgtgtagtgtcttgagttgagattgatctaatacatgttacctcttaattaatagtgtatatcatgtagaaattggatggggtagtcatctctactataaagcttgccctaattgcttgaaacttgtctgttaagtaaagactggttaagagagagagagagagagagagagagagagagtaaattcgagagcgatcgatcgaagatgtttgaaaaagaaacggagaattcgtgttccagattagatcggctaactgcatttaattaatttccgtggagactcgcagacttggccggggttttggggggtgctgcaaatgcttgctaatatcactatttgaattatttgaaaccgttagttgcttagggcacccataatggttatctataggctctctataaaagatccatgtcagcatatttttcttagaagagattaaatgaagagatagactaaagctatctactaacccgaagatagtctatagaaaaaaacgaggcaatggattagagagctatagatacccatgtagacatacaattgagctgagatgtacatgttttatagagagcaccttactttaccattgcgggtgctcttatgagatactcggagaaacgcgcagtgctactcctccgtaaggtagtaagacgatttgggttcaaagcctcacatcttctaattatttatattaggttattttttaatattcgtgtttttttaaagatgctatcttcgttccataaaaatcaatgtaatactctgaacagaaatctctgttcagattcattgtattaggatgtgttatatccagtctatacgttttttatgagaatgagcaaagtatgcggcttgttgtctcgatgaccgatctatttcccccctctctatgttggatactgttctttagtacgctgagtcatgttaactgtttgttgatcggaccctccatcagatactatgcatggacgaacacaaacgaccctttactcgtgattgttcctgtcgtgtcggctaattgcatttgcagcttcccagatgctgcatcaataatcaatctacataaaggctagagagagatacgttgatcaggccatatgtgacttggtcaactgtcctaaagtcagaatgctagtccaaagccaagagaagaaaaatcagattgtaataagagtataagaccatcagcacaggaggggacctgacacagattgttgcgatgctacatctttacttcttgtataaatatcctctcaagtctcaccatctacttagctaatatagcctccctccgtccctaaatatttgacgccgttgacttttctaaacatgtttgaccgttcgtcttatttaaaaaatttaagtaattattaattctttttctatcgtttgattcattgttaaatatacttttatatatacatatagtttacatatttcaaaaaaaaattcaataagacgaacagtcaaatatgtttaaaaaagtcaacgacgtcaaatatttaggggcggagggagtactatcctctattatga

SEQ ID NO: 79005 - DNA, 1355 bp, Oryza sativa
tgcatgcatattgatttccaaccaaactcaacaacaaaatcacccacattcacaaaaacatcatagaatcatccacaatttcaacaacaaaatcatccacaaatttacatcacaaaatcatccacaaatacctagattaattagatcatcaattatcagcttcattctccatctctagaggatcaaatacctagatttattagatcatcaatcctgtagcctaccgccgccgcactgggcgccgctgccgcctgccggtcgaggaggaggagaagaaggagtggaggaggatgggaaggagtggagaggcgtgcgggcatgcgacgatgccgaggagataaggaagagagagagagagcgagagatgcgtgggagagagatatttagtcccgcttagtaataccaatcgggattaaagatataatctttagtccaatttgttcggaggcctgacagctattaaaccgagactttaaaatgatcttgttaccaatcgagactaaagatcaaagagagacgctgaacttttgaactgggactgaagaaagcttactacactattaaacttgctctaattaaagtataaaattttactgctcataagggaatcttttcctaccgatatgaagttttagtgcatatgtagtttcgtacgtactatataaatgtatcaactgtagtttcacagtatccctttttggttttggataaatttgcaattctaatactgacaacaattacttatgcagttgtagcctctaccgtttgagctgaattaaacggtacagactatccagagtgctgtagcaaaagtactatataaaagtttttttttttttgattctgctgtttgatcacgtagctgtgaatctgaattgttgatcatcaaaatatcaaaatgaagggctgaatatatatatacagtcctaagtgcagtcatagttatggctggaactaatctcaatcctcgaggaacgacaatacttatttttctttgaaatctgttagcacgttttttaaacatctaaacgatgtgtttcgtataaaaattttatctgtaaaattagctataaaataacatataaagttattttttaaaaatatgtaataactaaaaaataattaatcatacgttaattccctttctcttctttttacatgcccaatacccattaactctatctccatcttcaccatttcaaacacctctctgcggcgagaaaatggacatttagccacgtccaaaacagggtttcactaaaatgttatcccgaaaacgcgtttcgctaaaataccaatatgaagcgcgtgctcaccgccactttgccagtttggaccttttgtgcattttcgaa

SEQ ID NO: 79006 - DNA, 1171 bp, Oryza sativa
tgatggtgcctgatcgaccgaaatcttcagtatatgtacaggccttgataacaagtgcaaagcaaatcatgctttgcagtttgcaccatatcccactttaattcctgaaaagcagtccagagactcacaccgttgacggaggcgttcgttttgttaatttcttgcactgtgctgtctgccaatctactcatcacagaaaaggtttgagcgctcctctcccagaaaagctcagtggtctcgccgtcaccagaccgagtgcgacacacgttgtgttggagaaagctagtctagaatccggggcccctctcccggagactacactgctagtgcccgctgccctccgtctattggtttcgcattctcactgtagctcgagcgagacggccgtcgtccggccccggcctacctctacctgcgacggacgcgtcaccttcatgggatcagcgctcgacgccggatcggctccccctcccctcccctcccctcccctcccctgccttacctccgcgtggtggcgcgcgcacgcgtcccgtacgtactcccgtgaaacggctacaggacaacgacgacgccagctcacgagaaacgagaaagggacatatgattaattaagtaggagtattaactagaagtattataaactttaaaataaatttatttgatttctaaaaataatctacatatttctttctaaaaaaacgtactccctccgttccaaaatataacaactttagccctcaagatttgtcccaaaatataacaacttcttccccaacattctcttcttaaccaatcacaaccctccaccatttactttttacacctacccccactactcatccaatcacaaccctccaccattcacttatacctactttcttaataactgtgtccaactctaaaactccttatattctgaaacggagagagtaccatttagcatacttacagaaaatgagagagtagccaaaatgaaaagtttattcaaactcagccttatataagagacaggtgtcagcgataaattaattgatgtttgatgacatctctaaggtcattcccaactcaataactaggatgttgtccataatactccctccatttacttttgatagttatatttcatcctgacacacagaccaatgataagtaattctacttatcatccatt

SEQ ID NO: 79007 - DNA, 3018 bp, Oryza sativa
  unsure (1)..(3018): unsure at all n locations
aggaatctcttattcagcaataccttgatttcttaaatgttgcaaacaagtatgtgctacatgttctctatttcactttctttacatagatgagttatatctcatatttgatatgttccacccttttctgattattcattctgtttatttgtggatgcagggaagaactacagaagttgaaagtatgttccttgcttctcatcataatctggaggctattatagcagcctgctctttctgactaatttttcctttgttagggcattggtgaaaggagggcagagtacattcttgagcttcgagaagattcgcccagaccatttaaatctgtaagacttctagactactaacagacaatcctgatagtgagatcattggtcatcttctaacccaaattgatttgacagctttcagatttgggaaatattggtctatcatcaaaacaggtaacattttgctcttgttttctgtaggcacattatcatatcgacacgtcccttcttttatgtactaacataaaactcctaactaattcatttatgtcgcgcatcgaatagatacaagatattttgtgcaagacagcgactggaatcttcaaatgatcaccggaatggaaatgccaccgaactctaccactttgaagatgctggctcatattaacggtcagattgttgtgggctattgacttgtgattatcagccaggtctgccgctgaatcaagttagctccctcctgtattgccgaatttaagcaatctgtagtttgtgtaccatccatgattccttgggtgtaattgtagctgtagtcatctgatgtactactagagtatggagcaatggttgctcctctctgttgtagattttctccgagaaaccgccgtttaatttgagctgacttgcacgagcagcaggaaatgaaatttgtggaatatttcttggtaccttgagcattgaatccgtgaatttctttcatgttttggtgaattcgagcaccagtcttgctctttgttgcagattttctccgagaatccgcattttttactttgattagttcattctgctgaactgaaatctgtgaaacgtttttacattccttgaatttgggcaccgatgctgcgtgttgtgtatttactcacagtgcaacctttccaaattttctatagtttctgaacataacacacaataagaaaaaccgtattgtagtgtatttactgacagtgcaaccattgccaaattttctgtagttctgatttctgaacataaaacacaaggcgtagttctgaaaataaaaaatcgagagagaaaataacatgttctgatatctgatttctggtcatagaacataatgagtcgagaaaaacaaaagaatcgcccaccgtggggctcgaacccacgaccacaaggttaaaagccttgcgtnnnnnnnnnnnnnnnnnnnnnnnnnnctggcattttacaaatataaatactctagtagtaatttacatctgaaatgtggctcaagttttcttcaggttccagaccacagaagcacacaggttatgcctttgatagatttttgtccttgctgtgattaaatccattggaagcacccacaatcctgattgaaccatcccaaaagatatgcatagtacagtaggagttaaggagtatatgatatgatatatcacctaaagctttaacatcatttatatgcaaccagttcttacggtgattgcacggatacagctttgaggcatgaaaaagacacccgtccttctcttcagctatttgctaccgtcctggacagggcgccacttattcgttagcagatcattcacaagaccagactcgagaactcctaaaacagctactgccaaatgactgaattggacaagatgaaaacatcttcgatttgcatatagctgttggcctctcgttgcataaccaattgatgcagatgaatccagcagacattttaagattgaatacatatatatgcttcatcctttgtaaaatataacaatcttataacaaattagacataaaaatccgatccggacagagggatcatatcattttttttcccagtatgcctgccagcattgccagcaagggcaacacatagaccagcatttatcacaagaaaataaaatgcactagtagtagttgtgtccattgccatggatccaacaccaaatccttgagcggtagggcacacagttccctttcatggctaccttcattgctgacagtgtcgcgatcaggcggtcgctatccccaatctgttgacgcgaacaaataatgccacggcttctccggctaaagtcgcatgaaccccacactgtacttggctcgtgatgtgtttttttccttccatttccatcgtgtcacctgatcgctctcgaggctttcgtgtgtctggtgagctttggcacaacacgccaggccattcctcgccgttgaaacgttgaatacgccattttttttggttgaaactacggacatctagctgtcgacagtcgacagtttttgaggctgaaaactttcgattttttgaccgtgcgatctgcgccgtgattcctgtacatgtgcgcttgcaggggctggctcgaacccaggacctccatcctggaaggcatgcatgcgcatgtttttgagaagttagatgagttatattctagttatactccagttacaccctagatataatgtaactacagtgtaactgcattgtaactacattgtaactactatgtaactaaaatataacaacattatcatctctatataatttagatatattgttacatatattattttaatatttatatatgagttacattatacttatatacgaaattatattgtaattatactatagttagatttgaaagttttcttcttaaaaaactttcgacagttctctagatagtcccatgctgtaattgaaaagtacacttaaaataattttaaatttcaaactctttttcagttttgcctatctttttaaacttcaaactcttttcagggctgcagg

SEQ ID NO: 79008 - DNA, 588 bp, Oryza sativa
gagtaacaatgatgcgtgtacaatgtgatacaaggagggcactacctctatcaaggggttactaatgttccagattttataagacatagtattcgagtactcaaaaggatcagtgcaaactctattcatctggtcaccataatctagcaaggttgagttattattctctaggaggaccgaacctgtgtaaaatcctatgcttcctgtggtttaggaagcgatcacaaccattaatccccactaccgaacactatgtccctcacaaatctaccaactacgaacattgacacattatatgcttattttaagagtgggtcaatttcaaatcttgtgattaaaaggatttatgtataaatgatgtcagacatagattattttgagaacttaagtaaaacccactacatactagccagtgtcattgttcgataccgatgacttactcctatctatccaccattttaccgtgcaccaacaagattgttttattactcaatagtgtcattgatctataagagttttttttatgataggttgtaagttactcaactttaatatatatacattgacaaatcactattttatactccc

SEQ ID NO: 79009 - DNA, 1317 bp, Oryza sativa
ttgcctctcctttcgaataacctcatgtctacacatagtaagcctttagctagctagactttagctactattagcatcttttgtggcttgttagcggctaatatgttcagatgactatatacatctttcgatatagctagagggcaaaaatattgcatctattacttaggaacaattacaaaaataacatatatggcttttcagacacatatgcatgatcagtggcggagccactacttgacaggtcgagcggccaccgggtagagatgttcgatcttcatcgatcaaaccagactcaacggcgtacgtcgctggctccgccacagcatgattatgactgaggttaattaaataaaagagaagcaagtagcaatgagactaccactcacgaacgtccaacaagtagcaacgactactcatcaacgtctccaagtagctagggacgatcgagtagcaacgatacgccaaaatggcccaaagctagctagcaaagccgcccaagctaaagctagtgcacgctccagccacagaaaaagcaaggccgctgctgctgagactgagagcgaggcgcgggcccggaaaaatctccgcggccacctctccgccaatggggcggcggcgcccacgtgacatgcctccacgtccccctcctcccccaccacctcccctatttctatctcctctcttcttcttcttcttcttcccccatagtttagatagataagtaagcagtgagctacctagctagctagctaacagtgagctgaatcagcagcggctcctgtctcctggagcttgctgatccagtagtccagtactactctgccattagctaagctagctggagcttaattagtggtgatctctgtctctctcaagctaggcgccatgggagactcatcatcctcagcttcgtacatcagaatggtatatatacttatatgctagtatgagtttcttctgggttgtgtgtgttagctgggtgtgcatcaaatgagaggtgtttacaattaagctgccattgttaattaattactgcaggttcaccacctgatagagaagtgcatttgcttcaacctgaacaaggaggagtgcatggaggccctggagaagcatgccaacatcaaccctgtcgtcacttccacaggtatacttaattacttacccacttctcttcaagaacatatatatatctccatgtgcagtgctacctatagactctagctagtttctctcccaaattatatatatacacacgtatgcgcattctcttcgcaagctagtggttgcaccttattatatatgcatatatatcat

SEQ ID NO: 79010 - DNA, 5359 bp, Oryza sativa
tcataagggcaaccatgtaaaatcccctataatcataaaccctagaagaacagagcctataatagggttataaatagccccctaaggccatgtaatggggggatccccaaaaaatttctaatcaaccaatacagtcgtctttatttccaacctgttgagagagccacgtcgttcgacgtgacgcagttatcgttcgacaacaaaaactaagcaaggaaatagaaagtggtactctatgatctgttctgtctctcaattgcctaaggtggtgacaagcgtgtattccacaaatgttagtcgtaagggtaagcctccgtgcatatttaattaacatgagagagagtactcaaactgtgcgcttgtacattttagatatacaccattgtagcaactcctgattaacaaccaagtttttgtttccctttcgtcctttactcgggacgagcaaaggttcaagcttggggggttttgttgacggtcgttacagacaaatttcgaccgtcaatataactaaaataatggagaattagctatgcttacaatgcattttgtttccaaatagtatatatatttccacttgtacatggaaataacatgttacaggaatttatcaaataaaataaagagaaagcggagaaaacctcactcctaagcaatcaaatggataaggagggcccacatgtctggtgtaaccggcagaaaccgctttaactgccataaccacctaaaggacccacctgtcagtgccctgcccgaagctagaggcctgctgggccggcctaagttcggctgaactgccgaaccctaatggcgacggctcagcttggccctccacgtgcacgctccaaatcgcatactaatgacggttacaggggcaaaatggacaattcgcatagctacaaccgtcataaatacccaataaaaggaggagctcattcactctctcaacacactcaagcaagctcaaattcttcttcatactttagtattagtagtatagtgctaagcggagtagagtagattagtattcggagtcctcgaggtctccggaagagttttggtatggctctagcagctcttgtattctcttctgtaatactttccgaattaatgaaatactcatttttatacatcttcggtattttgttcagtctgagtactggtcttacattatatctgtgttatattaattatgtgggtagcctaccagagaggtgtaatggtgcgggtttaatgtctggttaaccagttgctctatgtcgtgtgcgcgggtatagagtagtatttagtaatgtaagtgtggtacttagattattaaatatcattaattgggcatatatgctgcgggacagtagaggtgggccgctgatggtgatagctcagtactggtattcctccacgttagtatatattcctaagacaaattcctggggagggtactcctccgtatttagccccggttggacggccatgataggttgtcgtaaggaactgggcaacccggggtggtctctcgatgtaccaggaggacactgtaggggggtattggccatatgattgtatattagcagatgtaaactaggaattgagtgtatgttagaagtatagtaattgagtgctttctattttttcttccacttagttagaattattttattatgaggagttgaatagctttgcttcgtgtcactctacccctatattaaaattaacctctgcttagattttgataaatacaaataatgtatgtataaagagtattagcatagtctactcatattatcttcccttggaattaaaaatacgataccttggaatacttccgggtgaaatgctacaatagtatatccgtgtgcttgcggataacttccgtaaccataaatataccaggacaatttctgcgccattgctgaacagtgactactgtgacgacatgggtatcaagctctgcttcacctcacccgcccaccccaagagcaacgttcaagcggagcgtgccaacacggaaatcctcaatggcctcaagacgaaaacttacaacgtcctcaagaagctcggggactcatcgatcttggagctgccggcagtgctctaggccgagccgcgcaatagaagaaactccatgtttcctcgtgcacggggctgaggcggtcctcccatccaagctgaccctggggtcaccctgggcatcactgtataacgaaaatgatcaagatcagcttcgacacgacgacctcaactaccataaagagcgaaggcaacgtgcagcccttcgggctacccgttaccaacaaagcctgcggcgctaccatcagtgcaacgtccgggcctggtcactgcaagtcaaagaactcgtcttgtgccacgtcccaacgcgtgcaagattgagcaaactctcacccatttgggatgatgttgagggtcgttagcgatcaatttcgaccatcaatattatcaaaataaaggagaactagttatgcttgcactgcatatccatgttagaataacaatattccacaagtgttaggttcattaaccttttgcagagaacaaccataaagtggaagagaaccgatatcaactcaaacgataaattaattggacgatgtcgagaatcagacttatgtccgaatgggccaagaactcagaattgacacgatcaattgggccaaaattcacaagtctgcgaagagaagcaacagaggaggcagccagccaaaacctgggctggttgggccggcacctggttcggccgaacccccctggcgccgttggatgcagggtttcttctagacggcgtggatcactccccaatgatggttggagggcagttccgaccattccaactgccacaaccgtcattggcagcctatttaaggagctcctcttctctctccacacacgcacctcaagcaagagctctctcatattcactcaagatagtttagtagtatcaagctagtggagtaggaatagagtagaaatcggagtccggaagccttcagaagagttcgggtatggctctagtagctcttctcttctcttttgtaagctctgtacttttattagaatactattctatatacatttatggtattgaaatactttccgagtacatgggtacctactttacattatgttcatgttatactgaatatacagctagcttatctgggagaagctgtggtgtgggtataatgtttgcttaagcaattactctatgtcatgatgatgatattagagtagtatctgttagtttaggcgtggtatctagatttggggatatcattatttggggttatatgctgcagatgagaggtgggccgctgatggtgacagctcagtacgggtattcctccgcgcgtgtatatagtcctaagttaattccctggggagggtactcctccatatttagccccggttgtatggtcatgatgggctgtcgtaaggaactcgacagttaggggtggcttctcaaagtaccaggagggcatcggatagagggtattagctagtatgtcagataactagaatgtatgtatactatgtatactagaagtataggaatagattttctttctcttttttttccacttagcttaggtaatttagtatgagaatgagtagcttcctgcttgtgtgtcattctacccttcgattatcttaacccctgcttagactatagttattacaactaacatataaattattagtcaggttctctctattatgatcttcccatgggattaaataaatacaatacccttcgaatactttggggtgaaatgctacaatggtatatccgtgcgcttgcggatgaactctgtaaccataatataccaggagtatttatgcaccattgctgggaattatatttctagtaatgtcgtttagaaataccaacaagcatttctggcaccgttgctggggaagatttgtaatagagattaccataactagtactttatattttcctctgtataatcactgtcctttgcaggctaaccttggttgttttcacttttattatggaaacagggtagtgcacgactggttttaagttgccagaaaacttcaaagaaaatccagaagctttcttctggagcgtcaggccgcgagtcgctgctcgacagaaaactctaccaacagagaaaccagccgtaccagcgtcaccgaccttcaagactatgactaacaagactctccgtgaattcgctgctccctctgctgacaatgtgaccattgggccacaaattaacctgggagacgtggattttgatttgaagtctagcctcatcacgatgcgcaggctagccctttctgtggcaaccaaatgagaatgccaatgctcatttacagtagttcctagagatttgcagcacatacaccatgaagggtgtcagtccaaacaacgttaggctacgactgtttccgttttctctccttgggaaagcgaagaagtagttttatgctaaccatgctacgatcaatacctgggatagatgcttcacgacattcctctcaaagttctttccgatgggcaaaaccagcgcccttcgcggaagaatttcaagtttctaggagacaagggacgagtccattcctgaggcacgggaacgacttcaagaatatgtggccgcctgtcctcatcatgggatggatgactggctgatcttgcaaaatttctataatggactcactcccatgtcccatgaccacctagacacggcagctggatgagatttcttctcaaagacggttcgaggagccatcgatttgatagagaagatggtctctaatatgggttggagcgaggaacgactccaaacccgtcagcgaggcatgcacaccgtcaaggagatggaaatgctcgctgccaagatggacctcctcatgaaatgattggacgaccatgacaaaaggccacaaggcatcgtcaaagccttggactcacacgttacatgtgaagtctgcggcagcacgggtcattctgggaatgattgcccggaaacccatgaattggcgatgtacatgggcaacaacaacaatgggtatcgtccacaaggaggtcaggggtggaatcagccatgcccatattatcaaggagctaacaacaacggtaacttttctaaccaaccctccttgaaagatctcgtttttgtgcaagctaagaccactgatgctttaagcaaaaagctagctgccaattacaagatcttagaaaacattaatgttaagctagatagcttcgcttctgctttccaaaaccagctgagctttaacaaaatgatagaaacttagttagctcaattagctgccttagtacctgcaaatgagtctgggaggattccggggcagc

SEQ ID NO: 79011 - DNA, 2224 bp, Oryza sativa
caaagccacgcagcaaatatgcaagtgcacaggataacaaaggatggcatagtagggtttcatttgcaaaagcagcatttagcaaacatttgagaattataaaacagttaagtgataattaaacaatattaatccaacactatacaacataccctgttgcataggcccaaccattctgaacaaccaccccggctgcacagttctatctccaaaccaggaatgtaccattccaaaccaggagctaatcaaattattaccaatttaagcatcttttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaactatgctatacaaacgataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttatcccaatagtgaatcataagttatcccaatagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggacggccgagatcgatccaatccaaaacggacggccgagatcgaacggtccacgaccggctcacggcggacgaccccgatgacgtcagcgatgacgtcaccgacagcggcggcggctcggcggagcggacggctcgggtggcgcacgctcgccggcgaacggcggcgctaggacgcaaacggagggcaccaggacgtagaggacgacgcggcgaactcaccggtgaccaaaacggcggcggaagatcaacggatggcgacggcgacgaggaggaaacggcgaaaaccttcgggttgacgacggcgacgaggctccggcgatctccggcgacggcgaaggggcggacgaggacggcgacgacttggcgaccacgacgacggtcttcccgagcgacggcgacggctgaaacgacggcggcgcacggctggagcggcggcggcgacggcgaagctagggcacacggcgctagagctcttccgacgacgagaggcgaaggcaagggtggcggcgggtagaggagacaccgggggtccatttaaaggggctcggaggcggcggcaaaggcccacggcgggcggcgacgaggaaggaaagattggaagaacgaatccgagacgaactcgaatccaactcattccaaaacgatttagccaaagattccaaaggagaaaaggtagagaagatgccggagattgtttcccctcaattgattcggccggaaacggaaaggaacgcccggattggaaaagcggcggcgggggcgcgaaactaggtgtacgcccgaaggaggacgacgatcctgacaggagggttttttaaatgcaattccatttattaaaaatactttcttagctcaaataaatcccagaaaaatctgggaattatagaattaagcaaagtatttaatgatattttatctggccccattttatattggaatttattaattaaaattagatcttctcttctaggcttttaaaattatttctaaaaattccaattaaacaacaatttatatattttgaatttccagggtgtgacaaacctaccccccttaacagaatctcgtcctggagattcggaagaactggtgaacagatgcggatgagctgacttcaattcatcttctcgttcccaagttgattcttcttccgagt

SEQ ID NO: 79012 - DNA, 4064 bp, Oryza sativa
ccgcgccctcgggtgcggctaacgcgtgggacccacggcgccggctggcgtaaaccgcgtgcacccagtccaccgtggaccgtgaggttgctgcgtggccccactcccgtggaccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctagtttttccttaagaagtcaagaacccatttttgtgctttgtttctgcttgttatatggggtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttacaaaattaggttgatttaaattattgcattatcgctttatttaaattcccgcgttatcactgttttatttagccatgcctatttacctttgttatgaccttattattattgttattgttattattaccttgttcaccctagaataaacaaaaccccaactagtggacactctactcatagtaccactagtataattttaggtagatgcttcgcaatttaattaggtaacattaggcggtttacaactctagactttgggaatattcatatcacctggacactttggaatggtttggttgttgtggaattggcttcacaccgccccctctattcaaaatccccaaaatggttttaggctgggctcggggtgcatggttttgatagtagcacctcggccatataaggaccggttttcgggcctctgttgcaaagcactaccgtacttccacatgtctagtaggtaaggcttagtttgtggctcagtctagttataaacaaaagtacacggatggagatggacgaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttatcaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagttctaggatcgtgtttacaaaatagctttgagcaactaaatatctttaaatgctgtttactgcaaccctaaccctttatagtataactcctttgtactcccttgcatttattctgcacttgtgggtgtgtcttgttgagtacggtggttgtactcagtcttgctcaatttttcccaaccccagaagaggagcccctagaagatgaaggctttggtgtctagctcgtgcctgccgtcaagtgcctgtggtcgtcgccctagtcttccgctgtttctcgtttgtctctgtgtgtgctgggccttcgctgcccatgtaataaattaactatttacgcttccgcttgttaaactttgaattgtatcaacttttggtgtaccttgcctcctgggacaaggattaatgcacgcacgtaaggaacgcccgttgggttatttccggtcgtgacaagttggtatcagagccacccttgaccctaggacgagccgtagatcccaagccatagcagtattttcgaaataaaaatcctttgtatttgtgaaaaccctctagtctctctctgtcttgctgcttcatttatcgccaaaatctgacctttttaaatgttgcttttctttttggttttgtttgtagatggccggcagcgtcagccgtcgtggcttggacatgactggtttcgtcttggagctgcggggcatgtgcgttgtcctggggtatccgcatggagtggactaccaggccaggccgctttcggatcaggagggtgacgatgcagagccccacgctgcgtgggaggttactgcagtgatcctcactggctctcccgagcggacttcgctggcagtcaccgcgggtggagattctttccccgccgcttaccaaaacgccgctctcctcgccatcggcactcttcaccagcgctacccggacgagttgtagcacttcgcctaccggtaccacccctgccgtggaggagcccgcgactacgccaccttccgggatgctagctcgaagaatgacgctaccatcgtgcacctggcgcgcatggtggaggcgtacgacgcggctcgtatcgacttccatcagatggtgcgccgtgggatggtcgagaacaacttgaagatcctggagctgcatcaggagaacctgcagctcaagaaggacctagacgcagtggaggcgcagctgcatcagctcaagatcgcccagggagaggtctgccgccccaagcgccaccgcgtctaccgcagccagaagatcaccgcccgcaaaagcacctccaggcccgagcttgttcgtcagtccctggcgtggacctgcttcgtggagacccctcgtgccgagcccgcgcccgtggttccccaggaggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccgtgtgtggtataactgtgtcggagcctgtctttattttattcgtctaagcaacttgaactttaatgaaccaatttaatagcagtaataaattcaagaattatggtagtcgtgggtggttagctttaattgtcagctctctctctgtttgctggttctgtgtggggttttcagatggtgatgaccaggagaagtgctaataccggtgatggcaaccaacctgaaggcagcaaccacaaccaccagggcaggccacctccacctcctcctccgcctccaccaccaccaccagataccaacgccattctcacccaaatcctcgcccagcaggccaacatgatgactgctttcctccaccaacctccaaaatccgccacaacagaatgctccaccaccacccccacaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggcccgtttcaccgccgctttccggaggacccatgtgcctgccggagtcatggcccttaagaaaagggaattccgggagttgaagcaaggcaaccgctctgtgatggagtatttgcatgagttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagcgccgcttggcgaatttccgcaatcaacagatgctaaccaaagggtccgctacaccaatccctatccagggggatcct

SEQ ID NO: 79013 - DNA, 1897 bp, Oryza sativa
attttcaacgaaaatttattgtgccacgaccacattgaccgttgaaacccaacggccaaaagtgcggccggtgggcccacaggggttcggccgaaccggccaggcaacggttacatgccacttttggcagggtaacggctagtgggtcccacatgtcatttctaaccattgtaggtgtccaatataagccagccagccaagagagggaattccatcccatttcaacacattttcattccctctctaaaggtttctctcaagttcattcaagctttgatagttttccttaaattcaaatacttagttgcatacatacaagttgctttggtgaaactaaccagcgggtgaaattcttgctattctaaccctcgccgagttagtccgttcttgctccattgtgtagaatgaggaggcgattgtctcgtttgttcaaggggtccgactcttcatcaagtcatcatgactagtctatagctcgttcatcagccgatgtctcgatggaggacgccgacgctccgcgacgtctcctgaacgacgccgacctcgatcttgtcgacgatcgggaaagacaagcttactacatgctgagtaatcgggagtatgctcacacgcgagaatactctccgaagctgctgaaaaagataggtatggaaacagacttttgtgccatctggaaagctgttggttggcagagatttactgtggtagatgagcctggttctcgtttacttactttgcaatttttgtgcactttgaaagaaatagaagatggaatttccttttgctttttccataaataatacacacttacatggaaaggattaagtacacttcttggttttcacgattcctgtaaatcaatctccagaaatgaatttttaggttcgagaaaaataggttttgggaagatatttgtggtgctccaatttgcacgaaagctaggacgaatgacgtccataattctacacttaggctcatgcacaaatggattgttatgactttgtttcctagaggtgatcttagacccattaggggggatgaattaattatcttgtttgccatggttagaaagatcaaagttgctcctgtcaaatgtatgataaggcaatggttagaaagtataagattttttgctcctgttgagtgcacttccttgattactcggatagcaaagggactgggggtcatcaatgaccagattgcttatatcttggccgcttgtccctgtattgataagaattatctagtgcaagggcacattcttaaacatggagtagatggatctttgatatactttttccccggttgtacaaatgaaatcccgctgcctaatgcggggtatcatttgtacaacttccataaactaaccattcccctgcatatcatagaagaatctcgtgtaggtggaacatacagggagacacgcaacgtggcaagaaaggaacgagaaggttcatcatcctcaacaccgtgcagatgtatgaggcaggttgggaggcaacttgggatgcgcccggatggacccaagctccacgccacaacatcggagtctcaagctggacaagtgccagtgaggaccggtggcgtgcacctcatgacatacagtgggggacaaccaaccctccagattaagcagtatgcctccatccccaagtgaatggcgctcaagttcctctcgttgggtcttgagtgaaatcaccagcagaatgtataccctcgatgtgcagacgggagatatccaaaaaaacctcgcggaacacatagcacagacgcaagaatggtaacagactgctgatgctcagttcgccaacatcaacaacatacatgatgcagtaacagcacgacgaccttcaagcatactttcgctttcaggggttcaatcattatcaaggaccct

SEQ ID NO: 79014 - DNA, 1546 bp, Oryza sativa
  unsure (1)..(1546): unsure at all n locations
aacctctctacgtctacagtcgataattcctttgttctttgttaaccaatccatgcccaatatgatatcaagggtctgaggtatcaaaaccataaggttggagggaaacaccacatccctaagatgaataggtacgtcgatgcaagcatggcttacggttacctcacccccaggcgagtgtactatcataggctttctaactcctaccagagttaagttgtgctgttgactagcctccagggatatgaatgaatgcgatgcaccagaatcgaggagaactttaaccggggtagaattgatagaaaacatacctatcagtacgccctggtcttcctgggcctcttcagctcgaacatggttcacttgtccgcgtccaaatccggtggcggtcctgttagtctgaggagtcctgaacagacctcgtccagcagcaggggtagcagccccgtgaatagccattgcattagcttcggtgcgaatgggtgtcttgtttagatgaggacattngttggcgaaatgcccatactcttcacaattgaaacagcttnctggcctcattactncagtagcggcctgattccgtgcangagcttcgntctgaagtgtaacccgcctgtggaagtngctatgtgccgtaggaccggttcgttgtaccaaccggtggntttcatcctgatgaagtagcttctttaggatgcttgagtgcgaacttgaggtggggntcatgggcaagctnctcttacgattgtgctncacaaccttnncnngtcgtttncaanctcacgaccttattgatcaaactcttggaactctnattgatcttggccaatcataggcccacgcaactcatcattcagcccttctatgaacttgtcgatcttttcctcttcatctgcgaggtctacgattgcgtagcgggtcaactgagtgaaccggtttagatattcttgcaccgttgtgtttacttgtcgcggacttctgaactcggtcttcttcatacgcatcaccgcagcaagcacgaagttctcatgaaaagctgcagtgaattcattccaagtgggttctccagcatcttcttcccgagcttccttgtaagtatcccaccaatcgccagctggtccctccagttggtttactgtgaagatcactttgtcggcttcgcgcatccggacaagggtcagtttcttctctatgatgcatagccaatcttctgcctccataggcttgtctgccgtagcgaatgtgtgtggcttagtcctcataaactccaaagctcgatcctcgacagttgccttgattgtttgcaatggtttgcagaagttgggtttgggtggccataacgccagccagggtggttaggtcgggtgattgagtctcttcattgctggttgacgcccgacgtcggcttgccatctgtgtaggccgattaggtaagtaacctagtttcctaactagcccttatggttttattctgttaaggaaattgttttgatgtgaacttcgttttgcaagcatggtggaataaactcattcataacacaacagt

SEQ ID NO: 79015 - DNA, 3576 bp, Oryza sativa
gcccccccccccccccccccccggtcggtcgccgtcgccgccccgggtaggaagagagccaagagaggaagagaaagaaaaagaaagcgaaaagagaagagagaaaagaaagagagaaaaagaaagaaaagaaaataggaaagaagaaaaggaaaaataaaagagaaattaggggagagattaggaggatttaggaaataaaaatggttggggtttaatcgtagattatttttggaaattcctagagtgtaatagtatttcgatcggaattccgggttaattataggaatatatttctcgatcggattttattagaattggtggtagtgaagtatttgtaatttcatgaaatattttaggatgtataaatcgaaattcgatttgcctatttcacgagtagtataattaatataaaagaatcgactttcgcattcgacttctatttggatttatttggatttttatttgaattctaaccgaattcaatcgaattttcgcacgtaattttagagcccgagggagttgcggatccgagcgaggaccaagacccgcaaagcttcgaacaaggcaagtcatcactattccttgaacatgttgatctcatttgcaaaattattttgtttacaaataaaattgcatgcaatgatgaacatcctacttgtgattatgccatgtcttgattattgtttacccttaaatcctataacaatgatttacgtataagtccctagacaactatgacaaatgcttagaaatgctactctagatttatgcatactcatatttatcaaatgctatgtgcttgggcaattacctttgggaaggtaattgagatgcggcatgtggagacatgagcgccacattgccataatattaatgacatgatttgtgaaaggaaaataaaactaaacaaatgttttcgactggggcggatggaggatttgggtggtatccggaaaaggctagtgccgtccctggtcaattaaggaccgagccatgaagttaagcctgaaacgactcccgtacaaccgtacttctcgaatgggtatagacctagcggattagatagccgagcggaggcagtatccatgcatagtggtttctcattgagtgaggcaggtgcgctacggtgggacagccgttgaggtagggccgcgaggcgtgccctacatcggtgtcgccattggtaggactgccatgagtgtgcgagaaaaaacttaactttaaaccacaacttaatatgtgtgtgagacttcttcccccgggagcgccagaactcctcacactgctagaaacatggacgcctagagtgtatgaggatgtaaagttcatggagcgggtactgccaatgcgaggttatcgaaaggctttgccgtgacgcgtctcatgtgttgggacgaggctcatgtgttgggcagtcgcggagtgcgggtaagtgtacatccactgcaatgtgagtaaaccaaatctattcgaatagctgtgctcgcagttattgagcaccgggacatgtattacacttggctagactctaaattcttaactgtgtgggatgagatactgcatgaagattttttttatgctgatggagccacttcctaagaggagggaaggtggacgtcctcagaaaaccatgacgactcaatggcgggaagctatccttgggatcacaatggatggtggacagaactgtcgttgtctaatgtgaacattggtattaaaacttgatcagtctatgataggtcttaggcttgtgaaaagaattacaaaacttgctttgcgcaaaagaaccatagccattctttgaataccctctatcatgtgcattgttgctgtggtgacttgctgagtacggttggtactcaccctttcaatatacaaactgaatcagaggtaggagttgaagcttcggaggatccctacgcttactaccaggagggtgatgaagtcgatggcgctcagtaggtcttagttacggtcgttggctgtggcaatggcgtgccgctgctttaactccgctgccttatctacttctacttttggaatgtattccggaccgttcggtcctatgttctaagactatgcctgcgggcctatgatgtaataattcgcactagactctcgtgtatgtgcacttggtatttcagctatgaactcgtgagtaccagactacttgatccagggaaatggtactgtttacacgattgattcctgttataaaaacgggggtccacatacatataccttgcacctatatctttgagatatgcagcatagtagcaactcctgatcaacaaccaagtcttttgtttcctttcgtcctttactcaggacgagcaaaggttcaagcttggggggttttgttgacggtcgttatcgatcagtttcaaccgtcaatactaccaaaacagaggagaactagtgatgcttgcaatgcataaatatgttagaatataaatattccactagtattaggtatactaacattttgtagagaatgacaaaaaaatggaggagaatcgacatcaactcaaacgataaatcaatcggacgatgtcaagaatcagacttatgtatgaatggggcacgaagtcagaattgacatgatgaattgggccaaaattcacaagtctgcagagaaggatcacagaggtggccgccagccaaaattgggctggattgggccggccccaggttcggccgaacctccctcatcgccgctggatgcagggtttcttctggacggtgtggattagcttccaatgatggttggagggtattttcgacattacaactgtcacaaccgtcattgggaggctatataaacccctcaccttctcacttcactcacacaccttaagcaatagctctctcatttctctcaagtttagtttagtagtatctagctggtggaaaagaaatagagtagaaatcaggagtccggaagccttcggaagagttcgggtatggctctagtagcttttctcttctcttttgtaagctttgtagttttaatagaatactcttctaaatacatttatggtattgaaatacttttcgagtatatgagtacctagtttacattatgttcatgttatactaaatatacggctagcttatctgggagatgctttggtgcttatacaattactctatgtcatgacgatgatattagagtagtatctgctagtttagacgtggtgtctagattacgggatatcattatttggggttatatattgcggatgagaggtgggccgttgatggtgacagctcagtatgggtattcctccgcgccggtatataatcctaagttaattccctggggagggtatttctccgtatttagccccggttgtatggtcatgacgggctgtcgtaaggaactcggcagtcaggggtggcttctcgaagtaccaggaggacatcggatagagggtattagctagtatatcgggtaactagtgtcacaccctaaaaattcaaaatatataaattgtggtttaaaatggaattttagaattaattttaaaagcctagaagagaagatctaatttaattaataaattccaatat

SEQ ID NO: 79016 - DNA, 10702 bp, Oryza sativa
  unsure (1)..(10702): unsure at all n locations
caatcaagagagtagaatcagggattgggaagagcaacatagagaaggcagaagcatgagactaggattagagaaatagaaattaggggaggcagagttggaggaggaagagagccatggcaaagccagattatatttctgttcatcgatccccttccagcgtgtgtggctgctgcttttatagtagtcaacttcctagctgagtgggccaaggtttgcttcagcccaagagctcactcgttaggcccatatcgtgacattctttcccccttgagtttcggcttgccctcaagccaatgcaacagagtcatagagccgccgggatcccagatcattggaactcttctggtgcaactgaagaacaatatcatgtgtctaaatatgatgctcaccattctgacagaactccaatgcaaaccaagtgatatttcaactggaaccatatagagtatatgcttttgatcctctcatctacacaaaaaccagcccagtacctcattgcagctcaggaacagcagttcaaaaccaaccagcataaaaccattcatgttttgcaccttacagtcaggtagaactaaagttttgatgagtccaagatgaattgtactccagaatctctcaacagatagcaaggttccatgcaattcagtggtgatgatgtggctgaagaatatttgatttgattcacaaagtgctctagcaagatatatactcatccaaaactccacggagagatccattgcatcaagtattgtgctagattgttcacaataaactgacactacccaagttgcactgaactgataaataaataattgcatcacaatgacccaattagattgtttctttagcaaggcttgaaagtgtgttccattggcagctgaaacatccgcaatatctgatctcctttgaaaatgcttgcaccaaacagaacttgctagaaagttgaattgtaacatactcggaacttgttgaataaatgagttttcattcccatatagaacctgcctggttttgcataaacccaggtacaagatgcagcttggatttatcttcgcccaagattgcacaagcaaatcaatgtcacttatgtctccagttggatgatcaagaaggtagttggaaccgaaattgacaactcccagttgcagctgctctctctgtaaacagcactcatttgtcttcccactttgattccactgaagaataaactcagatttaactagtaactgttgcagcctttcccatagttctccccaagaattgacaaatgacagtagcaatagttttggttgcagcattacttccaacccattagtcaaaccgccacaataatgcacatgaggtgaaaataatctcaagatccataaatcaggtggtggccatgtcttccaggaagtgatctctgtcaatgtcaaaaacatcaattccttacttttagtttgaagagaaggtggccatgattgaaagagtttgaccagcacacttctgctgccttgtactgttcgtggatcaggacagggttcaagttgatgctcagcactgtcacctttgcaaatggctccaggaagagatggcccatactgtgagatcttcaccaccacgcttccactgccttgagtaaaccatggatcaggccatagtaaagattgctgctcaacaattgaacctttgcacttggcttgaaaaggaggtggccatggttggagaggctcaaataccaccacactgctgcatcttccatctgcttgacaaccatagagacatatcgtcaaacagatgagagatagatagatagctcagtctgaatcagctatcccgtagtactccaataaacaattggtgccatatactaatatacaaattaatcaaccaagaaccagtcaatgataattgataaagaaatgcgaaattgtgtggcatgcagatcgatcgaatggacagcaacgacgaggggtggggggtgagattccattccacccaactcaacacacaccaccaccacctgctgtgctcgagttcgagaaccccaaccccaactactcccattcctgcctcccctgcgcaaaagccctaaccctgctcaacacggctcttgttggtgggccccacccaggggaggttttaaactaaacaaaaaaaaaacttgagccaatcagcatccttctcgcccttcgccagtaggacaggcaaaaagcagctgcagcatgtttgggatgccacgtcagcaattctagctacgactacgaaatcctccagcaagaagaagaacgcaccatttcatttaggcttctttatctccaaaatctccaaaggcccgggctcacgacaacatcaccgctacagtgtacaggatcggagcgccgccgtatcgagtcgagatccatggagacctatcagccagggcgctgccgccgcctcgccgccgaccaccaccgtcgcggcatcctcgctgcaggtagtgcaagctgctacccctacgccgctaatccctaccgcatggcgccggcggcgagcttgttgcgccacgtcggtgcgggcggcggcgcgatgaacacggcgttcaccgagacgacaaccaacggcggcggcgacgcctcctatagcatcgggccaagcttgagcttgcgccagcaccacaccggtgtgggcggcgccggcgaccggaccacggtgttcgccggcggcgacgcgctcgccgcgaactacccctacagctacgcgataccggttccttactccgctcaaggctggcaccgcatcggtgcggggggcggccggaacacggcgctccccaacttcgacgtggccccttactttgctacggcggatctccatcacatcggtggaggtggcgaccacaacacggcgttcttccccaacatcgacgacctcgccatgaacgctttcagcctcgccgcaccaaaccagtactctgctgcggaattctattacaacagtgcaggtggcgagcagaacatcgaggaattctactacaacggtgcgagtggtgtgcagaacatggtgcccccctacatggacaccctcactgcgaacgctttcagcttcaccacaccgggccattactctgctacggaattctactacaacaatgcagatggtgagcagaacattgaggaattttactataacgctgtaggccatgagcagaacatagtgtcccctaacatggacaccctcaccgcgaatactttcagctttgccacaccgatccattactctgctgcggaattctactacaacggcgcaagcggtgagcagaacattgaggaattctactacaacggtgcgagtggtgtgcagaacatggtgccctccaccgtggacaccctcaccgcgaacactttcagcttcaccacaccgggccattactctgctacggaattctactacaatggtgcaggcgatgagcagaacatagaggaattctactacaacggtgtaggcggtgagcagaacacggtgtcccccaacatgggcaccctcaccgcgaatgctttcagcttcgccacaccagcccattaccctgctgtggaattctactacaacggtgtaggcggtagcagaacatcgaggaattctactacaatggtgcaagtggtgagcagaatatggcgttccccaccacggacacccatgcagtgaacattttcagcttcgccacaccggcccattactctgtcgaggaattccaccaaatcagtgcaggcgccgagcagaacatggtgtcccccaacacggacaacctcgccatgaatgctttcagcttcgccaccccgttcaatcactctgctgcagaattcttccaccacatcggtgcaagcggcgagcggaacacggtgtgccccaacaacgacacccacctcgccgcgaatgctttcagcttcgtcgcgccagtccattactccgatgccaatgcagacctccttctccatgtggtggatgccggcggtgagcaagacacggtggccgccaatgtcgacgtgctcggcatcccaccagcaccggcaagcatcaccaatgccatcgtgaagagcgtgtggcgggagaactacagggagcagttcaagctcgtggtcgacgcgctcaaccaacctcgtcgccacctctacatcgccgtcgacatggagttcgccgcagacgccaccaccaacatccgccgaaggccggtaacctccaccggttgctaccatcacctgcgcgagtttgtgaatcgaggtgacatagtccaaatgggcctcacgttcgtgttcgtcggtgacggcgaacaatcctcctcctcctcctcgccgccgccgataacactagagatcaacttcaaaatcaacatcaaggcgcgcaagtannnnnnnnnnnnnnnnnnnnnnnnnnnccgtcaaggccatgatctgagggagcaccggaggaggggcgtctcgccgcgtcgcgtctacgatggccgctccgtcacctggctagcttaccacggcgactacgacctgagtttcctcctccacctgctgcaacgcggaggccgccgccgcggaggcggcgatctcccgcgtcagctagccacgtttctgcgccggctacgggagaatttcccggcgttctacgacgtccgcgtgatcaggcagatgcggaggatcatggcttcagcgggaagctcactgggctcgccgagcacctcggaatccggcgtaccggcggcgccgcgcaccatgccggctccgacgcgctgctgacactgtcgtgtttcttcaagatcttcagatccctctcaggacagcagctgcatcagctggatgctcggcgagggttactcgctgggttagaggagtggaacatggcgatcaaatgtgctcgccacattgacgatcacactagaaacatcaaggtgatcgaggtggtggcagaaaacctcggcgaagaggcgcgacgaatcggagagctggtggacagcaacttcagcatcattggagtagaggtaaatcaggtagtaatccatcctcaattggacaggaaggcttatgaaatggtcatcgcgttcatgaaccctgaaggaatgttggcttacgggcgtgcctggaaattctgcatcagtcgtttcacgtcagacaatggcaatgtactgaatctgaaacagcttgctgaacttgtgcaatcttgtggagcaaccgataaccctgatgtatcctgggtgacattccacggatcagatgtgatctgcagactgatcaggtcagccaatggtggtgttattccttcatcgatcagcggagagagtttcctccctagcttgtatgatgtcgcattgatcgttcgtcgattccttggcattggcacactccctacaaccgagcgcaatggaggtatttttgatgttgctcgagcgctggaactgaaggccatcgaggccgacaaggaggcagagagggttcttcttactctgagatgcttcatgagattggcagaaatggagtcggctgtccaatggtagcttgtggcgagctgctgcatgctggagcgttcagtgtgcagtggtaccaaatccttgctgtttcttcttctcagaattcatacgtgtgaacttcatatatgtatatgttgtaacagtatgatttttttttatttagaactagggcatgaagataacagtatgattttgtagctttaatttgtgcttatatgactttccttataacttgtacaaattcctagcttggaatataataataagggtgtacatacgtgaattgctctgggtttgtatgctggtgaaaaagtagagattaattggatgttgatggtggatggaaacgaaatgcatcatgttgctcttccgtttggctggaacatgttggcatctggcatctgcagatctgctgtttttttttttttgaaagtacagtggcatctgctgttcgatctcttcgtagcttacagcccttacctttttttcttttcaatggagaattgctgctggagctgcccatcagcaaatcgctcgacggtggaagatgcatgatcgttcagtgtggtaccgaatcatttctgtctgtcaatgttgtcagtgtggttttttagctgttgttgtgatacaaaaaggaattctacttaagactcattcgagtgaacctcatatgttgtaacagtgtaattttgttgcgtttgtgctcatatatgcgacttttttttcttcttcttctttgaagactcatacaattttttagctttaaatagaatttaaatgagtgtttgtttgtgaattgcatgttgaatagcttcatattgattgtgaaagggtaagaggcctaatatgtaagtggagaagcttctcacctcatttactagcttttaagataggaaatgccccggttatgattcaacaatgtacttgtttgtattgtatgtatgcgcagatgaataaggcgaacgaactgcatcagtttgtagatgacattatgaataatcaactgcgagatgaatgatgtttggaccttgtggtccgctctgattacaagtgagcagaaatgctagtcgctaatatgttttagccagcacaatctgatgcaatctgtaacaaaacacatcagttgttttcttcgacatctgtctgaaacagcggtcataacatcacagagacagagattcgtagcagtgcaaaagttttagcgccaagtgcaacgaagcagaggagagcgaagcgccgaagcgtgtgcgtaggatgaattgcgtggttttgaacggggaaaatcacagatacgctttcgcgtgggcccacctatagcctgacttctcatcagtcgctttttactagaaaggggtcatggtagtaggatattctagcggagagggtggtgggccctctcgaatcctcccctttttctctcgcgcggccgtgtgggcgtgtgttgcatcccgtcgcgccgcaccgccaccaaccccacaaaggtggggccacccgagaaacgtgcccaatgctctgatttccctgcaatgcaccttgtacttcttttttatagtaactagctgggtggcctgcgcaattgcgcggctagtatccatacaaaactaccttcttttatatatgagtttacttaaattttgataaatagctatctcgtcatcttaggcctttaaaagaccaaaccttatcattttcatgtttctaattttatagtttttaaaagtcacgacaatcgctacctcttccttctttgtcacccctttatttgcttccttgatctactacggcttctattcatcctcatttgaactttaaaattgaccttataagttaattatctcgttggctttcatttttataatttttaaaagtaacgccaaacgctgccactctactcctcttcggcccatccgctgcctcatctctttattgtcattgggattttaaaaatcgaacgtagttatcatcagtgttcatttttaactttctaaaagtcccgccaaaccgtcagcggcatcaccattatactactctacagcccgcttgatgccttttcttttaattatcattgagattttaaaaatcgaatgtgattacctttgtgatttatttttttactttctagaagtcttgccaaccatagtgattgtgcagcttaacgggttgcctgtcatctctccttcctgttaattgtcattgggattctatttggggtttgtttatagtttttacgcccgctgtcttatctctttattatcgttgagattttacaaatcgaacgtgattatcgctggggtttatttttttactttctagaagtcccgccaaccactgtgatcatgatgttttaatggtctgtccgtcgtcccttctctggatcataaacacattgtttttaatatatataatcaattaattgtatgttcagcactgataaaaaatgatccagtgacatgccttactactgtacttctttaattggtttgttgattttatgtgtgcacgtactccgtatgctgcatgcatgagactacatgagtcaggataacacatagcagctagcacctactgaattacaatccaagtctagtacggattgtttcactcgggaggcagggattccgattcctctttttttttcttttctagccaaaattgaccggtcgatttcctattagattctttctccatctctaaatactttaaatacttttatgtatcgtatgacttatgatatcaatctacaccgttgtaattttgaacaatcatgatctagcggtttatattttttttcttttcttcgattaatgtgggaatttctagcccccacagtaaacgtggtgtctcctttcaaggctgctttaataatataatagatagatgactgggaaaaaaaatacttgtgcgtcgtaatggatgaatgctattttaatcttatcattgttatacggtttggctatggcaaaattgactatgggaattcgtttggatatatttttttagaaaatcatgagctgcaattaagagtccggttttcatctcaaattaacatgcgagtttttttaaagagatttcttatataattcctttgtatttctaaaagcaaacgaaatgaaaatccaactcaaacacggatctgtatttccaaaagagaacgaactttaaaaaaccgactcaaacacggatgatgtaccaaaatatcggcaaaaacatcttcaatttttataatagtagagaaataaaacatcacggttttttctcaacgagctacaaccaattattacggctaacactcttaaaaagaaaattagtagtattaaccagaaaattagtctagtgttttgtgactaatccagttttttaaacagaagacaatgtcactaatctaaaagcaagtttgatagtataacaaactattaactttaaaatttaacacatcactacaatcaatataatagtttatccatacaatattttcatataaatatatatcatatcattatcatttgaacctcttatgcacacataatatcttaaagcccatactgcagttggctataaagtctatatctcgtttttcttcttctcttctacatgtgtgcttatagctagcttatggtctgttgttgttgtactttgctctaatatctactcccttagtctcagaaggttttttttttaggatttagaaccgatatatttgcaccagaggtacctggaatattgggggcatttgcattacactcactccggtgcgttacaaagcagctttcgtttggtttcagattgcatgatcaaatgcaatcatcctgttggataagacataagcaactagcactactgttattttgtattgggaaaaggataacaaagtctaaactgcattaatctgcatccatggagtctgttcaggagagtggctgttattttgacgccaattctccaaagcgatcctgactattcttgtatattgatagagcaggaaaataaagctatttacagagttttgtaggatggggaactactcaccattatacaagttaatacatgaggttaatcctaattgagattagacaatatttgatatacagttcactatggagtctgttcaggagagtgggtgtttttttcttcttgtccttattgtttctcctgttaaagtgtcaggtcctgttgattactgatagcacaagatttaaaatttctctacctcatgatcgtttaattgctataatctttttccctgagcacatgacctttttttattccaacttaaattcatagctggtatgtttttatttcaggtataagcagcatagtaaaatgagcaaagttgacgatttaccttgaaggtaatccatgatagacgtaagttagaaagttgcaatacgactctccagtttctttcatagtgaggattttagagatgaaataataagaactatttgtaattctatgacaggtggatctcaattaatacctttaagacagatagtaaacttatggtcaagaactgcatataccaaaactgtgtttagttcacaccaaaattagaagtttggttgaaattacaacgatgtaacggaaaagttgaaagtttgtgtgtgtaagaaagttttgatgagatggaaaagttgaaagtttgaagaaaaactttggaactaaacacggcgcaaggtctgttctacataagatccaaagtgaagtacacaatctttgtaagatctgttttacggtgaccagatcaaacgtgattatcactcattttcctcattgtatggacaaattacgtactccctttcaaaaaagaacaatttctagagatgaatttggacacatacctgtttagggtcattcccagaaattattttttatgggacggagaggagcatttgtctacttaatacttggcccataattaaaaggaggcccaggactgcaatttgccgggtttgcatttagcatttgcatgtgctaagatagatgagataaactatatgcctcttgtctctttcaagtgcgctctgttattggcctcaaatcatcaatatctcccttaactcgtttaaaatctatacccatgaaatatttattttttttaaaaaaaaaactctcccaaagacaagttacaagtgcagtcaacctacccacgttaattttggccataattatttctagaatctagattttctcataaaaatattaccatacaaaaatttttttgtggcaaat

SEQ ID NO: 79017 - DNA, 4512 bp, Oryza sativa
gtttctactttccaaatgtccctttccaaatagttacaacacccaaattcccttttcataaatctgaaaaaaaatacacaaaatgcaatatgataacgcatgtgaaggtatttgccacaaaaaatttttgtatggtaatatctattatattattaagacagctcgaaaagaaggcaccacgttcgccgtgggggctagaaattcccacattaatcggagaaaaagaaaaaatatcgaccgcttgatcattgatagcctatattttaatggctgagatttaattaaaattttggaagattagacttggtttcacgtatacggacataccaggcaaactggacgtacgtatcagacatggattgacatgtgcagtagtaataggacaccaataagtattgacatgtacaggtaataggacaccaattaacatacgacaacaatagcaatatggcagtagattccaaaataaaaacacccgaaaaggaaaggagagtccaagtagaaatacaatttaaaaatagctgaaattcggaattaaaaataagcaatattgaaagaagtttccatataataatccaatacgagattaattaaaatttaaattaaaataaaataaattctaaaattagaaaaggaaaggggagtccatgtagtaatacaatttaaaaatagctgaaattcggaattaaaaataaggaattttaaaagaagagtcaatataagaacccaatacgagattaattaaaattcgaaataaaaataaaaataaatccgaaattagcaaaagaaaataaaagaagagttcaagtaggaatacaatttaaaattagctgaaattcggaattaaaaataagtaatattgaaagaagaatccatataagaacccaatacgagattaattaaaatttagaataaaaaataatataatatccaaaactagaaaaattaaaagagaggtcaagtaggaatacaattttgaaacaactgaaattgaaaataaaaatttttattaaaagaacacaacacattattaactaatttttaaaaaaaaatcctgaaaattttcaattaggaatacaatttataaataactaaaatttgtgataaaaataaagactattgaaagaaaagacatctaaaacatatgatgagataaattaagtaataggcctataaagaagtaaagtggtggcggttgatacaacatataaaaattattaataaaacaccaaataaaatcctaatgacgattaaaacgtgggatgtcaggcaggccatgaagcaaacgagtaaggcggttgccgggacttctaaaaagtaaaataattaaaccctattgataatcatattcgatttttaaaatctcaataataatagaaaggagaagcagcgggcggggtgtataagagtatagttgcagagccgccgacggttgacgggacttctagaaaataaaaaagtgaattccaacgatagttatgttcggtttttagaatcacaataacaatagagagtagtaggcagacggactgtagaggggcatagtggcatcgtttgatgggacttctaaaaattatagaaaatgaaactacaagtccaatttttaaggtttcggaacttctaaaaagtaaaaaaaaaccaatgataatcatgtttgattttaaaatctcaatgacaataaaaaagagagacagcaggcgagccatagagcagtacgatggcaaagtcgctaatagtttagcgggatttctagaaagtaaaaattgaacccaaacaataattatgttcgatttttaaaatctcaatgaaaataaagagaagagacaatggacgggacgtagaggagtataatgacaacgtttgacgggacatctagaaattataaaaacgaaacccaacgtgacaataaactctaaaaactatcaaatccaatttttaaaggttccaagaaaaatgaatagaaatagtggtagatcgagcgagtaaataaataaggagatgatataatggtagcaactggtgtgacttttaaaagctatataattagaaacacgatgatgataaggtttggtctttcaaagtcttaagaaaatgagatagctatttaacaaattttaagtaaaatcataaaaatatatatatatgatattgtttgggtgttagccacgtaattgcgcgggccacccagctagtttttgtatagaaggaaggagtattatcttttttttctgagcgagtaggatattcttgcggactggtggggccgctagaaatcctctcctctcctttttttttttttaatctcttcctcgcgcggtttcgtaggcgtgggcgcattcgtgtttgccgtcgcgtcgcgccgccaccaaaccagaaaaacgtgcccgatcgagtccgcctcactctgtttctcgctttggatgggcgcaccgcgcacacacacactctgtttctcgctccccatctactacctcctctgcttttcttctgctctgtgttcccctgctctgcaggagtagttcttagtgttcttcctgtaagttgtaattagtattaacctgaaaaatcaatccatgtggctaattcttttctttaacataagacaatgtcactaacactaatggcgtactactactcgactgagtcatttgtcttttttttccttgaaccgagatatttggaggcatttgcttcaggctcagtctgatgcaaaagaaaacaactgctactccttccgtccataatataagtgattttggatgaatatgacatatcttagtataatgaatcgtctgtccatattcattgtattaaaatgtgtcaaatccattcaaaatcccttatataatgagacggagggagcatttcgtaacgttttgctttagactgcatgaccaaacgcaatcatcagaacctgttggctaacacatgctaggagcagccagcatagctgttaatttgtaattgtaatcaggaaagaatcatcaagtccaaacaacattcacctctcactcacaatctgcatttacaattggtcattcattcatctgcattcgacaactgatgcgtttttggttggcacccgccattcacatccaactgctctactcattcatcttcatgcaacccagtgcaactcacaaaaacaaaacactcttatttgtatattacaaactataaatgtatgagccttaaaacaaagaagagtggtatgagaaaatgagctaataaagttataccgttgagttttaaaaggataatttcgtgtgagcacaaaggctacaaaactacacggacaagtgacaacatggcattgacagccacagcaaggattcgattaccacacggagttatcatgcatcctccatccatcagcaatttgctgggcatttccagcagcagttatccttaagcagcccttggacagccatcgccatgcctgggaaatcaggacgttctgccaatttcatatagcatctcagagtaagaagaaccctggctgcctcattgtcagcctcaatttccttcaggttcaatgctcgagcaacatcaaacaggcctcctttgcactcagttgcgggactgtgctgatgtcagagcatctacgctcaagcaatgcaacatcgtatatagcaggaaagaatgctctgcggtgtccaatgtaagaacaccattagcaggaaatcgcgagaagaatctattgagcctaaataatcaatcattagcacatgtaggttagtgtagcatatatggctaatcatggactaattagactcgaaagattggtctcgcgatttcctccctaactgtgcaattagtttttttaaaaatctatatttaatgcttatgcatgtgtcaaaagattcgatgtgatgtttttaggaaaaaaattttggaaactaaacagacctaagtgtggtgtgcagtacaacctttccatgtcagtcaagtcaatcgaatgatacattggatttaggcggaatcgtagcaggcgatttcgcgtagtactcctacaatattatcttttttttttctgattgatgagtaggatattctggcggacaggtaatcctctcctttttcttctttctcgcgacggtttacgtacgtgggcgtggccgcgtgggcgctcgtgttcgcagtcgcgtcgcgccgccaccaaaccccagggacggtggtggaggcgtggagccacctggagaacgttggccaagaccgcctcactcagtcactctcacccgttcagagcgtcgaagggagactgtttctcgctccccatctactataccttctctgcttttcttctgctctgtttcccctgctttgcaggagtagtagttcttagtgttctccttgcaattagtattaacctgaaatttaattcctctggctaatccttttctttaacatgagaaaatgtcactaatactaatggcgtactaatcgagtgagccatgtgtgtctctttctttcctttttctttttttctttcttgaatcgctatatttgcat

SEQ ID NO: 79018 - DNA, 6543 bp, Oryza sativa
taaagtactttaagcacaacttttcgttttttatatttgcacaaaattttttaataagacgagtaatcaaaccgtataagaaaaactcaaaatctcttatatgatggaacgggacggagggaatatttgcctacttggccaataattaaaagagggggaggggggcaggtctgcgaatctgcaattagcctgtttttgcatttatcatgtactaagatatagggggataaattatatgactcttgtctcgcttgttattgacatcaaatcatcgatatctcccttaactcgttaaaattctacacccatgaaatatttatatatttttttaaaaaaatctctcccaaagacaagttacaagtgtagtcaatccacgttaattttggccatattatttctacaatctagattttctgataaatatattactataaaaatgttgcaaatactttcacatgtgttattgcactttgtgttttttttcagatttgaaaaggaaatttgggtgttgtatctagtacctactccctccattctaaaatataagcatttttagaatagcgtcaaatcaaacatttttaactttgactattaatagtattttttttaaaaaagatcaatcatgtaaaattgatgttaatagatttatcattaaaaaaaactacaatacttcctccatctatttttgataggcatatttccaaattttaaaaaaatatttttgataggcatatttcaattcaaccacctatcatcttaatgactttctcggatttaatgcgcgactctccattcttccacacaatattggctatataggcatcgagaaacgtaaatattaatgaattgtttgtttacgaggaataactagtagcatatttaaatggatgataagtagaattacttaggggtgtttgattgggcttttcaacctgcttttgcttttgtataagccaaaagccaaccaaaggcctaaaaccacagctgcttttgtccaaaatcagcttttggtgtagtataaatcaaaaccacttctagccctgctttcgtgcttttggggggaaatattacccacctgccacagcataacggttaccggttctttttttttgttgttttctttcccgtccgtgacttccctctcctcctgttcgtgacttcttccgcggcggcctcgacactggcggcagcggacgcggcccggactagcacgacccccgatccggccggcctcgacgacctctctccctctgccctggtgcacagtggccctcccccggcgagccgtgcatattctgccccccactcgacgccgccctgccctgctccgacgacaccgacgccgtccctggtctggacgccgccctgctcgtccacgccatcgccgccgaggaattgagccgccggcatctgctcttccccgtcgccgccgccgagaaatcaagcggacgaggaggagcagccccggctggcctcggttgcccactcagtcggggacatcatggccggcggtggtggcggcagaggccggggcgggggcgcagcggtccatgggcgccagccgcgcgcgaaggcagcgggcggagccgaggaggcggctgcgcatgccggcggtggtggcggcggagaccagggcgggggcgtggcggtccatgggtgccagccacacgcggaggcggtaggcggagaccaggaggcaggacagctcgtcgcatagcgcctccatctcgtcgtcggcggcctccacctcccgcaaaaacgtctcgagcttctggtcgatggaaccccctgccgtcatcttgccgatccagcggcgccgccacatcttggccgcaactgggggagattactaagatcgatctcccaaatcttcctcctctcttcccctccctcttttcctacggtggaagatcctgtgtacgacatgtggggtccgcttataagcatgactattatttcaaaagcttcaactattgaaccaaacgagtttttttaaaagccacggcccatattccacagctgctttttaaaaagccacagcccacagctactttttcaaacgccacagcttaaccaaacacacccttatacttgatcattgtgtcaagatgaaatatgactattaaaagtaaatggaaagagtattatgtaactttttttaaaaaaaaacatatttcttttacatatattgttgatcaaaataacatattaaaagactgtgtcaaaatttaaaaatacttatattttgagacggatggagtatttggaaaagtatacttaggctgtgtttaaatccaaagtttggatccaaactttagtccttttccatcacattaacctgttatacacatacaacttttcagttacatcatctctaatttcaatcaaaatccaaactttacgctgaactaaacacagccttagtggggtgtgcattacaacctttccatgtcagtcaagtcaatcgaatgatacattggatttaggcggaatcgtagcaggcgatttcgcgtagtacagtattatcttcttttttttttctgattgatgagtaggatattctggcggataggttggtggggccatgggcccgcctagaaatcctctcctttttcttctttctcgcgacggtttacgtatgtgggcgtggccgcgtgggcgctcgtgttcgcagtcgcgtcgcgccgccaccaaaccccagggacggtggtggaggcgtggagccacctggagaacgttggccaagaccgcctcactcagtcactctcacccgttcagagcgtcgaagggagactgtttctcgctccccatctactatacctcctctgcttttcttctgctctgtttcccctgctttgcaggagtagtagttcttagtgttctccttgcaattagtattaacctgaaatttaattcctctggctaatccttttctttaacatgagaaaatgtcactaatactaatggcggactaatcgagtgagccatgtgtgtctctttctttcctttttctttttttctttcttgaatcgctatatttgcatcagccatcaggtgcctggaattttgggcgaatttgcttcaggctcagtctgatgcaaaagaaaacaactactcctactaagtaacgttttgtttcagactgcattaccaaacgcaatcatcacaacctgttggctagtaacacatgttagtagcacctagcatcactgcttatttgtagtcaggaaaggatcattcacctctcactcacagtctgcatttacaattggtcattcattcatctgcattcgacaactgatgcgttttttgttggcacccgccattcacatccaactgctctactcattcatccgcatacaacccagtgcaatttacaaaaacaaaacacttctatttgtatattacaaactataaatgtgagtcttaaaacaaagaagagttttgattttgtaatgctttccagtccctgtcccctgctgctctctctttaaatgtaaataacttttatttctcttaatggaaaaaattcgcctctggcgtattcccgaaaaaaaaaacaaagaagagtggtctgagcaaaagagcaactgaacttacaccgttacaacataagaaactcagtcatgtgagtcttaaaaggaaaaattctgtatgagcacaaaagatacaaaactacacggacaagtgacaaaatggcattgacaaccacaacaaggattcggttaccacaccgagtgatcatgcatcctccatccatcagcaatttgctgggcatttccaacagcaactctccttaagcagcccttggacagccatctttgtgcctgggaaatcagggcgttctgccagtctcatatagcatctcagagtaagaagaaccctggctgcctccatgtcagcctcaatttccttcaggttcagtgcttgagcaacatcgaacaggcctcctttgcactcaatccaaggaattgtgatgatgtcaaaggatctacgcacaagcaatgcaacatcgtatatagcaggaaagaatgctctccggtgtccaatgtaagaacaccattggcttggaaggtcttggggagaaaggaatgacctgatcatcctggcgatcccatgtgctccgtgaaatgtcacccaagatatgttggggtcacccaatgccccacaagatgccataaacttagcaaactgttgaggatgcacacaggcattgtctgccctggaactgatgcagaatttccaggcacgactgtaagccaacattccttcagcgttcataaatgtgacgatgatttcgtacaagtcagaatccttaagaaatgtcttgatgagttcataattttgttgggcttcaactgcgtaggagcgcttacccaattgagcatggattacctctactcaaacgatgttgaagttgctggccaccagctcttcaattcgtcttgcctcttcatccaacttatgtggtagcatcttgacaacgtagatgcttccagtatggtcgtcaatatggcgtgcacatttgatagccatgttccactcctccaacccagcaagcaatccccgccgagcatccatgcggtgcatctggtgacctgaaaggctgacgatcttgaagaaacaggacaatgtaagcagcgcgtcggagccatggtctcccccttgcagcaagcggaggaggaaagccaagtcatagtcgccgtgataggcgacccaggtgacggagccgtcgccgaacgggaggtggcgcaggagcccctcgtaaacaaactccggcgtgacgcctcttttgctgtgctgcgtgagatcatggccttggctggataggaaatgtatcgactcgccatggtacttaggcgaattgacgttgaagtcgaagttgatctccagtgctatcggcggcgagggggcttgttcgccttcgacatcaccgacgaatgcaaatgtgaggcccatctgaactatgtcacctccgttcacgtacctacgcacgtgttggtagcagctggtggaggttactggcctatggctcatgttggtggcggcgtccgctgtgaactccatgtcgacggcgatgtagaggttgcgatgaggttgatgaagcgcttccagcacgagcttgaattgctccatgcaattctcctgccacacgctctgcacggtggccatggcgaggtagtgcgcgagcgtgatgtcgtccgcagcgtcgaacacggacgacgcagtgccgagatcatcagcgccagcgccgaagtagtcgatgatgcctgtggcagcgaagttgttcacgccgaagagttggaggttgtggatttgatcggccgctgcgagtgtgtagctcggtgcggcatagagatgggcgccgcggccaccagggacgaggatgcggcctggcctagtgcagaggcggcctcgggtgtgtagaagttgccggacggacgattcatcgtgatggtagttgttgccgaggtggtcgctggactgataatggttcactttgcctgtcgacggtggagcttgttgtgctgctggcatgccaagtgcaccaatgttgtcgaacaccttgttctggtcaccgccagcaccaacgtgatcattgaccatgctatccttgccgtccgcgccgatgtggtttatggttgcggtgtggtcaataacgtcgtacgccttgtttttctcgtggcctgctccgatgtggtgcagaaccactgcgagggtgccgttgtcgtggtagagctcgtcgtccaagcccgcacccggcttggcgatgacagcatcgtagagcatgctctcatcagagctcactccgctgcccgcaccgatgtggctcaaggtcgccgtctgggggatcgagctgttcttcttgcagctcgctccaccatggtgcaagaccactgcgagggcgctgttgtcgccatagagctcgtcgccggagcccgcacccggcttggcgatgacagcgtcgtagagcatgctctcatcagagctcactccgctgcccgcgccgatgtggctcaaggtccccgtctgggggatggagctgttcttcttgcagctcgctccgccgtggtgcaagaccactgcgagggtgccgttgtcgccgtagagcttgtcgccggcgccgatgtggttcaaggtgtccatgctgcctgccgccggtggagcttagtgacgcctttgcgacgtcaggaacccgagggtcgacagtgagagagagagacacctctacgaaatgtgcttttgtctaatgtggtagtatgattttgaggcgaatcccctgtcctctcgcgcttagatagaattgttgttttagcttaggacaaatgtgcccctaaactctaatgatctgcagtggcaactgctgacgtggcatgccaacactggaggtcgcggctgattccggattggctgtaataataccgtcaagtttttataaatttaaaccaatacgggccccccaacccaagagttcgaggctttgagccggtatactagtgcgcaggattctccacagtggtagttaatcgctggaagcgaacg

SEQ ID NO: 79019 - DNA, 8079 bp, Oryza sativa
acgccggcggtgaggtgatgcagcggggaggtcgtcggcgcgtagagagcatggcgggatggatggagactccaatcccatggttatgcccgcaaggaaggcgggggaaggctggaggcaacgtttctgttctaccagcagctcttcttcatcaattcatggtgagcagcaagaactagggctggaaactgtcaatcaatttttctttaatacgaatatgatatcctcctcctccttttttttttcttttcatacaattatgctagtggtgttagacgactacttttaattcaatggtaaccgtgatgttaggacataagattgcagtttgatgtagctgatgtaataatgttcatgctgctacactactgaacatctctatatacagtatgagcaattttatagtccttgaggagatactatgaggtaccattttttctattgtaaatttggtatctcttggtatctagatactatgaggtaccaaattttacactaaaattttgatacctcacggtacctcctcaagaaccatagaattgctcatatagtatagtttctgttctccatttgcataacaccaggctaaatttttctgggccctgttttttgagagactatttgcgactgatctgcgaacaatagaaaagacttactttctttagggtgtggattgtcttctgtttggggtctttggcaaaccagaaacaaaatggcgattgaatcagtgtttttgttcccctgttaggccctgttgatgtttccttcgtttgcaaaacttagatatgttagtcttttgtttccttcatgtttagctgttgtccccagccctcaaacttctatatcccaaactcgctctcaataaaatcaagggccctgccctttatccaaaaaaaaaagttatatatgaaaacgattcaacttgaatatccttaggtttaatgaagtgaaaatttaacagttaggacgaagcatcacctaaattcttttggtcctttttcgtattaattgtgatgcactctagtcttatttacacttcatctcatttgttagtatgatccaagaaaattactgtatggctcgagtttgtccctggcataatctgttataatgtatcatttgatgaagatgtaccaaacatcacgttgcctagttcttcttttgattgttgatctaattattgggcacatcatagctgaaaataggacttgattactgattgcacaaggtttaaatctttctatctcatggccgttgaattgttaatcttttccctgtacacatgattttttttctaattgcagctcaaattcataggtggtatgtttttccttcaggtataagctgcactgtaagaagagcaaagttggcaatttaccttgaaggaaactcatgataaatgtgaatcaagagaaaattgctataggtctctccagttgcttccatgctgagtattttagagatgaaataacactctttgcaattctgtggctggtggatcaattaatacatgtaagacagatactaatgcatattccaacttttctacataacattcaaagtcgatctctatccaaaaatagaaggtacaaaatcttcgttaggtcaagctttgcagacccaactaagttgttcaaggtctttttgaagaagcctgaagaatcagtgggaatgcaatattcagatccagaagggctccacaataagaggtatgccattgattattgattcagttgatctttgggataaccaatacattttctaaaaagcactatggcataatacactactatctgataagaataagactaaatggataagacaatgtttcctgttatgcccccacacctcttctatggtcaatgatcccttgaaacatgaacttacaaagcatattggtgttgatgcctcctttacccggtctcattgccatcagaaaacaattgctcttcagtattcccttagaattgcaagtagcagttttttttttcactaaatcgcaaactcgagagcatcatcggcttccttcatttactcaaaccaatgcttcagatcctccccttccaccttgagtttgaaggggggtgttaagtatatcaaacattcaagcacatatcttgtaggcccatgtggctcatgaggactctgtataacatcatcatccctgagggataatggtctttctcaaatctccaaggtaattaacagaccttagagggagcaaaatacaccatgctaaagtagacgatcaggctatcactgtaaaatcaaagtgtttttgattattattctgtgatgaacaattggacattggagattattggttttgttatttagaatctattcacgaagtggtttttgagatgattggattttacaggtgaatcgcaggatcgtcattttatgtgaccggtcagaccgggtagtgtgtgccggtcagaccggcgtgtaatgcgcggtcagaccggcgcagcccacggtctgaccggccgacactgtgtcggtttcggttttgagttgtttatttggatatccgaatttattttatgattatgacttctagatgactcgatgtcaagttggagatagcttggtctcggaatatagtttctttgtttatttcatgtgtaggtgactcgatgtctcgggagagtatttgcggtgatggaccgggagtcggcttggggataagatgacgtccatggtggtcagagatcatgtgggatacttaggctagagttgatgcacatggttgatggagattccatatggcatacgatggagttattgtgtgcgtatgggatgcggagtcgaatttggaaggagtctaaatttggggcgattggttatgtaaagtttcttacttgtactagaggatttcctaaagtgtttagaactcctagtatgagtttggttcgtggctttaggctgcctacctcatgtataaatagaagggggagcggaggccttccggtatggcttttgaaagcaatagaattgagttttgagttaaggtttcgagtttagtcgagatttttgtaaagagtgatgttggtgcactttgaaaacacagagagaatcaataaagtcgtcatgtactttaagagttcttcgatttgtgtttcatcgagtttcggcggtctaaccggcgatctaccggcggtcagaccggtgggagcacggcggtcagaccggcggcggcgacaggcgcggcaggcaatctcggcggtcagaccggagattcaacaccgggctgtcacaccccaatctgataccggcgtacaacggcacctgataggagcgtgtcgtatggaaaacagcgcgaacccgttttctacgaaaccgcgatctcggtaccagtcccaaggacatagtgcttgtacccacggtgacaaatatgaatcaaagcaatccttaaataaatagaggacttatttaccttaacttaggttgcagctcagacagcccgagaatacaaccgacgacgcggacgaggaaacaccaacagcagcagcagcagcggaaccaacggtctaacacccaacaccacaggcgacggctgggaaccaggacgaaaccctaatcttcacttcactttatcttctcttcagggcggaggaactatatatatatttatatagagcaagggtgagtactttcgtactcagcaagtcacgggaacttaggtgtttaatgcaagcttggaagagaggcaaggttgttttgcaaatcttttatttgaagatattttgaaatcactaagtgatttatttctttctaagtttgggccgaaaagagacttacgtctcgtttcgaccttaagagatgtttttcaacagctcatttggtaatgtaccgacctcccgggtcagatcattacttctcggctcccagagccattccacttgattaatcggctcccagagcctttttcattttctcggactcccagagtccagctgcccagcagcacaacaatccgcttctactcgggaagcctagtctatgatgccctcagacatcccgaatcacacagattcgtttctgaccactcaggtcatccatctgtcacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataaacataggcctttttaggcgttcacaaatcaaactccaaccaccttgatcggtaagtgagcaagcttctcgtccttgccttactaagaacccggtttgtccgaccccgccccggcgttcccaactattggcatgcgaggcttccctgaatcgactagttacttagccagggtgtcccattccaccttgtggttgcactttgattatgttcgatgagtttcccacaggaatcggtccttatatgcgaatacaggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgccagttgcaaacaaaataataatgattttccaattataggagcaattggtcaaagggtgacttgtctttctcaaggtcttcacgaagctttacgaatcttcgagaaatcccatgatcgacgaaaatccgataaccgcaactatacgcaaacaatcgaaaacctaaacaaaagaccaaaagaaagatcctatttagactaaataatagtgccattaaacagatctcaattttacggaattattggaagtggaacggagtcgatcggagctacggatcaagggatatgaattttggaggtctaaatggattttctggacaaggaaatgttttgtcggaatttatggaaataatattctcaagaatattattgacagtcactgaccaaggaaaatgattcatggaattttggaataaggaattgatttctgaaagagggaaaaatgatttattgaatttatagaaaagagaaatatttgtggagtattggaaaagatattctcaagaatatctttgactcattgacaagtggggccaacaagaagtgagagtgagagaggatagatgggctgcggtccaatgggtggcggatgtggtagggggaggacgagggagcaaagttagactttgttccacggcagctggtttggaagagagacgcaacatagactttgttccaaggagcgaggagagaggtgaggcccatcagctagcgagagagagagagagagaggagatgggccggctcgggttgggcggcccacggccgggtgggcgtggccgagccgagccaggcctgcgcgcgcgggcgacgctgaccggtcgctgcttgacccggtcaagctgggccggcgggccagggtggcggccacgttggcacgggagagagagaggagaggagccgggccggagatcggacggctcacggcgcgcggcggaatccggcgaacggtggcaatccggagcgagcggcgggcaccggaagcgagagggggtcacggaggttccatccaccggctcggatatgggagagaggcgcgacggaggccggcgacggcggccgtgcggcggcgggatgggtggcatggcgcgggagcaaaagaggaggccggcggcggaattggcggtttggggtggttcattggagctcaaggtgggtggcggcgaggggattcggcacgggaccgaccggcggcggcgcgcgactgcgcacggcggcggcgggagcaaggcaccggcaagggcgcgatttggaggacgaacgcacaaactaccatgccccagtgctgtttaggagtcgctagaggatatagatgagaggatttgggcggggagctcacccatgagcgggaacggcggggcggatggagtcgcggcgaggcagacgtgacggcgggcgggcacggcgcggagagtgaaagggaagggcgcgggcttataggcgaggaggaaaggtcggtttgaaggagggaaaccgacattggcggtcaagggagctcggctggtgttcacgggcggcagcggcggtttcgtgggcaaagcgaaggcggcgacggtgtggatgcgttgggcggcgaagacggtggatcgagcggcggaaaatcgaaccgcgggagcgggaggattagcgcgggctggcgcggtcaaggtgggggcgacgagctggcgctggcgtctgtgtctctgcctccgagcgctagcggccaaggagcggaggcatggcgtcgttgcttgggagggaaaaagagaagggaggacggtggaaaggggggactttaccatgccggtttgggaaaaaggaggtgggagagggagtgctctgccttcgggatttggatggacgcgggtggagcggcttgggcacgcgctgcagagcttgcggcaggcagcggggccgagcggcagcatgacgcaggcgctaacggcggcggcgaccgggcggttgcgcggcgcaggcgcggcagggctgacggcagcaacgaccggccggtcggccacgcgcgagcgcgggaaagagcaaaggcggtggcgagttttgggcggcgacggcgggaagcggcgtcggcgcgagagagagacatcgagagagagagagagggagaaacagcgagagcgagagagacagagagagcgagcgacggctctctctctctctcggctcgcatgcgtgcaacgcacgtgcgaggggggggagatgatgggctgggaggggagatgggccggggaggagagtcggtccatccaaaaacatagggaggtaaagtagacttttacagagaaaactgatttggatagaattggagagatttagggtttggattcgaattcaaatttgatattcaaactcgagggtttagggatatatcaggggaaactcaaggagaagtcatggtaaggattcaaaaggaatacttggatatttgttctcgggaacatagggtggagtctaggaaaggattcgaggcgggatttgaataattctggattcgtagaagtatttggcgaggattcaaaggaaggatttgaatttcagaatttgatttcagagactcgaatcggaagaggaatttggatgagggggaggatttttgatttcgatgagagggaacaacgggattaaattgggatccttggcacaacttagactctcacacagagaacgaaaattttcgcatttaggattttgccgaattagttttttaacgtctcacgaaaagcggagcattacacggtcagaccagcggcatccactcggtcagaccagcagatcaatctcggtcagaccgacttccgtcgatttcgagggtaacttttatttccgctaaaagttttcggtttttgggtataccaaccattcaacccccctctggttggcttagttcttgtgattcgatcctacaatcacccctcatggtaacctctgcaccaccaggaattgtaccttaaaatatagcaaatgaagtgaattaccttttctaaattcaggcacaaatggaatctctatgtgtagttactttattgatcgcggtttatcattgacttcattgtgaactggagatatgctttatgtaccagtatttttactgcctattacagagagcagtgcgcatcaatatctgtatgtggaacctataatttcctattcctttttgctaaccgtgacattctttagatg

SEQ ID NO: 79020 - DNA, 3064 bp, Oryza sativa
aagggattgtgtgaccccaagcagtcgctatgattttggatagccaggacaagatgatgatgagccaataattacacaaagttagcactagtgctgaccataagaatttgatgagatagtttcagctatatctttgtagcatcagtctactattcagagttgaggtattgattagtgcttgaccatcaagcaggtggtactttcccagtttcacatgttcaaaaacagacgtgtcaacaaatgccagcttacagtgagaaccggtcaacctgaacatgtttaacaactgtaaatgatcttgttagggatttaccaattcgagtaatcctccaatattaatgggtacaaatatagaacgattccatgcactggtggagaaatactttttagtcacggttcgcaaccccctgtagtcccggttatctttagtcccggttcaaatacccgggactaaaaatagatctttagtcccggttagtaacaccaaccgggactaaagagaggggatctttagtcccggtacaccaaccgggactaaagagagggttgcggcagtgagatgatcccctttttctttttttttcttttttattttctcccaaatcaagtgggatacatatcccaaatcaaacccccaatccacaaatcgaagtaacatctcaaatctacatcacaaatcaaagttacttatacacacaaataaatacatcacaaatcaaatacatcacaatatcctaagaaattactcaaatacatcacagatccaaacaatgaatcacaaatttgtaacttctcagtcaaatacatctcagtgaatcatcacaaattaaaaaaaaaagaatgccgttgccaccgccagtcgccacgaacgacgggcgcggccccaccggccgccgggcgcggcctcgccgcccgccgcccgccgccctccgccgggcgcgaccccgccgggcaccgccccatcgcccgccgccggccgggaaggggaggaggaaggggagagaagggggaggagaggaggaaggggaggagttggagaagagagttatagaggatagatctgaggatagagggtgagattcgatctgttaagttgtaattgtggatgagaggataagggatagggattatatactacgtgtttaattttagtcccgattggtactatcaacctcttgatctttagtcccgattggtgttaccaaccgggactaaagatcaaaatttttataaccgggactaaaaacaatctttactcccggttctttttggatccgagactatcgtggattttgccggaccgagcaaagatggttcctccaccagtgatgtcattccttgaataagaaacacatgaggaacaatgattcaactaaagtactccagcattaggaaatttcaagttactatttgcatgatgaatcttttttgctctgctgtggaaacagcaacatacagacttatcaactaattttggaagaacgagaaagaatcaatctggtttggtggggaagatcagctccggcatcgtagggcacaggacaagactgtgttgcagaggttggagacgtcccgtggcttcacttatggactaggccaaagagatgtaagttgagtggagggaggtagcggactgagctagggctaaaaagaaaggaaggaataagctttcaaccccaaaacaaagcaaagatttaatgtttcaatttaggaaagattttcacatcttatactacacccttcgttctaaaatatgagagattttggacggatgagacactttctagtacaatgaatctggacagagagcaaattcagatttattatattaggaagtgtcccatccgtctaaaatctggagattttgatgtcccatccgtctaaaatgtcttaggacggagtattagattgtactcactactggattgtttttattttggtatgaagtacagcctacaggcgagggtgtgtttggttgcatgcatgaaacctggctcgcacgcgtggatgcagtaggtcgctgtttggttgcctgcagctcgctcccagcctggtcgagcggatgcaaaaaatcccccacagccaggctgagcagaaacgctcaagttgagcttcgctactcggccaggcccgcacgatgcaacgcgctgcatccgcgcatgcagcgccccgcacccgcgtgtgcaagggcaagcgatggggtcaccactccgccccttgctcctcgtcattttcccccagcaatcgacatggcgaagacgagctctgctagagggagtggcgcccgacgaatccaacttgctgctgcatccccctcctcttcccaccgtctcccaccttcaatatccggccaccgccttgcccacacgtccccgctgatggtgtgagcactgccagatccaactagtggtgaggcggcaaaaagcttgacggtgacgagctcagcggaggtcgcggcgacgaggacggcggatccaccttgctgccgcatccctcctcttcccatcgtatcccatcttcaatcgtcggccaccgtcgtatcccaccttcttctgtgccggtcagatctggagcagaggagcggcaagcggcggatggagaggagcgcaggaagatgggtggaggaacggcgagcggcgggcaggtgggcatgcatgcggctgcgggcggacgggagttgatgacgacgaagcgacggctgcaacgccgatccccttcctttctctctttcgtttcttttttctccccgggttttctgttttctttttctttcgtttctcactagcaagtactccagcaacagagaagtcaatgtatgcagaattactactaatagattaattagttccactggttcatctagcttaaagaaaaactagcatggtggcccgcacagattgcgcggctagcattattatattttctctcacgtaataacatatatgttttcttattatattattcaaatatattaaaataacatcataattttaaattttacaataactttacgaaactacaaatgtgtaatattcatatggtattttatatttaatgcgagata

SEQ ID NO: 79021 - DNA, 1970 bp, Oryza sativa
ggcgcagcgcacacttatccggtccgcgactggtcgcggtgtgtgaccggtcacagaccggtcagatcgcgggttaggtggcaacaggtggtctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggagacgtgcgctctgcttgttagaggtcacttccggctgtagactagccctcattgtaaaaagcatgtttcccttcttaggcagctagaggcccatgtggtgacccctgaccagataaaaaggaggcccaggcctaggaaaaaaagggggagagagagaagaaaggaggggagttgggactctggcgaagggtttctagagcctgaactctctttcgctctcggcctctcgggattccttcacgcaccgatccaccagaacacaggagtagggtgttacgcttctcagcggcccgaacctgtctacgtcgcccgtgtcttgcgtatttcctctctcgctgacgttcctcagatcgagggcgaagaatctcacttagcgcccccggccgaatcggcaaaggggggcctgcgcggtctcccggtgaggagcctcacgctccgtcatctggcgcaccaggtaggggcgcgcgtatttttctaagccctcgtcctctttcgtgtgcgccaagcttctctcgctcagcccaatggtcgaacgggcagtggcgcacagcctctctccgaacgctagcggtgacgatggggagcagaacccgcgccgtcgggctcgcaccccaccgttcccctatcgccgaaatcctgggcggggggtggcgctcggggaggtcgaaagatccgtgacttctccgcccgcgggcgacgggggaggacggcgagacggggcgcgtcgccgcctcgtctactgcgatggcggcacgccccaaggcgcgctccaggctgcgggcgcgctcctgcgtcacccgcctgtcgtccccgatccaaagactccagcccgcgttggctggatgacgtggccgacttggtcatgacgcgcagcggcgcctaggcgccggcgggcggtcctcccacaccgaggcctctggcgctgccgccgccggctccatgtcgtcgaggcggagggcgcggcgagcggcggccgttacccgccgttcgtccgccattccctcgtcaacgcctccgacccaagaatatgtgcgtggggggccggatgcccgcctcgatatcgagcgccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagcctttggaacgtccgttagcccccaaggttccggcccaccatcaccgaaaaatacaacggaagcgtcaaccccgccgagtttctccagatctacacgaccgggatcgaggctgccggggctgacgacagggtcatggcgaatttcatccccatggccctgaagggtcaggcgcggggttggctaatgaacttgccacccgcgtcggtccactcttgggaggatttgtgccagcagttcaccacgaacttccagggcacatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcaagaagatcgcctccaaggagccccagaccaccgc

SEQ ID NO: 79022 - DNA, 11341 bp, Oryza sativa
ggcaccgattgtttaatactacgggatagctgattcagagtttcagactaagctatctatgtgttcgaccaaatgtctctatggttgtcaagcagatgcagcagcggcggaggagggaggatcgggccggggcgacgtcggggtgggaggagagagcgccgcccgacccgagacggtggaggacgccggcggtgaggacatcatggcgggatggatgcaccgccgccgccatcgccaagggttccaggtcagcttttccagtctcctccttcccctcttcttcctcggtcctctgattctttccgccatgagttcttgttgttctaccagcagcaagtgttatgtgcaaaacacagggcgaggagcaaacaagatgcagatccagcgccatcgatggctgtgtcggaagaattaattaatcctggtttggataaatcttcccaagcaaaccgaattaatcttggttaaattgaggagtttagcgctagacaatcttaataccattggatggtctctcctaggacagccattccggataaaaaggagtttagcaggcagtaggctaaagaatttgatgcaaactctccaaaatgtgatcctggtttggaagggacaatatttgatcatttcaatcttcttgaatgtataaggttaagtattagtaacatttaggagggagcatcaactaaaacagagcctgaaaaattattgctggcccataacattcatttcattattggtatgtattccggccttatttatgcttcatcttatctgttagtgtgatccgagaaaattagagtgtggccacgcctgagtttgctctgtgtatatacacttcttcgacacaatgcaggttttgatatagcatttgatgaagctataccaacatcaatttggttcctcagctctttccctggtgtaccattgtagatctaattaaagagcacagttcatagctgacacagagacctgattacttatagcacaacatttaaaatctctctcctaatggatgttaaattgttataattttttccctgtgcatgagactcttttttatcattacagctaaagttcatttctgatatgtttttgtttcagatataagatgcatggcaagaagagcaaagttgacaatttacctcaaacctaaggaaatccacgataaatgtaggtcaggagaaaattgcaattgcaacacactctgcatgtgtggttgcttccatactgagattttttttcaatgagataagacctctttgtatttctatgacaggtggaacaattaatacgtgtaagatagatactaaacttcaggggggggaggactgcatatatcaaggtctgttctacaatctacataacatccaaagttctctccccaaaaatgacagaagtgcaaaatcttcattgcgtccgttttgcaatattttgaagaagtctgatggaacagtgggaatgccaatattgagatccagaagggttccaccatcagaggtatgctttgatcattgaattgaattatattgtaaaaaaccaatgttagaaactgaaaaggctccatgacatactaatatttattttgattggctgataggactaaatggccaagacaatatttttgaatttcaaaacttttacatccttgatcctagatgtatcgaatacaccatgcgaaggtagatggtcaagttgtgcccaactgcctatgtccctcactggtaacctctgtgcactttcaggaattttactgtacaatacagaaaatccaagtgaacatcttttgcttaacttatggcatacatggtatctctaagagcagctaatttatccattgcagtttatcattgactggagttatgccttatgtaccagtgcttttttactgcctagggagtattacagagagcagtgcgcatcactgtatttgtgactggtacaggatcaacatgattttgtctcgttcttcttttcaatgttttttttttctggagtgtttcttgttggaaaaagagatgaaccgagtgcctagttctctcgcagtactttgtggcagctgagaacagtacgattgctgattatttaagtggatgctgacagcagttgatctcttggtttgcactaatctgaatgtttttgtttggacgtttttgggcagatgatggtcattggtgatgaaggagatccgtagcaagatgatgaccatatgaatttggtgagacagttttagctttatcatcttagcatcagtcaagtctagagagttgaggtggtgattgatgtctgaccatcaagcaggtggtgcttttcgcaatttcacctgacctttttttttttgttcaattgctgagggaaatcatatgtgatgcctcaagtctctctccaccaatgccagatttcaatccagaacttgaacatgaatagcaaaattgtaaatgaatttgctaggaatttaccatttcaagaaatcttggaatattaacaggcacaaattgcggagtagccaacctccatatctttcgttagaataaggccatcaccaatcaaggataccatatgagtgtcttcactaactgaagatactgtgcgggaaacacctctggagaataccctggtgacccaatgagtgttcctaacccaaaaagcctacgtagttattttactgtactacccctctcttctcccccacttcctctctcttccccacatttactcatctaccggacccgttcacatcgtggtcctcgccgccgccgctcgcctttccctctcgccgcggggccactcgccgtcgccggtggccgcgagggctgcctccctccctctctctcctcgccgtcatcgtcgccgctgtggccgaagcgtcatcgccgtccgccacctccgcctccctccctcactctcctcgccgtcgtcatcgccgccgcggccgacacgtcgtcaccgtccgccgcctctgcctccctccctcactctcctcgtcatcgtcgtcgccgccgtggccgaagcgtcgtcgtcgtccgcctcctccgcctcgccggtctcctccgcctcgcaccgtccgcctccctgatctcctccgcctctcgccatcacaggtcgggggcggcaaaatccggcgccgtagcgggtggatctagcccccccggctagatcggggaggagatggtggcggccgtcgcgctggtcgcggggtcggcgccgtcgccgtcgcggggtcggcgccgtcgcctccgactcctccccactgccgtgtgcctcccgcctactccaagcgacgaggccgagggtggaagggcaaagttgtggtgggggagccgtgtccacgagccacgcgctcgtgcaacacatagccccaagcggtggctcaagaaaaggagcttgagccacccgtcccccgcctgagggtcacgcctccctcccaggagacgacccggcgacggaagttggttaccgtttgcgaggctacgggctggagacacgcattggtgatgcccctaagaaacatacgagtaaacaactaacgatgattattttttgctttcaagtggtaacagcaacaacgaaatacaggttttttttaacagcttctttcagggtgttcgaccaggaatgacatttgcaagactgaagtcaccatcaggatcatatacacacacgtcagtttcacaatctcaaagatgcaaaagcatcaaacaggtcatgaaagaggactaagattacaaacacaattacagaaaggccctttgctgtgcctctatttgcacttgttgtactcagtcaacacgtgccacgtgagcttggaacgaaccaaagcgtgcagagaaggggcgccacacgagcttcatcgcatacttgctgctccctttcccttaggaaggtcaggaaagaagggttttcacttttagaaataaacagaaaacagtttagaccaacaaattccctgtttccatttacataattctcaaaaaaatatatatataagtcttgtaacttgtatgaaagtgtttgcaacgaaacacttgtatattgttttcatgaacccccccccccccctaaaaaataactatggccaaataggttgaccacatacacttatctttagaaaaaaagaactttgtttgctcgaggacgtacaaattatacttcctccgtttcacaatgtaagtcattctagcattttccacattcgtaatgatgttaatgaatctagacatatgtatctatctagattcattaacatcaacacgaatgtgggaaatgatagaatgacttacattgtaaaacgaagggattaccagttaacgatttcactgatgatttcaaattaagaacagcgacatatgaaagagacgaggttatcccctaggttggccaagtaatgtgtccaaccgactacgaaaatgacctgaagcctcgaaaatcaatagatttcgtgtcgtcatggtgattggactgtcagctgtagattgcagccaatcgaccgcgcatttcctggaaaatcttgctcggtagagccagtagaggctacctaggacttttgtaaaattgaagttctaatttctggagctaaaagaattttaattccaaagatcgatttcttgtccttttttatgttcgatttgttgtcgttgttgcctgaactggtcagcttgcaaccaaccatatatcctttctgaagtgaagtgcatctctttaattaattcgtcgtgtactcgtgtgggcagtgggccagccagccgcccgccactctcacctgtacttcataccaaaataaaacaatcaatctagtactactagtttaagatatggagtacaatctaatatttcatccgtcccaaaatagatgagacacttcctagtataacaaatctaaatagtctctttgatcagattcactatactagaagtatctattaacgaccaaatttggtaaatcatatattggatttggagccaaagccgaagcggatttggaaggagttcgttatttttggggaacaaagtgtgcatcggctatggattgcatcggctagtgtctgcatcagtgaatcggataagaggaagccaatgtagccgatttcggcaagataattatagaatcattgtcaaaatcgactgaagtactgtacaactattgctaaatacggattgagtccgaagaaggcaattgtatctattaattaggatattctagtagtttctttatagatattttcggtaagagttcgcctaagggacttgttcgtgttttaaagttgtaatagaagtagagtcgtgtccgacaaggacatattatatattatgggtataaatatgaccccataccttgtaaataattaacatcagttcaataacacttcaataatactttcagcgcatcaccacccttttctattttcattgtttcgacgagttcttgctttcgagttgggctgcatcggttgcaatctccgacgaaaaggtaaaacttgttatggcggcttgcgttctcaggattagtgcttacatccttatgacactctaatcttgtttatgtaaatcgccaagttatcatatatgctatataatctagatcgataattttatatagttctatcggctagtctctattatcgaaaccagccaataagattaggtaactttgttgagttagattatatagtatatctaccatctcgaaaaagttctcatgggcttgtttatcagatattatgtttctctttatgcttaatgttgcatcggttaagtttgaactattaagtaatatctagaatcataatctctagcttgcttcatgattaccgatagagatagcattggagtttcagccgatcttacctggtttagctatcttgttcttgatttatctactcgatatgttaaatctgccctttatatcaagatctcattaagaaaaaatatattaagctcgatatcaatctgcttagattaaactaataatagattgattcttgttcaatatatttaatctataatgatatcttagtataaaaaagtatcagagcaatagccgatacacactagatttgcctatcggctatgatatgagtttatataatcttttgctttcaaatacttttagacttgagtgatttatactgctttggcagccatccgatctatccaatcacttggtttaaacatatttagaagaatagattatattgtgttgatatttacagccgataaagtgaatttagtccccttttcactatatacgttactgtcgatccaaattatattgcattggctcgatttagacaatatgtcattggcaatttagctgatcggctatcgtttatggatttaactttgaattctttgtttcttgttggttgcaggatcaaaccaactggcacgctctaaacccgaaagcaaatctttagacctgcactagagtaaaacaaatctctcaggccagtgtgtgtttttttgcatcaacaatgtctcatccatccaaaatctcttatattttgggacaaaggagtagtataagatgtgacgtattcacgtctattcagatttgtactagtagaatgtcacatttcgtattaggtttgtttactcatattttgtattccgtattaggtttgtttttttaattttagtagtcacattttgtattaactttgtttattttactatactagaaaaatgcccgtgcgttgcaacgggtgaggccgtgagggtgactttaatcttattattgttatacgggtaaattaaggtgaaattcactgtgagaatttgcttggatatatatattttttataaaatcataagctgcaattaggagtccgatcatcccaagttagcatgcgagttttttaaagagatttcttatacgactccttctgtatttccaaaagttaacgaacttaaaaactgactcaaatacggatatgtatttccaaaagcgaacgaagttaaaaaccgactcatacacggatgacgtaccaaagttccagcaaaagcattttcaatttttataatagtagactagaaaaaatgcacacaacgggtaaaagcgttttttctggtataatagctattaggagctaagcaataaattgaaacattaagatcgctaaatacattataatgaaaatctttcatttgttttgggctgaaagcctatagcttattccttcctttttagcccctccgtacctccctcctcagcttgcctctctttagcccaacccataagtgaagctgcaagcccaactagcacaacgtcttcaacctccggaagacgagatgtttacctatttgccactcttacaagttgcaattaaggatatgctactggacccacacgttatagatacatgagggctcacatggtagcaaattcttaattgccacattttaaaaggggttaattggatccatgccattataaaattgtaggtttggaaaaataccattgctatttatgaaattagaaacatgccattactattcaacatgtctttgagacgtaccactgcttgtcccttcaccgtgatttctaaacttttctgatcaaattacccccgtcttgttcctccttttcttcctcccacctatttctctctctcctctcacccctcctctctcttctgaccaaaaattagaaagcagcttcggcagcacagaggagaggagaggagcgtgatggagaagaagacgagagaaaggggaacaagaggatggaggaagaagataagggcaatttggtaaacaaaaattagaaatttcagcaaagtggtaagcaatggtatatttcaaagatctgttaaattgtaactagcatggtgcccgcgcagattacgcggctagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttagttatttgtaaattatatatattcctatatggactctagactcgtcttttaatatttcttttttttaattccgaattttctgtaaattgtatttctatatagactctatgctcttcttccaatattatttatttttatttctgaatttttattatttctaattatatttctatgtggactctaaactcatctttcaatattctttaatttttaatttcgaatttcaggtacttctaaattgtattcctatattgactttaaactcttcttcccatgtttttcttaattttgaattttagttatttgtaaattgtatttttatacggactctaaactctacttttaattttattatgtttattccaaattttagttagttttaaattcctatatggactatatactctacttctaatatttcttattttttatttctgaattttttttcttaattgtatttctatatagactctatactctacttctaatattccttatttttaattccgaattttagttatttcctaattgtatttctatatggactctctactctacttctaatattccttatttttaattgttatttcctaattgtatttctatatggactctagtctgctcttctaatattccttattttttaatttcgaatttcaactatttctaaaattctatctagactctagtctcctcttctaatattccttattttttaattccgaatttcagctatttctaaattgtatttctacatgcattctgctttttatttttctctgattaatgtgagaatttcttcaggtatttctaaattgtatttctatatggactctgctttttctttttcttcgattaatgtgagaatttctaggccatgagagcgaacgtggaggctcctttttctattcctttaataatataactagctgggtggcccgcgcaattgcgcggctaacacctatacaaaattatatattttatatgataaggtttgaaagaccaaaccctatcattcccgtgtttctaattttttaattttacaccagttgctacccgttacttctgtcatatccttctttatttgcttgcttgatctatcactgtttctattcattctctttggaaccttttaaaattggatcttatagtttttagagtttatcgtctcgttgggttttgtttttataatttatagaattcccgtcaaacgctaccattatactcctctacggcccgtccactgcctgttatctttattgtcattggtattttaaaaaacaaacataattgtcgtttaggtttaatttttttagtttctagaagttccgtcaaaacgtcagcgactttgtcactgtactccaatacggctcgcccgctgccttccttctttattctcatcgagattttaaaattaaacatgatcatcattggggtttattttttttacttttccgaagcccgaaccttttaaaattggaccttatagtttttataatttattgtctcgttggatttcattttttataatttttagaaatcccatcaaacattgccactatactcctctacgacccgtccgccgtctattctttattgtcattaggattctaaaaatcgaacataatcgtaggaattcttttttttttactttctacggtagctttaccaatgtactcccgtacaacccgcccgctatctcttctttcattggggcttattttttttactttctagaagtcctgcaaaccgccttgaccgggtgcttcactacctgcccgccatcattctatttggtgttttattaatagtttttagatgtcctttataggcctattacttaataaccaaccctactcatttatagctctattacttaattaatcacgtcatgtgtttttgatggtcttttcttccaatagtctttattttcttatcaccaattttagttatttataaattgtattcctagttgaaatcttattttccttttctaatttcagattttattttattttttatttcgaattttaactaataatgtattgtgttcttttaatattttattttttattttcaattttagtcgttttaaaattgtattcctacttaaactatctttttcatttgtccaatttcggattttattttatttttcattccgaatcttaattaatctcgtattgagttcttatatatactcttatttcaatattgcttatatttaattccgaatttcagctaattttaaatagtattcctagttgaactcttcttttcttttattttttaatttcgattttttattttttttattttgaactttaattaatctcgtattgggtttttatatgtactctacttccaatttgcttaattttaattccgaatttcagttatttttaaaatgtattcctactcgaagtcctcttttttcttcttctaatttcgaaatttattttatttttattccgaattttaattaatcacatattgggttcctatatggactcctctttcaatattgcatatttttaattccgaatttcagctattttttattgtttttctatttggactcttcttttcttttttccgattaatgtggaaatttttagcctccacagcgaacgtggtgccatttttttataatttttagaaatcccatcaaacgttaccactatactcctctacgacccgtccgccgtctattctttattgtcattgggattctaaaaatcgaacataactatcgttggaattctttttttttactttctatggtagctttgccaatgtactcccatacaacccgcccgctgcctcttctttttattgtcattgagattttaaaaatcaaatatgattatcattggggcttttttttttttttactttctagaagtcccgcaaaccgccttgaccggttgcttcactacctgcccgccatcattatatttggtgttttattaatagtttttagatggcccattaaccgccaccaccctactcctttataggtctattacttaattaatcacgtcatgtgttttagatggtcttttcttccaatagtctttatttttttatcaccaattttagttatttataaattgtattcctagttgaaatcttatttttccttttctaatttcagattttattttattttttatttcgaattttaactaataatgtattgtgttcttttaatattttatttttaatttttaattttagtcgttttaaaattgtattcctacttgaactctctttttaatttgttcaatttcggattttattttatttt

SEQ ID NO: 79023 - DNA, 7661 bp, Oryza sativa
gcgcataaccatgggacgggacagaggagaaaggggaaagagccaaaagagagggggaaggagaagctgaccaccaatggccgcgctgcgtcggcggcggcgcctccatccatcctcaccgccggcaatccccatcgccccgatcctccctccctccgcgctccgctctgtgtctgccgatcctgatctgctccatcctccctccacaaacattgacataactactagtactaggctgcatcagccacatggtaatactaataaacaaggcatatgtggtgattgaatatcaatgggcgactcaataagaaatgtttggattggcacgtattgcaaacacaaagagattcttttttgcttttttttgcaggacattcaacacgactacggagaacacaaatcaactaactctcctaaataaatcaactatactgtagtaccgaatacttctcctctagtactcctcgctcgtccagctcagcggcttggcacttgaagaagtctggaaccgaatgtccctggctggttggtggggccatcaagttctcctattttttttttaaagaaaagccacttggccgccggattggcagcccggcgcgcgtgacgcattgagactttaagccactgacatttaggccccacatgttagtggcccaatttcccggtggtggaggaggagtacagcacagcttatataaccacccccaattcttcttcacgaaatcacaattcacaaagcctcgcatctgcatttcgcaagcagcctcacgcgccagcagcttcaccgtccgcaccctccagtagcctagccctccgcagcgccaagctactcgtcccacaccatgggcgtccaccctttcgccaaggcagccaacggcttcgtcatgcaagccgatgccccggacgccaagctcgccgacgtccaagccgtcgcggacgcaatacacggtaacaccaagctcgccaacatccaggccgtcgcggacgtcatccacgggaacgccaagctcgccgacgtccaggccgtcccggacgccatccacgggaacaccaaggtctttgacatccaggccgtcgcggacgccaagcccgacgtccaggccgtcccgggcgccatccacgggaacaccaaggtcgccgacaactcggtcgtcgcggatgccatccaggggaacaccaagctcaccgacgtccatcccttcatggaaggcgactgctccatcaaactcgccgacgctcaagtgcgcaacaaggccgtcgatggcttcgacgccacgaacatgagccctttggtcgcgcggtgtctcgcgcaccaccttgccaaggtgtccgtgcagagggtgtggcaggggaactacccggagatgttcaagccagtgctggacgcgttcggtcagcctcatcgccgcatctacatcgccttcgacttcgagttcgccgcggacgccttcaccaacatgcactgctggccaggatgtaccaaaaccaactacgaatacttgcgccggtacgtgaacgagttaatgtcgtttagtttggcctcgcatctctaattatccattcaagaatgatgtcgaagaagctgcaattaaccttccttcacaaagatattaatttcgacttacaacaaaaaaaaaaaaaaaaaaaaaacttgtgcagctacgtgaatggaggcgatgtagttcagatgggtctcgcatttgtatttgaggatgaagtcgacgaagaaccgacattcacggcgatggcactggagatcaatttcgacttcaccgtagagctgcgtaagtacaatggcgaggccataagcttcctgtctgaacaaggccatgatctcacggagcacagggacagaggcgtcgtgccacactttgtttatacggggctcttgagccacctcccattcggcaacagctccgtcacctggattgcctaccatggagattacgactttggtttcttcctccgcctgctgcaagggggatgccgtggcagcagccatcttccacttgagctgcccacatttctgcaccaattgcggctcaacttccccagattgtacgacatccgtgttcttgggcagctggtgcagcatggcttccgcgggagcctcaccgcgatcgccgatctccttggggtcaaccgtttcggcagagggcaccacgccggcgtcgacgcactgcttacactgtcatgtttcttccagattgtcagctgtctttcagcctcaggagaccaccagctgcatcggctcgattctcgccagggtttactcgccggaatagcccaggtgaacaaggctatcaaagatgctcgccacattggcgaccgtaccagcaacatcgatgtcatcaaggtgcaagcaggaaacttggacgaagaggcacaacgaattcaagagctggtgccaagcaacttcaacatcatcggagtagaagtaatgcaccctcaattgggcaaccgctcatatgcaatcggcgcccaacaaaattatgaatcgatgaagacctatctgaaggatgccgactcattcgaaattgtcattgcattcgtgaactctgaaggaatgttggcatatgattgtgtgtggaaattctgcatcagctccacaccacgtagtggctgtctgcatccccgacagtttacccggcttatggcgtcttgtggagcaacgagtaatcctaatgtatcctgggtgacattccacggagcacacgggatcgccagcctgatcagctcattctctgcacctcaagaccttccaagcgactggccttcctacgtcgagcaacggagagcatatttccctggtatgtatgatgtcgcattgattgtgcatagataccctgacattggcatacttcccacaacggggtgcaaaggaggcttgtttgatgttgcccgagctctggacctgaacttcatcaaggacgacaatccggtaaccagggttcttcttactctgagatgctacatgagattggcagatcgtggtgatttcccagacaagcagtcagctgtccaagggcagcttatggaaaactgctgctggaactgcccagcaaaacggatggagcatgcatgatcactcagggtggtaccggaatccttgtggtggctgtccatgttgtcagttcagtttagtggtagcttttgttctcgcacgaaattttcctgtttgagactcagacgagtgaacttcctatgttgtaacagtgtaatttttgttgccttttgttctcacacgactcctctttgttttaagactcacatttatagtttgtaatataaaaataagagtgttttccttttgtgaatcggcttgtatatatgcagatgaatgagtagagaagtaggatgtggatggcgggtgcgaacaaaatgcatcaattgtccactacagatgagcgaatgaccaattgcgaatgcagactgttagaggtgaatgttgtttggacttgatggtcctttcctgactacaaatgagaagtgatggtagctgctattagtatgtgttactagccaacaggttgtgatgattgcgtttggtcatgcagtctgaaataaaacgttactagttgttttcttttgcatcagactaaaacaaatccccccaaaattccaggcacctgatgcaaatgtctcagttcaagggggaaaaacaaaagacataaaccttgagagatgttgtatcgttttatcctcctcctaaaatgaaattagcagagctactgccctttctcctcaaagaaaatttgtacgccattagtattagtgacattgtcctatgtgaattagttttgaggttaatactaattgcaagaagtaagtgcagagcaggggaaacagagcacaagaaaagcagaggaggtcgatggggagagagaaacagatatctggtgtgtctgcgcgcgcgcgcccaagctgctgatagtgattgttggccgtggacgctttcaacgggtgagagtgcgacggagttgggcacgtttttgtttttcgggtggcaccacatccacaatcgtggattggaatcctctgccgttatgccgttagcacgtagtaacacggcaagagagctatgttatacgggaacagtgtatcattggatgcgtgatggatggtttagatgaactgctagacttatcttaaaataaatggtgccgtcttataaccacggtgaaaagttactcattccataaaagaaaattaggatgaaatgtgacacattatagtattataaatctgagtctattttgtattactaaaatactatattacatcatattctatgattgtttttaagagataaaaggaagtatatctatcactgttctactcacgtcaacagttaccctctaccttactactcactccgtttcaggttataaaacattttgacattggtcaaagtcaaactattctaagtttaatcaagtttgtagaaaaaaataataacattttcaacccaagacaaacttgttatgaaaatatattcgattattgatttgatgaaactaacttagtattataaatattactatatttgtttataaacttagtcaaacttaaaataatttgattttaaccaaagtcaaaacgtcttgtaacctgaaacggagcaacggagggagtagtagtctaagagcaggtacaatagcaggctattagccaactacaaacatattttaatgagataaaagatgagagagaagatcagcgggctacagatctgtagccagctgcagcacggactccaagacgcaatgtgtgtatgacaggtgggaccatatactaatagtatagtaagcaattattgtatgaattggctataaatgaattggagcttagtaatgggctgtactattaaacttgctctaagaggaaccaggttggtggtggcgtggcgtttaatcgcgcgatgaagaaaaaggagaggatttctaggggggccaccaagccaccaccctgtccgccagaatatcctactcactcagaaaaagggataatattctaggattacgcgaattcgcctactacgttttctagaagccaatccgatgttcattcgcttgacttgacttgacacttggaactgaaaaattggattgaacaccagattaagatatgcccggcttcattatttcactcatgtttatgcgtatctttataagttagaatttaaattttaaaacttaattaaagttaatttacaatatttgctttttatcgctaaggatacatatatataaattttatctaaaaaattaatttttatttgctaataaatggttaatgaagcattacgtaagcgaactaatatgaccggctttcacaaagcgccagtactgcacagtgcacaccagacagttcagtttagcatggccagactcatgtttgaataagtatttgtttggctgcaaggtgcaagctgaccaacgcagggatattaacttcctatcccatttgctaaattgtggcattctttggatgttctgcttgcgggatgcagtttgcatgatacttagggttctatagctgcatgtgtaacgtgttcctcctctaaggcacataattcctgatatgaggtagagaaaaagggttctcggttcataatttaaaacatgggtaaaaatatttaacaataaattgatttccgatgcttctcatttactccatccgttttaaaatatttgacaccattgactttttagcacatgtttgaccgttcgtcttattaaaaaaacttgtgaaatatgtaaaactatatgtgtacatgaaagtatatttaacaatgaatcaaatgatatgaaaagaataaataattacttaaattttttgaataagacgaatggtcaaacacgtcttaaaaagtcaacggtgtgaaatattttgaaacggagggagtatctcataaggctatctcttttcttctaccgtggagagatttggcgccaatgaaggagaggagtgccatggacgttttaaggggcttactgcttgccagtacccgaaggacctgatgctgcgtgattgagttagcaacaacccctttcagccctgcttgggaatagtagtagtcttgctttgctcctggcttgtctaagagctgtgccagcagctatgatgcttcctttggtgaactggagtccccagtctttatgttttcttttactctgtttgtaagaactattatggctttttaatgaaagctgggcattagcctcttttcccaaaaatgttggataaatacataagcaactagctttactgttattttgtattgagaaaaggataacaaattccaacttgtgtttttcgaagcacagaaatcacgccaaggccactcgcgaacaaaatcatggatgtactaaaaatgtaggaaatgggagcgaagggagtggtgtgagtaattacgagagaatagtactattgctttttctttttctccttgtaggcgggaagcgcttggccgccatgctatgctgctacctttcctccttaaatttttgtactgtttctactcttctataatataaaatcagcgtgcttggttcttttaaaaataaattaattaacagctgatccagatgccccaaatattcctgctaccttgtgcaaatatttcggtacgaaaatgagattggcaaacattaggataagtggcatcaccttgtgttaaaaaaggattaatcaccgcaccatgctggattaatttttaggttaatgctaggtgaataacattaagaaggggcagagcaggggaaagcagaggagagtgaaaaacagggtgggcgcggcgtgtattgtgttcggaatttggacgtgtgcaggcttgaaatgttttcgggtgggccccacctgtgtggggttgttggcggcgcagctgaccaaaatatcctcctactaggctgctgaccaatgcgccagattcgctttccagtaaaagctcactcggaacatcaatcctgcatttttttaagaaaaaaaagaagtgtactttaaatcttgaactttttaatcatttattttttttggctaaagttacacaagatttgtgattgtgtgtgagagagaggtcaatagtcacgactgtctgattgaggaatactagtgctgatttctctctttggaacggcgaggaagaagcaggtcacttggaattaaaggttcgtttttgggccacttggcttcaccagattaggagatgctttttggaaagcgcctgaactgcacaacagttcagtttagcacgtacggtcagatcacatgtgattattagtccctccgttccaagatgactgagaatcagtcattttcctcgttgtgtggacagatttagggctgtcaacgagccgagctcgagcgagctcgcctgtccaagctcgagccgagcctgttgcaccttcgggcttttaggcaagctcggttcgagctcgagctcggtgccgagctcagccataagtagtataatatatattttaataataatctcttgataagtataattattttctagttaatcacactaataaaatagtagaaaatgattaaaataaatatattgtgctaacacatgctaatttattgtgtaaatagatactaatatatatatttatctattagtttattatattaataaggtgaacatgcaatat

SEQ ID NO: 79024 - DNA, 12651 bp, Oryza sativa
  unsure (1)..(12651): unsure at all n locations
catgtcagtatctcctgtaagcaacatcttccggcttcaagattcagaaaggttatctctgtattcctttaggttaaagaattcagaaatgtagtaggtcgcccacgcgtgggcgactcggggggaaacctagcaccgccgctgccactctctcctcctctccctcccctcgcagctaccggagaaccgagcggccagctgggacggcggcggcaaggccaaacgtcgacggcgctatgtgcatggaaggcgggccggcgcgcggagcagaggttgaagacacggcgtggaggcggcagattcagcgccgccgcggctggatccggcctccccatgggtggatctggatctggccggagcaagccgctctcgggcagcgacgacgggaggcgaaggcggcggcgtctggtggctggcggcagctggtgaaggaggctagcgcgtgcgaagctgcgaccggcggcggtggagactggcacgcgcggaggacgcaatggccgccggcggcggaggcagtagaggcgtggctggcgacggcaaaaaccggcgtgtgcaaaggcgcggccggtggcagcggaggccggcgctcgtggaggccacggtggcagccgcagctgaagctggcgcgcgtggccggcaacaggagatgactaaacggcgcgatggagcggctgagggcggtgtaaagcctgtcggcggtggcgacgctcccggtggttggcagtggacggtgaggaggacggaggctgccgcagtgagagaatggaggcgacgacgatgcgaccaggcacccgttggaacacgagcgccctggtcgaggcggcgacgacggtcatgttgtgaggggggtgttgaagcctacggccttttgcggggaagaggggatccattcttttctcaccctctccctctccaacccaatcacgtgggtagcggaagctggtgcgcgtggccggcgacaggagacgactgaacggcgcgatggagcggctgagggcggtgtaaagcccgtcggcggtggcgacgctcccggtggtcggcagtggacggtgaggaggacggaggctgtcgcagtgagagaacggaggcgacgacgatgcgactaggcacccgttggaacacgcgcgccccggtcgaggcggcgacgacggtcatgttgtgaggggggtgttgaagcctacggccttttgtgggggaagaggggatccattcttctctcaccctctccctctccaacccaatcacgtgggtggacttgaagcacgacaagggttgagactcttctttgatggccggccggcggcgaggcgtcgacgtggtggttgcgcatcgaaggggattagatggtggttttgctgaactggcatgcactctttagcgcgggagagtagaacaatgggtgagccggcaatggcaacgcctgcgggcgtcgttttccccttggggcattgttgtgttttctatcgtttcccaatgggttcttcaggtgaaaacaacgtcctggttctcaaggacaggcggcggtggcgcttttggcgtcgttttcctccttggggcattgctgtgttttctatcgtttcccaatgggttcttcaggtgaaaacaacgtcctggttctctaggacaggcggcggtggcgcttttggcgtcgttttcctccttggggcattgctgtgttttctatcgtttcccaatgggtccttcaggtgaaaaccacgtcctggttctctaggacaggcggcagtggcgcttttggcatcgttttcctccttggaagcgtcgtttagaagacatattccttgggggtgttgtgtgcatattttgttttgttttagcagtatgatcaaacgtagacgcgtggtgtggtgaacgcacgaactttattagcttcaaaatgtttttatttcctgatacaatgcacaggctattctattcatcaattttcgttgtttgtattactatcatacgaaatctataaacaacatgtgatgtaattattattagtgccatattaaagttttcatcataaaagaattacacttaataattatttattaccttactgtgtggttttaaatcggtgtataacttttacctggtactcgtgacacatcctaaaactgtgaatttggaagagagcatgtccaaatttctacaactcccaactacctaatcacccataagcaaatatcatttaataggatattctagtattttaatcttacccagtagagaataatcccttatattatagaatgaagggaatatccgggaagttgggaagtatccagtgcaatagtacttctcggtgggagaatgcgatatcctattgctagcctttagatttgaaatggacgcggtagattggagcacttcctattctcttagttgacaaatgcaaaaaaaaggaccctataatatgtgccaaaatgttacgagcccttccgttctcttctactctaatctatctatggctatatttagttccacaccaaaattggaagtttgaagaaattagaacaatgtgacgaaaaagttaaaagtttgtgtggctaagaaaattcgatacgaagaaaaagttaaaagtttgaagaaaaaaaaaagttatgaatctaatcgggcatagcctatgcctgaggctctatctcccttgtggccttatctgaatcatttttcattgttcacctcttgttcggatacttgtcccctatcttttcccccttccctggcgtaaaagaaaaaaaatatctcccgtctccactccactccttgcgccatctcgcggctgaacaggggagtggaggggagggccgcctatctccatctggcgagcagagcaagagcaagggaggggatcctggtgtggtgagcatccacatcctcttcctgattcatctctctctctcccaccgggactacttttgcctggaatttgctttgctttcgttaagctcctctcttaatttccgatacttaaccttaatacaagtagtaacagtttgtttgttcgtctcaagttggattctcgctgatgtttcttgaaattctctcagtttcttggtgcttcttgggaatttttcaggtgttgttgttgtcgttgttgctcgccggatgttggaggtctgctgctgctccggcgtcctcggcgggtcgccgccgtcgtcgaggactgcgggggtttcctcacctggactatcgccgtctcggcccagtaagcggcgaatcggccgcgcccgggtgcagccgcgcgcgccgccgccgtgcgacgagcggagggcggcggaggacgtcatccacgcgctcaggtcggcggatggccccgccgaggcgcttgagcggttcaggtcggcggcgcggaagcccagggtggcccacacgaccgcgtcgtgcaactacatgctcgagctcatgcgcggccatggccgggtcggggacatggccgaggtgttcgacgtaatgcagaggcagatcgtcaaggcgaacgtgggcacgttcgcggcgatcttcggagggcttggtgtggaggggggactccggagcgcgccggtggcgctgccggtcatgaaggaggccgggattgtcttgaacgcgtacacgtataatggcctggtttatttccttgtgaagtccgggtttgatagggaggcgttggaggtttatagggtgatgatggtggatggtgttgtgcctagtgtgagaacctactctgtgctgatggtggcgttcgggaagaggagggatgtcgagacggttctttggttgttgcgtgaaatggaggctcatggcgtgaagccgaatgtgtatagctacaccatctgtattcgagttcttggacaagccaaaagattcgatgaagcttatcggatacttgcgaaaatggagaatgaagggtgtaagccggatgtcattacccataccgtgcttatacaggttctttgcgatgctggccgtatcagtgatgccaaggatgttttttggaagatgaagaagagtgatcaaaaacctgatcgagtgacctacattactctgttagataagtttggtgacaatggtgactcgcaatcagtgatggaaatctggaatgcaatgaaagctgatgggtacaatgacaatgttgttgcttatacagcagttattgatgcattgtgccaagttgggagggtctttgaagctttggaaatgtttgatgagatgaaacaaaagggtatagtgcctgagcagtattcatacaactcgctgatatcggggtttcttaaagctgatagatttggtgatgccttagagctgtttaaacatatggatattcatggacctaaaccaaatggttacacacatgttcttttcataaattactatggaaaatctggtgaatctataaaggcaatacagagatatgaactaatgaagagcaaagggattgtgccagatgttgttgctggtaatgctgttttgtttggtcttgccaaatctggtagacttggcatggcaaaaagggtatttcatgaattaaaagctatgggggtttctccggatactatcacctacactatgatgatcaagtgttgcagcaaggcatcaaaatttgatgaagctgtgaagattttctatgatatgattgaaaataattgtgttcctgatgttcttgccgtgaattctttgattgatacactctacaaggcaggcaggggtgatgaagcctggcggatcttttatcaactaaaagaaatgaatctagagccaacagatgggacttacaatacacttttggcaggattgggaagggaaggtaaagtcaaggaggtaatgcatctgcttgaagaaatgtaccacagtaattatcctcctaatttgataacatacaatacgattcttgactgtctctgcaagaacggggcagttaatgatgcacttgatatgctatacagtatgactacgaaaggatgcatacctgatctttcgtcttacaacactgttatatatggccttgttaaagaagaaagatataatgaggcattcagtattttttgtcagatgaagaaggttcttattccagattatgcaacactgtgtactatcctcccaagttttgtgaaaattggactgatgaaggaagctctgcatattatcaaggactacttcctccaacctggctccaaaacagataggtcttcatgccattcactaatggaagggatactgaagaaggctggcatcgaaaagtcaattgagtttgctgaaatcatagcatcaagtggtattaccttggatgatttctttttgtgcccattaattaagcatctctgtaagcagaagaaagctcttgaagcacatgaacttgtcaaaaagttcaagagctttggagtttcactaaaaactggattatataattctttgatttgtgggcttgttgatgaaaacctaatagatattgctgaaggcttgtttgctgaaatgaaggaactcggttgtggtccagatgagtttacttacaacttacttcttgatgccatgggaaagtcaatgcggatagaggaaatgctaaaagttcaagaagagatgcatcgcaagggatatgaatcaacttatgttacttataacacaatcatttcaggtcttgtaaagtcaagaaggttggagcaggctattgatttgtactacaacctgatgagccaaggtttctcacccacaccatgcacatatggccctcttcttgatggtctgttaaaagctggaaggatagaagatgcagaaaatcttttcaatgagatgctggagtatggatgcaaggccaattgcactatctacaatatactactgaatggacatcgaatagctggtaatacagagaaggtctgtcatttgtttcaggatatggttgaccagggaataaacccagatataaaatcctacacgattattattgacacactctgcaaggcaggacagttaaatgatggtctaacatattttaggcaattattagaaatgggtcttgaacctgatctaattacttacaatttgctcattgatggtcttggaaaatcaaaaagattagaggaagcagtgtctctattcaatgagatgcagaagaagggaattgtcccgaacttgtacacttataattcactaattctccacttaggaaaagcagggaaggctgctgaagctgggaaaatgtatgaagagctactgacgaaaggctggaagcctaacgttttcacatataacgctcttattagggggtacagtgtttccggcagtactgatagtgcctatgctgcctatggtcggatgattgttggcgggtgcctacccaattcaagcacgtacatgcagctcccaaatcagctgtgactaactagttagtgactgaatgtacttcttctgtatagttttgtctataaaaggaaaaggatcaactgtagatagtccacttcaatatatctgagggttctgctggttcttgttctacactatatttttgtacttgatggaagaaaattattcaatacacagctgacttgatcacttgaatcatctgttcaatttaactgacattgtgaggttacagttgttaaactcttatcaagtccatccattatatgtggttcaagtacaactgatctgtgtgcacattacccattttctttctactggtatgtctcttcagccaaatgcttgtgacatagttcagttttactgcctgtataggtttactgatgtgtgcgcatctttaggaagttgagctagtggttcagtttcacagtgttacgctgcttagcaacaatcaactttttccctgattcacctttttctcatatgatatagcactgccaatggactgcttgagaaggttctctattgttgcaatacatggaaatgcagttagatgcttcctttccaaaagtttctttgttcacatgatagtgaattggtagcattttgcatactttgggtcaaaagatgtgctcatttcttgtagaccataattacaacactggaatggccaatttccttcatgaaaattttcaatgagcagccaatgcaaattcaaatttactatttcctttagtttggttgtgtctaatctgtaagtttatggtgatttttactagaaaaggtatcgctaagtttctgaaattattttcatttctcttcagtctagaactctagattaatttgttgatcttgcttatatgccaatttgtttgactatattttcctgttgtatctatgatatgctctctctttgttttggggtttatcatggtatatttctatattttatggtgttgagctgttgatcatgagaaagtaaacttgcatgttaaactgaagtaattgacagtttgacattcgtaataccttgatataccctgatcaaatgtatttttgttccaaactcaagctactactagggaacattcatcttgatctatttattcaaagctttcttgtggtgctcagttttgttttctggttttagattgtaattttgtctggtaacaagctcttcttttgatatttttccccttgaaattcaaagaaaggtgtattttgcttgcctacctaaagagaagtttgcagttctagttgaacagttgtgcatctgtgaagtttgttatggatgtcccctttaggatgcgtttggagtttggtattgaactgaagaagctattaattttagtgacctaacttcttgagtgtttttcattcgtttggtgtggtatatccatatgcagaagttgtggatgatgcgtattgcttctttttaaccagcactcttctcttgtcatgatgaaggacaccacagattcaataaagccatacatattctgttctccaggtatgttgtagcatctccttccttcaatatgctaaaacaatttgagcttgtagatccatggaccgagaaaaaaaacagatgcaaaagaatgaagcatagtttactcctctgcatgctattgccaattgtgcctacaaaatgatgttgtatacttcgattcaaggaaaatttactcctctcatggttgcttcttgcttgttttctcatgactcatgcattgggcgtcaatgatgccctgctttgtttgcagttggagatcacctagacacctgccactaaacagtttggtctgcttgttgctgtgatgcggttatgcccttttttcctgaggtatttttagaagaaaatttctacatgtttcatattgcattatcagggactcttcaaactgttcgtccccggaagctgtcggcacagtgaggaagcagatcaccagccatcgtagctatcacaatgccaaagagccaacaacaaaggtcagggtcttgatctcttgtatgcccagtaacaggttaatcctcctggctctctgtactgaaacaatttctctggatctctttcccttttgttttggaccttatacaacctgctgatggttaataatgatgttcttgaataatagatcatgttaagctgtttgcatggtctgctgctgtcaaatagttttatgcggtcacaactcttactaactgatcaggttgacttcaagcattgggctaaaaactaagattatgtaacttaaataacatatatgccatcatcttcaatttaagtgatattgtgtcaatcttctgatcaactgtttacatcttcgggttatgtagattcatgtcatcttcttttactctgaaatgctatatgagattggcagaatgtcctgatttcccaggcatggcgatggctgtccaagggctgcttaaggagagctgctgctggaaatgcccagcaaattgctgatggatggaggatgcataatcactcagtgtggtgaccatctgatttagcatggcgtatttcgcaaaaggtttgaaattcaaaacagtgtctcatcggatacgccatagtgattttcagtttctcttattggcgtacctctgcttgtggaaccctcctggatctgaatattgcattcccactgttccatctggcttctccttcaggccggcaaagcattgcaaaacagacctaacaaagattacttccccctatttgtcgtaagaaactttggatgttatgtagaacagaccttggtatatgcagttcttgaccataagttcactatctgtcttctgcttgtaataattgatccacctagaattacaaagtggtcttattatttcatctctgaaatcctcactacgaaagaaactggagaagactattgcaactgtcatcacagcgacctcagttttgcttcgacagcttcttgtcgcagtcctaacacttgtatatatgtacataccctaatcttaatcttgctccgttttaaatcttgtgctatcagtaatcaagtccagtttgagctatgaactgatctgtaattagatattacaatcaatacacgaggagaagaactgggcaaacaacgtgatgctggtataacttcatcaaatgttatattagaactcatatcacgtcacataagtgtacacagaaaactcaagtcacattctgatttttttttttctcggatcatgctagcagatgagatgaggaataaataagattggaaatatgttatgtaccagcgagaattcttcacattctgttttagtttgctccctcccaactgttagtttttcacttacagattcaagaaaattcaagctgaacgcttagattttagtatgatacatttcttttataaagggtaggaccccctgtcgttattgaaaccaaatgttggggatgcagaaatttcagggctagggatgccagctaaaattaaaggatacaaaagacctgcacatcagagttttgcagaccaaagaatctaacaacaacaggacctcacaggagaaacaataaggacaacacacacacacgaagacccagtctcctgaaaacactacatggtcaaatgtatatcaaatattgtgcaatctcaaacaggattaacttcttgtattaacttgtataaatggggagtgattctccctcccacaaaactctaaataaatttgttttcctgctctatcaatacacaaggcatagttcttgctttcttagaaaacattctcagtcaggatcgctttggagaatttgcatgaaaatgtttggcgtatcagtcgctatcgctactaaattcctcaagttttgctctatcctccatctgcaatagcacactcttaagactgaaaaaaggcatttcaataccgcactcgaagactgaaaaaagaagataaccttaaaaaaaagagagatcaactcagtttgcttaggattttttttgttcaattaattaccgttttattgcgagtttggcgagtaagtccactgtaaaattttacagaagaacttcacatcagtgaataactggggccacggcccacacccacccttcaacagttaagaaaggaagtcctctttctatgtatgtttcaattttgaagatgtatcacaaccaagcatgtctaaaagagatccagcgtcatattcaaagaacacagagtggtttaatattgtagcagcatgaagatgaggtacagcaaacgccaatctcatatcgcggtttccattgaattggaacttgaaagttgaaaatatgacaaaaacatcattgtgggaagaaaaaagagaataaacagtaatcatctcgaaggaaaacataaattggttgacagttccaaacagaaattggtgatgcggatctacttagctgctggtagaacccttggcatcccgcgtcgccgctccatccatcaccgccgcccgccggcgtcatccccggtctcggcgccgcgcttcttcggcccatccatccgccgtcgctcctcatccccaatcttccctcttcatccttccatctgcttttcaaccattgacatatcgtcgaacccatagtctgaatcagccgtaataaacaattgacgcatacagttgacgaacaagtcaatcaagtgttttgtagcgcaaatttgccagaaattccactcaactcgatattaccaaaactgcttgtccatcggttgaacgcgttcgctccctgcgcgcgcttaaccaccactccatccgtcccgccccacacaacctggggccgcatagttttgaattaaaaagaacagctacatcgtttttggccggtgccagtaggagaggcagtgttcaatacgtcagaggatatcgttgcgttgagagtgacacgcgagacgacgggactcaccttgtactctcgcggtggtctctctcgacagcaccatggtctgcggcaacgtcagcaccgtcgtccccatgttgcagcacaccagcatggccagggagcagaagttggtgctcgacgccgacgccgacgacgacgggttgcaccacaccggcgcaggcgggaagcagcagaagttggtgctcgacgccgccgccgacgggttgcacctcaccggcgtgggcgggaagcagcacaacttggtgctcgacgccggcgcgggcgggaagcagcagaaattggtgctcgacgccgccgacgacgggttgcacctcgccggcgtgggcgggaagcagcacaacttggtgctcgacgctggcacgggcaggaagcagcagaagttggtgctcgacgccgacgacgacgggttgcacctcgccggcgtgggcggaaagcagcacaacttggtgctcgacgccgccgacgacgggttgcacctccccggcgtgggcgggaagcagcacaacttggtggtcgacgctggcgcgggcgggaagcagcagaaattggtgctcgacgacgccgacgatgggttgcacctcgccggcgtgggcgggaagcagcacaacttggtggtcgacgccggcgcgggcgggaagcagcagaagttggtgctcgacgccaccgacgacaggttgcacctcgccggcgtgggcgagaagcagcacaacttggtgcttgacgccgccaccgacggattgcacctcgccggcgtgggcgggaagcagcacaacttggtgctcgacgccggcacgggcaggaagcagcagaagttggcgctcgacgccgacgacgatgggttgcaccacaccggcgcaggcgggaagcagcagaagttggtgctcgacgccgccgacgacgggttgcacctcgccggcgtgggcgggaagcagcacaacttggtgctcgatgccgccgacgacgggttgcacctcaccggcgtgggcgggaagcagcacaacttggtgctcgacgccggcgcggacgggaagcagcagaaattggtgctcgacgccgccgacgacgggttgcacttcgccggcgtgggcgggaagcagcacaacttggtggtcgacgccggcgcgggcgggaagcagccgaagttggtgctcgacgccaccgacgacgggttgcacctcgccggcgtgggcgagaagcagcacaacttggtgcttgacgccgccaccgacggattgctcctcgccggcgcgggcgggaagcagcacaacttggtgctcgacgccggcccgggcaggaaagcagcaaaagttggtgctcgacgccgacgacgatgggttgcaccacaccggcgtaagcgggaagcagcagaagtttgtgctcgacgccgccgaccacnggttgcacctcggcggcgtgggcgggaagc

SEQ ID NO: 79025 - DNA, 2427 bp, Oryza sativa
aagcagccgaagttggtgctcgacgccaccgacgacgggttgcacctcgccggcgtgggcgagaagcagcacaacttggtgctggacgccgccaccgacggattgctcctcgccggcgcgggcgggaagcagcacacttggtgctcgacgccggcccgggcaggaagcagcagaagttggtgctcgacgccgacgacgatgggttgcaccacaccggcgtaggcgggaagcagcagaagtggtgctcgacgccgccgacgacgggttgcacctcgccggcgtgggcgggaagcagcacaacttggtggtcgacgccggcgcgggcgggaagcagcagaagttggtgctcgacgccgccgacgacgggttgcacctcgccggcgtgggcgggaagaagcacaacttggtgcttgacgccgcccccgacggattgcacctcgccggcgtgggcgggaagcagcacaacttggtgctcgacgccggcacgggcaggaagcagcagaagttggtgctcgaggacgacgggttgcaccacaccggcgcaggcaggaagcagcagaagttggtgctcgacgccgccaacgacgggttgcacctcgccggcgtgggcgggaagcagcacaacttggtgctcgacgccgccgacgacgggttgcacctcgccggtgtaggcgggaagcagcacaacttggtggtcgacgccggcgcgggcgcgaagcagcagaagttggtgctcgacgccgccgacgacgggttgcacctcgccggcgtgggcgggaagcagcacaacttggtgctcgacgccggcgcaggcgggaagcagcagaagttggtgctcgacgccgccgacgacgggttgcacctcgccggtgtgggctggaagcatcacaacttggtgctcgacgccggcgcgggcgggaagcacagaagttggtgctcgacaccgccgtcgacgtgtcgcagcacaccgtcgggggcgcggagcagaacttgctgctcgacagcactgatgacgggttgcaccacaccggcgcaggcggggagcagaacttggtgatcgatgacgacatcgacgggtcgaaccacaccgtcgggggcgcggagcaagacgatgggttgcacaccaccggcgctggctgggagcagaacttggtgctctgcaccgacgtcgacgggttgctccacaccggcgcgggcggggagcagaacatggtctgcgacaacgttggcaccatcgtctccgggttgcacgacactatcgcgcgttgggagaggaacttggtgttcgacgacgtcggtacagccgttccctggttgcgccacaccggcgttgatgggaagcagaacttggtgtaccacctcgccacggccaccgtgcagagcgtgtggcgggagaattgcatggagcagttcaagctcgtgctggaagcgcttcatcaacctcatcgccacctctatatcgccgtcgacatggagttcgcagcggacgccgccaccaacgtgagccataggccagtaacctccatcagctgctaccaacacatgcgcaggtacgtgaacggaggtggcatttttcagatgggcctcacatttgcattcgtcggtgaaggcgaacaagctccctcgccgctgatagcactggagatcaacttcgacttcaacgtcaattcgccaaagtaccatggcaagtcgatagatttcctatccagtcaaggccatgatctcacgcagcacagcaaaagaggcgtcgcgccggagtttgtttacgaggggctcctgcgccacctcccgttcggcgacggctccgtcacctgggtcgcctttcacggcgactatgacttggctttcctcctccgcttgctgcaagggggagaccatggcggcaattgcctcctgccgcctaagcttgccaccttcctgcaaaaagtgcgggagaagttcccagtcgtctacgacgtgcgcgtccttgggaagctggtgaaggatggcttcaatgggagcctcaccgcactagctgaataccttggaattccgcgtaacggcgacgaacaccacgccggctccgacgcgctgcttacattgtcctgtttcttcaagatcgtcagcctttcaggtcaccagatgcaccgcatggatgctcggcggggattgcttgctgggttggaggagtggaacatggctatcaaatgtgcacgccatattgacaaccatactggaagcatctacgttgtcaagatgctaccacataagttggatgaagaggcaagacgaattgaagagctggtggccagcaacttcaacatcgttggagtagaggtaatccatgctcaattgggtaagcgctcctacgcagttgaagcccaaaaaaattatgaactcatcaagacatttcttaaggattctgacttgtacgaaatcatcgtcaca

SEQ ID NO: 79026 - DNA, 2078 bp, Oryza sativa
ccaattcttgacgtgcggtgcccgcaaccaaacagaactgcagaaatgttaaaatgctgtagatttccatgtactcccatcagagatgactttgagaaggctcaaattcgtagactcctctcgaggttttttctacccaggggatgaccgcgatctcataagaccgacaggaccttccaaaaccagagcacgaactacggagatgagacacaacattgccacaccgtaacaacctcagcacaagcggacaggcaaaacacaagcaatacacaaagcaagaatagtctgcagaaaactgtaccacgagaatggggaaggcatggaaagaacaaactaccagaagcactttgcgcatatcggacatgctcaaaacacgccccatgcggcacgacaaccgcaccaacccgtctaccggtaagactcgtccaccttgcagtcaaatggacaacacaggggcgcactaagctatccggactgggaacatggacataaaggcgaaatttccagagacaagaccaaccaagagctaaaagaaaatggccaaggccctactgcatgaagacctgagaaggaaaacggcagcggcaccaaggacacatacacaacaaatgacccaaagaactaatatgaaagtgtgaccaaaagacccaaaaaaggatgagcatggataacacgaaatccaagccacaagggagtacaacagcaaggccaaaaggtgctagctgatacaactcacgggctgacagcctttcgggacatggcaaaacatgcaacagcaaatggatgggatccatataccgtgcgttgacgcttcatcacatggagccgtcacgctgagccacaatgaaggtaacattttcaaggtaaatggccatcatttaaagttttccttgctccgttagaagttgatcgtgacttagatgttgtgaatctagtctcttttagcttctacccggagtctttaggtcccccttgatccgttagtttttaatgccccaagtccttaggcctgataggcacgcttaggtctaggttgtttagcttatttatttcatttcattccatccttataatgtacctatcatgataaaaataaaataaaataaagttggctccttggtcttccaaccaagtgagtcctttttgcttcacttttgtctttgtttttctttttgtgtctaataaagagtcccatgtacaaagacaagtgtggaggtgatcttgcacatcaatgccataaccaaaacaagatcaccccagaagtgatgagccatgacgaaccacataaggaaaattgatgcagtcagaaccaatgaggggtcagccaaacctccagttcggctgaaccacctctaccatgaatcatcctctgttttatacaaagcgcaggtttgcacaatttttcctttggacatccattctatcttgagtttaatttgattatcaattctaaaatatcaaagataattaaactcaagctagggatagtaaaattagagttcatagtctacctgaaaataatatgcatgcctattattctttgctcattacttgttacttgtggtgacatatccaatagggaccctatgctatctaggtaattaatgaatgagatacggtctgatgatagaaattctgctcttcatgttgtgcacttgggaattttataaaaaaaagaaaaaaaatataacaatgctaaattcctcattgatatttttattcccactagagccataggttgatcattcatgattagcttgctacatacgttgcttgtcattacattgagcattgtcaagttttgtgaccctagtgaaatgcttttcatactttcatggtcgagatcacatatactccacatacacccacctatgcttgacttctacactggaagtgagcattcctcatttaccattcattccattcattttccacaaaataaatactccatatcatttatacgtcttcctccaaagttcttcaaaaaaaaaaacagagagagagaggcatgtctatgaaaaagaaagaaaaaaaagctcatacaagtatggagcatgatgatgaggaaaaaaaaagaa

SEQ ID NO: 79027 - DNA, 27818 bp, Oryza sativa
  unsure (1)..(27818): unsure at all n locations
gttccgtgtggtcccggtagatttatgctgttcttgagcgttgaatcggtagggggatggatacacgggggcgctagggttcaagatgcttgtgtttgaggtatagagatctcgagtcagggtcggttgtttttgcgtctccttagacgagatcttgtgcgatccagttatggggaattctggtttgtgagattgtgagaacgcactgcaagaggtgattctgacttttatctcctttttgctagatgtgtatgtgttggtgtatgcttactactagtatcttggttttagtatttagtcatgagttgacatgatctccactccccaaatcccagatccagttagtcagttacgcgctggtgtaccttttgagttttgaggttgaattatactgattgaattagcttgtatagctgaatttggcaccaaaaagggtagtatcatagattttttttcgctgttaagtagtatcacaaagatttgaaaagctgaaactctctgttttttttaacacatagaatgagcaagagatttcttgtagtttacttgcactattccatcagatgctgtgtgaagtcatgagatgtttttacggacagtattgttccgtcaattttagtggcagacctgctcatgctgtcttgcataatattttgatttttctcactatcagtagtccaatggtatgctggcgaagcttgattggcactgtcttgactcttgagtaacccgccgttaggttgttcgttgaagtattttaactgatttaactgtggtctgtgttaatcaatcactgaacaaccatagcacatcaaagaaattgttgcaattaaacctgttttggtgtttcttcctgctcttattggaggaagaattagtgactgggatgtgtttgtgaacttataaacaagggattagtgcatctggtatcaataactttatctgcagaattactttaatgctttgtactgttaaatgttcttctttgaaactacttatatataatttcttggtatgccttcccaagtcacaaataacaaccgagtcctttttctgctgacatttttttttaatttttttaattatgtcttcagacgtgactgacatatgctttctacctttgttgcagatgtttgacgatcaagacttgggtttctttgccaatttcttgggcatcttcatatttgtcttggtcatcgcttaccactttgtgatggcagacccgaagtatgagggaaactgatgccatttttgttgagcaaagggatcatatgatcctcagatcaaaatagtgcgatgtatgccagttaatgatagcaatagtgcttgactgttattgtaagttcttacgcgaaatctggacctgcaatttctggcattttgacattacacatgtttaatcgattgaaatagtgaatccaggatattccaaaaaaattgattatacttatctagtatctgcaattctgcatatgctagtccgatgggtgctggcttactctatgatttttctctccccaatttgttggatgtggaaaaaccaaatcattgctgcgtgccctcgatcatgatatgttgttttggtaattctgaatgaatatgcttcaatatcagatacatgtgcagttcaagtatccagcatatccatgttcaaatgctaaaaaatcatcacctgttgcatttttagctcttcttcttaagcagattttgcacctgcacgattgaaacatggaggattccaactgcaaaaatctcttggctggtcaccgttcacggaaaacacctcgaaaataggttagccaagcttaccccgaaccattccttatgccctaaaacttacaaggcccatacccaacacaagaaccatctcacacccatttaactcctctcctttctcccactttcttggagctcaaacatcaaatcttcctgtgtgagagatcaagagagaggaagtgatagattttttttacctgacctagctgtttgatactttgatttgttaatttcttgtgcatttgctgtttgtgatccgttgctgtgatcgatgtgcccctgaacgaggtccacgacgtcgttggagttggcgccggcgagccggcgaagatggatcgccgccgcgcggcggagctgatgctgctgtccctctcctcgcagagaacgcgcatggcgctcgtgggtggcaaccacaccgccgcccgcttctgcacccgctaaccccgccgccgccgccgtctcctcctcttcttctcccatctcttctctctcttgatcatcttctccgttcatctctgctctgagtgtgtttgatcctcttcttggcgatatttttgtgttgggatcaatggcgacgatgaagaaattagctgcgagggatggcagggccgccagcaatggcaggctcctccggctggtggcgcgggcggcgctcctcgccgtcgtcgtgctttctctcgtgtcgctccggctggtgctctcgccggccacggcggtgggcgacgacggcgagctctacctgccggtgctactcgccgaagtaagcgaccgcggctacctgcgccacggcagccgctcggtgttcgtcggcgacgccgggtcgtgggcgccgttcctcgagcggcaccacgtcgccgtcttccgcgccggcaagctccgcgagctcgccgacgagtccgtcgacgccgtcctcttcgacggcgacgcggttcagctcggcgccgtcaaccgcgtcctcaagctcggcggcgtcgccgccggtttcgccacgtcggngtcgtcgacgttgcagccccctgacaactacaaggccgtgttcgcgcacaggtcggaggcggccatcgccttcgccgtggagaagaccacgccgccgaccacgagcgccgccgtgacggcttcgccggtgggacctcaccggaagctcctcgcattgccggggagcaagaaggacgacgcgttggccggtctcgaggccgtgctcctcgagccgccgcagaggcagcaccggcgaatcatccggcggctgcggccaaggtacctcccggagctgaccggcgactcgctggaaggctaccgccgacgaacgttcatcgacgtggcgccctctcgcggcggcggcgcggcgtcgtggttcaagaagcactacccgagagggaagcgcgtgttcgacatggtgcgcctcgacgccgccgacgcgacggagccggcggcgagctcatcggcggcggggatcgccgagtggctggaagggaacgtgagggaggaggactacgtggtggtgaaggccggcgtggaggccgtggaggagatcctccgcaggcgcgccgccgtccgccgcgtcgacgagctcttcctcgactgcgacgccggcgccggcgccgacgcggcgcgccgcccctactgggagtgcctggcgctgtacggccggctgcgtgaccacggcgtcgccgtgcatcaatggtgggagctcatgaatgctcgaccacgtagagagagaaagaagagagagagagagagagagagagagagagagagtgaaatgatggagctcatgagagggaagagatcactttgggttcagaacaaactatgaatatgcagggtactgattaacagctaacggataaatatatttggttttggttggggaagagtataaacttatgtaaatcaagcaaaacagttgttccaagattggacaatttttggatcttgaaattcaaccagcaagtaaatatatattcatgtatcaagcatgtgtgtttggccaaaatcattcttctagggcatctttcttatggtactgatgaagacaaacttgtactccctctatttcctatttctcctatgtaaagtaacatagttgggcagcaagcacaagaacgaatgattctatttcctatttcctattagaagaatgctttgggtttattttaagtcaaactcttgactgactttgtaaaatatgtagcaatatctgtaacatcaaattaggttattaattctaccattgttttttttgttagtaatggtactacaattttctaaaagcttaatcaaattatgaaagaagtcgtatatgctaaaagctctttcaggactgagtttcaccaagcgtggcttgaatccaacaggctatagcacgcaagacacatgcatggaggcccagcccttacttaattttctcacatctccaggtccagtggaagctgaagtagacctgcccatcttgagcttgtcaatggaacagtagatagagggttgtacagattcgttgtccattaactagtggaagctgaagtaaggtagacatgttccaatcatttgtccctaaatcttgatcaaattttaaaaagttccgactagaaaaaaaatcaaatcaacttataatataaaacggagggtgtacatcacgttgtaaaatggaacccaccacttctttagagttgccgttagtgccatctgtcaggatctacttttatatacgtagttttttaaggtttatttgaaaaataagttttataaaaggtttaaatgtcaagatttcccgtacaataatatgttccaaccactaatcgtgtaaatctaaataggatggaggtccaaggtggtcgcaccccaggtgcggaattgggcctaggtgttgggtcccaaaactaatgattcagaaaccgacatatttaactgtatcaagccctgaatcggtagattgatacaggttcaacaatctggatctttatcgcatacatttggtcaagactccaaaggagatatatttatataaaataataggacatttacaaatttgtggctaactattacagcagaagctatactgtgacccaattctgccgttttactatagaattaaaccgtctaactatactagacttgaagactagttttaaaggaaactaacttatgtgattgaactcccagcttcggcaaaaactccaaatagactctgaaaaagaggggttgaagtaaggataagtacaacgtactaagcaagctattatattattcaacaatgaatgcatgagaggtaatatctgtgtagagctagatttacttgcagaaagcagagaatatagaagtagaaaacctgtaatgttttaaatgcagaagtatttaataaaatttcaaattaggtttctatccaagatgccatagtgagtcccaatgcccgataaccgcgagcacggctatttgaatagttttgaggatattcatactgcagtagatgtacgctttacccgcaatccatgacgtgccaaacacattagccttgttatggcaaagcttttcggttactaacatcagtggtacctgttccatgaactataatccccatacgctctgaacgtaacattatcagcagtgagaggagttatggcgttcccggggtctttagagagatctgattgtatgacaccatgtcatcgcaatcagggttcacaaacaagtcacatgacatcataatttatctcaaacaaatatttacctgcgcctcggtaaatatcacaatattgcccttcgcggcataaatttgcctcctgcgcgaggacttaaataagaaccactacacagaggtaccacctttgctagataacttaatcagctaggtctatgcccatacgagaattgcggtcgtactcgtatgttcttcacatgtacttggtagtcttatgtcggttggaacagtactagccacccggaaatcaaccatttctaccgtactgtcccaatctaagttcattatattttatgcagtctaactaggcagggctaagcaaaagctagcatatctggtttgctatgttcaggttatgcatttgaaatcatgtatgactaatgcatagaatagagatataagaatatatgatcattatgctcaaaggggaggaataataacttgccttgctctaacgcaaataaatccaagataggcaacctgattatccgattctcgaaataccaaaggttgtcatccaaaacacaataaactctactgagaaagaggaagaaccaaattcaataaaagccataaaataataagaaaacgataaacagcttaagagggctagggtttaaggtataacctatctcttttgtagggcatagggattactgggctaatattttatgtggaggttctagagggttggaggctaaggtaaagagggaatcaagcaactaatgttgcttatattttatgtgaaggctctcgtgatttggatgataggaaatatactggatagttgatatggttaaataggtatgtggctaatatgggtcaaggttgggcttttgtagaatagtggctagggtttagttgtttaggccgatatcgaggtaggataaatatcggctagggttttaggtgtttgctagtcgtcgctagagttggacaacataacgactagatttggtaccatttctagccggtgtcgatagacagcatatcggctagaagaataggaggtgggtgcaggtttagtggggtggaagtgttactccgacaaccatgagtggcggcggagcggctagggtcacacaaagctcgagagttaactgtgcggcgtgcaatggaggtcgagaggatagtgaagctccgaccgctatacgcatcaaggtgtggggtgccaggagcagcacttcgaccttgggtttggtttttgccgggctttacaaccaacggtccgacgtagaggttcgtagaccgcgcgaacgtccccatggaaggcgtaaagttccaaccgatggcctttaagtggctaaagggtattttggagataaaagaaaatatttgaaaagcaaatataagtttaagttgtaaattcaatcataagattaaatcaaatatttattcaaatggtatttgaataaattaaggaaattcaaataaaatattaaaatagcaaatttggtatgaaaatgaagagtttgaatttagatgaatttaggtccaaatttcactagaatcggatctacagtttaggagatatgggcttctaaagattggattttgagttaaataaagaaaagcgaaatagtactgtgcaggggcccacctgtcagtatcttttctttttctttttctccttcttcctcccgtctcttccttcttttctcctctttccagcacgagcagcagaggagaaggagaggaggggcgccggttttccggcggctggaagatggcgacgccggcggcgggtggtgttcccgagcacaaagcatccggggagtgcggtggctggcggagaaagtgaaggagaaggccgaaacggcgacgacaagagctcgaccgtggcaacaaaaggagtggcggtggtggcttgttgtgggggctaaaagagaggggaaaagggaaaaatgggttcacctcgtcgaggcaaacatgatggcgcaaggacttggcttgcagagctgtggaagaggagatcggccagtggcggcaatggccggtcatgagaagagagagagagagagagagagagagagagagagagagagcttggtttatatgtagagaaggggagggatggccggctatttataggcggtggaagtcggtttggaggaggacggcaaggagggtcacgacgccggtggagtggaggagaaggagacggcgccggcttcgttttcttagcggcgacggaagggagtttgcggcggcgtgcgcgtgtacaacacgcgcacctgcaggaggaaggtggtttggcttatgggccgatttgggctgaggggagagatgggccaagggaagaaggaaaggaaattttggcccgatgacaaaaagaaagtcttatttgaatacatgatttggataactaggttttgcaaagaatttgaattcggaaagggaaatttatttgggtgcaatatttagaggtggagtttgagggaatttatttggaagcacttaaataggaagggaaattaataatattcctcaaaatatttttgggaatatatagaagggaattagttgaagacaataaataggataccaattctaaaattggtattatgtatatttgtggctaaaagggaaagttgaatgaagagtataagttggaattttcttagcacaagagcaattattcacaatatttgcaataatacaattcttgtgccgaagaggaaattaagccacagagattaaattggtgactagatcaaaagggggaatttggatatttggatcgagaatcaaaggatgggtttaaaatcaaaggacgggctaacaattaattccaatgagattgaaattactttggtttaggttcaagggtaaaattggaggatttcttggaccataattcataatagtaaaaatggttttcaaactaaatttgaataaaagagttttagtcgaaagaaggtttaatattcaaaaatagagttccaacaagaaataccaaatatgtttttaaatgaaaagcacaaaagatgttaaatagcatagaggtttttatacaagttagttttaggaggtcccgctaattatattttcctaggtttagaaagttattaagaacataagaatcagcatgatgcaatattagaaaaatgacacattttcaggatgttacaaatttaccccccttaaataaatctcgtcctcgagatttctgaagagtccatgtagaagtgtggaaatcttatcttttccaaaattccagatatctgtttaattagtcggttgataacttcatgtttttgttgcatagtattcactctaggtctttgatgagttttgtatcttttccttgtacctttcgttccttaaagtatttctggatcatctctttgatattcctttatcaactcttcttgtagttattctggcattgtttcttgttgtctttgtggtataaactggattataaaaagctgtagatcacttgattaaatctcatgtgattcaatgtttgaggatccaacacttaataacttgaacatgttgtaggatatttctgtctaggatttaatcttccttgcacatatatgtgtagcgatgatactcgtcgaggaggtttattatgatcttttagttattctggtcattggggtgtatcttcggaatagggctgatgaatgatcttcgtttgatggctttaatgtcttcttagacaatattttcttccaaccttttgtaacaattcaacttagatttctgaatcctaatcttgtgttgtttcataattccctaattgttcgtagttaccaatcctcttcttatgcattcccttacgatatttcttgcggtaactgcgtacggtatttctacgatgattgctacatcacaacttcttgaatggtgtcgaacattgaagtcgtattttctaactatatctaaccatttccttcagtacaaatccatgtagcccggttgtcctcacacggccccatccatctgtatcccgtccgtgcgtgcgctcgtcgcgttcgcgttcgcgtacaccgccgcgacgcatccggccaagcggcgtctttgcacatggcaggccgcaggatcgcgccgcgcgctgccacgctacgctagcgaagcgagcctcccgccggtgtcgatgcctcgccctcgccaacgacacgccgcaatcgacaacaccccaacccgcacccgcgggtcccctccctcttcatcagtcatcacatcttccccgcggcgagctgtgctgtgctgtgcatcctgcctgcctcctcctctgatgccgcctgcagcgacagccttatggcttgcgagagagttgaatactcctcgtgctcctctgcacgcggcgtcgcagcgatggacggggaggcggtggtggtgcagcgcccgtgcaggtgcagggtgcaggcggaggcgagctgccactagctgggctgtggctgctggggtctctgctatggttttaactgccctgaagcgttcactgacgcagacaaaagactcagcagcagctcgcacgctactgttcccgcacagcaccgtaaccgtgacaccatttttcttttttgttccttcgtagcagcatcgattattacacgtataggtaattaagggtatgttcagatttgataccaaaatgaaccttcctgaattttgataaattgacagcattgccataggattgacttaataatgttgccaaaattctttacacattgccaatttttgtgacaaactaaacatgatactaccgtgaatcaacaagggaagaatcctacggtaagggggggttggacaggattcacctttccgactgagtgccggatgctggatattgaatttatcattttaaatttgaattctcgaaaactattcggaatcacgctcggaatctatatattcgtcccacgttcgaaagctctagattttgtggttcgttaacccttatggtccaatggattaatcaagcgcgacaacaacagctggttcggcaaaaaaaaaaaagaagaagaagaagatttgaatgataaattactctgatgttaattcatcccttagttcgatttttttttcaagtgctcaaatcggtccaaatggttttgccgccttgcatgatatactgtactatactaataaactggtatctcctgacaacacaagttcaggtcaggctcatttaaatcatttgccaatcacgttctcagtacagtacttactgatctaatgcactgtgggtatgtatacaaggacaatgtactatgtttggtaatctcgggtagtcaacgtaacggcaagcgatgaaaatctttccatggatactaatgctgcagtttaattttattccgggagtaatcaagcacaactagtacatgacaagacaatattgtggaaaatttacacccatttggaaatatcacgtgctaatgcaacagggtcacctgtatctctctgtgtatctaagtagtacagtcaacaaagaaaatccgtttaggacaagttctgtactagtactgtattatcaagtgcagatttactgctaatgcgatcagcaacaatacggggtacagtaagtactaactaatgctaaggaggaaactatgcatccggatcttattgtagcaaattaagcactcatctcaggttgaacaactagcttagctacttgccgatttgaggattacataatgataaatttatttcttgaaatattttatttgtatctataatttaatttttttcgcgaatgcgcaaaagaattgcacgtcaatatattagagggagtatctataattcaatagacaatccatagctaatatggtgaataatctgtttccataccttattattctaccacaagatccgttggaaaatttgcaaccaaaaaaaaacaagaattgagacttgtactatcaattttcaggggctgtgagcaatatgtgcaattatgggatgtatttttttaaaataatttaatgtgatatattggctcaattgggtctggccaatgccaggagcccaggactcaggaccctctcatgacaagcatgcatgcatatttatcatgggtccacagtacagagaccatggcaggtgtgaggactgaagtcttcaactccttgcattgcatgagtaaaatagcagttggcatagctgcagcctcttcttcacccatttcaggggttgtcttcacggacactgtccctcacaatatgaaaaagaactgcagccaccaataaattttcattgcaggctttttaccagcctttttaggtgaatttattgagccattcattcaatcagtatcaccactaccatgagagaaaaaaaaaaggggggggcagatttaggtgaggttgtcattggaaaatcctacacgtctgtccctgaacagaaattcagatactcaggtgacacgttttatattgaaatttagtacttggtgagactccatgataggtttggttctcatgaaccatgaggcatgtatgctctccttctgtcttattgtctctttaaactgtttgattgggaaattttgatagataataattgaatccatttgtgatgtaagaatttcaaaagaatcagcccatttcacataaaaatcagaaaaaagttactacagaagagaaggcaatgaaaagaaatcaaaacgattttcagtgggtggtgtggcacgctcacggtgagttgtaacgacaacattgttcatgtggagttgcgggattgggattcggtaacattctaggtgactcaatgtcaccgagaatgtcatgggggaatgtcactgaatctgtgttcggagttgcggtgcctagcggcacttcaccgtgacctgtggtgaaagatcatcatatatgataattaatttttagttatacgatgattaatatggaaaggaggaattacattataaagttcacgttacaattgggggccaataagagccaaaacacatagacaaggtcattgaaaggtatgattccatcattagtttaggggtttaaacagatcgttggaattgcatattgccaatagttatcaatgcaaatgggagttcagacatgggacccatttgtttgtacctactttccaccatctcactatcaagatacactgtttgtttatcatgtgccataccaagatttgtacttacgattggttctcttcataaaagatttgaatcataagaaagtcattgcagagaactttcaaaaaataagagagaaatgcaggtctcgcagacaagcagtcaactcattgatgaatcagaagcacacctttaccagaattcagatgaaaaaaataatggcagaatttctcacaccatgaatcgtttttatatggtgaaagaataaaggaacaaaacgaaattctttttgttgattttctctcacatcctcacatctccaatctcatatccacaaagatttctctgctcagagaaggggaagaaaaagataaatagaagcaggaggaaaggggaacaaaactgcaagaggaagaagacttcctcctctcctcaaaacacaccctttctctcttcatccagagttcaagaagctgatactagcttattactgctcactttcatccttgcttgttatgatgatgctcgccatgcaccactacttgctaccctgatgagttgctcactgaatgaacaattgcaaagcaatgccaagttatgtatgtacagttatcagattggtgttgtgtttaatctcctcctcttggaagcaggagcagagtcctggctgttgtaatctttgttgttgctgtttgactgtgatgatcctagtgttgtgtcatcactcctaaaactgaagcacgccgcgtccaacacggtgatcgggctgtgtggaactgaagagcttgcattgctgttccttatcttcttcaccaatgccttctctaccatcagctcatagcatctcataaccatctcctgcggatgcacaaacatgacacattcagaaacattgaaaatacaatggcagatcagtatgccattcctaaaatgcaagaaaaggctcaccttatttacagggatttcagattctccaagggcactgttgaagacaagaaactgattctcagcaagcacagctaacaccactgcggccgcaatctcagaaggtctgaatgacaagaacctagagtctgtaaaaacattgcacataaatttctagtaagtacaacttcatcagatgttgccattggcaatgcaggtagatcttctcgattaaatcatcgggcaatatgatcaaacctttcagagtgcccactgtgagatcagagcaccatgatgccagcgtgtagctcggcggcttcccttcattgaacttgtccaggaagtagccgatgaaagagaatggggtcacagcttgcagcctccatttcagggttttcatcacaataagctccatcctcttaatatgccttgcttcaaacacatattccgcatcaaaaacctatcatgcaacaaaagcccattttagcacaagatcatcgcgcgatcactgaacaattatcgatttcaactgtaactcttcattcattcacctgaaggtccatgggaagagggaccacggtctcctccatcttcgtagcaagagatagacaactaactgacagcaactgttgcatccaagattcgtcatgctacaacaacaagaacaaacaaaagcatcgcaatgatcactaccgggattcactatacagtaattaagtagtggcaatgtacatacacgtcccagattcttacagggagattaaacgaggagaggaacctatccaggtagttcactgcgaggtaaaggctgagtggtccaaagttgtagtaggaatggacctgcaagcgcacatgagagaagacaagattagcaccttcgtcagtttctacttaaaaacaaatttgtccatataaaaggcaaagccccattgttatctgcaatctggtgctttgtcaagtttagcagcaaaggcaaatgcacagagccaaagcaagatcgacgctagagtcaaagatgtaacgcaagcatgcaacaacctacctagaagacccaattaatccatcaatagtaacaaataaagcaaaaaaaaatcctagagctttatttatttttcctacacttttgattcatattcaccttgcaaatccaatcaatggcatctttcctccaagaacactccaatccaccgagctccagcttctccagatacccccgctgaggctgatgatccatctccttctccaccaacaacgccacgaactcatcggagtcgatggggaacacagcaccaccaccgaagccaaagaaatcaaagccgccaccgccgccgcaccccagctccgccgccacctcgccgccgccgccgccaaagccgcccaggccaagcacgctgctgctgtcctccgcgcagaggaggatgttggaagcgccgaagcaaagaacacccatatcaatcaacccaagatcgcaagaaacaacacctcctcctctagtactattagcacaagtgatactggtattgattcaagaactcaagaacgcattgattcaagaactcaagaagagagagagaggaaaggaggttggtggtgttttggggagtgagtggcctagggaggcgagagggagagggagagggcgcagcaatggaggtggaggaggaggaggaagaggggcgacgcttttgttggtgcgttgtcttggaaagtggaaaaaggaggggagagacagaggagaggtctcctggggaagagaggaggaggggtttttggggcgtggcagttttatagggcgtgcgcgtgcgcgtgcgacgagacaggaggtggatccgtgtgcggtggtgcacccacacgctgcgctgcaccgaggcgtgccaacttaaggccaaaatagagggagccgggagagacgtggcgatagtaataacatttcctagtgtaccgaacgaattcaaacaagtttagccaaacttttttgataaaaagtatttggtttttctcggttttacacccttcttgcgacggtaaggtaaacattgctcctcttatgtctacgctagacatttttgtaattcaaaaatatgacataaacatcaaatagattggcgtcgagtaaaattgggtgaatttgttgttacgtttagaatattaatcgggcactacatggttttttcttcttcttttttaagtagtataatgtctacggtgcaactaaccacgatgcgcaatatctaaaatgtgattaaccacgagttatttggtttactggtgttatgttctatgctagtagtactttatttttaatcgtataatacttgtttaaaagtctctagtggctggtgccaatgaatatgccactcactgttgtttttgtagtttttacaaattgcctcaatatttttctaatattgtagaatagtctaacatttagttcagacaaataaataatagataatcaaataagcaaataaatgatactaaaatatttgattaaaaaatattttgctatgacatattatgattcttctatccatagcaaagtatgagcattttgctagtatgagaaatgtgtgacacctccttacagcatagagaaaggcacaagaaggcaattgtctcttggttagtggtattaggccatccccaacccagaaactatcaattagtttccatatttgctatgttatatatacattatgcatagaaactatatatacaatggatgatgtcttcaaattaagttctcatccaatcatctttcttctctcctttatctacctatccccttcttttcattattggttcttgtgtagagatgatttcttgcatgagaaatggtttctccatctttttgcctctctcctcattaactctcttggcacatcacatttttgtttatgtggcaatatattttatgctatggatactagatgtcatggagggttagggatggccttagagtaggtacaatagcagactataagctagctataaacatattttaaagagataaaagaagagagagaagagcagcggactacagatctataactagctgcagcacggatttcaagatataacgtgtgtatgataggtgggactatgcattaatagtatagtaagcaactattgtatgaattgtattacattggctatagataattggagctagtagttggctatactattaaacttgctcttagaggggcgagggggaagctaggagaggggaaccacattacaaggattaaaaaaaaagaactagagaagtcacctatggcttaaatacaattatatgcattttttttggtacaatgatatgtacattgaaggcagaaatctatggtggtgagatacttattgtactacatataactgttccttgttttttgggggtgaatagggaggagtgttttatttttttttaacaattctgaaccaaaaatagtcatttgtgctatacagcacccagtgaatatatgcccaaaaattacaactcttcacgcatctatggcttcacgatacacttggtgatagaattgcgagaaaaaactagtcaactgtgctaatttaagatgctacaactaaatatagttaatgaccatggtagcctgatatatgtttaattaattctagaagatgcagttgataacaattgtatagtcaacacaacctgatagcgtgctagttttcttttagcgcgcactcgcttgcattaccacatcgattactaaatactaggtctgtacatttgcatctgtaaatttccacaatttatgttatctgtcaggtaattgggattgatgcgtctattaaaaaaactaatcaacccgagtgttcatgctggactgtcgaacagaaggaatttcatcgcttacagctgcgttgacaacactaaaatttgcaggcgtagtacaaattacaattacacatgcccacattgcatttagatcagaatgacaataagtagactgtctgtaacgtaattggcacccagaataaactggtggttcctaattcgcgtggtcaacgagttctttttaatataatcattcaaggcggcaatccattttggattgtgagttaagagctgcttaaatccgatgggcaaagcatcaagattatccaaccattggttacgcataactaaccaatcaatttggccaaagcccataggattcttctccatgtatcgatggatcacacaatagataaagtaaaagaaagaacaaatgctgcaagatatcaccttgacgtttttgttagcatatgcaccccgtccccagtggtcctagagttggataaacccaacacatatccttttctccatgcagattcacgatatactcacattgccttctcttcgatgccactgcactcttctcatgatgcaaaattgttactaccacagttttacaaaatgctgagctgtctgaaaaaaactctgaatgtgtgatgctgctctgatacatggctcctatgaacagatcggtcaataaaagtttaggcaatttaaccacagccactctcattctcatcatgtatcagaggaaatgctgaaagctatagaatctgcgatgctgctctgaattctgaaacatttttttcttggtacgggtacctatgagagcaggtttaatagtatagtcaactactgattccaaatcatatgtagttattttaataaccaattcatacaataattatctccaaatatatactacataattaatatctagtttcacatatcatacacatgtatcttatagtccgtactgcagttggctacaaatctgtagctccactgcttttctatcttacatcttatcttcttaaaatgtgtttatagttagcttatatcctactattgtacatcctctgattctctgaatatctgtctactagaccagtagtaataagttgactagtggtgctgtggaggcaatttaaccacggccgcccaggcggcgaggcaggcaagcaggcgaggcgccccccgggcgtgcgttgtcgcttgcggcgtctcctccgcgatggctaggtgcaaagattgcgaagacgcagtacgcgtttggctccatcgccttgtacgcgacggtggcgcacgcccgtgtccggcaccgcgcgctcgccatcgccatcgctgcgtacgtacgtaaaagccaaggcgagagcgtccaagcggaaaaagcctgtgccgccgtggcgtcacctgtacagtcgaccagtcgtgtctctccctcccgtgtccgtgctcgctgctgctgctcgatgggtataattcctagtgccgatagctagctagctgctcgttacattttcgctagccctagtcctccttgcaagggacaacctgttgttgttgttttttttaagaaacacggtacaattgcaagcaatcgtaacacgcatacacttatctctataacacgcacacaccatatttcgattatatcagaagactgagctgatatatcttaaaattgacgaagttaccacgaatgcctcgtgtcaatgtgtacgtcgctctacaactgaaagaataattacccgtaaatacgagcatccgttttcattttgttactgctacgatggttgtgtgatttgtagagttcattaaccttgtgagccgaaatgaccatgctgcgtcatgtatgcttcggggttgggtagtttggggtgggtgtgatggtcagttttatggctcgtgatgcggttaatatggtgcaaccaccaccaacgtgatagtttgctgggctaagcccagcgatcgatccatctcttcttcccggggggcaattgggccaccatttttgtgttttgacactcgtgaggagcgtaatgtgatgcaactaccagccaagaaggggtttggctggccttgcagcatgatgagctcgtgtgtaccctaccaaggaagctggctccacattgtgaagatgacgactagtagatgagagtatgtacatgtgctccattggtacaagcatagcatccataattgctcgtgagaagtttcaagcgattcaacaaccaaagtagctagcactcggaacaaagaatggaacaaaaatgatctggtttgggttagtgaattgcattctttggatcagcaggagtagagtgtgcactggtccatttagtcatttacaaatcaagaggcatggaaatgcctgggccttcatgccatgtgctttgtttgcaaagatggcttgactactattactagaggaactggagttatttctcgtgaggaacgttatatggtgtaaccaccagacgaactagctggttggataattggatgtaatcaagtatacactagcttactcttttacctctagtggcctggtgatgttgctcttttattgatcttcacatttattttcttcactgcaaaactgcaaattttacgctgaattaaaagatagagtatatataatgcattctacagtatatataatcctgaccagggtttactttatcattttaaccgatttgatagaaggtcaccgatataccaagaattccaaaattttaaataaaagttagttaaatttgaacaaatattaccaaaattcgtgaaaaaattaaaacaaggaaaaatttcggctaaaatagtattgtattggaggggtccgaaatgaccgaaatttccaaccctgatctttgacatttctcctttcgcagaaatactccttgaccaatcggaacaactgctgcaatgctctaatgctctgcaagtagagctactacgtacctctgttcaatcagatcatcaggcaatcgatcagcaatgtacgcaggcaggatgcaacccgtgagaagaataatgctgtgtagctaccagtggtagtcttgtattggattggctcggcttccacattgattcaggctcagccagccacatccgtactgaattcaccacacttgaagtcgatcttgaacacactgagaattagcatgcgcgtcacgtaggttaattgaatgggaggcaacatttagtgctcgtgacgggcgtaacgcggcgcagcaaccggtcgaggtagagctgcatggtcgtctcgtccgtcagattgcgaacgattttagagcggagtagtacttggcgtggtagacagatcggtcgccgtgtgatccgtgtgaccctgtcgccccgtgcccaacatgcgctggtcccgtcaatctcggagagcgcaacccaactaaccaaaccaacaggatcattacggccccatttggtagggctctaaactccaactcactcctctcaggggactagctatgtgagttgaactatgaaagtttggtagttaactctgactgaaaaaagcaaaaaattgaaaaaagtgtaaaaaaaggaacctaccgccggagccaatcccaggcgccgcccgccgcgtggcgcatcgtcgccacccgcgctggccggccgcctcccgcgtgtcgtcgccgcgtgccccgcccgccgtcgtccggacgcctccgcacgtcgtcgcagcgcgcgccgcccactgcccgacggccgctgcccgctagctcgctgcccaccgcccacgtgtcgtcccgtcgccctgctaccgtcgtgtgcctgccgccgccgccgcatgctagctcgccgcccgccgcccgcgcgtcgtcccgccgccgccgacgccgcgggatagcactgaccggagcgccgccgccgcgccctccaccgcagcaaccgacgccatcgcccccgatccctcttcctcctccgccgccatggccaacaccgcctgccgtcgccgacgccgcccaccaccgcccgccgcagctattgggactcgggagaaagatgggggaggagaggaggtgagtaggggtagttcaatggtatttttatgtaaatacactaaagaattaaaggttagtgggtcttttggggtggagtggagctgtggagcagcaaaaacccagctccacccccgtagtacaattttgtggagcagctctcccaactccgctcccaaaaacggagtatctggactgtttgacacaactccagctccaggtaagttggagttgggagctggagctgtgccaaacggggccatttgtcgataaattttcacctaaaaatttgacagatgtaattatagtataattgtgatgtaattacattgtaactcacttatgtttaagtttcaaaaatctcttcgtaaaattctatttcggtaaaacggaggtcgtggaaacgaatcctctcatatgtgtgcgcgtagtgacttttttcctcctccatttgcacaaatcttgaaacaaatctaacggtttaaaattatgtgcaagttacattgtagttacatatgttactacgattaaactgtaattatatatgttcacagcgtcttcacgtgacgccgcgagatagttatcaaccgcggcccgcgtaaaacggcccaatcacgcgcgcacggctcggcccgcgaggcgtcgagacgagaggattcctcgcgttttcgccgattcggcccgcgcgcacacgcggcgcgtcgtctcacgcacgcatcggtctctctctctctctctctcggtgactcttccgccgcctgcgccgcggcgcgagccgccatggcgaggcgcgcgaggctccggctccggctcgtccgcgccctcgccacggcctccgcgtccggatcgcctgcggcgccgcggccggcgaggcaagcggcgccctacctggcggtgctccaccgccgcgggagggcggaggcggcggcgtgcctgaaccgccacctccgcctgctcccgctcggggaggcgacctcgctcctcgacgcgctcccgtccgtccgcgacgccgtctcctacaacaccgtgctcaccgcgctctgccgccgcggccaccacgaccgcgcgggcgcgctgctccgcgccatgtccctggagccccacccggcgtgccgccccaacgccgtctcctacaccgtcctcatgcgcgcgctctgcgccgaccgcctcgcggaccaggccgtcgggctgctgcggtccatgcggtccgccggcgtccgcgccgacgtggtcacctacggcaccctcatccgtgggctgtgcgacgccgcggaagtggacaaggccgtggagctgatgggcgagatgtgcgaaagtggcatcgagcctaacgtggtggtgtacagctctttgctccaagggtattgcaagtctgggcggtgggaggatgtaggcaaggtgttcgtggaaatgtccgagaagggaatagagccggatgtggtgatgtacactgggttgatcgatagcctttgtaaagtggggaaggcaaagaaggcgcacggggtgatggacatgatggtgaggagggggttggagccaaatgtggttacgtacaacgtgctcatcaattgcatgtgcaaggaaggttcagtgaaggaggcaatcggtgtgctgaagaagatgtccgagaagggagtggcgccggatgttgtgacatataacacactgatcaaggggctctcggatgtgctcgagatggatgaagcaatgtggttgcttgaggagatggttcgaggtaagaatatagttaagcctaatgtggtgacattcaactcggttatacagggcctttgtgatattggtaggatgaggcaagcgttccaagtccgtgcgatgatggaagagactgggtgtatggttaacttggtgacatacaatctgctgattggtggactccttagagtccacaaggtaaggaaggctatggagctgatggatgagatgactagtctagggctggagcctgattcattcacctatagtatactgataaagggtttctgcaaaatgtggcaagttgaccgtgcagaagatcttttatctacaatgagagatcgtgggatagaacctgagctatttcactatattcctttgcttgtagccatgtgtgaacagggtatgatggaacgagcgaggaatttgttcaatgaaatggacaacaactttccactagatgtggttgcatatagcactatgatccatggtgcttgcaaagcaggggacttgaaaactgcaaaagagttgcttaagagcatagttgatgagggactgactcctgatgctgttacatattctatagtaatcaatatgtttgctaaatctggagacatggaggcggcaaatggtgtgcttaaacagatgacagcaagtggctttttgcctgacgttgccgtatttgattcactgatccaaggttatagcacaaaaggagagataaacaaggttctcgagttaattcgggaaatgataacaaagaatatagcacttgattcaaaaattatttccactctttccacttctctggttgcaagcaatgaaggcaaagcattgttgcagagcttgcctgatttcagtgcagaaatatcaaaaggcaacatcaattcaccccaggagttaatgaaagtgttgcataatgtgtgcccccaaacaaattaaacctggtgttgagcctctttcatgttctcctgcgcaggtagccttcattccttcatatttgagatttaaaatatgttcctttgttctagatctgcctatagtttgtacatagttttgtccattcccaaatcataggtgctatttgatttcggctgcagatattaaatttggcacatctctatcagatgtagttagtagttactgcgtgtcatgcgtccattttcctcgtggttatttcagtaggttcttaatttagtctttgcttctctgtaccaatgcaggctatatcattcaaagctcccagcaatcagcaattgcacaagagagcaaaactaaatctgggtacatttgccggatcgttggctagctggagtcatcgaaattcacaggcaaatatgatcatttgccactctttagattgccacctgccacccagtgaggctgtgacaatgacacggggggtcgatgacatatgggctaggatggaaaaacatcaaattcccaatctaagagtagcaaatcatcaattttgggatgaggatttaggatatagcaacttgcaagtatataggagacaggaagtccatgtccagcaagtatcagatgggcatgattcacggcagtacggatgactattttcaagggctagcatgataccagcatcaaaggccaggaagcaacgaacttgaaagtttcgtttcaaactcgataatgacatgctactgtgtcatctgctgccgacatctccatggtcttggtgccagagctggacttcacctgctcgggtcctgaagaggtggcatctgtgcttccaagggcttgttctccattgattgatctagcgtgtatgcagccttttctaactgggattaagagttgagattgtttttcttgtccctggtattgttaatttgatacgcaaattattttgacgttgtagtggtatggcaaaaagtatctcttttacggtacacaaattttctcaagagactggcatgcttcgtagtcactactcaaatactcaatgatgataccaaacggttattctcgttgcaattgccgaaatgagttgcaatggcaacttttatgtccaaatgcggccgtttgcaattggaaaaagagaagaagaaaagacgctgcttttcagattgttcggcgatgtatactccaccgcagtacatctccgaacgatttccctgtggaataagttcaccagaggtccctcaacttaacaacgagatttatttaggtcactcaaccacaaaaccagaaatgttcacccctaaactcattcaaaccgttcaccggaggtcccttggcagtatatgtgggttgtttcgctaacgtggcatcctagtcagaaaaaaaattaaaaaattttcgtggggcccacatgtcagctgcggtttattgtttcttctcttttctctcctcttctctttcctctcctctttctttgccggcggcgggcgcggcgatgggcgagcgcgcggctggagtaggtggaggggcggcgtcagcgcgctagagcaggcggagcggcggcgtctccgggcgagcgcggctgcggcaggtggcggacgagcacgacggcgggcaagcggcggctccgagcgtgggtggtgcgcggccggagcaggcggagcggcggcgtcttcgggcgcgggcggagcagaggggcgggggacgcggcggcgaggcgtcgcctctttccccctctcccgccggcctcatctcccccactccgcccggcttcctctccccctctccggcggggcgctgggagaagggcggtcactcgcgggtggcgtggacagggccgaccacccgactacccgagcccggagctccgtccgctcccgtcgctgcggcgcgccaccacgctgggctcctctgatgagtgcgacggcggcgggaaccagcggcgagaagaacagcacgcagagcgacctagggctaggagtagaggtgcatggcatacctgctctccactccacgtcgacggcgccgtcgatttggccatgctggtgaagtttcccgccgcccggccgtcgccgtcgccgatgacggccgaatccagattttccggcagcagagagagcgcatccccagctcgctgctcgccgccggtcttggggaagcggcggcgtcggggagagtggagagaggtcgggagtgagcgaaaagccgagaaggggaggaggatgacccatcgactcaggcattcgactgccacccccctctgattcctccgccaccggcggcgacatctctgtcggccgcggggatcccctcccggaacaggagcccgtcccggatcccgccaccacctcccgccgcggttgcccacagtccgccgccgctctcgccggctgtcgcctcgctcctgcctgcttcgcatgccgctgccgctctcgccggccgtcgccccgcccgtctcggctcgtccaagaagacgagagaagagaagaaagggaaaaaagaagggatgtgggccccgcaccgttttctctcacttacatgtgggccccacgtattttatttatttatttttgctgactaaaatgccacgtcagtgaaaccacccacatatactgccataggatcttttgtgcacagtttgtgaaaatttaggggtgaacatttctgattttgtggttgagatgttaagttgagggacctttggtgaacttattcctttccctgcagaagaaacaacagtatctcgtcgagagcagtgacacaagtttgacacagaaccgatgaaaaccgctcagttttcttaaaatttgaagggatttttaggctaaagatcgtagacccggcttttaaaaaaaacgtctaagaggtcttccggctaactccacaagatggtgggttagctaacctgggttcaaaatctcatttgatattagatcttttcataatattcgcttttttaagctggtttttaatcaaaagtcacaaagtcagaaaatttgaaggtttcgagccaacacgagttgacaaacagcacactagaccagtcaaatataatttataaaaaaaatcaaattacatttaattatttgataaaatttgttcgtatgtcattgccttttactagatggtttaccttaccgctatctagtggtatcacagttatcaatcgtttggttactataaaagcgataagatattaagtggtatcacaattatcaattgcttggttactaaaaacccaagaggtttttgattaaaaaaacctattagcttttaaaaataaataatactccctccatctattttcaaatttgaaaaatttatttttaaaaggcatatttcaatctaacaacctattatcttaatgacattctcggatttaatgtgtgactctctattctttcacacaagattggctacatggatatcgagaaatgcaaatatcaatgaatcatttgtttacgagaaatgactagtagcatgtttaaatagatgataagtaaaattacttatccttggtctgtgtgccaagatgaaatatgactattaaaagtagatggagagggtattgtagcaggatgttactgtgataagtgaaggtaattatctgccgcactgctgatgctagcaaacagtaaaactgtaaaagcttcaggtcaaactcacacgctggcccagttgctcagttaactcctcccaataatctcacgcgctctcctctcgcatcgaccctgtccctctctcatcatcatcattcatcaatcgtcgcctgatcgcctccagcgaaattcttcctccatttctctctccatcgaatctcatcccagcagcagcagcagcagcagcagccgccatggattccaaggcggacgcggagtcagccacggccagggccgccacggcggc

SEQ ID NO: 79028 - DNA, 4615 bp, Oryza sativa
gtttttatgttgatcgaacataacggcgttcggctagttattttttgaaataagctgttgtggtttcaacgttcggtgagcgatgcttcggccgattcgtttcgcccccctggcctttttcgctgatcaggcgtttgccttggtgtttttccacaaattatcaatcacacaaaaaataaaaagaaggcggaggacacaaaggttttatactggttcgggcctccgtgatggataatagccctacatccggttttttttccttttcttttatttttctgccgaaaggcttacatagtgccgaagggcttacataacaatatgtacatttttacaagttggcgatttgggtgccacccattcttagacatagaagcgcttgagagaggcggtgttccaggaatggtcgaactcgtcaccttctagtgtcgccaatcgaaaagatcccgtcctagacttgtgtttgatgaggtatggtccttcccactttgattcaagcttgccaacagcaatcgggttcgctttcttccttaggacaaaatgaccaggcatcagttccgtcggtcgaacttttttgttgtaagttgccgaagtgcttgtggcatacttgcgcatgtgctcaagtgcttcaactcttaccccctccaagagttcgagcgacacttcgcgcccctcttcgcctccagagaacatcacccttggtgagttagcccctagctctgctggggtcattgcttcgtcgccataaagaagcatgaacgggctaaacttggttggtcttgtgggggtcgtccgaagggcccagagaacggatagcatttcctctggccatttgcccttcgctgccccctcgagccttttctttagtgcttctaggatcttgccatttgtacgttcggccgccccatttgactgcgggtgcacgaccgatgcgaacctgatttccaggttcagccctacgcacatttctctgaacttgtcagagttgaactgcttgccattgtcggtgatgaactcttttggtactccgaaacagcagacaatgtttttccacacaaacttctgtactgctgccgaagtgattgccccgaggggttcggcttcaatccatcgagagaaatattccactgccacaattgcgaacttatacccgtttcgcgccactgggaatggcccaatgatgtccaatccccatctggcgaagggccagactggcgcattgggctgcaaatcatactggggcgcggtttggcttcgaccatgacgctggcaactttcgcacttcttgatttgctcaacacagactttcaacacagtgggccaataaactccgtgtctaaacactttggaggccactgttcttgcggcctggtgagcgccacatagcctctggtgtatctcctttgccatttccttgccttcggcgaaagagatgcaacgaagtaagggttgaagtaccccggagcgatagagctggcccgagaccatcttatacttcgtggctctaagttgcaagcgctttgcttctgcttcgtcttccggaagctagccagtttcaaggtgttttacaaacggggttcgccagtcgtatgggtcttcgcccagtttcacctggtcgattgccatgatctccaagctgtccgtgggcacacttggtgcatgcaggacttcgaaaaagatgccaggcgaatgtgggccaccacaagcagcagatttcgccaaggcgtctgcttcctcgttctggcctctaggtaagtgttcaaccgttatgccggtgaagcacttttccatggaccgaacggcctccaaatacctcttcatccctttttcttttgcctcgaaggatttgtccacatggcctttgatgtgaccatggctactacgaatacatccgttgctcacatcatggatgaacaacaagatatcaagttcgagtcctccaagtgccaaaatccaattcggccacctgctacactgctgacttcaaatggccgccgaagctgcatacgacctccgttttcggcccgtgagtacttggtggaaagctctcggagtcctctttctaacagatgcagcctcatcgccaatttccatgtagtttggccgcaatcacataaacaagatgctacgtcacctgtcttgggcctatgggcttgtaacttttgtttgggacccggccccaaatggggcccatgtggggtgtgccccaaccaggtggaggacgacctagggtcctcccacccccataaatagctaggtaccctttcagggtttcttgggttttgtttagatgaaagtttagccattgctacttgcttgcagcgcgcgtgtcggctagaccgtccgtctgcttgttcttcggaaccccaacttatcatttgtattaaattcctatttgcaatatcagattgtttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagttttgctttgttgaattttgtgttgcattgtcacgacgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacacaaaattcggctgccatccactccacctcctggccgagtcccactcgccccattggccgagtccgactccctccctctcttccaccgttccgagttgtgtcaaacaccttggcgaatttttgtttggtgtcggtttcgagatctgtttggaaaaacggaaccggcataaattcagcattccattttttgtataatgttaattttgggtttagacttttacatttgagtccctataaattttatatttatgtttgagtccctgtaatcttacattaaggtccttgagtcagtttttgttaaaaaaataagaaaaaaagtgagaaaaaaaaggcagaaaggtgcaaaaaaaaaaaagaaaaaaaaagccgcaccaaaaaaaatcagaaaagaaaaggaaaaaaaaaagaaaagaagaaagaagaaagaaagaaaagagaaaatactgttatgtttgagctaaacttcatatatcagagttgggcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttgtcagagaaacaaaaggttatgtgtgcctctagtgttttaattaaacatgcttctaatgattggaaacgtctttgtaggcataacaaaataccacaatcttggaaagacctgaaacgatatttcagagatgtttatgttcccatgtattatgctgacattttgttcaacaaactacaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttac

SEQ ID NO: 79029 - DNA, 22191 bp, Oryza sativa
ccccccccccccaaatcccaatttcacatccgcgtgatcgaatcaaacacctgttcatcatcatctgcagcatccaagtatccaatccatcactactactactgatttgtttcaccaatgctatgtgattcttctctgtttgagtgcttacttgttcatcatccgttagcatccaattaatccgtcacttttcagggtcaagaacactaattctgctagtactaatttgttccaccagtgatatgctatgtgagatgtgattcttctctgtttgagtgcttggaattggaaattcttctgcattgctgtagtgaaaactgggccaagcattgctgatacggcgatggggaggattgctcagatatccaaggtgatagctgaaggtggatatgacaaggtgttccaccagacgttcgagtgcctgcctgatgagaagctcaagaaggcgtacgcatgctacctttcgacctctcatggcccgatcatgggcgtcttgtacatctccactgccaagattgcattttgcagtgacagtcctgtggcgtatgtcaccgaggataataagaaccaatcttccatctacaaggtatggtgatttctttcgtcatatgctctataaaccacatgattgtttgctgatattcaagttcttggtttcgtagaaattatttcagatgctggtttgtatcagtatcataaatgctatagcaaattggtactaccctggttccaaaatataaacatttctgcatgttttccaaaatatatctggacatccctccttctggatacattttgaaactcaagcagaaatgtttatattttggaacggatggagtattttataagttatctcaactttgtgaaaacatactaattacgaagaaggcatggaagataagaattccacgcgattcgtatcatgtatgctaccaaattgctatttcaagtcaagtttcggacgatttgcaagggatcttgtagaaacacacctgatcatgtatgtatctgttttaacaggtagttgtacccgttgctcagctaagatcagtcactcctacggcaagccagcagaacccagcagagaggtacatccaggtggtttctgtcgacaaccatgacttctggttcatgggcttcgtcaactacgacggtgccgtgaagagcctccaggaggccgttcgtggcggcaaggcttcacttcaccatcacatgtattttttgtgaacatcgccgttacatgtattgatctgtccgtcgttcgtcatgcatcactgggaattcgcatgtgtcggtgtgttaaattgtctgtacagatcgctccccttgctgtgtatattggctgaaatttgtgttgcatatgcattcatgtattgtatgtagtgtgtggactagatgtgtacaaatactggattgattgttggcttgatgctccattaaagcctttctgttcgttgttcccattctaagttcaatcacatgatgagttgacgattgctgttgaatatttttggcattcccggagttaatccatgctgagaagatattactaaacatggttttgggctgtttagtttacgtaaagtgttggtattgcaaaaaaaaaaagaagataatactgtattagcaaagaacaaatcatgccagaaaaggtaaatgcagcttccaaaaaaaagaatgttgtttgaatagaggttaaaacaaattttagaatcgaagttctcacccttggattaccacaagtgacgatgaatttcctttgctgctagcaaacatgttgcgctgttagcgcaggtacaatagcaggctataagccagctgcaaacatattttaagaagataaataaggggagagaagagcagcgggctacaaatttgtagccagctgtagcacggactccaaaacgcagtgtgtatatgactgatgggaccagatattaatagtgtagtatgcaactattgtatgaatgagctattaaattgactatagatgaattggagctagtagttggctgtactattaaacttgctcttacctcatttgctttgacgccttggcccgcccctatccctatggaaccagagccggtttataggatggcgcctgtgcagtgcatggctgaggccgtggggaaatgaggtcgcagcctcacacgcatatgtatactgcatctgaaatttctgttgtgtaaagcatcaacaacagtaaaaatgtagtcttcaagatcgaatatacagaaatttcaaatttctgttgtccaaagcaaatcaacaatactaaaaatgcagtcttacagaatcaaatatcactatagaaatttctgttgtgtaaaacaaatcaacactaaaagtgcaaccttcaaggatcaaatatcatccacaaaatatgaagttaaacatcacaaatatccagggcatcaaagtgacagactaaaaattaacgaagctagaaaatatcttctatgcaatgatgattacagaacagagtatttcaaaggtccattcgtttcattgactcgtccaagttctgtaaaaaaaaaatataaatagttcaaatgatcaatatttctaagcaaaaaaaagatacattttttctaaaataaagcattaataaagctttctaaaatattgaattattggtgatgataaatttgttttccatcaagtgattatccagaatttgtaggccaaattttggaggtgttaattaaatatgatagttgattatctagtttgccagaatttgcataactaagatagtacatacaggaaactgacgtaatttgcatcaactttgctgataaactatcagatttagaaaaaaaaaacaaaagaacacaagaaatttactaaccatggaatcatcaataaccagatccttcatttggacatccataagcttccacaatccattgaatcctctaggcccaggttctgtacataaacatgttagagagatcaaatgggtacatcagctcatctagttctgtaagatgaactaaatgcatattaacaaatgcaaagaaacatgcagagtagtccatctagttctagaataaagattcatcaggtaaaattttactctacataatactgctacttaaattagatcctctcaacctgagattgctaatttgctcatcaagcaagcaaacaaaagagaggtactaagcaatgaccgttcaagtctcttccagccacaagacttagtagatgcagaaagtacagatggacaagacttagggtttatggaaggaatcatataccggtgctcacgggcgagagaaacccagctggacgaaggtggcgatgtggctgggtgtcctccggagccctcatcgttgctgccggtggagtgtcctccggaacacctcgccggtcactgctcctccggttggccatcaagcagatagccgccgcccactggtgcctccatccgccgctgccacaggtagagcacctcgtcggtcactgctccgccgcctgcaggtagagtgcacaccgacggtggagcacagtgccgcgtcgcctgaagtcgccgccgctgccgcgtgcgagacgagagcacacctagggtcaatccacgtggaccctagggttcactgggtgtcagccctttgttccctaaaaatatatgggccaacccaagaaccttttggtgccaaatttttagggtcggccagcgcacctaatgggtcgatctgccccctttgcaggctgaggtgtagcattatataacactaactaaacagagacgattttgctatatatttgtcgacaaatttttccctaaaaatttgacagatgtaattacagtacaatcgtagtgtaattacactataacttctatgtaatcacactgtaactatagtgtaacttgtatgtaactttcaaaaatctctccgtaatatgttatttcggtaaaatggaggtcgtgggaacaaattctttcacatatgtgtgtgctatgatttgttttcttcctcaccaaaacaaatcgtgtaatagatctaacgattcaaaattatgtgaaacttatatataagttacactgtagttacatgcaagttacagtgtaattacatataagttacagtgtaattacactacgattgtactataattacatctgtcaaatttttcgggaaaaatttgtcgacaaatgtataggtagtcccgtttcgggaaaaatatgtatagcttacataaaaattcatgagtggacgtccacatgagccaccaatcgtttattcgacaaaatcagcataactggcaaaaagaaaaaacttgcagctagcacctactcctatcaatatcctacatgagtattatgatccatacaagatcattcaattcttcaacctactgagatgcttcacaattttttagagcttcaaattttatccatttgcttagtgtgacaatgctccaaacaggggtcttggaaatacatgacattctcgacgcattacaacttacaagatagcatattgcatatagttaagttaagcaacaactgttgtataaaacactaaggaatctgctcaagaaatttcaagcttcacaaggagactaaattaaagataacatatgctggattgattccatgaagttaagaaacggtcagcatgtaacattgaaaagtctgctatagaattttatacttcaaattaggggactaaattgcatatactagaattaatagaacattgaataaactacaaacaatcattatgaacaaaacaaaagaaaaaaatcaagatgaccttcatggcctcacactaaaatatagtaatgcttacgtctatagagcaacaaatggaaggaggcatgtcttggaacataattcccggcagactttctctgggagtctattattgtttatagataaaactagataaagcacattttccatgccttgcatagatcaatttctaggaacaatatactgttgtgttagattaagacggccatcttacaaagaaaatgccatttattactaaattccctaaaatattctaaatgatattttagtactttaccaaatagtgctacaatattcagaacacaaatgggggctgttggcatcagataattattagtggtaatggatcagctgcctatattatacacataattatttgtaccaatttatacaaatttacatgatatgttaataggataggtgcacagacctgagatggctataacaatcatcactgctcctgaagttctccaagcatgcccaacaaatgtgactgccacatttacactcgacatggttgcaaccatcagctttctcgattgtaaagtggcaagaagggcataccttcacattctccttccccttgcgccattcaagcagagttgcatcagggtcttccttgtattctttgtatgcctcacaggatatgaaaggatgatattcaagatgacacttgttgcagatctccacaaagcaagccccacagacaaaaggtttgctttcagcatctgcagcagccacttggtaaatggatgggcaatcaggagtaggacagaaacgatattttcctgcattagaagcaacaaatgctctcaaggaggctctaaatagctcttccagtttctcgctcgataggagagatctcaaatcaacaacaaggagctgcttcttgcacccatttttgaggcaacacagagggaaaccatcatgtgatttcaaagcagattcacactgatccaccaagcaagtcagacaaaacacatgcccacaagattcaagcttaaagggatcttctacctcacacaggcaaatagggcatgcattctctaatggaagttgaagcaggccattgtactttgtagaatttaccagctcagagatcatttcttccaccctttgcttgtcttctttactgcctcgaacgtaaagtgtatgttgtcgtaaatttaatcgaagctctactgcaggcacctctctcttcaatccttccagatcagccccgaacttttttaacatttccttcatcaagtttggaggtaggttacggccacgaagacgaatatccaaaggtttcttatcacggagttgtagaagggcatggatcaatttctcctctgctgcagcaacctgatcttggagtccaaagactttaatatttagactttgtctgtcatacagaatgtaagtgccagtctcttgctcaacagatttcaaatctgctacaccatcacgggacatgagcaactgaactgtacttagtgtcagatcaggatggtttattgttttgcctttcattaaaatctcaagaggccttctcaagtctgctattgtttttgtggcgtttgcagtaagcttgacacggaatataccatattcattcttttccaaattgtaagacacgcctacatgaagaagaacactggttaaggcctgaggacaccaacacatacaaatatttttgcagtccaaaacaactaaacattattaaggccgtctaagaaaggtgtcactgctagttaccacgcagtgaccaaatgaccaccggttattgaatgtaaaaactgtggatggaaaagacctggataatatttacatctactgagataaattaggaatgcaactcatagaaaaaagtgacattttcaaacttccaaacatcatcagttagcaacattggtatacacattgaatggtcacagatttgcccttatcaaagacaagatatttgtttgacgaagggccagtggcccacatacatagatgagccaagatttgagacccatccaaactgccttgttgtgtttaattttctatccttccacaaaatagaaaacaggaaagtaatttttttcccatcaataaaactatgaatttcagggaaaatatgcctcaaacatactgttcgtaaatcatataaaactgaagtatgggaaaataacattcatgcaatcatgaaaatgaagaggatcattcaactgaacagtatggaaaattagaagcagcagagtttaagaagttataaggaatgcagaattacctttttggcttcggaagctctcaagaagagaagcaactgcttggctgataacattatacacgcgtacttgacaggacacagtactatgaaacacatgctggcattgtattgtctgccaaggaagacagcatggaagaacacttccttgaagatgttccaatgctcttgcagcctctcgatgaagacttccatcaaaagtaatagtggctctcatcaccgaatcattctcctctggagttaacacctcaacacggaaattttgggcaggaaaaattttctttggcatgaaggaagaaatttctctatttagtgcttctgcacacaaggaagcagaaggggcagctatgggtgttcccctgagcaaatgcacatcaacgattttccttgttgtcgtgctacgaaaggcatcatacaattctggctctgttacatgcattggaattcctctgacaaaaatgcaattctcatgtcttgtactaacctcacagttgatataccttccaccaactcccagagcaaagcagtcctttacaacaaattcagcttccccactggcacatgttaccagcgcgagtccccgactttgcttaagtggccaagatactttagctctcactgctggaaatggtaatcctcgattactggaagagcatactggaaccactttcaatggagaaccatgaaattccatcccattcaattttgaaacagcatcttcagcatattcaggattgaggaatgtaaacttcccccacttcgtttcatctgaggccacctgaagatttccataaagtttataaaaattagcaacaccagagataagagtatccaccaagcaaataagctccttgtcattcaactcatgagcattttgatgcaaaacctctacggtcagatacctcttctcaagttccaaatgctttatttcagcaccagaaccaaatagggcaagagaacaatcaccaggttttccagaaaacaaacttttctcaaggcattcattcctcaacatccgagcttcacactccaatgcatcattaacgatgccaaacaccttttctatgtcttgttctttggcaaatagcacaacctctttatttctgaagtcaacttcaacagtcacacggtcatccctgaattcttcttggagaagtgagattatcttctgctgattttggccagattttccacaaaattttctcagcaagttatatccaagtccacttattaccttcacctgcaatttaagcttctccagttgctgaatcaaaggcatggggtgaatcgaacacaaagcatcaggatcaatagcagttacacataccaaatattgatttggtactgacaagatttctgtgaacaccacccactcaggcttgctatcataaatgagcaatgagcaagagggatgtagtttcacagcctgatccgttgaaatcacctggtaaccaaacctttcatgtccagaaaacatagcaatattaccagaaagagatgtgagaataattctttttagcaacttatcatgcacggtggactcctcagggttccaacaccagtaacttgggacaatgatgttcagctcgtgtcttaaacaattctcaaggtctgatattgtttcctggcacctcctcatggtcttggcattgatgctattctgccagcaccacgtattcctgttttcatgctcatcctcccactctttatatacagctagtaaagtgaacagatctccatcctgatgacagaatgggacctttagacggtcagctttgtatttctcctcatctgtgcccactctacaaaatatgctgctagaatttgccataacagcagctagaactacaccttccttcctcaaaccaaaaccaaagcaatcaagcatgattttcccaagcctcggctcgattcccaatttaactaggtagcgaccagtatcagtcagctcaaaaccatcacatttatattttacagcacccagttgttcaagattctttacagccatattaatagcttctgggtttggggcatcaacaaattcaaaattctgtgcatccctaatacccagcgcaagtattctcagaacagcagtgccaagatgaactttgcggatttcaggttcttgatgcacttccatcatactgaagtcagattcagagtaaagcctgtaacacctccccgctccagttcgacctgctcggccagcacgctgattagcagaactttgggagatccaattaactttcagtacattgagaccactgctaggcacaaatctgctctccttagccagtccagaatcaacaacatacttcacttcttttatggtcaatgatgtttcagcaatatttgtgcagaagattatttttctcttcccaggatagctcttgaaaactagactttgctctacatgggaaagctttccatgcatcggaagtaccacagcatctgcatcgctgaagttttcacatgcccattcaacttcgagttgagaagtcaagaaagcaaggatagcaccctcttcttcattcttgtgaatgatgcttaccattttcacaacatcgtaaacatatgaagcagtagcacaagaaccgcgcagatggtttggcacggtattgaaggaagcctcttctgatatatcagggacatatttaatttcaacaggaaaacttcgccctttaacataaaatgtttggcatccataaaaatattcagcgagtctattagcatcggcagtagcagacattatgataagtctcaaatccagcctatcaagcagtttcttcttaatcaaagctaagagaagatcggtgttcaagcttcgttcatgcgcttcatcaacaataatatatgaaatgccatctagtcccatatcattcatacagtgatgcaaaaggcagttgtctgtggtatatataatctttgaactgaaatcttgatgatctaaaaaggttgaattcaacacaaagttgtccccgtagcaaccattgctttcttcaactactctatgtgccaatgatatagcagcaatttttcggggttgagtacagacaattgaaccattagcagcaagacctgagtcagcaagatactgaaccaattgtgtgctcttcccagaaccagtttccccaatcaaaatcatcacctatggaaaacaaagctatacgacttaaagaattatttacaaatttaattgaatgactgatagtaaatacagaaaggtatgggtgcaacacaatatgtattagagaatgatttacaaatttaattgaatgactgatagtaaatacagaaaggtatgggtgcaacacaatatgtactggaaaacttggacatgctacataatcaagactcctgtgcctcatgagcaaaattgcatcttatttataggttttgcctataagcatagaatattctgccaaccaaaattcataagaaaaatgcggcatgctgatttagaatgcaagagaacctattcaaaacttcaaacagagttggaacttgatggcgcattgtatgtgaaaacatgcacaaaactaaattcctaactcaactctttcttccagagttccaagcataacagtaaagatctaatggttctttctgcattgcaaacttccaaattccaacccactacagataaaactgcattgagaagtctggctctcacctggttagcgaaaatgtgatctagaatgttcctgcggtaagcatagatgggtagcccctccttaagccttctacattcccgcagcattatcatgtgcagcctagcgaaattcatctcaccacctcccccaatcccaaacacctccaacccttcctcctctgcctcctcgtcatcctccgtcccacgcaacaatgcacgccgtatcgatctcatcgcggctttgtactcatcgattttagcatctaccaactccttctcagccttgagagttctcttctgggcctggagctgctcgaagtcgcggatgcgattgtgccccgccaggcggcgcttcaccgcctggatggaggccgcgagctcggaggagcgggcggccgtgagggagacgaggtcggagtcgacgaggcgggcggcgtgggcggcgaagagggaggcgatgaggggggcggcgtgcgcggcgagggcgggatcggagacgtccggggtgaggaggtggaggccctcgaggcggagcgaccagagctcgcgcgcggcggcggcggcggcctgcggggagcggaacgcgaggcgcgcggcctggcggcccgacgaggagacgctcaggctgtccgggggaggggagggcaggccggcgacgagtgcctcgacctccgtggccggcggcgccgagaggttgctccccccgcggaggaggatcacggcgaactgccgcggccccggctgcgcggggcgataccgctgctggtactggtactggttctggtggtggtggtggtagcggtgcggcggcgggccccagtccggcgggcggaaggggcggccatcgttggatcggcgcatggcggcggcggcggaggcggcgaggttgggtttccgagggtttggggggaggttttggagaggggaggaggcggtggggtgggaatcgacgggaggagaggagggaaaggtggggggagaggcggacgagacgaaggcctttttctcgcggttttatgatttccgtttccgtttcttttacggttcttttttttttcagatagcgtccgtttcagtggggatgatggacgcgtgaacggatgaacggacggctgtggatgatgcgatagggcaagtattatgaacatccaagcacaagtcccaagatatcacataggactaaatgataaggtggaggagagaaaaaagatgagagataaatagccatctctcatgcaaggggcaatctctacataaacttcaataaacatgtaaaagtgttagaaatattggagattgtgtgatagagataacctataatatatgttacctcttaatttaatggtgtatgtcatgaaattagatgtggtagtcacctctactatgaaacttgcccttagaggctaggctacttactagatattttttttaagaaaaggttttactctttctagattgattatatagtgcctcatctattttagattataagtcgttttgactttagttaaaatcaaactgcttcaagtttgatcaagtttgtagattaagtttgattttgaccaaaatcaaaatgacttgtaatctgaaacagaaatagagcttaatgctcacttcccattttacattttttttagaaaataaacgaataaagggtttacacatcaaattataatgctataatataagaatggataataaggtctattgatagagttttttaattagttagaattgcatattcccgctctgtgttttaaagatatgttgtttacttttggacatgacgtttgatgtccatcctattaaaatttattacaaataaaaaatcatactaaagaaagtgttgtaataataataaaacaagtataagattagtattttcatagtttttaataaaagcagatagttaaacgttgatgtccaaaagttaatagcattatatatagaaaaacggagataatgttatttttggcgtagctattagctaatatgaacttctacatacgtccaaacatagcattaattattagttcggtcatacatcgaactcctgttcaattttattctcccgtatctagtttccatgttttttttctgagcttagacagttagacggcgggcaacatagctctaattaaaggatttgtttttagcacgatcacttacgatcatttgcacgtgcattgtttgttgcaaacgtcctatttcatgatttatttcccatatccttactcgagtttggcctaaactaaatcactaattgcaatttagctcactaagaaatatttgcacgacgttattcccaattttccaatgtttcgaagctttttcgcccgtcaccatcggaatttcgtggctggtagctttgttctggttggcactaccaccaagcagtgcattggctaccaagtgggtgcctctttgccaatccagtgtaagcacactaccaatgatcacatagtggttgacgctgcaacaaccattttcgtgcaaagcacatttacttcactagcttgctttcctgcctggttgagccaggcaatccatcttatccaaccttttggccttttgctttgctttgccgatgcactgcacagggccatctcaggcttcagtgctggttaaagcagccacacactgacatttctagtggtgcagctgagtcattatgagtcatgactgcagtaaaaaaaatgtgtaggcaacagctccagggtttcagctgaactgaagccaaactgccaaagatgtgaagctaaggtggtgaatcatgagagcttccaatccatgtttttccaaactttcctatgcaaccaacacaatcatatcatatgaacattgcacggtgggacagcaagctgggtacattccattgttccaaaggtgaattatttgaacaattccgtaacaactgtgttacctaaatacagaagcgccttcttcgacttagaaccagtcaggacttttatttgtaagaactgttcaatagaaacaagtgactgacagcatcagctcttggttattttgtccggttattcatgaaagattggttgggaatttgtgggatgatagcatgggtttttctttgttatggcctacaagggtccagggaatgtgccattctcacgttgttcgttccaacgctcaatctgcacaaaagataaaacacactgtgtcatcaaggagggtctctgaaaacagtgacgctttactagagcaatggtttatggctaaagcatcatagaagcaaataatattggaaacatagagttttaggcttatataaggtgacaattgaattactagagaggcatactgtagattataatggaaatctcagataaaaaaactgataggcatgtcagtgaagaaagtgtaacagaaacttcatacgccataggaatacctagatcatcataacaaagcaagccacagaagtattactgaaaaaatcgatataagaaatgcatacccattcacttgggcaaagtgatcgataatattttgcaaatttttcacactcaggagcaccctctccttttgcagctacacacctgttatatgagcatgctcaaagtaaatagtttaattaacaccaaggtttcaggtatgaggaatctgaaactgaaagatctcgatcatattcatacctatgatattcaatatagcgtgtgaagcaatgccttgtttgatttgttgttgggaaacgaaaatcagcgggagccgtctcaatctgtatattatatatggtcagtactcaatactgaacaacaaatgtgattgcttttccaatgataggtggtattgtattgtaccttaatttctggcttctcatcaattgtttcctcttcagcctcattgctttcctctgtagcagcattgctcccctcttcttctggcttctcagaggatgctgtcatctcgggagtttcacttttgtcctcaacaacagaagtggtgtcctgagctgctggtgtttcagcatctttctcaggaacaacttcagccacactgttatcagaagatttttcagaggatgaattttccacagggacctcgtggggtgggagtgtgtgttcctaaaaaataagatggagttcaatattgtttatcaaccatggaatatcaattacagaaggaacagcaacacacagaagatagttgggctcaagtgcgcgtctacattaatgcaagtgtcaaattgttgctacccacgggatactcagggtaacagtgttctaggcttaattttggtaatattttttcacagatatcatccaccgaaattttgaggaataattgtgcattgtccagggcctccatatcctttattacagtacttagattactttttcttttttgtgaggacagtgcctagattacaattggactatgcagcggactcatacaagattatgggttcagtctcaatatatcctaattgtaactcttccaactttgaggctacacacctaagtacgcaaatgctcaacaaaaacataaaaatagaaaatatgaattatcctttgaatgacattttgtactacctccgccccactggaaataaagtctttttggcacggaagtagtacatttagcatcatatcagctttatcataaactcctaatacatgcaaaagcatataattttataagctgaatgtttattacttaattcagacaaaataaagggggttaacttcaatcgcattgctcatgcataatttgattaaggcaatatcatacggctacacggtaagtttgtgagcacggaatgatggccaccacatctttgaagctctgtacgcgtctgtgcagcaccaaagttacacggtagacaactagtcaacgatttggacaaggcaatcgaaggggaaaaaaagagatttactgacggcgacagtagctaacgcctaacagcagtcgcaactgagccaattcagaagacggaacgagttaattcctccactcaacccaactaatgccctgtttagttacaggagtgaaaagttttgacatgtcacatcggatatacggacacacatttgaagtattaaacatagtctaataacaaaacaaattacagattccgcctgtaaactgcgagacgaatttattaagcctaactaattcgtcattagcaaatgtttactgtagcaatacatggtcagcaattaggcttaaaagattcgtctcacaatttacacgcaatttgtgtaattagtttttttttctatatttaatactctatgtatgtgtctaaacattcgatgtgacatggtgaaaagattttacgtgggaactaattaacagggactaaacatgcacacatgcatccaagagaaatcccaccgctccaaacctactcgcacgaagagaaatcccgccactccgaacgcgcgaaccaatccactacgcgatcacagattgctgggatctgagcgcgcgcgcgtgcgccgccgccgcaccagtccaccggagcaggccgccgcccgcgcacgcgcgcgtaaccacacctcgagaggcaaactagcaaggcaccaaaatctgggaagcgggaagcgatagggatacgggattcccatacctcggcggcgagcgtcggggccttgccttctcccgccgccatgggcgcctcgcgagagagcttccggaagcgagctgagccccgtggaaagagagagaagcgtacgcgtctccgaagtccgaggcttcgagctgtgtcgttcgagaaggtaaaagaagagcggcatttgtgggttttgggccgcgctacgacaaattagttcactggaggcccagagagttggctttgcacttggacttgaactgacgccttctctttcgcaacaagtctaatggaataagttcatctaaggtcccttaacttgtcaacgaatccgatttccatccttcaaccgcaaaaccagatacaacgggtccctcggcggttttgatgccggttttggctgacgtgacgcctacgtggctaatttgacttggtctcgatctgacgtggcactaatgtggtgcttacgtggcaatttgatccgaaaaaataataaacctcgtgagacccacttgtcagtttcacacagaaattaataaaaaatggtggggcccacgtgggccccatgtatcattcccacccctcttcttcctgtcctctccccccatctcccatctcttcaactctctctcacatctcttctcctgcgacggtggcacgggcgattcgggacggcagcgggtctagtagtcctccggtgccagcggctagtgcgcgccgccgtgcggggtggcgtcggcggacgggatgacgaggtactcgtagagaagcccggcgaggccggcaccgatgaaggggccgagccagtacacccagtggtgcctccagtgccagccgacgagcgctgtgccaaacaccctcgccaggttcatcccggtgccgtcgaacggccctccggcgagcatgtgtcaagagatgttgcattaacagatagcattgtcaaatacatgcttgataacacaggcaattagcagagaatgtactagtgttagactgataaatgaggatgtatacctcccggaagtcagagacgtcgtcgtcggggttcaggtacctcgtggaatttgtcctcgttgccggagtagtcgaccacggtgtcggaggcggagtcctgcgtggagacgaagctctgggcggcgaccatggcgatgtccccctcctcctcctcgccctccctggacagcggccgcggcgacgccttgacgggggcgagcaggtggtcatagtcgacattggacagcgcgcctcgctcgcctgcttcgccgcccacccgtgccgtccgccgcccggaaagaagagagaggggagaggggaaaggaagaataggagtgaggatgaagaagagagaagggagagggaggctgacatgtgggccccaccattttttattaatttctgtgtgaaactgacatgtgggtcccatgaggtttattatttttcagatgaattgccacgtaagcgccacgtcagtgccacgtcagattgagactaagtcaaattagccacgtaggcgctacgtcagccaaaaccgctgtcaaaaccgccgagggacctaatctgtacccgtttttatagttgaggattcgttgtatctggttttgtggttgaaggacgaaaatcggattcgttgacaagttaagggaccttagatgaacttattccaagtctgattgcttccgcccaaagtctctttttagcacttatacatagaaatctaaatcaatcatgaatgttctagttttcaccgttttcatattataagatgttttgatcttttttaagttaatttatttaattattttgcgaacacgtaaaaggattacacgtcaatatattaacaggaaaagagtttttgttacacaaagcaatcagccagactggcttatgtctaaaggggggacttgaagctatgaactactacgacggttaaaaacgcaactccaaacagcgggagggggcagagccacgctacactcccaagaaatcccaaaaaaagtaacaccggctaaagaccacagctggccctccgagcggatggactctagaaccactgcaaccgaagcgagcgcagagtcgaaaaccctggagtttcgttccttaatttatttaattatgataaatttatagataaacgtagtaattttgaatttaatgaaaataatttagtgtgatagatgtgtcgctatggtatatctgcaccagggtttttgcttctatagaagaaaaatcagcagggctgaattattttcgtatacggtctaagtgaaaaaaaaatcagaattatttaatcaaggacatacaccgtcgctaactcgctgtcaaccgcattttttatgcagaacagagaacagacaaagccttcagaaagacacgacggacagtttgagttaacagcgaggctcaactgtttcccagggtatcagcggttaatcggttattagcgacaggacgacgatgccgcgatcactcgccgttgtcgatcaccttggcgccgtccatccagatgatgcagcggatgctcttcccctgcgtgagcagctcgaacgccctgttgatctcctcgaaccccatctcgtgcgtgatgaactcctccagctccagctcctgcagatgcaagcatacacacaccggttaattaatcagacacaaaagatatgtagtattttcgttttaaaatatactccctccgttgtaggttataaatcgttttgactttactcaaaatcaaactactttaaatttaatcaaatttatagaaaaaaacatttttaatccaaggcaaacgtattataaaaatatattaaagtattgatttaataaaactaatctggtgttgtaaatattactatatttatctacaaactttatcagacttaaaatagtttgattttgaaccatagtaaacttataatttaaaattagggagtatattttagcatgaaaggagtaatatgaaccaaacaaattaattaaaatcccgttagatcgatcgatgtggatcaccttgtccaggtacttctgagccagcatcgggatgtcgttcttgggcttgatgccgccgaagagcgacccgatgaccgatcttccccggaggatctcgtgcgacgggatgctgatcggcgccttgttgccggagacgccgagcaggatcgtcttcccccacccctggaataacgtgaaattccgatcagcttgctgctgctcttagggcctgtttggggaggtttaaactctgagaagcagttatttggtagacagtttctgagaatctgaaaaagttttgaaaaagttttgaaacccagtttctccagcttctaacttattagttcattttttaaaatctgtaactacagattctcagaaactgtggactgtttgtggcagtttctagcagaagcagtttatgagaaaaactgcagctgacacaaagctccccaaacagagccttggtatctagtctctactgcacaagcagagcaagtagctcgtacatttcgagtgctttggaaggcttccgccatgaccgaagtcgagccgatgcactcgaagcagtagtcggcgccgccgcccccggtcatctccttgatgacctcgctcacggtcttcccgccggtatcgttcgggttgatgaagtcggtcatgcccagcctcttacctgcaacgcaatgagacgagttagccagataggagaatgattctaaactctcttagggaatattcgttcattatttgtatataccacattcaatgattataaaaaaattcagcaagattaatgcacgatacattacttcgcagacatgcacaatttgctcttttgttgtaattcatagaagtggaattttaactcacatatttatgtagtgatatattatatattaataaattatttttataactatttgaatgacatgctagaaaaaaatatcatctcgaaaatttaaaatcatttcccgacgtacttaaccacccaaaccaaggtaccgtttcatttgtgtgatttaaatattaaacagttcaaattttcgtatgaattaggcaacataaattcttcgcattccagacgggactgaattcaaacaccgcttcgagcttaattatcacgaacataccaacgtcgaatttgtccgggttcaggtccaccccaataatcctcttagccccacgcatcctcgccccttgagcaacctgcagcatgcagtagccagcacacagtcgtacattaggtcattagctcgatgagacgtcgacattgcattaaaattagatcagcacagagacgatcgatctactatgaccgtatttagttcactccaactgccctcaacttttaacttttcattacatcgtatttcaacttttcatcatatcacattacatccaaaacgttgctacacatataaacttttaactttttttaaaaacttttaattttttttagaactaaaacacaggctatgcatcagctgcagttgggcaccggcaactctggtccaagccaaacacgaacactaacttctcagtttggtggtctatatcagagttaagcactgtcgttaattaccgctaacccaacggcacccaggccgaacacggcgacactcgagccgggctccactgctgccaccttccatgccgcaccaacacctgcacgcaccaatcaaagtcgcagtcagaaatcgatccgataacacacgactgcgtgtactgcgccaatgggagccatgcatccgctactgtagcggcagagaccacatgccaaacaactgcagttaaggctgagttcaagtaggagcacacatcttgctccgcgtcttctagagctagccaaacagttttagtttcacctaaaatagcagtgtagttggatagaacgttgttataaaataaattagtgaggtggagctgggtttaggtccacccctatagttcaatttttttgagagagctcaatccagctccactcccattttaagtggagctgaaactgtttggctgagcttcagctctagctccagaagagatggagatagagctggagctgtgctaaaccgatcctcactccagactcaactcacgtagctaaaattaggagttgaaactttgccaaacagaccctacgtatattggcttggccttatacacaacgaaaacaagttgttagtgtatgattaaattgagaattaactattctaaatttgaaaattatttttgttttttaaaacttctgtagagaaaatatttcataaaatatatcatttagcagtttggaaagtcctctcgaaataagaaagttgttgttttgaaccgatgaatagaactcaactataaaatacttgaggcagaaaccactttaaagtttgtgtttttttcttcttctgtttttaccggtggaaatgccacaactgaggaggcatgccatcgccggtgggaatccaacatcgagcttgacaatgtgggtgatgtcaacgacggtgtactcggcgaagctggagacggagaggaagtggcggatgggctcgccggtggagacggaggagaagcgcgtcgtgcggtcgcgaggcatgaggccggcgacgttgggcagtttggagcagaggttgctgcggtcggagaggcagtcagggcactcactgcactgcgcggcgaacaccggcaccaccatgtcacccaccgccacctcctgcacgtgctcccccacgctctccaccacactggagaaaataaatgtatgataaaattatggcacacggttgagctacagctaacaattaacaagtattagaaaaaaaacacgaataatggacggttttttatatagaaaatatctctatttgtaattatttgaaagtcaaaggtagtaaatagagtatgatgaaaaaataatataaaatcagcttatataagtttcaaaactcaagttgtatttgattgtgaccgataaacca

SEQ ID NO: 79030 - DNA, 607 bp, Oryza sativa
agtaccacattacagctgaatctgtcatgtcgtacattctgcttcaaaattgtagtaatatttctatcccagttatggggaatccccattggggatagttcctccctcttggaataattccaaaggaaatgtgcaaaacaatcttatttacagacattcaccttcatgtctttttgtcatcactcgtcaccactcttttatgggcatacccaaatgatatgggtgttctttttcctcaggttaaacttttgaataagcttgctgcagctagaatattgaatccaaacgttggtagtaaagttttgactgatttggtcgagggccttgaggaggcttctgtgacagtggagataagattgaagattgatcagaatcatgcagatttgaaaggggggtatgtccctttccaagagaagctatattaccagttatctaacactacacaattatcattgaaacaatgtcatttttgccatttctagttgagaaaattacatgaatgaatcaatttgattttttttttgtttaacatttgttgttccctaccaccttattctgcacaaatattattattttgatttcgatacacgaaatcaatgactgaatg

SEQ ID NO: 79031 - DNA, 877 bp, Oryza sativa
atgagttttcgtgtccaaatttgatcgtctgtcttatttgaaatttttttataattagtatttttggtgttacgagatgataaaatatgaatagcactttgctcatgacttatgttttaaaatttttttaaaaaaatttaaataaaattatggcagcacttaaaatgagatagattgagtggagtttttggaagaggagagtcctgcatacagccatacacagtgttgctctgcatttataccagcactccagcagtgcacagttgccggtcaagagctgcaagagcagcagcttgacagtagtgtgacagcgtctcagccttcgtcacgcagcagcagcagcagcagcagcagcagaagaagagcatggaaatgggcttggttgcaaggacttgtttgatcgtctctctctctctctctctctctccctctcctagtccctacgcaggcgttggattcgatcccttctgccattttcgcgcatgcggcacatctccttctgcgtcatgatagaaagggccttcttttcacgtcactgaaaaaaggcgtgcatccaaatgaaggatggcactgccatgcatgcatgcccggtagaaaccaatgcagggccctcactcaactgtcaccttcctttccaacatgaagttttcacatggatcagtttaatttctgagataattaattcttcacttcaaaaggatgtgtgagattgtgagagaaaagaatggccctaattaattaaacagatatgaagggaatgaagagtttttttggcaagtggaagttggcactcatcgtacagtttggtggtaagcagaagtggacaatgtggcaactcaagacagctggaggtgacgaagtcgaacccccccccccc

SEQ ID NO: 79032 - DNA, 11920 bp, Oryza sativa
  unsure (1)..(11920): unsure at all n locations
atcgatgcttatcgtcgctaaattaaatgggagtacaggctaaacacatgagacatccctcgatttaaaaacagattacaaacacatggatgttcacttcacacacacgacaagcaggaggaggagcagctgctgaaacaaaacgaccagcggcgaacttaatttttttgaaaaagggagaatcataacacggtagaactcatcatcatggccaattgcttcatcaacgccttccagccattatcccccaacaatggctgctcgaactcctttgatatcacgcgttgctcctgaaggagccgagggctttgatggcgccggcccggaggatgtactggtggtagaacgccgcgatggcggcgccgacgaacgggccgacccagaagatccactgcaaccggagacggggaagacgatcagtcacaattcacacaacccaaaaaaaaaagaaaatcatgatcaggccatgcccaattgaggtaatttgtagtagtagaatgtatgtgtcttcttacatggttgcgccacgccttctcgttgttgaagatgacggccgctccgatgctcctggccgggttgatgccggtgccggtgatcgggatcgtcgccaggtggaccatgaacacggcgaagccgattggcagcggcgccaagacctggtgacatccacacacacatgaacaaaaaacaaaaaatcagaaattagcataggtttgcaagatgttaggcgagtaaccaaactatcagtagtactgttcagcaacaagtgtcgttttaacacagtgagtcaagtgaggcacaataattcacaaaactgtgctgctgccaaaccaaaccacaccctgcatgacatgtgtagggtgtcttttcagccacatgacccatgtatacgttttaatggtcatcaacatcagtggactattagggagcaagttagtggccaaaaagcccacaagccttcttgtcacgaaatgcccctttcaacaaggaactggaaacgaactagctagagcaccaccaaatggctgcttttagccttggcttagtgcgcatttcacctcctccctaaacaccaggtcacccagggcatattttgacaagatgtgtgcaaatctgcaaaagcagagaagcacagcacccccaacgcttcttcacgccttgtcacctccaccaaagggaagaaagaaagaaaggaagaccctcatgtcaagatgcccaccttcactcacacaacctcacatgttcaccaccatataaagtgacctatccatttccccttctccagaaaaaagaaaaaactactactagtactcctctacaatttcacctaataatatttggtcttgttttttagtgaggagctagcacaaaacaacatggcgtgaaaggacacgaaatagttttgggaaaaaacagaggggggtggtgaagaatttgtaccggcggtccagccaaaattcatcatggagatcacatgaaaacctagccgctgcctgcacggaccagctcacccccggtctggaccatacagtacaccggaccagctcagcctttttggctttgctagggccacatgtagtacgcgcgcgcccgcacagccatgctaccgtgatgggatggaacagtaatagcggcagacgtgacaaatgagctacagtaaataagttatagggtcccatcggttgccctattaagccgaagcaaaagccaaaaatttaaatttttaaatttaattttaaagttgattttaagatattttgaacttagttttttttacagtattagcttttaagtcagctagaaatacatatataaaaattttaactacaaattattttttattccttagtaaaacattttatcttattagggaatataagttttagttataaattattttttattcgctagaaaaacattttagcttattagaaaatatatgagcaaccgatgaggcttatagattatttgtaatcctctccgtccttccgtgtgtactaggaccatcttgaatcttctactaccaaaaaaaaaaaactactactactttcaattatgtggtgactatctatctactgctagtctgctactgtactggagtgatacggagtaagaacggtaagagcaaattcaacactacggtatgcttaataatgttcatgtagtactatctgaaggagatctgaaaattgacaatctgtaggcatgcgaatagcaataaaactgtgtaattttagaatttttttcttccgaaaagaattaagagtttttgaaggaaattattgcttctcttctgttcaatatgcgcttgcttttatcaaagaggatatataggatattcttccactgcttttcattcctttttgtacacatctgtcattcttccgatctaaacaaactaatattctcatactaacacatgcatgttagttgttagattaaagcatctaccgtcacttaagctccaattaagcaagcacaattttcaaagagaagaaaagaaaaagaaaaatttgggagagctagctccgatgcttcttaccgggacatgtgagtcgcgggcgttgcgcttggggtcggtggcggagaagacggtgtagacgagcacgaaggtgccgatgatctcggcggcgaggccggtgcccttggagtagccggcggcgagggtgttggcgccgccgccgtacctgttgaagtaggcgctctggaacgccttgacgaggccgacgccgcagatggcgccgaggcactgcgccacgatgtagaggatggcgcggaccagggacaccttgcgcgccaggaagagcccgaacgtcaccgccgggttgatgtgcccgccggagatgccggcggtgcagtagaccagnnnnnnnnnnnnnnnnnnnnacgcccacgcgatgccgagcacgcccacgccgccgcacgccgcgtcggcgccggaggccgacgcgtccgtctggtgcttgtacccgatcaccgtggccacggtgatgtacaggaacagcagcgtggcgatgaactcggcgatgacggcgcggtacagcgaccacgaccccagctccgccgcgtcgatcagcggcgccggcggcgggtccgtgtagtccttggccgcgaactcgccggcggcgccgccgctctccatcacctcgtccttccccatgcccgacctagcttagcttgctctcgccgccgcgggaagcttaacgggaggagtgacacgaccagctttgcaagcaatggtggagagcttagctgagcggagagcttgtgtgcgagagtgagaaggaggtggtatttatggagaagaaagagagttggtgagtgacaacgaggcaagctgagactctggcgtgtgggactaccctcctcaacgtatgagactctatttctgtacttttttattttgtcttaaaaaaatatactttttatttccttttttattttcttttgctgtccatggagcagaaaatttggctgtttttcttttatttaacttgttttgataagaatggatgggccttttggttttcttgctccaatgatgcctatgacgagctgggatgataagctactgcgtgttggggcctggggcttacgtgcttcaaactcagaagaatgtatccaagccaagaattcccggttttgttctaaaaacaaaaagaataattcccggttttgtttttgttgctgtgagtggaagattccggaggagagaagtgaggcagtgtccaaaagacacctttcaatcctaaccattcatttctcattttctatttaatcttaacccttcattcatttcctaatcccaatcacaccccttattttccattatccaaacacacactgaaaaactaaggggagacagagaggagatttgttgcgtgttgccgtgataagggataggatcaatgtacccgtgaccattgtgacaaaatgatcatgtgcttagtgtttttttaagacaatgatgtgtatattgcttgctataggtttatttaatacgcatttggcaactaattaagctgagttctttccttcattgaacccacctctacgtataatagttatgcatagcgcattgttatattacttattgaaatgcatggttgagaaaacagaagattaggaaaacatagaattttaataggaatatataagtgcaaacaaaatattgcaagacataaaaatgattgtttgaatagaagcaacaaaaaatacgcagtaaacagacttgaaaggaaaatttcttagatattagaactcttgttaacttcccttccaaatctacatgtattgagctatttctaaggaattttatatgatttagaaagcttcaatcctctatttcacaaaacgaaaaaaaactcctatcagattttaatactacaaattcctccacaaataatctaataaatgaaaaatgtttttacacatctgtttttggcagccaaaagatcatgttaaaataaattacttcctctatttttaaatataaggtgtatttttttcatcaggacaagctttaactacctattactttattgtaatatattacttttgtcccagtttagtactatccagggtttcacttatcgcatgataatcgcgcttatcgcgggggtacggtaggggaaaccggcgatatggtttggatgaattttgaccaaattcaaaattctggaaaaaaatcgaaaaaaactgaaaatattcatggatgtagttgttgatttgtaattgccaatggtgaagaatttttttgaaatagagtaagctaaattcaaatttgagtgcaaaaccaaaaatggtttacaaattgaaaaaggaagaggatattgggccttaagtatcctacatattcttccaattattctcagtttctagttttctacacatattcaaccgtattttttattttttaccctatttattttacatttacattatttcagctatacagcccgcgataaccgtgcgaatatcgcggttatcgcggtaaatcgtgcgattatcgcggtgaaaccgcgaaactgtcgagttttgaattcaaatttttggatgtgatttttgtgcgattttagacgattatcgcgctattatcacggttatcacgctaccgcggggtggcgataaccccggccctaacgataaggtaaaccctggtactatctccgttctaaaatatctatttttagtacagtaccttgttccaaaatgaaactatttctccgtctaccttcttctctcaaccaatcacaaccatttttcttcatctactttcttctttttaaccaatcacacactttctcctttcaaccaattacacactttcttcaatcattattacatactttctcaatacccatgccaacctcaaaagtgtttacattttgggataggcaaagtagttgttctaggagagaagcgataaaatatggtgttgtagaaataaccaatgtgtcccgacgttaatcattttaatgcttattaaaaattgtcacaaagttagtactacgtcagccattttgacatatctgctacaagtatggagaagaaaattaatgggagcactcttgctagtggctagctgttggttgccccacgcctaaacgatctcttttttagacaatgaccatatatctccaagcaacaactaaattgtgacgaagggaataatttttcgtggcacaaaattgatatgagatttattttggaaagtatttgtgacgattataatttgcatcacacaagcaaatatattagtgaagcaactattaatcaaagccttatcctaacaaaataaaatgcatctaatatcttgaaattgaggtagttgtagaaaacaacgaaaaatttcctaattaatatgaaaattaaattctaaaactgaaaattgactgtggcttataatcgagggaggggtcaaatagaacctgaattagttattaggataatgtgggcaggaattatatattcgcagttgtagctgttttgaaggcccggtgttcctcgcggggatttaattaggttatcacggacgggacgtacgtaaccaccataaccgcaggtcgctccctccgaaacggcgccaccgcacagagcagaagggaagcgaagggaaggaaggcaatctcctgaccacatggatgtgcgcgcatcgcattaatattccccacgcacgattaaattaattacacgggattcagtggcgcgccgagtcgatatacgagacgtaacgtactcgatcgtggctgggcatgggcatgggtccggtcgatcggtcgacgtccatccctaatcccttccgtttgggcaccgcacggccggttggcggttgcatgcgaccatgttccgaaccgacgacgccgatgcgacgcggcctcacgataaggcgatggcgtacgtcttcgcccgggggggaggggggggggtgccgttcggtcgtggtcgatcagtagtactaggtcacctgcaggccgttcctgcccctgcgctgcgctgcgcctgcggcggagagtagtactactcgcgtgtagcacgatggccagccagcctcgcgtcgcgcgtgggccgcgccgcgcgcgcggccgcagcagcgcaggttgcgcacttccgccgcagatggctgcggctggctgcgggtgggaagccagcctggtccacgcgtgtgcatgcatgcgtccatcctatgatgcgccctccgtccgccaatgcgttgtggtggtggagtggtcaggtcaccaacaccagggccgcggccaggtaagatgagatgagatgagacgagatgaggtggagagagatggtcgcatgtgatgtgtgtgtgtacgggctgggtggaggacaaatcagcagcagcggcatagtagtaggagtaggtgcgtttcgctcgctgtttttgggagcaagttgcgggcgggcgcggcgccgtccggacggagggggctggaccgccatatgatagatcggtccatccatctgcctgccaggggatcgccgtaaatcagatcacggttttggttggtgcgtacgtgagtggtgacacgctggcatccacacggcggagagatccgtaatccccatctgcaaacgatcgatagaattttgcatgattcgtttagtactggttgaattgttttgtgcgtgtataaatattgtggtaatttttttatgtgaatttggtgcgctctaaaggagacatgagggagccaacaaatgatgtggatattttcatcaggatctgtttattatatttttttatgaaactgtttattatattttgaaatgtgtatagttttacaataatttagccgttgcacacgcagaataggcactttttggtgcgaagtcggttaacgtagcagctgcggctaccacgtaccacatcgtttgatatatagcacaatctacaggtaagtatgcctggatgtggcctttaatggtttgtcttttcctctggattcgccgattagccgatctgtcggggcgttccttgttctctttacccctttccttccttagccggcgtgtaaagtgcaatgtattcctatatccacttcaccttcccctacattttttttctctttcctgagaggattaactttttccttgttcagttggtgtgtttcaatctgtgtgcacgctcccgctaacaaacatagtactagaaacaactaaacaaaccgttaattaagtataagagcatatacttgtcccgtttgtcttggagtgctccggtgtggacttgcaggccggctagcagctagatcgccccgagtgcagcgtgacagcagcaaaaggatcgaagcagttgcagccagttggtgcaatgcaatgcaagccaaaaaaggggattaccgccatcatggcggttagctacatatcatctctacccgcgcacactaccgttgctggatggatcggagtagtcctagtcctagctagctgccgccgctgggaatccaatgatttggtccctggcccgtcctcgctgtcctgtccatacgtgcggccgaatcagctgcccgcgccccgctcccggcacgttgcgtcgcgtcgccttcagcgtgcggcgcgggcgacctccgtcgcgacgcacgcttttccctggcacacgcgccgcgcgggatcggcatcgcgctcggatgcggccagcgtccagcgagcgtgtaggccgcgatatgatcgagtggttcggcagtgtgggccgccacggcacggcgcgcgcatcacgcacggacgcgcctcgccccagcgcgcgaagcacaacggctagctgcgtgtcgcgcctcggctcgattgggtggtgtgccgcgcgcggtttcccccctttcaaacccccgtcgatcgagacgcagacgctcgcacgttgatctcgtgctactacatgttacagcagtcatcagctgcttgtatagtgctactagctgcttcgcggcgtcgcgcgactacgcgcgtacagtaccagcctaccaggacgcgactggcttgtgcgggtgcacgcgacgcctagcaaattacgccaccgaccggtcacgcgcggcctagatgctcagcgtgattgctagcaggggagtcgtacttctcttgtccacggcttcttttcgcctttgctgtttctggcgatgcgggcgtccacctgtccatcggaatcccgacatgccagattcccaatatctccggccaccgtgacatcgtccccgatcacacagataatcccctgctttggaatcgtcgatacttgataggactactgtgactgtaagagtgtgtgccctaaacaaaaataggttctatttgcggtaataattgaggctacctgttacacgtggagcaagctagttccatgcattccaaatcaagccatagtcaatgtgcagtcttcgagcttcattttaatttacgagcacgttgcgtcgtggggaatgatgagcccgtccatgcttcttggaagggctgcatctgcatctgcttcccgaccgagcaggatcagtgatgtttgaaaaggattactctactgtaattagcccaacgagcgatcatactatactcctatacagtactctactgtaaggcgtactagttaattaaccagtccttgcattaactacttggtccgaggcgcattaatcggcaggggtctgacagaaggaaattaaatgtgtaatcggcgggcgacatatccatatccaaggccacgctgtggcacgacggccattgctaattccggatagcaacggcggccacgcgtaacatccggaccctgtagtcgcacaccctgtagtcccacagccccagaacgcgaactcactgcctaggcctaggcatgcgagccagcaaagtgctttgtcactactactcctacagtgctatagtactcctatagtagtcctattatggtgggatagttctaatgtcctagtattatggtgggatcagcatatgggcatggcacggtgtgacatcgatctttgatttttcctgaccagatatcaacgatgataaaacacctaaaaacatttgtttacctgttccaactttttttttgactggaattacctgttccgatttgacaagtgctataaggatgtgttaatttgccttccctccacagacaaacgcaaattaacgcgtgattaattaagtattagctatgaaaaactttaaaaatgattaatatgactttaaaaatgacttttctatttaaaaatttttgcaaaaaaaaaacactctataaaaaacgcaccgtctaataatttgataagcgtgcgcacgaaaaataaggaatatgagttgggaacttaggataaagaacatagccgaaggctcgcatcgtttggcttatttgtaaaataagacaaacggcatatttgtaaacaaaaaataatttgtggataaaacctttatatacgggttcttagcgatctaaaagcaaagctaaaaaataaacttcgacgaaaaaccccaaatcagcttcaaatttaaggttgaaaatttaagagtgaagtacatggacggtccctaaacttgtgccggtgtgtcatctaggtccttaaactcctaaaatgcatttttagatccctgaacttgccatgtgtgttatataggtccaaacggattttaacccactcgatgcgctgacgtgacaatgccacggtgacgcctacatgtcagtggaatccacatgtcaagcatatataaaaaataaaattaaaaaccatattttctcctcttaggtagacagaaaaaaagataaaaattctaaggtagagaggagaaaatatgtttttctacttatatttttttatatgtgactgacacgtgggtccaactaacatgtatgaactatcgtggcatgtcacatcagcgcatggaaggggttggagctcgtttggacctatatgacaccccaaaacaagtttaaggacccaaaaatgcattttgagagtttagggacctagatgacacacctgcacaagtttagggaccactcgtgcacttcactcaaaatttaaattttggctaataagtataagcataagcataaacataaacgaaaagatgaggccgtaagttattttaaaactccactcatgatttgagcattgcaattgtaaaaggccgctatcgaagtaatcatattttgaaatggtatgatatcaagtggatactagatactccctccatcccaaaataagacaacctcgtactaggatagggagttgttgacgaaaaatccacacttggctgatggtgctagaactgtgttggcccaaactaagtcgacgaacacaacggcctgggagatctgcttagcttcagtgcaggttcaaatgttgatgagatgcgggcgtgccagtcagtttgatcctacaactaacaagatatacaaaaaaacagatcaatgagccgatcggctgacaagtcgatggagtaattccagctgatgctgataccagccgatagcaataggattttgagctatcgtctatatggttgatgtacaatctaacacttgatataaataaagacaacaggcttatgataatataacaaaacaacaatataatctgtaaaatcaaaatgtttttgattcttattccgtgatgaacaattggcatctaatattattagttttgatatttggagattattggtgaagtggttttgaagatgattgacttgcaggtgatgaacagggtccgctgattgaatgggtccagtcaaaccggcgtgtaccatgtggtcagaccggccagcccgcagtcaatctagctgactctgtgtctatttctgttttgggttgatttgttgggtatctatggataattcgtgtttatgacttctagatagatactatgcgtatgtaatacttttgtttgctaacaatgattcaagttggtgagaacttgtgttcggatatggttttttggttgatgcatgtgtaggtggtcttgatgcctcgagagagtgtcgccggtgatggatcgggagtcaacttgggagaagataacgcccgaacgatcaggatatcatgcgggatgcttaggctaaagatcaatgcatgtggttggtgaagattccatatggtatacgatggatatattgtgtgcgtatgggatatggagtcgaatttggaaggagtccaaatttagtacaattggagtttattaagtttgtttcttgtacagaaatgtttcttaggggattagtacttcttgtatgagttgaattcatggctttaggctacctacttcgagtacaaatagagagggagggtgtggcctcccagtattgcttcagagagtagagttgagagataagttagggtttcgagtttagtcaagattttcgtgagtagtgctgttgttgcagtttataaacacagagagaagtaatatagttgcaatctactttgagagat

SEQ ID NO: 79033 - DNA, 5410 bp, Oryza sativa
acacatatacactcctatcttaaaaaaaaccttcaaaaacaagagacaagagagaaacttgctagaaggaaagagataaggaataaaccggtaaaataacccataaagtaattttctctaaatcatatagttgggatgagtaactttatgtgtaacacattgcggataaatggactcagacagcgattgagatctgcaccacaactcatcccaactcttagaactcctcaataggtgattccagaagtctgatcatagctgctagtacgagcctaaatcaaactctctttttttacggttttaaaaaaaaacttttttatatcaatttgtggatactccatagtcagacgatttctccatcaagcgttgctgattagtagttactcactccattctaaactgatctacatataatttttttaattattcctaaataatctacatatttgtgttcatttattaagtctattcgttatttgtgcattggagtaaatggacattgatacatgcatacatgcacacaagtatttataacccacatgtaatatcttgatttgctattggctagaaaatagtgggaatcgtgcatgcattgagtttgatgctagagtaaatatagtatgagagagttattagcttttcttggtcttggtgtacctatgaaatatgtaaatcaatttggaatggatgtagtatactccctccgtactcgtaaaggaagtcgtttagaatagcgacacggtctccaaaacacaactttgacttcttgtttctataaaaatatttattaaaaaatgatatatgtatacttttatgaaagtatttttaagacaaatctattcatataatttttatagagtaaattgcatcaatggtacacgaacttgtcaggtgggtgcaatctagtatataaacttgtaaaacgctcattttgatgcatgaacttgtttgatgcgtgtgaacaaggtcaaaatcgcacggcaaggttaatcttactaattttgttattgatttaaactctatgtaaacatgtgtctaagaaagataaacatataataaggcgtaatgatcgcataacaaaaataatgcaagtagtaatgcaaggataaacacaaagaaagataaagtgaaaactaagtttgcaaatataactttttctactatgtgcacggacgttatctattaatttataatttataatgttcaacatagaaaattcagtctagtcatgtcattttagccttagcttgcacgtaccaaataagttcatgtaccaaaacaagcattttacaagttcatgtattagattgcacccacctgacaagttcgtgtaccgctgatgcattttactctataatattttcaaactcaacaacttgagagttattcatgatttagggcctgttcactttgatgctaaaaaaaccttaccaaattttggcattgccaaaattttagtatagttgccaaaattttgtcaacttgctaaaattttggcaagatttcttatatagttaccaaaaattggcagcaaactaaatgtagccacttttttgcaacttttactaaaatttggtaaggttgaaaatggcatcaaagtgaacatgcccttatattcccaaggtttgacttaaacattgtcctaaacgaatttctttacgagtacgaagggagtatataattgtgatactcctatctaatatctacgctcacctagccacctcaacatgcagctgtgtccgttaattgattgctgcattgataggatgttagaggatcaaacttagtggtttgtcacactaagggcacccgcaatagttatctataggctctctacaagagatccatatcagcatatttttctacttggaagagattaaatgaagagagagagcaaagctatctactaacctggagatagtctatagagaaaaacaaggcaatgcattagagagctatagatacccatgtagacgtactattgaagtggtttactattaatctagtctattactgagatgtacatattttataaatagcacattactttactattgcaggtgctctaataactatcacatggttttcggacggcgggctgggcatcgacatccacacattttatctcagctttacgcgcaggagccggaaatcgtcaatcacccgttgctggattgtcttttcgttgttcggggcttagtttttcgcctcactgtaaaatcctctgtgatcgctacgacaagtcatcgttatgtttaatgcttttctaatatattgacctgcaaaacttttacgcctcggaaaaaaattatactgtctttcctggtcaggaaggacgtactcctaaattaaattactatagagacctgactacgattaggtaaaggctaattagatgattagttcacccaaaacttggcaggcaaaagatagagaataaaatgcttagtacggtcaccatttttctaagccaccttatctacgccaatgcgacgactatccctaatgtcagctggaatatctcataaggacacgccaggtagaggttgttgacaatgattattgcaacacaagctttggatgcaaccttcccctacgtccatggattaattcacgattcatatcttcttttgaatggtttattcctgaaatttttcacggtcctaccatgttcaaaaacaatgtcattccttagctgttgatgctgtgtgttcattaccacgctactgatctgaggctcaaagtcatcttaacaccgacgcaggatcaaactcatcaggaagagcacaaaacagtacaaaaggcgaataatactagtacatacgtgcagtggatcggatcagagagtatgttcagaatcagaagcgtggaatgtctctatgtttataagagctatatagtttaatttgtttgattacgtacccgactgcttcatggccaaagatagacggatgattgccttcctacaaatgagaagagagctatgagcctatgagtataacctcatcatagagaagcaaaatagttcttggttgctctcaattctagacggatcacatctgaatttaaatacgcaataacctgaatttaagggagaaagaactgaagaattcatggttaccatacgccagaaggtgatgtccgtgtggcagatggatgtgcagaggatcttgatccggacctcgtgcgcccgcggcggcgccacctccacctcctccatctccagcggctgcccggccaccctgctcaccgccgctgcacgccgccgtcgacggcacagaacgtctcgtcagagaatcagccaacgacgccattgcaaaactcgatctcagatgctagctcacctctgcacctgatggactttgcagcagcagtgttcatctgctccatttccaggaagctagcctctcccctctatccttgttggtgtttggctgctactccaacttcgtggttgtcttatttaaagatcgcgttggaagctggaaaacgaaaggcaggcagcttcagctgtatatcacgctatgatatactcgtatatcttctgaaagcgagtggtcgtgaaaggggagcaggtgaaaggggatcaggttttatcgtcgtcgttttttggactttgttgtgtgttgggtacgtacggtgatcggctacgtgcctccctgttcgtcaccgctcatgtacatatgcactcatgtgactcatcgtgttcacgcattacatcatccaaacgcatggcccgtctggtactacagaaattaactgggctggaggctagccatcagggagtggaatccaagaaatgtttccttcagattttgtgaacaagaacatttggtaatgttgatgttgagggaaggttgtgacttgtgagggtggcgaagtgggagttgtggcgtcagccaattaggccattcccaacccaatgactataatagtgtctatagtattaaataagctgtcacctagaatgaaaaatgatgtggcaagtgaataaatgaggaaagagaaggagaccatgtcttgcatgagacatggtttctacacaatatccaagacatcgtgtgaaataagtagcattaaatttaagtatagaatattgatgtttgtataggaatagtagtgtctagtactagttttttttagtaatgtggagtttatagaaactatgtgtatattttggggaatggccttagacaaggcttagcagcgataaggcatgatgtgtcgactgatcgtcacctgtagcagtcttgaggtatcttctcttgtagtgtttttttatcatatagtaggagtagtagcgtgcctttcttctggtgttcaggtgttggcgtcttcaggccggccgtccatcagtcgttgtcaccttgtcttgtcttttgtcttccccttgaggttcactctatctgttcactccttgaaatgattggatgtgtctttctaaacaaatcatcataagttgagtacatgagttacaattaggcccattaagcttggtgaaaaattttcaccgtaggaataaattcacgggaggtccttaacttaacagcgagattttttaaggtatgttaaccacaaaccagaaatgtgtacccctaaactcacacaaactaagcacacaaggttctatagcagtatagatggacggtttcgctaacgtggcatcctaatcagcaaaacaaaaaattaaaaaactgcgggacccacatgtaagtgagaaaaaaagggacccacatctcctcattcttctcttttcttcgttcttctctcatggtcccgacgaaatgaggcacgccgccgccatctcccgcggtcgcggcggcggacggcgggagcatgcgcgcgggcgacgacgtgggcacaggtacggccaccgccgcggcagcggactggagcgagcgggcgatgacgttggagtcacgcggagaacagcggagaaggcgagtgaggcgggcggcgaccttgctcccgttcgcgtgaggcgtcggcgtcaccttcatcctccgcagcgatttccccgacgagctagcggaagaaccgggtcggcgggcaggcggcgtcgaggctaagcgtcaagcatggctccgatggagcggcacgtctcggtgggcgggtggagcaggaggggcggagcggcggctggcaaaggaggagccaatcggccacaccgcagtcatgctcttccacgcgcccgccgctgtccatcgtcgcttcgcccgccgccccccatcatcgctctgccggcatcccggcgccgctccgcccgccgtgctcgcccaccgccgctccgctgccgcacgggcctctgccgctcccgagggcggaggcagctggatccgtgcgccggcggaggcagtcgcccacgagctcgtccaccgcgagggtccgtggaggcgccgttcttcattgc

SEQ ID NO: 79034 - DNA, 1168 bp, Oryza sativa
gtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtactatataaaagttgtagctctcaatgatatccacaactttataactaacaacatttctattagagatcgtttacatccctgaagatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaataaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgtgttgagtaggtgagttggtaagggagctctatatggaggttgaggtcttgggttcgaatctcacttgtagcattcaagttatattacgtgaaaaattgtgaatttgtaggtagtgatgtgtaaccatgtataggatggctagtaaaattcaaaatatttttttgaggttttttgttgcatttaaaattcaaaaattgtatttctttttgtcatcagagacgggtcgtaagttacaacccgtcagagacgagtccgcagtgaggctcaggcagtgacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgtcagagatgacctggtccggcgtagtgatcgttctaagcacgactagggctgatgtagcaaaaagtatgaaaagggctgcaggaa

SEQ ID NO: 79035 - DNA, 9350 bp, Oryza sativa
  unsure (1)..(9350): unsure at all n locations
tcctgcaccccccacccaattaatcctcgaataaaccatgataatatatatgcaataaaaaaagaaaaatacctcagttttactttacacttacttttcgttgacatgtattctaaagaaaataagtctacctttttcaagtgatgaagaagattataaataattgcttatagatattactttaatatgatataatataaaactaatatgttagaaaattataaaagaaattaatgtagacgaaaacaatttatggagaaatcgtggtagatattcacggttaatattttgctcttataaatgtctcaaacttagcgtatgacgtatgcccgcgcattcgcgcgggctaccttcctagttttataaatagcctaaaaatatcctaagtttggaccccttgacacggagttatgggtgattaggttccacactttctacattttttgatgcaccgatacaatagttttcagctgttctggtatcggatatatgtatccgatacagtgataagccactactgtataaaagctcataggtaccggttccaaaggggtagccggtgctggcaccaattattcaataccaatgactttgggtctatgtgacactataggtgtcggttctaaattagaaccggcacctttaggggtgcacttattttttaaaatttgcaggtgctaaaaaaattgaaaaaaatatttggtatttccattaggcacctatacgatcactcttcttccaaccagtcacatggatgtttcaacaaatctatactttctgtatagttgttacccactaaagttaaagctcaacatgtaagcatgccacatcatcacccactagcaattactattctagcccatttaaaatcccatgcaagcatgccacatcttcactcactagcaattattattctagtctattttaaatcccaagcaagcatgacatatcatctacaatattctattatagagttcaacaagtatgtgtcaaatcatcttcctcacattattttcttaacatttcaactttcatcatttcgacaatatttaatatatactcatccgtgaatcccgcaacagagcgcggggtatcacctagtattcatatatatgtgtgtcatgtaagattcaaactcaaaatctctctcttcaaccaaagcttcctcaccatcttacacacacgcacttgtcttgaaaacaaatgttattcttttgagactattgtcatccaaacttataattcataattaacaccttagatgagctcaaataaaaagtttgtcaactacataaatgtagatatcatctatctctacaacttttatatagattttgtctcctttagatattgtttagaaaatttaaatatccacttgagcaaatagatccaagaccttgtaacacatttttgatatccaaacaaccttaaatcgaaaagtcatcaactagaaaattataaatctcgtcgagttctacaaatttgatacaaagtttatctttgtccgacttcaaatgaaaaagttagataaaaaacacacgtatattgtatcatcataggcaccggttttaatggtaaaccgctacctatgggctcataagtgccggtttttattgaaaactgacacatgaacgatgcccgtatgagctggttcataataaaaaggtacctatgataccgcacttattggtgtcggtttattataagaactagcacctataccatgtccatgtatatcagtttgttataagaaccggcacctataactttagaggactattggtgccggtttttgaaataaaccggtaccgatgagtggttataggtaccggttctcaattttacattgaaaaaaatgtagaaaaagcttcatagccggttttaaataagccagcacctataagactaatctctatgtgatgttttatagtagtgagcgggatatgccagcgatacggtatttggtaagtattgttaattcgttagaaaaataaattaagaaaaaatagagatatgtcctcgatacataccggaggagagtatagatgaagctagataagagagtttgggcagtccaatgtgtaacacagataatcttaccttattccaatgtgagaatattagttaagggtagtaagtaaaactttagtaataaaaggtggtccaaactgtcaattcactcaatagtaaaagtatggtcgaatattcatttttcaaagtataccaaccgtttcatattataacacgctttaattttattctagtcaatttttttacgtttgaccaattctatagaaaaaattagtaatatctaccacatcaaatttgtttcactaaatctaacattgaataacattttgatcatatgttttttagtgttgaaaaatgttgttgtgtatttctataaatttgattaaacttaaaaattttgacttagaaaaaaaaaggaggaagtatataacaacatatttttcttcttaaagttctttaggagcatgtcacttgctaagagcctgtcacatggacaatttcgcccttaatttgtaggcacccttgatcacttcaactctaccacctcaatttattgacttttggttcacttagattcttagaaacatgaagacaacagagggacagagtttacacttgcattgcaaacactgaaacatacaccacactgcagggcttctcacttaaactgaagctgcttctactactgacgaacaggtgctctgttctctccattcaccttaaactctgaaggagaaagagcccaaacaatgccgacttgaccacggatatcaccagacgagctcaactacgcgttgctccggaaggagccgtagccccttgcactggcacggaggatgacctggtggtacagcgccgcgatcgccgcgccgatgaacggcccaacccagaagatccactgcgtcacacagatgaacaccaatgcaatgtcagttcatggccaattaaccagccaggaatgagaaacaaacaaagcaattcttgcacaatttggcagtaaggtagtatgtacctgatcactccaggccttgttgttgttgtagaccacggcgacgccgaggctcctggccgggttgatgccggtgccggtgatcgggatcgtcgccaggtgcaccatgaacaccgcgaacccgattggcagcggagccaacacctttgatttatcgaaattaaatagaagcaatgagctcgagttcttgcaatgtgcaaattgctgcagggtgcaaacacaaatcgatggaaagtttatgcacttacgggaacatgtgagtcgcgggcgttgcgcttgggatcggtggcggagaagacggtgtacacgagcacgaaggtgccgatgatctcggcggcgaggccggtgccggtggagtagccggcggcgagctcgttggcgccgccgccgtacctgtcgtagagcgagctctggaaccccttgacgagcgcgacgccgcagatggcgccgaggcactgcgccgccatgtacaggagggcgcgcaccagggacaccttccgcgccaggaagaggccgagtgtcaccgccgggttgatgtgcccgccggagacgccggcggtgcagtagacgagnnnnnnnnnnnnnnnnnnnnacgcccacgcgatgccgaggacgcccacaccgccgcacgccgcgtcggcgccgttcacggcggcgtccgtctggtgcttgtacccgatcaccgtggccaccgtgacgtagaggaagagcagcgtggcgacgaactcggcgatcagcgcgcggtacagcgaccacttgcccagctcgtcgacgtcgacgagcggcgccggcggcgggtcgatgtagtcccgggcgccgccggcctcgagagtggacacgtccacctctttgcccattgacctcgttgaggactcgattggtttgcaagaagtgatcacagaaggaggaggcaggagctaagctgcttgagagaggtttgcaagtgttgtggtttgctggttgtgttgggatgtatatttataggggtttcagtggtactgggatttgttctagggtttatgtttcattgattttaatcgaaatttgaattggttatataatatacccaattccctggcattctctggagcttccctggcattaacgcgtgttgtttgaatataacgatatagttgtttcgacgatatttattgaactaattttgaagattaggtcctgatattgatacaatcgcggatatccttgacatcagattataaagaaaactagtaaatcgttgaagattttgacttcctctatggtttgttcttaaacatcaataggaccaccatatctgttgatcattaccatgttttatgacctgcatatgttattatccaacatttcgtaggaatatcactgattgaataaactatatttcttaaataaataatatagtcaagagtataactaaaaatcagggctacactaattttttgggagtgttccaattaattattactttatttaagctgctagaaatattgaagatgtatatgtttttttttaaaataaagtgtactgacagaatgatggtcctcaaacttatatagatatgttatctaggttcttcaattctcaaaaatacaattttgggtccctggtcttatttgggtgccatacatatttaaacgggctctaacccactctgtaccacagtgatgcctatgtgttggtggcaccaatatgttagtcacatagaaaaaaaataaaaaaaacatattttctcttttctccaatctcttctttttctctatgattggcatgttgatcctgctgacacctaagcgtcaccataccatgtcatgttagcgcacagagcaagtgaaaacccatttaaatctatatgacactcacaacaagttttggtataaaaatacattttgaaggttaaggcatctagattagggatgaaaacagtacgtaatttttccggattccgggccagttttcgaaaacggaatcagtcggtcggaattttttcggaatttttcgaaaacggaaacgaattcggaaatattttgccggaaacggaatcgaatatgataatagcagtttccgtcggaactcggaatcggttggaaattttccgaaaactttctcggaatttccgaagttacagaaggcccatacaagtacaactacaagtccataatacctccccagcccaacccaactcagcatctaccctaagtcctaacctaattcagaatagagattagagaatagagaagagtgagagacagagagtcagagcgagccgggcggaggagcggcatacagatctcgcggccgtcctcgccccctcgcccctcgcggccctgcgcggccgcgcccctgcggtctcgcgccgccgcgccccggccgtcctcgccccccgcggccctgcgcggccgcgcccccaccgtccacgccccccatggccccgcgccccagccgcctctcgtagccgctgaagcctcatgctccactagtccactgggcaagtgggcagtgggcactggcagtggcaagtggcaactcttcctcaccgccatcgacgccgacgacacctcgcatcgcaacagccagcagtgagtgaatgttgaatgattgatttatgaatgattgatttatgtgtagtctctgtatatattgttgagcaatgagcatgactgcatgagtctatatatatatatgtgtgttttttgtgatatattgttgattgttgagacttgagaattagacttgacaaagtttgaagctcagtttgagggtttttttttattccgataaattttcgttaccgtatccgcgccgattcattttcgtttcgttttcggtttcgattatattcgattccgttttcgtatccggggtttccgattccgtttccgattccgaaaaaaaaatatgaaaacgaaaacgataaagatggtttccgtccgtttccgtaccgttttcatccctaatctagatggcatacttgtttagagatcgctcgcacacttcactaaatactcccacatgtatagtaattatttctttagactcctatcggtttgccatttactagttgtaagccatatggtttatgagcaacaaaaaatattttgtgggttaaatttttcaaaaaagtctgaattacacccctaacctgtagcgattgtacgaattactcctctaaaccacaaaagaaggcacccttcacccttgactattcatactagacgaattactcctctgcctcactctggatggttttggtcctacgtgatgcactcgtggcagtccagtcagcataaaaaaacgaagggacccacatatcagttctgctttttgggcccaccgctctttaaatttttttatactgattggattgctacgtgtaaattacgtaggaccaaaaccgctcaagagcgagataaggggtaatttgtccggtataaaaagttacaggtgaaggatgtctgttttttaggggtaattcgtaccgtccttatagtttaggggataattcggattttttttcctaaatctttatacacgttaataatttaaaatccaatactaaaagataaaaaaacttaaaataagatttaaaatttaacagtggcttataagctaatacttttctatggcagcttaagacggtgatatgatgattttggaactacggatgatagagcatctcaatgattacctgtaggccgggttggatcattggatggccgtccaacaccggcttgatcctcatgctgacgtcatctcccctatcctgctcacgggacccaccaccagaggtccagcgtatatatatcacttcggatcatcttgtggccaagatgcactagcagactagcttagcattccacaaattaattgttggcctaatttttttatcatttttttcttgagatggcataattaagttagttcactctcaataattaactaggagcccaagcttagccacaattaatcagtgtggcaactagttagtgttgtgctagtgttgtcatgcctagccggtggttgaacgccatccacaaaggaaaagaaagttgggcgccgaaatcaatctcttgtcaccgttttctgtcattgctgatattatatgtgcatggctaccaatttcttggcttgattgggtcattatttttttctggtctatctgaatgggtttttgtttgtggctatgtacatataagaggagaaaggcaagcatgcatgcgccgaccaaagaatgagagaatcttagggaaatttcacatgctagctagaagctataggttgacaaaaagttgttgtgatggggagttggttggatcaggggcggatccaggaacaaaaaattagaggggctcaattacacaatttcttcaacctccagccatttagggacttttagtttatcattcatggtgaaaaaattaaagggggtgctccgagggtattcatgggtcttgtgggtgtaggngnantnnagtccccctgcaccacgttggatccgcccctggttggatccaagtagtgattagatttatcagctagttcatggtctcttttcatccaaggtttttcttatggatcaggcatttataattccctttaaaaatgtccttttttacatgtctggaaaatgagagggaaattgtagtaaagtctgagaacaaatgggtctaattcaccctttttttttttcaaacaagtcctaagtgattgtttacattcatttcacattacgcctaatctgttcgggttggcagtgcatgtgaactacggccttttttttaatcgaaaacactttcccgttgctatatgaattcgttatcagaaaaagaaaattcatagaggaattgaactaattactataaaaagatgctataatatttgcattctaattaattaaaggaggcataaaatttctgtaaaaccaaagggatccaggtaatccactttctatgggcctgtttggtatagctccaactcctaaatttagctccaggagttgagtctagagtggagttgtggagctgtctaaacccagctccataactctagtatattttgtgagagagctccaccctactccactcccagttttgatggagctgaaactgtttggctgaactctagctccaggagaggtggagctgaagctgcagctgtgccaagcaggctctatatatcaaacatgtccaggcttgattacatgataattaatctgcttaattatctgcacttgttcttctgcaatgcagctatcagcaactaaatgtatgatcaggagcacgtacggccgcgacgcctagtcataggctttccaaaaggaacaagaaagcgaagtgagcatagctcaactggctaggtttcttgtggtggaaccagcccacctagatttaaattatagatttgacgcgggtgctcgtatttatggctaattatgctttcagtggtaggcgacgtacccgtcgacagcgaggcgcctgtggtgacttcgtaaatcttaagatttgccggcccagtcttccggaggtgcttacaggggtagggtgtgcgtgtgtgtgtttatagggggtgagtgtgcgcacgttgtgagcgcctgcgtttgtactgtgtttctaaaaaaaaaaaagaagaacaagaaaaaaaaactgtagctacgttttgagaggagcagttgcaaaacatggtgaggtgtgacgaacgtgatgaatgactcggattcttgtctgtttccccggtggtttctattgcttgtcccttcttctggattcagtcattactagggcaacgatctcaggtttcatatttgattttactttttttttcctttttaatatttgtatggtaactaaatcgtttgattttcatggtgttgatttactgtttttcttagggggcaattactagaatatcctatctatgcaagtcacgtaaaaataaggaataaattcatctgagatcccttaacttgtcaacgagtccgattttcgtccttcaaccagaaaaccagatacaacgggtccctcaattatcaaaactagtgcagatgaggtccctcgacggttttgagagtggttttggttgacgtggcgcctacgtggcaaatttgacttgtcttcatctgatgtggcattaacgtggcgcatatgtggcaatttgatccgaaaaaataataaacttcgtgggacccacatgttagtctcacacataaattaataaaaaatggtgggggcccacgtgggccccacatgtcattctcagcatctacctctcttcaactacagcccctcttcttcttcctctctctcacttctcccatccc

SEQ ID NO: 79036 - DNA, 34777 bp, Oryza sativa
ctctctttggtctcggttggtgttaccaaccgggactaaagatcccctctctttagtcccggttggtaacagatcgatctttagtcccgggtatttgaaccgggactaaagataacgatctttagttccagattagtagtcccggtttgaaaaccgggactacagggggttacgaaccgggactaaaaagcaattctccaccggtggccggacgctctcacggcaaggcaacacgtacgtacgcacgacgccacggcgtcgagagggcggggggggggggggggggaactcgtggattctccaccggtgacgccgacctttgctgctcgcgcaaacgcacgatggatcgatcgaaacacgactggttcaacgagaccatcacgtcaccgatcactaccagcagcaacggccggtttgccctttgcagacggagaaatttaaagaccatgtggcgattgagagcgagacaaatctacgccagtttctcgcctcctcaccccgtccctgtctctgcgtataatatcgtactagataattaaagagacaattttacgccatttttttttctttagtgtcctctctctatctatgcctttgtctctgcgtagataattaaagagggaaatgagaaaaatagagaaaggacgtgcacacagaggaggccttttgtttgatgctacctgaacgtgatgagaacgtccgtgggcctctggcttaacgtatgatagccggtgcagcaagctgaaacgaagggctggtttggtttgaggtctaaattagggttattaacatttgacaattttaatagtgtttagtgtctatttggtttaaagccaaattttgacatatcaaaaaaacagaccattttaatagtgaacttaggctattttggcttcaatccaaacacaattttgttttaccaaaattagtcatgataaacttaccagaatttagcattgataaaatttagtaatgcctatttagggcccctttgaatcgcagggtagaaaaaacggaggaataggaaaaacacagtattctgacaggaattgaagtgtaaaacagaggattgcaaaacacaggaaaaacacagaaatggtcgtttgattggtgcacaggaaaaacgcaggaatcggatgagagagatagactcaaaggaaattttccaagaggttggagctcttgctaaatttcctgtaaaatccacatgcaatgtgacatttcataggaatttcatagaatttggaaagcttcaattctttaaatcaaagggccaaatagaaaaatttcctatagaatttgaatcctataaaatatctacataaatcctttaatttaaaggggcccttagaccacaaaccaaaccaaaaggaagtaacgaacacgagcaaaggaacaaaacggtcgtggccgtgggggacggagatatggcgtcgacttgggacggagaaaaatctcaatgcaatgttgtcgtttatctggtggactgcagctgatctgcccaattggacgagacaccggggtatggctatcaaaatctccactgccagtgaagatacgagcaacgagagagtacttgtgatggctatcaaaatctctattgtagagaaccgtacatttatttttccatttttttctatttttgtcttgaaacttgtgcaaatttagcttaattgggagaggccacgtagtgatccgggagaagtgtggcgctgtgagctcgggttgccgtggcgggcggtagagcgccgcatgcgctgcggcggacaactaccggcacacgtggagggccacccgcctcctctcctcgagagtctcctccactctgccacttgacgtgggcccagcggcgccgcggtcaagttggtcaagttgtggcgccctatcgaccaacggctttgtttgcgcggcttctcttcgtctgataattgccacggcggatagccatttttgttcaccttaaatattgatgaatctggtcatagggtggagggcgatgagtaacagtgatagtctagcctccagtttttaatatagagttaattgaatccatatcgttgttgccatattataaaactgctacgactgttcgcgatatcgatttgagtgccagtataattttataaaattggatcatgccatcgtcgtgtctgttacgctctctttcttccttctcttcttttcttcttccctatcggtcggtcgctcttctcctttcccgagcatgaatgtgtggggacagtgataggaaaagtcagcattggcggatggcaagccatgactgtccacggacggtgagatgtcgaggcgataccggtgatgactagtgggcatgggtgtgtgtggtaagaagaaaagacggtgacaatgggtggtgagccatggttctcctcatgcggcgagagagcgagaggcgacgccgacaatggcgtgacatagctatgcgtgggcaacggcgagagggtgaggaggccattgcatctccttccctatcatcgacgagctttttcggctaatccaattcctcctcatcgatgatgcccatgaaatcgacaaggagcatcttgggctcaccgtgcgggatgggggagtctgctcggaagattggactcgccaatggcttcatgcccacgaggccgccgattcattccttaaccagatccgataaatgagaccgcggtggtcgtcgccgacagagaaaagcggtgggaggctcgtcatgcctgccgaacgaggggaggatggaagtgaagatggaaaacgtgacggcaatatcatagatctaattttatcaaatttcagtggcactcaactaatatcgcaaattatagtgtcatttttctaatatgacaaattctcaatttatggatataattaacccaaagaaaccctttaatatatgtcgcagtttaattttctctcaaattttaaccaacaattattcgattagctagttaaactaaattaaaaggaatactgagtactaaatttcttatcgaaagtaccttaaacatatctaatatgtttatcgatttacttaaatatatttagtgaagactaataatcaaatgaattaaaaaaaattaaatgcactaatattttttaaaaaattgaggtccgagtagtagcaaactggttcggttgagctcaatattgcaaaatgctccggcaggaggacctgggtactacaatcaaatcattgatgctcggatggtactgcattattatgaatggccataatatgcagtatgtccgtgattgattaggggtacataacagcattgaaaatgtagacctgcatggaatatttcaagcccaaaaatcaacgggcagacggttctagagtgaccaatcttttttttaaagaaaaacaaaaataaataaccgtacattcctgaaattaaaaaaaaaactgtcagttcaggtgttcgtggctacaaatacagtatcgttagcgttagctatgaagaatcggtcagaaaaaagggtttgctcaagataatgataataatttagcactaccctggctggctaagcaactaaactaactaatactcgtatttattttcagtcatgtcattagcccacgaagaaatggttgcttccgtgcaagcagcaaaccagagcaagaaacgctttgcaccagagagattaaaaaactatcagtatcacattattttactgacatttgctttccacttcaagacatctgctaattgtatattcgatggtttggtgcctgacagttagagtatcctaataataagccatggctgggtgatgccacgaaccattctgttctagatgcgactaccccatctactgggcaacgcaacaaagaggaaaaccttaacaaattttaatccagaagtttcggttcctagctgaatttttagagcaggtacaatagcagattataagccaattataaacacatttcgagaaaataaaaaagaaaagagatggacagcaggctacagatttatagccagctgtagcacggactttaagatgcatatgtatatgacagatgagaccagatattaattatgtagtatatgtttatatgtaactactgtatgaattgactattaaattgactatagatgatttggagtccgcagttagctttactactaaacttgctcttaatggaatgttccatcccaaagttcatcattctgtttggttagcattagagcaggtacaatagcagactattaaccagctataaacatattttaatgagataaaaagataagaaaaaagagcagcgggctataaatctgcagccggttgtagcacggactctaagatgcaatgtgtgtataatagataggactatatactaatagtatagtaaacaattattgtataaattagctattagattagctatagatgaattagagttagtagtgggctatactattaaacttgctcttagcatgcggttagagtgacagcaacatcggttcatcgatcaagagtagattatgagtggattataagttgtaatagcttactagtgaaaaatattttacgagtaaaacttttatatatacacatccataaatttttataatttttaaaataaatgcattaatgatacctaaaatccacttaaaattaagttttaaaatttaaactttgacgtcgattaatttgttatacgtcaatcaataagaccctttagctattgcacctaccgtatttttcctggatataaagtaagatcctgggatcaaagaaagcttcgcaatcacatgttgagaaaaggagtgggctttcagaagcaggagcagaaaatgatgtatgatagactagttcggtactgcagttaggtgcccataaagaagatcttccggtgattgcattgggaatgttcggttgcatttggagctagtatttggctatagtattatactagtattgaacttgctttaacagatttcttcagcttaataatttactgtttgaatttgttctacattttgagcagctttgatggtttctttgtgtagttttttcaagtataaaccaactcgatcaaagttaggaacagtacagatagaaggcaacaatgtcatatcagaggagagaatcattcctgtgttacgtggagtataaacaatctgcaatactctggtcattgctacatctgacaaaagtcgttgtgttaccacttaccaccatgtcgttcaagcagagctggagaatcttttcctcaattttctgttcggttttcagttccaccttgcctcttttggtcatggtagcgccacgtggacataccaaatccaccattttaatccagaagatatataaaatgtgattttcttaagaggaggtttggtgaaagataccagaagattttcatggcttcaaagctgcatgcaagtgagagaagctggcatagagagaaaggtgccctccgatgcgaccgatttttgttcagatcgacagcaacatcaaccactttttgttcagttaaatccattcttctggtcgtctgtttttcttgcagacaactttggcatctttgaaatgctgaagggctcgatggattggcatatctttgacggatcatgaactcgatgacggaaatggcagattctactggcgtatgttcgcggaataggacgagatgtcggctgttgatttacgcgcgcgtgtgaagttgttttctgcagttcagtgcccgtttgatcatttcccattggtcgagagactagtgccgtgtttagttgtgtttagttgtaaaaattttgaagtatacgaatacacatttgaagtattaaccgtagactaataacaaacaaattacatatttcgcctataaaatgcgagataaatctatcaagcttaattaatacatcattagcaaatgtttactgtagtaccacattgtcaaatcatgacgtaattaggctcaaaagatttgtcccgcaatttacatgtaaactgtgtaattggttttttttcgttcacatttaatgcttcatgcatatgtccaaacatttgatgtgacggaatttttagaagtttgaagggaacagcctaggagaaaatactgcagtggtgttgggtgattaggtcaaatgcttcggcagttctgaaatactaaggaattatagacaagacattttgcaaaagaaaaagcattaaaaataactaaagaaatggatcacgaggaattttagaaatcgccaatatatcacggttttttaccaacttgtaaaatgtattgggatctagtagtatgagagacataagaaacaaggcaaaactagaaccaagccacttggtaatgctaatgttcgtctctatctctctactccctccgtaaaaaaaaaactcaatcctagatttgaacacgtgtgtccaggttcagatctagaattaggtattttttgacagagggagtagaatttaacttgaaatgaaagttatatgattttttgaagagacaaatgtgtctattaatataacatactccctctataaaaaaaacttaaaaatcttattctaggttaaacttttcttttttgggattaagagagtattgacgtacctagcttataatattggtgattcatatgctggccctattcgaaggcacttgctgccttagccgcagcgacagttcaaaccagtcaaaacagttgtagccacaaccgttgtggtagctagtctagccaaacgtaaccactgtcatgatagcaatacttgttcagtacacttaaatagagtaacagaattgtatttgaattttgtcggggccgattatagttgactactagcacataagtaatcaattgttttggtaacttggtaggagtaggatctggtatagctgtttggattgatgataattttcattggtgtaagtacaagtagcactaagtgattacttcatgattagagatatctaccccctatattaaaaaaaagaaaaccaattctcactataaatcttaatatatacgtgttctgatttatctttttttagacggagtagtatatggggagcagtaatagcatgtaagtgcattcttactctctctatctttaaaaaatcaatattataagtctgaatatgcaatgcatctaaatttatttttctaagtaaggtttttatggccaaatttaccagcgaggcgaccacttcagagtgagagcgagcccaccagtccaccacgacggttggtacgcctacgtctctctctctctctccctcctccccacttccctcgactactccacctccttcgcctccgcccccatcatcaaaagcccccctctcctctcccctcctcctccccttccacaccgcaccactccacgccttcctcctcttctctcgtctagcccactcgctggtctctccaattcttggcttctttgctctgctggattagcagcagctgctctgcttcttgctctgcccttgtctttgggctttcagggcggtgtgctgaggccgagcggtttgggcggtctcaagaatcgcttgtgcgtgcgggggagttgtcgtgggaggtggggatggagaggtacgaggtgatcaagggacatagggtcggggaacttcggcgtggccaagcttgtccgggatgtgcggaccaaggagctgtttgccgtcaagttcatcgagagggggcagaaggtgaggcagagatcgcgttggtttaccctctccccccctttatctctgttgctgtgtgagtatcttgtttgcttgcataaacccagttcttgcaggcgggttctgatcagattcttgatttgtggaaatttttggatttttagtttagggtgcttgtgcacggaaagggtttatcctaatattttggaggaaatttccttaaaattgttgctgttgattttattgatttgactaattgctacttgatattgtgtatctggttgactggttctgcccccatacagtctgatcgatcgcttggaccatccattgtgctaccgttcctttgatctgcaatactccataaaaaatcggactttttttctatatatttttgagaacctccttaattcactccttaatatgtgatttcttggccttatatcacactagactgttcaatgcgggtgactctcatcttatcgctgtttccgattacaacaaagaactgaaatttgcaccagggtgctcttgatctggctctattgttagatgtttataagtaaactttgatctgctaaagcttctgtccctcatttgacatctgggttatgggccaattcaataaaacacatgttgtggccatgtgaatgctttgctctgcccaatttacaaggtcaccttttgggtcctgttaaagttcattgaacgctccatttcttgttgattcgtttaaggcgtagtagtagttaaatgaggtactttaattcgatttctacttagtatggacacaactaacatcgttaatcagtgccaccattatgttattatgttaggacttgggttcatcgatctgggtttatgttatgttactactcttgtgttctagaacacctcaattttcccagcgtattattttggacctaaccattttctgttcccacctctcgcctctttagtgtcttcattgttaacatttcaccgttcttttcaaactaggtttcttcaaccttttgggttctacagagttttcttatatggtgtctgattgtctttgatttgaatcagctcactttttttttgtttttctttcatagatcgacgagaatgtccaaagggagattatgaaccacaggtcactgaggcatccgaacattgttagattcaaggaggtaagtcgcatgaatgataaaaactttgaaattcgtttctgcataccttgtttttagtacgctaaattttctatatttttgttgctgaatgcatttaaagttagccaaaagatgcccatattcataatttctccttaggttctaaaacctgttaagaaaacaagcatttcatattttcactggaaaaagattggcaatattctggtacaattttcaatcttccaaaagattattgtaaaattgcataaataaattttcatacttgaaagattaccaagatgaaaatggtcttctgtaatgctcgactgtgaagtctgaactattttggtcagtaggaaagcgatatctgtgatctatccatcaattctaataggacaaatggaatatgtaaagaaaaaagtttatcctagttgcagagttcaaaggactcttcttgtattgactgtgactcatacctttatggtctaaacttctagtataactgccctcagagctttaggagcactattttgtttacttaagagaatatgctatatgtgggcgctgaacttatttggtagactttttgtgtagattctatatctaagcacattatgggtgtttccttttctcttcttctttccctacacaagactagaatgccacttctttaaaccgtttaggattaattctgttggatacttgcatgtttatcaacactcagttgctaatatagcttgtcctagtgccatgcccttgagcttgggtaagtactttagtggctgagacttgagggcatcatgaggccatgacttctgtgaaaaagctcataattgctcctaatcattcattaaatgactactggtactggaaatgaaagtgacccagcaggatattatagcctcttgttcaaatcttgaccgtgttaagccttgtttgcatttaacagaagccaaattatctgaaagttgcattattcaactatttgatggtagtttacattcattgttgcttttcatattgtcaaacatatatttagtagagactagctttaaggagttaggtggataattgcaggtatcttgttaatacctctgagcattagaaatggctgtcatattttctaagatttaaagctgttgtcataagattatatactcaaagagaacacttagtttttcaggttgtgctaactcccacacatttggccatagttatggaatatgctgctggaggtgagctattcgaaaggatttgcagtgctgggaggtttagcgaggatgaggtagagaatatttacaagtcatgatacttaaagattataagatgattcaattttgttgatggtttattcaacctatcgacaggcaaggttcttcttccagcagttgatttcaggagttagctactgtcattccatggtacacaataatctgaaatcaaattgttgttagcaactcaaatgctctatatcttacataatgatatattgccttattgtgtcagcaaatatgtcatagagatttgaaactagaaaatactctcttggatgggagcatagcacctcggctcaagatatgtgattttggttactcaaaggtagtcagggaagattatggcctttaaaaatcgctggcttggcaactgaactcttatacttactctcgaattttctttgcagtcctctttgttgcactctcaaccgaaatctactgtcggtactccagcttatatcgctcctgaggtccttgctagaaaagaatatgatggaaaggtagtttctgatttgctatttctcatttttaatgggcatactcctactatcaaagttccgaatctcaccatatacaatttaggttgctgacgtttggtcatgtggagtaactctatatgtgatgcttgttggtgcgtacccctttgaggaccctgacgaaccaagaaacttccgcaagacaattactgtgagttacccaacaaccatatatacctatgagatccctcattccatcttgttgacctcagctcatgctgcatcttgatgtgtgggaataaaagttataagatccttgcagcggatactaagcgtacaatacatggttcctgattatgttcgagtttcgatggaatgcagacatcttctgtcccggattttcgtggcaaacccagagcaagtaattcgtctctcaaaccaattgttcctctagaacaaaacattacattttgctctgtcctcaccagtcatttcttgcagcgaattaccattcctgagatcaagaaccacccatggttcctcaagaacctgccgatcgagatgactgacgagtaccagatgagcgtccagatgaacgacatcaacaccccgtcacagggcctggaggagatcatggccatcatacaggaggcgcggaagccgggtgatggctccaaattctccgggcagatcccgggcctagggagcatggagctcgacgacgttgacaccgacgacatcgacgtcgaggacagcggcgacttcgtgtgcgcattgtgacgaggccgtgaacttgctttctcttcttggagtgtgctgctccttttgttgtgctgctgttcatttctgagagctccattctgttgttgtgtcagtgtttgtaaacgaggtgctgtggataatctgaactcttttatatgttggtgttcttagctgaattctttgcgtcctgcctgcttccctttgagctatgtgcagtttcatcagtctcacaatgcattctcaatttctcatgttttgttatcctagctttagggccaatttagtaatctctatatgcgttgcagttgataacaaagttattcattttgttcattgtactgaactctttcccccgaaaagttatcatacaaggagatgcaaactgttgtgagaagatgaaaatattggtagcctaaaagatggatcttcttggtgaacagaaacacaatcttatttttttccttaaaaaagaaaaacttttaaatgaaattgtaatataattacatcacaactataccataactattataattataaaacttatgcataagtattaaaaaatatatacaactttttacccaagttataatagatattagttacattgtacactacaactaagttgcatgtgaatgtttttgactaaaaaaatgcgatagctttttagaaattccgtaaaaaaagttaaagaaatatactaaaatggattttcagtgtgtacgcagaaaattatccttatgaggccttcattgtgagcccacaatttccagatcacccaggcctcattttcatcataggccttcacacatggatgagcacattaaggcccattcaaaccatgcctcaagtgtgggcccaaacgagactgaaaccaagagataggcccattccaagtgagaaaagccagcccattttttccctccggcccagtaagtccaatccaacggtgaaggcgatcaacggacggctcagatcgagcctcgcacccgcggcccagaccccaaccccttctctcctctaaccctatataaactccacccatcaactcacgccgctctctcgctcaaaaaccctagccctcgcgccgccgccgccgccgctcccccgcgcactcgccgctcgccgcccgcgagctcgcgccgcttcgcaaccatgaaggtaagacgctcctcgtcgccgttgctggatcccccagatgagctagggattttatggtagggttagatttttttttcgtgggtggcttctgattcgtgtggtttccgccttcgttttcagttcaacatcgcgaacccgaccaccgggtgccagaagaagctcgagatcgatgacgaccagaagctgtgagtattctcgccgccgctcccccgtttgtttcgtttccccaatattagagagagtggtgttggtagtggcaagccgaatcagcgcgaacccttgtgttgatgtggtccgttgatttacataacaaatcgcatttctctttttgtggttggacttgtgttgatgtacttaggtctaatttttcttagccttgggggatttggatgccgtttaatgtttgtagtagacggataccattttttgtgattgggctctgtgcttatgtacgtaggtctaacatgtctcccctttggggatttggacgccatttgtggctgttctactgctaatgtttgtagtagactggattcattggattgcgtgcctctgcacagaccaactgtggaatggtgatcgttcctgtgtgaatcaggtgtacatggcttaagattgtgaggttgtttgacattttatcattatgtggacctctttgcttatatttgtgaggacatggagttatactataatatttgacttacaggttgcaagagtaactaacgtatatattgtgccacttttcacttagagcatggacatgcaaatctagatagcattttaagttaacatgtttcggtattcttattgattaaattgtggtgattggatagtttcatcagtacttgcaatcctttgcatgagtatagagaaatacaaagatccattctttacaaagccgtatgatttctagttggacttgtttttgtatcttacttcagtgcatgttgggggcacaattaaactgatttctgtgatatgtttttagtcaacttccgcaactaaaatgcggcagggagttagttttcatgacctgtaacaatgtgggtgcctttcaatgtctaccttgttagctgatgactgaacattagtttgagtttgttctgtaaaattggatatctgatgcctttgtatgtactgcaggcgtgcattttttgacaagaggatctctcaggaggtcagtggcgatgctctgggcgaggtaatatcgtgaggcctctgatgtttcctaattactgttacctagtcttaagatgttaacatatctctctcctttttctcaggaattcaagggctatgtcttcaagatcatggggggttgtgacaagcagggtttccctatgaagcagggagtgctcactgctggacgtgtccgccttcttcttcacaggggtaaaaaggctctatttctattattgactttcggatattcatgcccttgctctgaccatattatgttacttgtatggcaggcacaccttgcttccgtgggtatggcaggcgtgatggtgagcgcaggaggaagtctgtccgtggttgcatcgtcagccaggacctatctgttattaacttggtgattgtcaagaagggtgagaatgacctgcctggccttactgacactgagaagcccaggatgaggggacccaagagggcctccaagatcaggaagctcttcaacctttccaaggatgatgatgtccgcaaatatgtcaacacctaccgcaggacattcactaccaagaatggtgagctttcctgcaatgtttaataatctacctcatttctagtatgtcctgctcctgatctgcattgatcttagtactgttttaattttcttatggataaattcaccatattatattgtctgcatgtttgtcagttttcaagtcaaaatatatcttccaggtagctttctgcttacctacctaatggtgttgttgtgttgcaggcaagaaggtgagcaaggctcctaagatccagcgtcttgtgactcccctcaccctccagaggaagcgtgccagaatcgctgacaagaagaagaggatcgccaagaagaagtcggaggctgctgagtaccagaagcttcttgcccagaggctcaaggagcagagggaacgccggagcgagagcttggcaaagaggaggtccaagctttcttctgctgccaaggctgctgctaccaccgcctaagttggtttagagcttgagatgttttaaaatcgttcattcctgagttataatagcccaagaacctcttgcactatgttcgatcaatccaccccagctactttcagatttctcgagtaattggtgcaattttgcatgaacatgctgccttgtttggaattcttttttgagtaccggagaattaccatgttagtgtgttggtttatgttttgaaggtggccttgttattctgttgctgtgttgatgtttggacgcaattgctggattggtacttggtagcatgctagaggttttttactctgcttcatttgagttgctgggttgcagttgcaggcatcggtgtaaactcaactcgaagtcgtttgctgctgcctatagtccaggcggtgtaaattcaaccttattttttttgtaaaatgaaattttaatttcaggagagcaacagacagaccaaactcttaactgttatgacctgacaagtttaatttctaccaaaatttgtaccgtcgttgtcgaggaatttcttcttgccgttcgaattcgatttcttcggtattgggttggtccggtctcaatccgttccgattgtgtcagtcttgggccataaagcccatgtgttacaagcctaacagcccaattcgactggcccacgacttttgcaggcgggcaccaattccgggtgcactccgacgcggggcgcgtgatcaaatttcttttcacactttatatcctatcaaaatttaataattttcaaattttgttatattttggtattatataaattcagtagtgctaaactagtttggttcacgcagaaaaaaaacatttgaattcgaaaggatttgtttattatgggaaataatcatataagggaacatatgttatacatatatagaagcttttgcgtgtacacgccaactaagaaaatatggctggttctaaaacttctacacgttttaaaatccaataggaatgcaaagcatatgacatttcagctctacgtttatctctatctcgtattcacaatcatatgtttcaaaggtaaccttatcaaatcctttttggtggaaatttccgaaattacaaaatacgaacaagcccttcagtactagcgttggcgtactgcattttgcccatctcgcttggccaagaaagggggacaagggggaaacgcatgtcgcagcctggcacgttccaaacttccaatcgcagagaaaaaaaaaagagaagcagatagagaggcatcgatcgtatctacgagtacaaaagtaaccaagcaaaccatctagctttattttctcctgtccccaaggccaaacagcacagagctgaggcccccttaaaaattcatcagaacacatccatcaaaaaacttattacaacacggcgagtatatatgctaccatatcctcgacaactgcctatagtgccaagaacactcaacaaccaccatacaaacatttgacagaacacatgcagatatcaccgccggcgagttgaaactattctaccccctcctcccagtttcttttcccttcccccgtttcagcagtttagaaagccaatgggggcaatggcaggttgctgttgaccccggaccgcatcctcctccgcctcagtctctcggcgatgatgaaggcgagctccagggattgcgacgcgttcagccttgggtcacagtgggtgtggtagcggtcgctcaggtcatcgaaggtgacggtccttgatccaccgatgcattcagtcacgttctgcccagtcatttccaggtggatacctcctgggtggctaccttcttgatcatggacatcgaagaacgcacgtacttcagcctgtgaaacacagcaatgttcatgtttatttgaccaatagtccaaaatgacgctagtttaacaaaggttacagttccgtttcagcagtggtacacttttcttctcataccatagaattagaaacgcctaggatttttgctgatatagcatatgcccaaaagtgtcacattctcactgacataaacagatactctaatgcactagatgggaacttgggatacaaatggccaatgcactagacaggaactttatgcatatagcataccgagttatcactcaattttcagtactgttaaataactgtgcagtcgaagttggggaatgagggtaattccttatgtgagattgaccggattgttgcatcatactaggaaaggatactagcaaatatggaatgctgtagcagaaaaatactcaccagaatggaatcgaatggacgagtcttcagaccacatggagccttgatggtgtttccatgcatgggatcagtaatccatgtgacaatctgtccagagttgcggacagcacggataagatgaggcaatttcaccctcatgttctctgcccccattcttgtaattatggttatccttccaggcttgtttgatgggttcaaaatctcaatgagcttcaccaagtcacgggggttcattttgtcactcacctacattacacagggtcaatgtcagtttgaaatgtcaacatccacaaggcactgcaaacaacattaggatttcacataactttatgaaaataaactcaatgctgacctttatgccaagagggttggcaacaccacggagaaattcaacatgagctccatcgagctggcgagtgcgctcaccaacccatagcatgtgggctgagcagtcatagaagaggccactggtggaatcctcacgtgtaagagactgctcatatggtaagaggaggcactcatgggatgtccagaagtcagttgttgtcattatcggatggtcgactgttagccctgctgcagtcatgaagccaagtgcctcatccacccggtgtgccaattcacggtacctatacacaaaatagagacaatcattggataacctctcgattcagtcgttacaagcatattttattctgtaacgtaaacaattgcatatgtagcggcaaatcgataatataccaacagcacttatgcagtataccaatgagctgctcttatttgcaatttgcaaataccaccaacaaaatggcatttcaatgtcttattatgatggcaactttgtattttgtcggaacaccatcttttacagaaaaagtcaaaacaacattctaacaataaattctttataatctttattggacgcatgtctgaagaaaatataaatacgttaacactgcataagtcaacattataaatccaaagaaggttacagatgctaaattagagcacgaccgacgataaatttcatggacgggtagtttagttaattatgtattctgaaatgggtacgcctcagataattgcatgcctttttaaccaacaattccatggtattccataccatgaaaatagcaaaaacgggcagcttcctaacaattattcagaaagttggatgcaaaggacaatgatgtcccgttagcagtttcctcgaaaggaagggacagaaagtgaaagcttctaacaggacaactcaccaactactgattgatggaatcagaactaccacgtgatttttattaaacattgacgagctgcgaccacctaaaatgtttccatttacttattcaagctgcaaattagaatatcagaccattttcaagagcagatgactgggttcatactttcaagaacatgttcaccacccattacttacacggtcacacagattccaaaaggggtgaaaccgtgttatcaccagcaacctataagcagctctagccttatcatgataacgagatatgtggaagcaattcaacactgatatcttttaaatcgaaagcgactttaacaacttccgcaacaaaaagtgctaaaaaatcgtatgaaaaaaaaggggagagaaatgaatttctcacctgtctccttgttcgctgtgatccatgaaatcgaggttccactgcgtgacgcgctgcatggcggcgtaccctcccgtggcgaaggcgcggagcaggttgagcgttgccaccgactgcgcgtacgcgcggatcatccgctgcgggtccggcacgcggctcttctcgtcgaaggtgtcgccattgatgttgtctcccctgtaactcggcagcttaaccccgtccctctcctcgaacgaatcagacctcggcttggcgaactggccagccatcctcccgacctaaactcgcgcacaaaatttggagcagatcgggatcagatctcgcgaatcgcgtgaaggatgagctcgttttggggtttggattttgggtaccttgacgacgggcatctggccgccgaacatgaggacggcgcccatctggagcaggatgcggaaggtgtcacggatgttgttggcgttgaactccttgaagctctcggcgcagtcgccgccctggaggacgaaggcgcggcccatggcggcgtcggcgaggcgctcctcgaggtggcgcgcctccccggcgaacaccacgggcgggaacgtctcgatcgtcttgagcacggagtcgagctcctcctggctcgggtactcgggcagctgcagcgccttcttcgccttccagctatccaccgtccacttccccaaccccaccggcttcttctccggcgccgccaccgtcgacggggacgaggccttcgccgcggcctgcacgggcccgttgctcttcgccgggtcggccgcgtggaccgccgagacggttcgcctcctcatcgggaggaacgtggcggcgagccgcggctggggcgccgacgacgccgcggccgcagcgccaccggaaacagcggcggagttggtggcgagcgccattgctgacgtcagcttcgaggtgaggtaggtgggaggaggcgtgagggcggcggtaggcggggctcctctgaaggtggaggtgggtggggtgaggggtatttataggcggggtcgacggcgaaggggaggaggaggggttggtggatgggttggatggtggttggcggcgacgagggtgtgagaggagggaggaagaaggggtggtggggaagggtagtttcgtagtttttcttcgtatctatatgacctgacttggaaaagatactttaggggttaggtggcgtgtatgacaatgtgggcccgtgacgcagggtcggtggggtaggtcttgaccttggctcggctcggctcggcttgccgcctgatctgctaaagcttgagccgctccgttacaaaatatactcctcgtcccaaaattctggtcatcctgtgaaagtgctgctaaattagttttggaggtactataagtaattataatttagtacttgcaggtactataagtaatttcaccggcctcctctcctctccactgcaccaccaacctgcaacctcgtttggggcataaagtcccatagagcaaaaacaattgatagcagtataagatgaccttataccatatgggtctacttttctgcttcaaatgctaaacgatcactttttgggacaatcacaaatgagtaaaacgacatattttgtgggacggatggagtagtaatcaagtattagatttggcataaattagtatcacgaatatgtacaatcagattcatactaataggttttgtataattcggcgctaggttgttgtattttaggatgaatgtaataatgatttgatgtcaaaaaaacacattaacagagcctgctataataatcatgttcccagtacaattttggcttggctcggctcggctcagttggaacagctaaaaatatcgtacggcgtacagtacagcgccacttgtcaacatctatccacaactgacaggtgggccccgccgcttcccgtgcccggcaggttggcccccacctgccatcgagacgaccggctcgtgaaagtcacctgtctgggtggggttagttggtggcacgaatggccccgggggattccggacccagggccaattatgtggctctttgtgtggctccctgctcggccacatggtttcgtttcgcattcactttcaaattttgacaccatacatacatgcgtgaaaaattaaaacaatttggtccgatttcgtacgaatattctgcagtatcgtacgttcgacgacgtctagttcgcatatttccgcgtcgtcttatgacaggaagccatgttacttgatgctcgatttaaattaggtcgaaatcgattttacgaaccaggcaatgcaatgtttttggggtgatttgtgtgcggcaccacacgcacgtggcaccacgaagataccccccatgtgacacaattgggaccagatgttcttctcttttctttctttcattgtgaggaggtgaagatacttgtctccaaatataagtagttctgaaatttcttttacagagatcaagaagagatgtgaaattaaataaaggatggttatggtcagttgacatagaaaagtagttgaagaaattaggccccctttggattcaaaggaaattcgtaagaattttagagtatttcattcataaattttttttctctgtagcctttaaatcaaaagaatgaatcctatagaatcctataaagttcctatgaaatgcctctttccatggaagttttggaggaaatttaacataaggtagaacctcatggaaaaaatatcatttaaatctttatctctactcgaattcttgtgatttttctacggtccaatcaaacggtcgtttatgtgttttacaattctttattttacacttttgtttccgttagaatcctgtctttttttttctattccttctggggtttttttcacattcctgcgagtagagaagcgaggctaactgagttgcatgcatgaactagttcaacataaagcttatttagttcttactaatcagttcaagacaagaggttaatttgatcacatttttcaatcaattcaatagaaagcttgttaagttaatatatttactagttgtggtttgtggccaaagttatccattcactattctttttttctctcctgggtcatcataattcatatgctagtgacgctcctaccatttagcgaactgttataaaacacaggaatataattctgcctactaattaaggttcaaacaatatcataaaaatagcgtatgtcaatgtgaaaatgtgtgttatccgtataacatcaggcataacacgtggtaatatcatttgtctaaaaaagggagcaatttaattaattagtgtgttacgtactccctccataaataaaaagcgaatctagaaccggatgtgacatatgtatgcccagattcgtaatactaggatatattatatttggtagtaggttgattttctatgggacggaggtagtatatgtatatttcgtggggagtgcggagaagttgcatgctgccaagcacaaaggtggctaccaaagagacaaacaaaatgacacatccgttttcctcacctaataccacatcatcatcatcacccacttgacacgataagcttaaaaattagccatttgccttctcctactccttagcttagcttcctccccaaataacagttgatcacacgtgcaccaatataattgaaaaattagtatgcgaccgatcgacttagtgtaatgtgtacatagttacacacgaccaggtaataatgcggcgcacgaaaaacaaactcgatacagtatcgaaacaaaacaagaaaaccaaaatgacgccactacatcgagccgattcaaattcaaccccagcaccaatccctcgtgccaaaaaaaaaaaagaaaaaaacgacgcgtgcgttcgcgcgaatgctcacgaaacagacggttttggctcgccgcgcgccagcaaatctctgaaactgccactcctatggaaaacggtattactcattaacaggtaactagttaagtattagttaaaaaattaaaaagtaaattaatatgatttttaaaattaacttttctatcaatttttttaaaaaatatacaccatttaactatttagaaggaatgatcgtggaaaataagaaagtaaaagttgagaaagtgagagaaagagtgtattttaaaattacacaaatcctacgagggcacgacgagtactactccaggacggaaatgtataaaaacgtcggtctccgcacggcgagggctcaaggcgccggcggtaaactgcggccgattcacggcgacgaggctgcctggaaagagtgggtcaggtcatgttttgcattttgctacgtgacgttatgacggaggctttgggtcaatgggccggcatgtttgaagagcagtagtagctggtaggcgacttgaccaggaggggacaaccggggagatatgcacttgaatatgccgtattgtgggggatctaataatcctcacctaccaaccccaccagtagctactattcctatattgtttgacccaattatttactattggatgagcaacatcataaaaaaaaaagtagctagatcactaccattctgaattatagttattctatgctcactcgtagttatatttttatgctaactactctatttttgctcctttataaaagagagtagtggtttcgctgtcaattcctattatttttaaagaaaaaagtgacacgtggagctagagggctcatatgtcaactactcatatcaattctctattttccgtgggaaggaaaaaagattaatgtgaggttaaaaaggttcacatgtgattaacaaatatgtacaacaattgagagatgtcactaaaattaaaatcccgttgcaacacactgacaatatgctagtattaattataacttaaacatgcatcgagtattttgttgttttttttaactcaatttcgtttttaagtgtttttgaatgaatttcaaaatcccgcgacaagctgtgggatatccactagtataacaaattatcaatgacccattggtcaggtaaagaaggcgacggctgatttgatcccatcaattactgtagcaattgtgtaaccacatgacatgtcccacatgcatagcaagtgcattgcatcagtggtgatctgacaatttacagaggaaataattaagctaacaaagccataaaggacaccataacgtcgctttgatcccttctgcggattgattgcacgcagcatgagccgctagctctgtatcagtgtagtactgtagctatcagacaaggcaacaaacaattgctctaacgtttgcaagttcagacttcaagagggtagccagttagccactagccaagcttatctaatctacacccttgggccttggcaaacaggctctagtccggcccattattcggatatcgacggcccaattataaagcccacgaatggtgcggcccaatagcggcgcctccaagcaaacagaattggaggtcttttgctcggcaaaacgcaaaggaaatcatatgatatgatatgatatccatccatccttctcaagccgcagctttgctcgttatttgattgggccacatgatgtaattaaattttaagataagcatgtaaaataccaacgttaaaaaaaaggctgtctatatatcatgtgacaaaatcccacctcttatcattcgaactttggaccattgatttaatagctaaatggtgaataggtgcgtgcccgcctcatcgtgcgatcactattccgtgctatacaggtcatataacatacatttccgtatgtatatgtatatgtaaaataaatttatatatcaaaagtgtatacatatatgtgtaaatttatacatacataaaagtctgtataaatctatatacaaagtttatacacaaatatgtatataaactttatatatacttagtatacttatgtttaaactttgtatcgtataattcaaagtatatacatacgtatatagagaaaatactagaggggaacccctgcgtggggactctccacgctcgcgctcggctgggcgtgtattacgtgccccggaccattgatatcttgtaacaaactgatatcgtagatcaaattcttattcatggatcgaattcttattcttattataaaagtacatattctccgtccatacgatgctcaacttttttttagggaccatatgatgcttaacttgacgtagaactttactttattatgcatcaggtccctccaaaaccttccatggaggctaattttcacatttgccaattatcagtgaaactaggaaaaattataaaaaccacctcaaatgtcactttatgttgcaaatatccctccaccctaaatcacctttgtttaaaatttcccccaattgccgttgctcattcatttttttgtggtcgcaaaccccacatttactcatatgaatactagtaggcaaggagtcatggtctccactcatatcggccacgccctatatgatataaccgtgggttcgtggcattcgctggaatggcgcacaaacgttattggacggtggtgttcacaagtcttcactcttggacatcttgatcactagaagatgagttgttgcgcttgtctcctggcagaggtggagctaggattttaagttgttggggtcatggcattcaattgtactagtgtcatgtttgagaggactttaactctaagtatttttagctcaaaattcttttgtagctagagatgtgagtaagttgggattgtttcattttactaaaaaactgtttaaactctatattctacaagaagttagagattttaaaaaggtccaaaaaaattaaaagttataacagtataaatcgagcctaaaaacaatgtatttttggggacataaaagcaagttatgaaagttgtttaatgctccctccatcttaaatgcaattacctatgcccttctccttcttttttttaagatattggttgagtcccttaaaaaaagattaagagattggttgagactgagaggtatgtgaagaggtagttgtattttaagacaaatttgaattctagatatatctatattttgtgatggagtaaatggcttaaaaaaacacagctaacatctagtatactattagttgattaacataactattggcctagtgcagtgatacacacaccaaatagctgaaatagatcattaacataccaaataagttaaattgtggtattagtggtgttgtggtgggttgacagtcgcataacaaagctaatacagtgtgcttccatagaaacaagctactataatgttaatgttttagcttttatcaactccactattaattgattagcagaactattggcctaatgcagtcatacacgcaccacatagctgaaatagatcattaacataccaaataagttaaattgtggtattagtggtgctgtggtgggctgacagtcgcataacaaagctaataaagtgtgcttccatagaaacaagctactatagtgtcttaccaaggtaaattcagagtgatatctgagtggtaaattcagagtgatatcttatacgggagaatttaaaattcagagtgatatctgaggtggtttatacaattttcctataaaaataactactctttccaatggaatatgaagtagctacagattaatgtcaacgatgagttggcaaagaagtcacaacaatccatgctcaatctcaggtatccaacacaggattatctaattccgaaccatggatggagtcaaccttgacgcccacatgtgttctcgtttaacagccacctgagcagcatacgcaatgcattgtgtatagtaggtctgcatttgcagatagtgagttcagtaatttccatactcggttattggtcttctaggtttatacagaacaacgggctcaacaaagacttgcatatcggcaggaaagaaagctttagaagtgactattgactgttttttatatagaaaagtttttcccataaagaatatatattgttgtccatatgaaatgcctacaattaatccttttatctaagtcaatcaaaattaagatcaatgcattactttaacatcaaaataattgggttcaagatctaaatttggtacggacgtttgcatttactgctaattattcttttagctatagacgatgctacatcgataatgatacgtctttggtaattttggtccaatctttcgaatgtgcttatagatgtagggtgggtgttcatgagggtgagtgtgcttaaaagaaaatgaagaattatatttataccattccaattttgtctccaattttcttttatgttgaggtgggatccaacaaataaattattctgggacgaaggtagtaacttgtataaccttttgaccaataatttttctaaggcaattataacatgttttttttctaaatacttattacgttttgatttgtacgacacgtggcaacatgcggggcacttttttttttaatccagctcctctgactttggatagaaaaagcagagaagaacagcaaaattgtctgatgctacagtaaaaacaatattttgcagtaatctattatctatctatcttctattatctatctatctatctatctatctattatctatctatctatctatctatctatctatctatctattatctattatatactaaaagtccattaatcttcctataaacactcctaagccgccatgtggcgctcctacaagcactcttaggttgccacgtggcatgctataatctcaccgttgattttcatttaaattggtggacccattattttaaaccgttagattagatctattaaaaaaaggttaatacttcatgtgtatacataatccgtttacacttacctaaaaaaaagtcagcataccaggaaaacgtactatgggccgaaaaaaatatacctttacgtactatattcatttgaaaaacaaaacaaaggacgtacgtaccgtttagcgatggaaaaaatacctttacctaccgttcatttgaaaaaaaagatgtacgttaaaaaagctataaaaccctaaagaaaattatatgtaaatatcagaaccatcatcgaaaaacagactatctttttaaataggattttctatataaaaaataaaatttattacttcacaaatatggttacgtgatgcttctacaagcactcttagaccatcatgtgacactgtgtaatctcgccatcgattttcatttaaattgatggacctgttatgaataatatgtgacgaaaataaactagacgctaaaatatatatatctgagacatgaacacttagctaagtagtgtattaatgatatattaggcttattttatccgcatttatgcaatttcatctattaataggtagtcagcttttaaaatatatagtgataatgagttgttacgttaatagaagaatttatatgtaatcgggacaaagtgttttttttttaatctgagagaaattattatcattgaagtatactaaagtctatgatctatctcacgacgtagaaatgtgagatatggcttcttttagcactatttcatagaacaataaataagatgcccgcgcaaccgcgcgggcttccttaaaagattgtcacggtcgtatgtatatttagcgatacatttcttaataatcaacctcactcatttcaaaagagaatattttctctatgccataaaaacttaagcagtactgattaacaatacaaacaaattgtctctactcaaaacgtaaaaaaaatatttttatggaaagaattattttcttcacatctatcttctctttctttcatgaagggcatcgagcagttagccagttaacacaactataggagggacatacatatgattgagttgagacagacccaatggagtccaccattgacaatagtactcaacttcctacatactaatgcaataagctttgaggataccgatagtgaaataggacttagaattatgctccacactagctttgattggcacaagtacgtcgctacgaaacccatgtttgaaggcaatagagaaataaattctcggtagctctacccattagagggtatattcatgtctaatttttaacagtattatccctttaaccaatagaagcagtatttttagaatatttatttatagatttagaaataagagttaacgtaaacatttaggtatgtagtggagattgatgttttatgtattaatgatgtaatacgcttactttggtgatacaaatgtagttctgtttattaaaaaggcatcaagcaaaaatgataattagtaatagtgacaataggcgagtttacgtgtaatctagacaaaagtgatttttgtttgaatataagaaacattgttatcatttattaaagtctacggtcaatttcacgacaaagtttttttttattataaggtgaaatctacaatttattatatttattatatgcatacagtgagatatgacttaattctatttaacattatttctatacataataaataaggtgcccgcgtatctgcgcgggcttcctttctagttcactatagaaacagcagaaaacagtgaaaaccactattcacaactactgttcaccaaactactgtggtgatcgatctcgtccgttcgctgtgaataggctaaaaatactctgaaagtcaccgcactgtagctctctggctttacacacatgtaaagtcagaggatccaaatcccaggggtgggggtttgggttgctagtactacagtcctgctatacaggggcgtagacagggggtggtcctggtgggctcgggactaccctgattttggcccaggatatccccacccccaaaagcccacaaaccttggttcttattcaagcccagaaaaacaagctcacaaaccttggttcccattcaagcccagaaaaacaagcccacaagagagaaggaaaaaagcgctaggtttggccttctgggagtcaaggcatctgacgaccacgacgccgtctctactcgtcctcgtcgcctctgctacgcgcttgcgccgccgcttcctcgccaccgccgctgccgccgccacttccctagctcgatctacggaggccgaatggcgaagcgctagaggcaccagtccccacgccgcgctgcctgggtgcaggctgcttacgccgctcgccggggctcctcacatggcgccgccaccggccgccggtgccaggagctgggagcccaggaccctggcggcctagccctaattgatccttgcctcgatgttttccctccgtctaccccttggaatcccgtgcttaggtgagtaaatcattgtattgtgatttgtgaatcagtgaatatgtgaatgtgatttttgatttgtgaatcatcggatgtgaatgtgttgctatttggtactattgtagtatgtaggatttgtaaacatgtggttgatatggaattgctcttttgtatgttagccttaatctagtgatgaccaagaggagaaacaatatatgatttattgaatcattgatttgtcacatatatcaagtgagatatcttttatgaattaagttagtaaagaagacataatactaaaaactttgatggctaagatattggcattgtgattttctatttgtgcccaagatcttttatatttgcaatatttatgttgtaatatttgcacgtgtgagcttgcttgttaagttagtcaaatattgacaatataagacaatattgttacatttctattactttttcattaaatttgtactcgtatataggatttacgacgtttgaaaatttagctatgtgatgtgtatttgtgagtaggactacacagcgaaaaattcctggctacgccactgctgctctatatatcaagccgaagccgaagccgccttgacctgcaaaggcagagcagagcagcgcaggcgagcaggttgcggagaagtggaagccatcagctgcctagtgctaaagccatggcgtcgccggcggcgagcaagccgcacgtggtgctgatcccctacccggcgcagggccacgtcaccttcgtccacaccgagttcaaccgcgcccgcctcctccgctcccgcggcgccgccgccgtcgccggcgccgacggcctcccgccgccgggccagccggcggagctcgacgcgacgcaggacatctgggcgatctgcgaggccacgcggcggacggggcccggccacgtcagggcgctggtcgagaggctcggacgggaagccgccgccggcggcgtcccgccggtgagcttcgtggtggccgacggcgccatggggttcgcggtgcacgtgaccaaggagatgggcatcccgacctacctcttcttcacgcacagcgcctgcggcctcttggcctacctcaacttcgatcagctcgtcaagcgtggctacgtgccactcaaatgtagtagtaacagctaactgattaaacacgatcattactggttctaacctctcgccattcacaggacacttgtgctacatccttagttaatttgcactaatttgggatcataattatatatatgaaaaaatggatagctagaaattaggattaatgatcagaagatcagtagttcagtacgttacaaactctacttttttacatgctccaagaagaaaattcagaatcaagttagccgtcaagattttatctatccaaaaattgtttgggatcatcgatcacccatagatagccaacggtacgagtgaccctatgccatctagtgaccaatcaaaattttcatggatttgtttttgagtccaccacattgagcatagctttgagatatactccctccatactcgtaaaagaagtcgtttaggacaatgtttaagtcaaactttagaaatataaatcataaatatctctctagttattaagtttgaaaatttaaaacttatatgaatagatttgtcttaaaaaatacttttataaaagtatatatatatatatatatatatatatatatatcacttttcaataaaattttttatagaaacaagaagtcaaagttgtgttttagaaaccgtgtcgctgtcttaaacaactttctttacgagtacgaagggagtacttacaaaaaccaaaacctgttgaccagatcaggccccggattgacaatttgacattattgtccaagcatttcggtacatgttatcagcgcacgctacggatggagagaaaagcactccacgtagtttaaaatatcattttagtccagctatgttgtcattagtgacatcaaagtctaaccagcagttttcctttccttttttttctactgccagtacacttcatttttagatatgtgatgttatcgacttttaatatgatgttcgaccattcatatgtaaaagctactatagcagaaattataaaaatataagttatgcataaagtaactttaacgataaaatagacaaaaaaagtatacttaatagtcatatatttaggtcccccatcatttattaggaaataaaaatgaatttgtaagtaaaacttttataaatgtgttcttggtgacttaaaagccaatattaaaaagaaactatattgaaaatattttaaaatcaatctcaaaattaagattgaaaattcaaaatttgtctttttctttagctgattagaccatccgatgggagccttaaaattagaggtagtattaattatacaaaattatcggggaaaaaacacttaataactatcaggtaacacactacaaaataaatgaactttatacacatgatcatacagaaaagcactgtaattatcaggttaagttacacaccgaaatatgaaccacctttaattgtgtactgtgctatacagatgagagttgtttgaccaacgggtacctggacacccgcctggactgggttgccggaatgatcgccggcgtccgcctccgcgacctgccgacgttcatccgcacccccgaccccgacgacgtgatgctcaacatcaccatgaagcagtgcgagctcgacgcgcccgccgccgacggcatcctgctcaacaccttcgacggcctggagcgcgcggcgcaagacgccatccgcgcccgcctccccaacaccatcgccgtgggcccatcggccagaggtctcgccgccgtcgtacctcccttccctcgcctccagcctgtagagggaggacggccggtgcgcggcgtggctgaacgcccacgccgacgccgccgtggtgtacgccaacttcgggagcatcacggtgatggggagggcgcaggtcggggagttcgcgcgcgggctcgccgccgccggcgccccgttcctgtgggtgatccggccggacatggtgcgcgacgccggcgacggcgacggcgagccgctgttgccggaggggttcgaggaggaggtggtggcgagcgggagcgggcgggggctgatggtggggtggtgtgaccaggaggcggtgctgggccaccgcgcgacgggggcgttcctgagccactgcgggtggaactcgacggtggagagcctcgccgccggcgtgccgatgctgtgctggccgttcttctcggagcaggtgaccaactgccggtacgcgtgcgaggagtggggggtcggggtggagatggcgcgggacgccgggcggcgcgaggtggaggccgcggtgagggaggtgatggggggaggggagaaggcggcggcgatgaggaggaaggcggcggcggcggtggcgcccggcgggtcgtcgcggcggaacctcgagagcctcttcgcggagatcgcgggcggcgtccaaccggtaataaatccagtttgaggaagcgcaacgcaatgtgttttgtgttggtttgtgtgtgacgtgtgtcgtgcgcttgtggtgtgttttgtggctttttgcgtgtgtcgcgacggatgaatctttctctgccgtactccccttttacttggatcactgacgtatgggtttgatgatctgtttccgtgtggcaatagatcgggttgtgccagtttatccggggaaactgtgatattgtaggggttaaaaatggtaacggtaatttctgccaaccggcgtttgtttttaactttctaccgactaagccatatgaaaatggtaattgaccgaaaaaatggtaaaggtaacaaatatggaaatagaaaacgaaaatggttttaccgttttcgtattcttgtgaaaattatgtttcttataatatggtaattgtttagagaggacaaatctatcctggagatagacaaagtcactacagtcgcctcgctgtcgacgggtacgttgcctaccaccgaaagcacagagccgttaaatcttggaaaattccgtacaggcgcttcgctgtcgacgggtacgttgcctaccactgaaagcacaaaaccgttaaattctgaaaaattcgctctcatggggagtcaaacccaggaactaaggtactgctgagactcttgtaaccactagactacaaacccttttgcaatcaaatccctaacttaagtgcatggctaaaatggagttaatatataatttacatactacagcttaaatttatttgtacatataatatacttatgtaaagctaaatatatgtttttatagtttaatgtttccgtccgtattattccgtttccggtgttccgatatttccgatatcgttttcgtttccgacattattgttttcgattttattttcaaaaaattttaattatagaaatggaccaaattgttgatattgttttccgttagtttctgactgttttcatctctagatattcacatcgcaaaatgggacatttgccgtttcggtttcatgggaagagctgcgtctgtgtagttgttgcctggtggggctcgacttgtacttgtactcatggacaatataaatcgtaaaatcgtagtatcatatatattctgagatggcgaaagcagtggtgtgacgtgtttgtgttggttacttggtttgtgtgacgtgttcgtgcgcttgcggtgtgttgtgctttttgcgcgtgtcgtgatggataattctaagggactgtttactcctcattttaaagaaaatcccttttaatatactacaaaattttgaccattgaattaatttgagattcgtgcaaaccccatcaaaccctaactacttttccttcccctcctcccctgccgccgcaaaaaatagctcgctcctctctcgacaccgcgcgcgtcctgcgccgccgccccactgtgccaccacctcggcctcgcc

SEQ ID NO: 79037 - DNA, 2611 bp, Oryza sativa
accgccgcgagcctagaactgggtgatacaggatggtgtatcatgggccccgccgccgctccgtccgccggcatgctcctgccgccgctcccgcgaggacgaggaagagcttagaggaagagaaacgagagccgagaaggacttgtggggcccacgtgggccccaccattcttttattgatttatgtgtgagactgacatgtgggtcccacgaagtttactatttttccggatcaaattggcacgtatggcgccacgtcaatgccacatcaaaagaagaccaagtcaaatttgctacgtagacgccacgtcagccaaaaccaccctcaaaaccgccgagggatctcatctgcactggttttgatagttgagggacccgttgtatctggtgttccggttgaaggacgaaaatcggattcgttgacaagttaagggacgtcatatgtacttattcctaaaaataacggttacactaccaattcaagatttcagtgttcgcttaaatggtcaattagttgctaaaataagtgtaaaagcttttacctatccatcgaccgttgtcttcctatagctgccatcctccacctcacacgtgaggctgtaaggcaaggactataatctcctgacccggtttactgccttcatgacaatccactatattttttttatcattgcattataaggtgtacgtacgcatcactatacacgcaacatcacatgcacacatccagtcaaaagagatgaaaatcaattataatcttactaaattcctatagtaagtttatttgaatacgcataatacttatgtccacccatgacaccatgtcaacaataatttccttcgtaaccatctgctatattagtaggtccttccatgttaatgtatttcgttcgagacatgtattgagagatggagcaatgtggaccgtttgatcgagagagaggggcaagatacaaaataattggtagtggagtaattaactagtaaaatatatgcgttttatttttattgaatacctttactacaaagtattgtttggtattgttaggtagaaatcaaagtaaatattctaataaacaatttaatgaatcgaatcgtacataaaaaaagattgatgcctcttttttttttttttgagaacctttcactttgttcttgtacttggatttatacatgttcaccgaaagaagacagagaaagaagcaatccccgtatggttaagggttgaagaggagatgagatggaccgatcaaaggttaggcgcaaccgcacaagcgcatcagagaacggagaacccagttttagatgtacatagcgctactatggagctccagatctttctggaagcagcatctgagaatcgatcgagtgcttgattacaccagcaacggggcggttgctcatggcccacatccagtacacccgagtggcgtccacatcagaggtcaccgtccacggtcaggtcggcgcacgcgcggtaaaatatcatcagttcatcttgcctgtcacatcgccacctttttacgacacaccctctcaccctcaattccgttcaaaaaggtggcagtagtactactatattataatggacgatttaaccagggaagattatgtacgataccattggaagagctaccgttttgtgaaaagtttttctttttttatttgaattaaaatgtttcttttactttgggtatgaatttgatgaaaagttatcatgtttatacaccataacactagcagattcgtgctcacaaaatgataaatacatggcagatatacaaaatatagtaaactaataatttgaggtcatgaatggaacttataccaataaccatgaaaatttatacgagcaagacaacagaaacatgaaatattttcatttgatgataacatcgttccgaaaaccgactgccttcacagcactctgatgacgatataagcaatccgaaaacacattgacgatggtatataagattcctgacaactactttgtatattttctttaaaacacgaaaattagtcttccttgtttgacatttccataccaaacaaagaccaagtaaagccgaaaagtcaaaaccatgtaatattatgtgtaagcctgaatgcaagtacgtctatgtatagtactgtggtgcgtttctctcatcccagctcaacaaaggcatgtgatggctgcagattatcgtcgccgccgcaatacttccatcactgctgcaaaaacttgttcaatgccgttatgtccaatgctggaaattcacttacggcagtaagcactgcaagcccaagcttaatggcatcatccttgctcggcgcctgtgcatgcacatgttcacatgtcagttaaatggatgattggaaggcttgggatttcagatagggcaaagggaggctgacctcgatgttaaggggaagaactgggtcatggagggataaccgcaataagaaccagccaccatatcctgaaactcttacctgcgtagtaaaaatatagcatgatacagcaataagaaagcccagctactttacccaagaaaaggtagatatatcaagatatatactcaaacttgtgaaaacaagcaaagaataatgacatacgggggcgcag

SEQ ID NO: 79038 - DNA, 549 bp, Oryza sativa
ttttatttcacaaataatcagagaatcacctctgtccataaagttcaaaagggttttcaaaagtataataagtgatccataaccatgtttttatttattactaagctaggctaagcatttgcattttgtaaaagtatagtatacttatatgagcacaattaaagtactctcataaatcctaaggttcaaaacagcaaggggtgattttcaaaaggggtttcatgcatgtttataatcaaaaatacacgtgcagctttataatcaaagcatttagcccgaaaacataggattcaaggaagggcaaaacttgccttagaatatatatgacctaactgagtttagctataatccatctccttcaccggtaacgatttcgccgtctaaaagaaataaaagtaacgataaataccaaaacatgcaataattcaaaatgctctaaaatgcatgagtttactagtgtgattaggtgctgtgtgggtaagatttgtggtgaaggaatttatattttatcactttgcatttgggagttattaattttcaaagtttaat

SEQ ID NO: 79039 - DNA, 15309 bp, Oryza sativa
  unsure (1)..(15309): unsure at all n locations
cgaggcctcttacccctgtccctcctaccctgcgccctaatgtgcccgtgggagtacgtgagtcggtccgggggtaccggcacggcaacccgtcctgcctgtacaggtgtgacctctggctgctcctgagtgtgcgcctctgaagctcctccaagctgagaggagcctagtacgtcgtgtcggtctgcgccgtgcgagtcgtcgtcgtagaactggctagtaggaccagtccaaccggcgtgagacgaagaggctccagtactgaagatcccgagtgcaaatcctgctggacaaggaccatcagtttcgtacatgtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcttgcgatgaggaaatgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcatccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctttcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactggataaacttataaccgcagncgaagttgcacttaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatagataccacgcctgctcctatcaacacacattatttcataccgatgcacttgtgtgccttgagcaacaactcgatgtctccgtgcctttttgattttatcttccatgtactttgtcactacgttgccaaacactatgttgtcatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttcaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgataatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgttgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgccttcttcatctcatccttatgagcatatcttgcaccctcaattacctcgttctccttatactcccagggtacatgatcaccctctgatataacaagtccagagaagtccttatttgcccaatcagtggccattacatcactttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggagccatgtccgttcaaaagccatttccacataccgtctccaagcatcagtgctgtccatcggcattagttcccaaaaataaccttctgttgcacgactcactacaactgacactgacattgtgtagacttcttggtctattctaaatcctcttaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgtttttttggatttttagtgaatataatgaaatttcacagaggaggtactgggctttatagggggagaggcaaaaatcgccctcccccagggcggcaagggggccgcctgcaaaattccatgccccctcgccgcccatttgcaagcggccccccccacagtacaaaatcgccctagcggagggcggcaagggggccgcctgcaaaattccatgcccccccctcgccgccaatttgcaggcggccccccgcacagtataaaatcgccctagcggagggcggcaagggggccgcctgcaaatttcgttgacggccgtcgcccgagagcgaacggctgtctgccacgtcattttcgccgccctctgagagggcgatttttccagagggcggtaggcgactccttccgtcaattttcaaaatggaaaattatttttgtaaaacttttaataaaaaaaattataaataaaaaaaattcgcctttttacggtgaggcggtgcgctcccacggatcgatccatcagaaaaataaatgggacatttaccgttttggtttcacgggatgcgctgcgtctgggcagtagttgcctaatttggtgaggctcgacttgtacttgtactcatgggcaacatatgtggtgtttggctgtgtttgagttccctttaaacttccaaaaaaatcagtcacgttaaatatttaaacacatatataaaacattaaatatgaataaaaaaacaattgcacagtttgtatgtacattgcgagacgaatatttttagcctaatgtagtgctacattaaatatttgctaatgatagattaattaggcttaataaattcgtcccgcagtttacatgcgaaatctataatttattttattattagtttatgtttaatacattaaatgtgtgtctatatacttaaaaaaataattggctgcggaactaaactcgacctttgttagtaagataagccgtaaaatcaatagtatcatattctgagatggggaaagtaatggcggtggagagatcaatgtttgtaccagatttgaagattggatgtaacacacagcacaacggggtggtttcgcagttggctagcgcgtaagtctcatagctatacgtgagtgatcctgaggtcgagagttcgagcctcaccccaaattttttttttcaacgtgacgcacaacaaagcgactcgtaaaataggcccagcacatctgcccttgttaaatgaatagaacggccgaacgcgaacccccggccatcctgagtgcctgtttggtttccaggacttatttcaactccctgttacatcggatgtttagacactaatttagagtattaaacatatattaattacaaaacccattctataaccttggactaattcgcgagacgaatcttttgagtctaattacgtcatgattttaacaatgtaatgctacagtaaactataattatggattaattaggcttaaaaaattcgtctcgcggattagctctcatttataaaattagtttttttactagtctatgtttaatactccaaattagcgtccaaacattcgatgtgacatgggctaaaaagttttagccccatctaaacaccccctgaattgctagccgttttcgtgcagcgacgcacgggctcgagtgcgtcagagcaccctcgtccgttgcattgcatcggtaatatttttggtggttttctactcactcaggactcgcccgctggtgagtggtgagcgctgcggccgtgtacttgcagacgcttcgggctgtttcactttattgccaaaatcaatcaatttaacggcttccacatctcggcctgcctaactgggtgatcctctgttgcatcatgcatgcttgcgtgaacaagaggatcacaaactggccgaaatacctaattaagttaattttacacggtaagagagagagagagagatggcacaggcacgattgactggcagccgtttgctttccgaaactcgattcttcttcacaccgctcggggttgcaccgtgccagaagatacaccagatagtcgaggatggatttgttggatggtgcaagcctttaccagtttgtgtaccagtaccacacgaagatgctcacgaggagagacctatctgccgtcgacggaagctacacctgcgaaacggatcaaggaacatgagagatcacccagaaatcgtatcatgacacatatgcagtttgcgaaaccgcaagtttggttgcaaatgtccgtttcagtaatgctatgaaaactgctcgataatgactattcccaaaaaaccgctgaaatcatgcacattcaaccaagctattgtattcatgtgttggttgtcttataaaaaggttgatgtcctacaaatgcccaaagtttgcattattgcataccttctcatcgttcaaaggttcggtgactccctcttggaaaaactcaatgatgttcctgcacacatccttgggcttctcaaggttgaccgcatgcccagcatttcttatcactactaatcgagaactctcacctagatgtctgtcaatatgttaaagtcaatatcattactctgccaatcgatcctattctttgtgtactccatggagaaaatttgtgtttcaaattgaaggtagcgatagcaaacctcttcagtctatgagccaactccatggggaataccttatcccgctccccccaaactatgagcgctggctgcattaagtgagaaagaaaccatcttcaaatgtttcagatgtaagtgtagtagagtttaatcacatactaattggtacctggctaattattggaagatctgaaagctgcctttcactaatcaaagcatataataactcagttttttcttggatataatccgagcccattacctgatacatacgaaaaaagcaacatatgtaactcaatttctttttcctgtacataatccaagcccagtacactatttattgtggtttatgtgctactcaaatcactatggagagagcgcccaaatcactgattattccatgaatattcttgaaaaacatatcatctgatgaaagtaactgagcaagagctcttcaaaatactcaatttttgggtattttgctactaaaaaaagataagctgattttcaaaatactcaattgtatatgcaaatgcctgccttctatgtcttcaataatccataatatgtaaagcatcacaaagaacaaaatttgagatgtttcgagctttactaaagtcgagttggctcttgttacagatcaagcaaaccttcatcccattttcgcgaacgcgcaaaaggattgcacgtcaatacattagaagaaaggagttatagttacacaacgcaatcagccataccggcttatgccaggggaagagagaaaaagcaaaattaaaaacttgaagcttagaaaaaactacggtggctaaaacacaaactccaagcaaaccttggagcaacttccagtatacattatgccccatgtatgccagtaatcaggttcaattaacaagttcagcatgtgggcgagaatcattctttcaaaagataatgaacctcatcttcataatcgttcactcttttgtttacaaattcagttttctaattcctttttgacccaggaggttgatgatttctgtatttcacaagactgtatccttgaatgttacccgtcatttagggagtgtctaataagatcaaagcatttcttttagaagtcccatctttaatttgtaaattaacacatttcataatgtttgcagtttatcacatggatgaacatctgtcacgccctgaagttcctctccttgctttaaaatttgttaaataaatcgcccgaagaaattgttcaatttaacctagagttgaatccctaaattaataaatgcaaataataatcggaatcggcatgtggaatttttcttggattctacatgtcaaaatatgctaacaggatttttagtggaattttcagagccttggaaataattttaaccaattaaaataagcaaagtgcaataaataattcctggaaaatcctttttttccttttctcttctttttcttcctttttcctccctttttcctcttgttgggccgtcggcccacttcctcccgcgcccttcctccttgctgggccggcccactccctccctcctctctccgggtcaccgacaggtggggcccacctatcggccccttcttccacctccagccgacggcagcgccgccgccgaaaccgccgcccacgccaccgcttcctccacatccgcgccccgctctgcgcccacacgccccccacgtcgcccgccccacgccccgccatattctgtccacgcgcgcgcgcccgcaagggcgggattcaattcgaataccccccactctctctctccacctcccacgtcgtcggcgagaaatccggctgcccccggccacgtccgcccctcccgagtccctataaaacgctccccgtgtctccctctctctttttccgcgctcgccgtctcctctcgtgctctctaacgccgccgcgccgttcgccgctagcgccgccgcttgccgccgcctccggccgtgcaccgccgccactatagccactgccgcgccaagccgccaccgctactagcttcgccgtcgcgggagctatcccggccgccgctcgcttgccgcgcgccgccgcctaccgctgctagtcgtcgctagtgccgtcgccgcgccgctccgttgctgctgttggcctcgcgagatcgaggcccgtctcgtccatcccgcgcgccccgccgtccgccgcttgccgccgccgtccgccgtcgtcttcacccacgctggccgaatccctggtgaggactcactcttcctcttttactcctccttccccgtgtgcgtcgccgcctcctgtccgcgccgccgctttggccatgtgccgccatctcctcgccagccaccgccatctccgcgccgccggtcgccgccgtcggtggccgctcgccgccgccgcatcacctaaccggccggctggtttgaagccgagccgagccgaccgggcatctccccctccccttgagccactgcccggtggggcccacccaccaaccggtgccacctcctcccccttgagctgctgccgggggggtcccgcatgtcggcgcccgcccccctttgctgacgtcatccgggatcctttattgcgcaataaaactcagtaaggcttttcttttatagtaataaacacagataatcttctaaaattcatatctaattcatccgagctccgattaagtccattcaagtctcagtaaattcataaaaatgcgtagaatccattaaaaatggttttgtttcctgtttcagtagtcttataggctgttttgcttgtgtgctttgtttgtcgcatagatttcggtcgtttcgtcgatccgcggtttctcgaagacgttgctgtggtctcatcagtgcgagagcaaagcaagccatacattacgattgatcatattgtacccaatttacaaatgtcccgcatttctattaagtattgcattgttttacaatatcacgtgggatgggtcctactactcagccatatcttgtttaccttatgccattgataacttgggtattaagatgcttagatgttggtttagggaatgcttagccatgcttagttcaactagtacacaatggaggaatcacattaatgcatagactttgattattggcaatagctttggattagtgccaccgcaagggtgttagttaattaaaatacactacatggtgggctgtgggtgcatggttttgctagtcgtgcccatggcgattaaggaccggttcgcgggatgccctggaagaatttatcgtacttgccacaagccagcatgggcaacggctgggcttgtagtgtagctttcctctagtcgacgtacccaggcgagggtgggcgtgatggagttgggtcggccagggtgtccggttgatcggcttccggattcaccgcggtacgaaaggggggctgcccgttgcctgctggggacgggggcgaaccctaaggtgtggtgcgatcggttaaagggggttatgtgaagggtcctgtcacggcctctttccggtatgtcgtggtggcatgtcggcgcacggtaacgtgtcgtggggctgcgtcttgtgggtacagttgtacacctctgatcagagtaaaactattcgaatagccgtgcccgcggttacgggcggtcaaccagattcaccgtgattagtctcacccctagtttagcttaatgaactggtgtagttcaggtggttggttaggcctgttgcaatgtggtgtagcgttggatagtgattggttaatattgattaattgctacaactattttactgctttcaactgctgcttttaaatgctagctttatgcaaatgaacctctagcctcctttggttataccctgcatcataccttctcttccggtatgacttgctgagtacaatgggtagtactcagtcttgctctcttttcccccaccccagagttgaagttcttctcagttggagatctctcgatgaagttggtttcgtcgctgccgtcaaggatgtctgtggaatggagtcgcctcgctgcatgagtcaagtcttcaggcttagctcgcttttatccttttccgctgcatttgtaatcttttgtatttttgtaagacgtggatctgtatgtcaacaattgtcgtttgtgtaccctggctggtcctggacaggggtttaatgcacattcagcttagaaattatggttcgtaaatttttgggcgtgacaacatcccactagtataacgatgctaaacaatctatccaacctggtattgaattctccccaacaccagaaaaacttgtttctcttcttttcctgctagcatcagccaacattcttgagcagcacatgaatggatacccaggataactgggtgaaattagataaaatgttctcaaccaagccatattttacttgaaacaatttccactcttttgagctgcatttgccattactaaagagaaggaaatggttgcatggtcaaatgaactcccaactgctagcaaaatccagttgcaatttattaagtccaaaatatgttcgcatttcggtagtctgggtacaagtatatttattgagggcaaaacactaacaggaactacaaagaaaacttaggtgagtttgaggagagggggattgagaagattgggaagatacacaaaacgaggtgagccattagcacatgattaattgagtattaactattttaaattttaaaaatggattaatatgattttttaaagcaactttcctatagaaaatttttgcaaaaaatacaccgtttagtagtttaggaagcgtgcgcgcggaatacgatgtccttttctcacccaatccccagaactcatcacaacgaacgcagccttagtcagtgtctgaagtatacacaacagatacttgaatgtacatgggtaagcaaagaactggtgggcctactaaaatgcagtatcaaatcaagtgctctgttagtttttgaaaaaatcgagttgtcactaccctggccctacacatgcaagtgtttccactgttctccacatttgcaaactatgtacatatttaagcaaacggacaagacaaagcgaaaatgacaatatgtttctgttaagctactgacaagtgtaaatattttgaggctctgttggctcaatcaaatctaagcatgtattaaactagccacatagaggacattcagtgagttggtgtccattagtccatcataaggatggtaatattaatacattaagtgagatgttctcgccacaaaagacaaactgcatttatccccttgccatttcggttcaatacacttttgcctccaagcatccctcgtaatggcgtgcaaaaacaagattagcctcgtgatcgtgagatgatcacgagatgcctcgatggctaatcagcaaaattagcctaacacagatgtaagatgctactttgtatacttctatatggaatagaattcggcataattccctaacaactgtagagagcacagcattctagaagtgcctaaatttttttcccctcttgtgattctataacttcatctaatgcccgatagcaatgtaatccagggattgatttcgaaccaattttaaaaagaaatctcaaagataaaaaacgaagcggcctaaccttaatgtaatcccagaggaagcaggagggcataatgcagggtggccgcacgaatgtgagcctgacgaggcgccgcacctcctccggccgccgcggcacgagcaggtccgccgcctccccgacgccggccaccgggaacagcccaccggccaggtccttctcctccaggcaaacccccgcgcacaccagcaccaccctctccaccgcgtccgggtacatggccgccatcctgtagcccacgaatcccccatagctgaccccgaccaggccgaacctggcgaccccgatcgcgtccatggccgccttgatcgagcgcgcctggaaggcttcggagcggtcggcgaggcgggtgtaggaggcgccgaagaagaggaggtcggggacgatggggtcgtagcccgcggcgatgagggggcggaggtagggcgcccactgccacgtggcggaggcgccgaagccgtggaggaggaggagcgggttccgcggcgggttggcggggacccagacgtgcacggtggtgcccgcgtcgtcgtcgactccggtggggagcgggatggcgagcgggcggaggccggccctgaggaagcggcggctgaagcagcggtcccgcgccgccgcgaagctgaggatggacgacctcctcccgatggccgcggccggcggaggtgggggtggcattgctcgccgccgaccgccggagagagttgcgcggctaaatttggccgcccaagcgtggtggtggtggtggtgcagcgcgagtgcgagaagagaagagaatggcacttgcttagatgagaatgagattagtgctcgtcattgtctgggtggttaagctgctttattacggttttaacagagccaatcaccgtgtgtataacgtgggatggtcacaggatggaggtcggcgcgtcgggacgtggcgttttttttttttttttgggcagacagaaactagtgctacaaaagccggcggcccactcgaatcgtcgaatccaaaggaacccactgctcctcgatgcggagccgcggagaagacgcccactcgtactcgtggggttgtgcgggcagcgcgcgcgcgccacgtgccgccacgcgtgtcgcggttcttgaatctttgagacgccatttcgtttcatcatttttccccctctacgcagaggcgccggcggccgtcgacggagccgcaagcggtaagctgcttgtttctctcggtggacttcaggcctcatcctttctcagccaaaatttttgaattttaattttaaatttaaagttgattttaggattttattaatcgtagtttatttttcatcctttatttttagatcattaaatacatgtatataaaagttgtattcacatttttttttcatttgcaaatatacccattttgtttttttctcttattcgctaaacgatggggctattcgtcttagaccattaagaacatgtatataaatcttagaccattaagaacatgtatataaaaattttattcacaaattatctttcatttgcaaaaatacccatttcgttttttctcttattagatatatatataaacgatggggctgttcgtctaaatgacagggctaccctgagcctgaggccagaccgccagaggaacttccctgggaagaggatcttctcatttactttcctcgctaatatatggatttgttagataaaagaatttatatgttagtgacacaagttacgtaagttaaaaagttccctatctggctgcccaggcttgacacctgctagaccgctagaaactatcagaagatcaaacttcacgctcatatcagctggagggaaagtacaatcacaccagaaataagcctggcatcacgttgaacaagccgttcaaccctgatcatgcgaaccacgagtagcaagggatcaacacgcacttgtttatccaaccaaaggggccgttgttagttgtaagtagtaactaagtagtaacgcacagtgatgggcgatatactggtgaataacaagagtgtctgataaaacatgagactactgtatcagataaaccattcattctgtgcaaagaacattttcatagtgctctctgtatcaaaacaagacgcgctactgagatcaaggggaggagaggagaaaaacgaagaagaaaatagggctaggaatattgagctgagctgagctgagagtggcatttgcccattacaaacctccattagttacagacatcaacctgtgatggggactgttccccaatccccattagacgtttcgtattggcagtgtataataaaatcaggcaatataaatggccaagaatggcaatgtgatgatggtactctcccaaaaacttctaatccatacatgagagcaaaggcggagaggaaggtggattccactagctagatacgtacatccaccacttgtaaaggccaaacccatagattgtcgtaagcatagccatccttaggggatagggcttaaatctgcaggggagaagataaaaacatggtcagtcagttttctgattaatagcacagttatatgaagctaaatcagcagttgatctaggacaatggaattaactgtctaagcatagtg

SEQ ID NO: 79040 - DNA, 33031 bp, Oryza sativa
ccgcctccctgaaacgcacgggaatttcagctggaattcatacgggagaggggggcaaggaagaaaataccccagtagaagggaatagcaaaaccccacctggacgacgcccacacggctccctgcgctaggtcggaggcgccccccgccgccgccgccgcccccgcctcgggagggtagtcagggtgcacgccgaccgacgaggaggccctgcctgcctccgcgccaccggaggaccacccgagcgagagccagccgccgcaggcgtccacggcggcggcgaggtcggccctccccgcggcgacgagctcggcgcgggtggggaacgcccccggcttgtcggaccgccgcatgaactcgtagatcgcctcctcgaggtcctcctccccgcgggccgcattggacgccgacaacgtcctcctcggcgcccgcgtctgcgtcggcgccgcgcgctggcgacggtagacgcggcggcggcggtggtgatggtggtggtgcggcgccgcggcggcgaggaggacgaggcgtcggcgaggagcggaggcgggggctagggttagggttggggaggggagaggaggaggaggggtcacggggagggggaggaggagggggagcatcgcggtcgcatttcggtgctgcttctccgcggggggggaaacgcgatgggttgggcgggaggggggaggcgacgacacgagaaagatgaggaggagggggggagcgagacggccagccactgctgccaccagtggcgactggcgactggcgagcgatccctctgacgcatggggccctgggcacccaacccctgttgctcctcccttcttggacctttctgcactgcagagtgcagatcccaatttggcaatttgcaaccttagcaccgcgacctgctcaggtggctacagctagtagcctgcgtttatgcctgctattgtacaactctatccgtctcattttaagtgcagccgtgaatttatttgtttaatgtttgaccgttcatcttattttaatattatcattattatcagataaaaaatatgaataatactttatactccctccgtcccgaaatatagcaacctatgactagatgggacatcacctagtacgacctatgactagataggacatcacctagtacgacttatgtccagatacatcgtactagatgatgtctcatctagtcataggttgttatattttgggacagagggagtacattacttaaattttaaactttttcataaatttttcaaataagacggacagtagaacgttggatttagaaatacacagatttaaaatgggacggagggagtagtagtaacagagtagatatgcgcaaacaaggagcatgtgactgatggttggtcctttgatgcgacttgggattttgtggatatggaggagactgtacaatgtgccatcgtggcgttctctccctattttgatagggaacgagatcatatatgctacattatttggatttgagtcactaatatatggtttatttattatgatttatgtgtaagtgatctagagtcacctggcatcatggtagagaatccgtgtctatttgattgagctaaatatggtgatggcggtgactatggcaatgaaaaatgatgtcggtggtgaactggtgatggtaataaatagaactgcctgtgtttgtaatttaatgacatgacgtgcaaatttgtattgttgggttgttttgttccagttgtgtgaatgtaaatagcgttgatggagaaaatataatagtgtagtaaaaaagatttcatttcgaaattgatttggactacattgaaaaggctcatttgtgacatgtgaaagggaacacgggtggttgctatatccgagagatagacacaaacacctatgggtatgtccatacctctcacatccttgtcatcgtacgcccgacaaatataggacaacatcaacctcacatcatcgattcgttgataacttatcgtaaacatttgagaaatttttcagtgagcataaaaatgcacatctccgatgatattcaacattctccgcggcttgtctgattggattgccacgcaattcgttcaagcagaaaacggtgacagctttgacagtgaggagcatatgacaaaaaggccaagaggcagacacttccgttttgttattatgggctgaagagagaatagagaaagctggaaaatcacagctatggaggatagccggtgccaattatttcatcgttggtcgagacggttactggttactggatgcatgagaggccatgaagttatttccactgaactgattgtgtgagctggatggttgatgagcaaacaaacagcaaaattaaattttgagtttatgagtgatggcatggggtgtagacagctgcggttcaatgttaccatcggattctccgttcatcattaagcagttcttccatttcaaaattttgccaaaatttaagctggactttttcctcgggccgatttgagagacggctactccttgccaagccaacctgggattttccttaccttcgcatgctttagttcaatatagttcatgctgcgagagtacgccgtgccaaattgtcgatacacagattttgaaggcgtacctgcatatatatggattgagatcctctgacttcaagttagagaggcgtgatcattgacatgtggatccgattgccagtgacaatgacttcgactaccattagatgacatgttaacatcatcttccgcgagcacatcgtctctggccatcatgtccaaatgatttcctgctgttggttgaatgaatgtcagcggctgcaacaatattaaccatgtcaacaaatgtttatccaacaaatgggatgcaagtatagaagaatgttaagttctaatatgacctcgaaaatctgaaaaaacaacccttgtcaagacattccgaaaatctgaaacttttacggcagcttcggttctaacaaaaaaaaaaaagggaagctattgcagtagttccgaatcaaaggcaccatatcccgtatcttgaatttaagtagacatatcctataatatttccataactacaggcggtttcccatttaagtgactaaacaataatccatctgccacaaacatgccaaatcttgttgcgtgcgcaggatttataaccatttactagatgtgtagcctctttaacgtatcatgtttggctagtgctacatgaatagagacaccaaacgaacacatcatgaatttaaatataacggaattccgcaacagtatcagttaatctgtatgatgatacatcggttgacacaccccttgttcctgggtcaccacggggatcttctcgaacgagaagagggaggacaccagctgagctccaagctttggatacagaatcacttgcatcacccaaaatcaatgaggaaactgcatcaaaactgcatgcagcaagtcaagatctcgtgcagctgcactgtcactagaaagttcacccaaacataaaaggctaacagctccaagatagtgaagaagagctgcaactattgatgtcgtcatggcagctgatgacccaagtccagttttggcaacttcaggtttgctccagtcattgttccataattccattagcaacttctgaattaaatgtaattggacagaatggaggcagcgaaagcaatacttctggtctggagttagagggaggccacgtgcttcaatctggagaaacggtggaaaaagacaagttaattatttaacagcggcacaatgctccaaaagtgagttatattcagacataagttaatcatggaaagagagtatatttgcagtttataaaaccatgcaacccatccgcattgatttttaatttttatttttgcagctggttcatccttcacagttccattgaatatttatttgtggacacaatagaggatatcatatcatgaccacacagagtacaatacaaaaacttttcaactttataaagtacataagagaaaggatagacctcaaagcaatgccattacattataaccaatcgtgttcaatttattgcagttacagataggtgaaatgtaaacatttgccaatggaatgataattcaattagcagagaatctaacatcaccaggtatcagatatacagagagaaaatacttattacaaagcataaagcatatcttctcccttatggttctgcctgagccaccccttttcagtaaattatccgagtagtcatgaaaaattaccaaaagttttgttcagacatctatccaggaaaaaaaaatcagctgaaaattactacagattgtcaggagggaaagaatagaaggctttttcttaaatccttaattaggcactggcaagtggcaaccgtgtttgttagtgcttttcgtgggatgcgaagaaaatatatgttcaagattaggtggtcagcaaagctgaaagaatcaactagggccacgttcagattaagtcacacttctttgttaaattctaacctgggattggtgagttaagctcttggctaaaggaaagcaaatgcgtgacaacgcaagctaattcagaaaagaagctttacctgttctctataggaataaaaaatcgttgcaacctacaaaaaatagagatgagaatttaacaacgatacgaaatcaaattatagcgtggtattcaaaatgattcggacaggagcaaaacttgagactaaaatcgcaaaaccttgcaaaagcaaagcttgtccagtgcatccttcccctctttgtcagcgactgtcacttccgcagctgccaccgagaattgcactgtcttgttccacaaaagggtttgcagattccctgcaacatcaagtcattaaccactatcaccaaacatgattacatgaggtccaagtctccaatgacaactacagagcagagttctgctgcgcaaatggtacaatcccagcaaatgatcatggactacttaccttgaggacgtcgatttcttcggggagagcttgtaggtggcctcccgggagagctgaggagatgtcactttcacattcgtccacgcctagtagcaatttaccatatgggacaggtaccacacagagtaaggattagttctccctgatggtgatggctactaaattgtgtgagaaataatctggggtttcgggggctcacccatgcccaggattcgtcgtgggtgagctggtcgcggggcgggaggacgacggcgtagaagcgagcggtggtgatgaggacgaggccggcgttggggcgctccagcacctaggaaacctcccgcgacgagcaccttccccggcgccgacgccgacgccgcccccctgccctgccctgccacagggatcggtcgaacggtcagacctggatcgagggctaggcaatcgaggtcaagtagagaaagagaaacactcacacttccattctcggcttcggcggcgaggggggacgcgatccggagctcacggccggcggcgggaaatgccgggtagcgcgcgcggcgcggcgcaagcacgacgacgcacgccgcctttcgaggtcgctccgcttacggcggggcggggcataggaagcgaggggcatcgcgagcgcgcgggcgcacgcggtggccggggggaaggacgacgacggcggcggcggcgccggcggcgagatggccttttgcagttacgcgggctcgaggactgggcttggtgaaatggcctcctgggccatgaggcccgctactcttagcttcaatataaaaattttatcctcttttttgtttcttttttgtttaggacaaaaggattcctccgtttccattcatgaaggattcgaattttatcctaaaatataaggaatttgcatgtctaacgtgtactcctgatgactctttatatatataacgactttgtagatattaacatgcatgtcgtgtttaggcgcatttagattttagggcctgttcactttgctgccaaaaaaaaccttaccaaaaatgttggcaagatttcttatatagttaccaaaatttggcaacaaactaaatgtagccactttttttagcaactttactaaaatttagtaaggttgaaaatggcaccaaagtgaacaggcctttagaacacatgatgagtatagcacgatctagtttctatgtgcacaaaattactttaaataaaaatcatatgctacacatggtgtaaaccgtctttattctcccagtcttgtttggcactcggaaaaaaaaaggaattggctgatgttttccctcgttatgcatgctcacacacttttatatcctgtgcgaatgcaaaaaatcatgcttgaagtgtttatactttatagtgataaaaacaaattttaaaaattaattaattaatcttttaagtataacaaatagttaaatgtgtctctaaaattaacgatgtcaattatttattagtagtactatgcaacatatcgtaccatccaatatataaaccactccaatagtaaatcttttggaccagatattaatttcaaggtcatgtggaggtttaattgcatatatgctagtactatagaaatctaagcattagatctggggttgctaaccaatccaattaacaaaagacagccattttgctggctaattctcctgcagcacgtgcccaacaccgaacccgacatcccatttacttttaagcaattttcacaaaactcatatattatactcccttcgtcctaaattacaatgtataaatttttacacatgttttaatgacatactttaaccaataatttattatattttatattcctagcagatataaaattaacatcacattaaagcactttaaaatatgaatctagttttttactgaaagttaaactatgaatctagtgatataacatacataatatttagcataaatatatggttaatatgcttattagtcaaaaactaccaagtttgatcttcctaaaaagaaataggacatcctataatttaggatggagggagtagtccaatttgttttataaccattataaccttatagagtcataaaccacaacattaaacattttttctttgactagtaaggtgcccgtgcgttgcaacgggaaatgctatatatcaatttcaaattatattaagtgaaaagatattaaataatcattgagtgaaaatttattgaacacggaaaaaaaatctggcaatccaaaaaaactacaaatcataattgttctatagattactttcaaagcaagaaatatgttatcattatagaagtatagtgcaaactttctgccacatatataaaacaatctcatggtgtttattaaattataaaaagacaacatagatagaagactttcttatggatgatcacctcaaaattaaattactacatataggtaaataactattctaatgttgtgcacttgcgatacacttaaaaaatcccgtgcaccgctagggtgttgctttcacactcattttgttggtacatcagtagatttagcaaaaaaaaaattgccttagctcgtcaccatcctggacatgttaaatatttataattataaaatatagttacaagcccgcgctagcgctatggtgacgatttatatcgtaaatgaaacaatcataagattggctattaagtatgtcgacgtttgatgtcacgactacagtatttggacagtatggggatcgttggtgctaggatatatgcgagactgaggtaaaagagatggtgacagggatttttatacaggttcaggcccctgagctatcaggtaatagccctacatcctgttggccggagccgatgttgctttttattcaccataatcacaccaatacaatatgtggggtagcctatctaactattgtcgacatggcggtctgaaggtctgactcgtagttgacaacagggtagccttcctcctcgagctcgtgcccgacggaatcagagacagtgctagatccctacggccggcctctgaaggtaccggatagggtcgatccaggcgtatctctgatgtcgatatccgacggcttgtcttggcgtatgtaggcttctatgttgattgaggtggccgtgtctcttccctccctagggggtcttgtatttatacccatagatgttccattatccaagtagaactagggaaaccaatatggatacaatccgagtagtccttgtcgtttccatgtagaactctggttgtctttccttaccggaactcctcctatatctgaaggttgtttccgtataggacatgatatgtggtgggtcctgccgagatttaagtcaacttctattaagtatgtggtatctcataaccatgacaaaggtatatattcaagacattaattaagacttaagtatcagatagttcaagcaggcaggtttaatgagctgagtacagaagctctttgtcaaaatataatataatacgcaattcttttaaagaatagaccacgctaaacttattgcaataagtttcggtccatttttgcaataagattttagcacgatctattcttcaaataaaattttcaaaatggtcaaattgtcaaaatttcagaaaatactctttgtcacaatataatgcaatatgcaattctttataccataaatactgcttaaacagacaaaacgctaattttagcgaagttacattaagaaggttttcacttcacgtcagaccagcacaaagagcctattacaaggtccttagttttactatagtgtaataaaccagcagccaaagaaactacatccaagacaaggtccatgattcagtcgacgatgttttatcaactccatgttatgcttgatgtcttcagcgtctttctcccacgtctcacgccagtaaccaaagaacgaaagtctgaaccaatttcaggacacatccaatcaatttgttcgaatacataattcatggcttttcaacgttaattaaagcatcacattcatatatcagtacatgacatggcaaaccacaaagccaaggttgccataatctaagctacgaccaaattacagaaatctttgcatttgcgaataaatgaccaagagagaatagattaaatcgcatgcactatttcagacacgtttggtattcacttccaaatatgagagtatgtactaaaccttaggagatatatgattgcgtccatattctaatacagaagtatatgatacttgcttcagataaaatctgacaaggagaacaaaagttcaaactcgtcataaaaaaatgtgtgcgtgttcggaagtaaaattataaaggtaccattttgccatcgttctgaaggagctaactctgttattgaatatctgatcctttttttcataaactcactaatacgtatgagctagctttgattgatcatcatcagctagaagtgaaattgtaagtcaatagtgaagataaatgatggtttagagagagagagagagagagagagagagagagggagagagagagggagggagggagagagagagagagagagagagagagagagagagagagagagagaggggagagggtggggtggggaagggggatgaactcaccaaaatatcccaactgcatacaaccatcaagggtcacgcattcgtgtgtgatagagagctagctaaagggctggcacaggcaacaaaatcaaggcagcaagtgccagaataatgggacatgatcacattcaacgacaagaaatatatagtattttccgagaattgcccatcctctgctagaaaaattcccatgttgagctattttgatctgaatccaaagaaactattaatcaaaaaagagaaggtgcagatttgcagttcactgggtacaaaagttagatgcacctctttaacatttagcagattgctctcgacatatgacaacaacttcccagtcaattgagctattgtcctttagaccctcaaacagctcctccttttgtgtatatatgccttcattatatatatgtctgaaaaaaaccaaacaaaagggggaaatttatgaacatccctgctagttggttattttacaaggcattggaaaaaataagaaaaaaaatatgatctactccatagtaatgacaccctgaaacaaacagatacaagaacaccaataaccgagcacatgggaaatcctaataattaaattgacaacacaaaaaagaaactaccaagaccacaggcagcaagcatgacttggagtgaagaaagctgctaacaacatagggcaggctcccatctgccaccagccggctcagattgcaccagcagcaagcatgttggagtatgcagcaacaatcatgaagcaggataggcttagttggtgatcttggggttggtgtggttgttcatcttgagctgaacaatacaaccataaaatgttagtcctactgctaggtatgaaaactcagttcaaatttttaagaaggtatcagatctatcacaactgagggttattaatagtagaaaatgtaagcagtgtcaactgtagagcagatttacaacatattaattcttgggctagctttaacatatgttatgcagatttacagagatgtagttcactaattaataacctgcaaatttttgtatttgtgcaatggccatctatgagaatttcaggatcgatatatcacgaacattgcttacataatcttcactgcatcgttccattttttattttcatccactctgaaacaatcaaggaccagattagttttgagactgcaagatccaaattagtttgctccaacatataatttgaatctttctgcttggtagcaacactctcaacttcccagcagttcatagccctagagtctatacatagtaattggatatttcattacattagcataaataacaacagagagaatcctgcaatcattagtataaataacaacataggggacatgacaatatgacattctcacttacagagaaatcaatttctggtaatacattggctaagcagcatttcgttgaacaccttttgggcaaaaaagagcattagtgatcctgcaatctgtaataaccctcgacactcacagtgatgattcttgacaaatgaatgggttgcaacgtaaagagaacgaaccaattaaccatgcgtcccttctccggcagaagttctgccggagggatcgtgctcggatggtaccgggggcatggagcgctggaggcgggcacaggtgtcacctctcccatggagcgggcgaggcggctgggaagcagattggcgaacctcgcccttggcaccgacctgggcgaggggcgagtgagggatcggcggcggcgttgatctgggcaaggacgaacaaccccgtcgcaccttgcacttcattctctccctcaacgcctggtagtgtcaccgcgcgcagccgtcgttggagtgaggtcttcaacatctcccatctgtcggctgttgtggcgtcgatgcagggtcagcgtccggtccccaatcggcggggtgtcgggcgacgagcggtggcgacgagcgtgtgaccttgagaggcggaggcgtgcgatggcgatctgcagtggatggatggaagcgggggtgcggccgacggcgagacgcggcggatggatggaggcggtgccgggggggggagtgttggggcgatagggcgggagggaccgggagagcaggcggcagaggaggaatggatcggtggtgcgaccggcggcgagacgcggcggatggatggaggcagtgccggcggggaggagtgcgataggaggagcggcgatgtcgacccgcgacgacggcggcgtcgattcgggcgagcaggagtggcggtcggtgaaggcgtggtgggggcgcggcgaaggatgaggggagcggcgtcgacggttggatagcgagcgcgatccggcctgtgggggagaaaagtgtgattcgcggaggggaggagtgcgtgcgatgggatcctcagcaccgtccgatctgccaatcccacggttaataagtcgcgtgtctgctagggttggagtgactgtcaccactacagaattttaaaaagtagtagagatacaccatgcatgcatatgatatcctgcaaattatatccaaaacatatgttttattaattcaaccgtagtaattttaagttattgttttttattttttacaaaattaagatatggttaacattgtggttctataaaaccttatgaccaaaatacccatgattatacgaacatgcctaacctcctatgtagggatggtaattgtgcccgtttgcccgtttatccgtgggtaaaaaccctattagggttggttttgttcgctattttatacccatgggttttttattgggtcaaaggctatgtccgatgggtaaatgggcataggtattgtcagggttacggatagggtataccctctacccttagatatacgttgtatactgatacggtatacccgcgcgtatacggatatttcccgtgtacattaaggaaattcatcacaagatagatgcggaatccacagatagaaggagtcctactcggacagaactgggtcgttcctgtatcgtgtggggtccgatgtctccgagttctacttagagaccaactgacctgcggtataaaagtgaccccccgggaggacctaaggcattgaatcttactgccaacacatccaccacagcctacgaagtcggagcctacaagagccaagttgccgggtgatctagtcgaaccaactcgactacggtctcgtcggtatcatcgagttctgctattccatttgtaatctgtggattccattatataatcccatatcaactggattagggctattacctattaaggagcctgaaccagtataatccttgtttcctgtttgcttgatgtcgtactacgtagatcctcgtaccagcgtaccccaataccctctatatccggtctacgggtatcccccgtcgacaggtatgggtaacactacgtatgcccgctttgcccatttacccgtgaaatctaacttatattgtaggctagaagcaaaatccactagaatacatcactactacaaaatcaatttttcatggcgtcactctatttttttctctggcggccatacgcataaaccgccattaaaaatatattgaggggtgaggggctaagtaccaccagcgaaaatagattttcactagcggccgagttaacttaaaatcgctcccaacctcacacttctccccaaccttatccgctcctctcccatccccatcccatcgctcctacccatctctgtctccgtgagcccttcctcctccgctcctctcctttccgccgccgccaccgcgcgctcttcctcctccgctcctctctcgcccaccaccgcgcgccctttcctcctccgctccactcccacccgtcgccgccaccgcgtgcccttcctcctgcactccgctcccacccgccaccaccgcgcgccgtcgacactcggcgaccacgacgacgacgccggccgagagagcggatccaccgccaactcaggatccggaggctcctcccctccctctgtaccctctccttctcccagatctagctggaagggagtggttggcgcagaggaggtgatgacgcggtggaggaagaggatgaaggggaggcgcggtggaggaaagggtggggtgtgccgatcagcgacgggggtacacgagagctctggatctgtcgggcggcggcggtgctcggcagtgcacgggtgtcagcggtggtcggcggtgcacgggcggagagacgtgcgagcagcagagctcggttgcgggaggcagatggcggatccggcggcgactcgttcaagtcctgcattggcaagttctccatcggcaagccattaggcaatccggcagccccaagtcctcggatcgacgacggcgtggagctccttcctccgtgacgagctgccgccgtggagctccgtcctccaccgccgtggagctccttccttcgcatcgagccgctgccgggagctcggagccttgggttcagcaaccgctgctgttcttctcgtggtgaggcaatgggtgatgcatgctgggattgaaacattttttttgttccgcaggatcgacagcatggttggcaaaattaattttgatttttgtgatggtgaaattgcactgtgaggccaacatatttgaatcgatgcttgaatttgtgattgtggacttgtatttgtgatttggtgagaagaagaggatgcttgaatttgtaattgagggcatatctgaatcggtttgaatttgagtttttgtatttttgcaccggagaatattttcgcaggcgatcctcttaagaatgcgcctgtgaaaattggttttcgcaggcggccttcttaagaacgcgcttgcgaaaaattgattttcgtaggcggctcttttaataacgcccttaaaaaattggttttcgcaggtggccctcttaagaacgcgcttgcaaaaattgattttcgcaagcggtattatgaccgcttgtgaaaaccaatgattctctggcctttacttactggcggggctgctcagccgccagcacaaacctctttttaccgccagcataaatgtttttttaagtagtgcataagctacgttctttgttttatgtggttttctttttatttcccttattatttttctcccacttcctctatcaccgccagaggagagaccccacaccaaggcagagaatatttaatgttttcagttcgattcaaacttagaagcttgtagacttttgtttcactgattttgttgtagccggtaaacgggcacgcccgcgagcgatgggcatgggcaacaatctttgcccgtcatgtagtaacgggcatacctacgggcaagggtatgggtaggcactgcccgtgcccgtcgcacccgattgccatccctactcctatggttttttgcaacttaaggtttgtttgtatgactaccgtcaagtgttgggtagtaccaaattaaacataggcaagtttggcactaccaattgtttgattgggtaattttgtatttagtttatagtgaagaaagttctagactgctaccaaaattagtatgggtgctaccaaaagtattggcttcaatccaaattaaccaatagtagaacaaattttggtagcaattcaaaactgcccttaaagcataatactggggttttgtaaaaattatttatttcttattttcaccctcgacttaacaagaaataacgaagcggtgacgataacaagtcaaacaggatagcaatttgcttagcttggtgtggcccagtagtttagtttggagttgaaacgatgatagcgaagtgtaaaaggcggtttggatttctcggattttccttctgtgcagcttagcccttttaattagaacaggtcaagcaaaactttgagcctttcgttctgtgagactgatagactacgaccctgtttggatcagggcacatcgaatgcttaacactaattaaaaatattaaacatatactaatgataaaacccaggactaattcgcgagacgaatctattaagcctaattaatctatgattagcctatgtaatactacagtaaacatgtgttggctatggattaattaggcttaaaaaatttatctcgcgaattagctctcatttatataattttattattatacttctaattagtatttaaacattcgatgtgacagcgactaaaatttaattcctagatccaaacaccacctaactacgccatgatttggatttcatgacatgcaccaaggacacacattggtggatccatgtacatgattccgcacgtgtagaaactatagaacagattttctgagctaaacgtagcatccatgattttcacatatatagaccagcaagttaatgttacttgtcaatttcatgaaacttcaataccagttattatgattcttttgctaatttatttttgagataatccaagaaatatcattgacaaacatccaaatccaagaaatatcattgacaagtgtaagttttaagatatgctatcgtacaaacgactttgtctaaaaatgccatcgccgttaggttccgttcattccgcgccgttaaatactataggatgaacaatgcatttaacgacgtggattggatggaaccctaacggtgatggtatttttaggataaagtcgtatgtacgatggtattttttggaactcacacttgtcgatgacgttttctagatttggacgcttgttaattatatttctttattaatttataaaaccaataatctgggatgatggcgtgggtcccttcctcttccccttcagatgttgattcaatcttccacttcccctttatacgttgattcagcagtaacattttatgatttaatttctgtgatttgtttttagtttttggaggctgcgtttgtttcagcctgttactaatctctctccctcgttttccacgtacatgattttcaaaccgctaaacagtgtattttttaaaaaaaagtttctatacgaagattgcttaaaaaatcaaattaatctatttttaaaaaaatagtaatacttaattaatcacgcgccaaagaactagtctgttttccgtacagaggagatgggttactaacccagtaacgaacacagcctaagacttgaatggagtgtgtagaccggatgatgggggtcggcgccatgcaaattggctccaaagtttaagagcaaggataacaatagatctgacggcttattattagccaatcttaaaaccaatatatataatagattagctataagattggctacaattttcttctcccatctctatcttttacttatacatttattgtatttgtcttggagtttgtgttaagctagctcttgcattagagccaacacctttgatttttttatctctcctccatataagcttagagcaagtttaataatatagcccactactagctacaaatcatctatagccaatgtaatagccaattcatacaatagttactcactatactattaatatctagtcccacctatcatacacacattatgtcttggagtctgtgctgcagctggctacagatctgtagcccgctgatcttctctctcttcctttatctcttgaaaatatgtttatagctagcttatagcctgctattgtacctgctcttacagtaggtttgttcccaactccctactctcgttttccgcgcgcacgcttttcaaactgctaaacggtatatttttttaaaaaaagtttatatacgaaagttgcttaaaaaatcatattatctattttttaaaaaaaatagcaaatacttaattaatcatattttaatggaccgctctgttttccgtgtttactgtttgtgttgagaacatgttcgtgtgaacacaccctaaagactcagtgccaagttttgatcaatttatataataagcatgtgtttggtttggggacgaagtgggatgtgttgggttcatccctattttctggaatatgatggttctattttttgtttggttagagggatggagcgcaccctattttttgttttgttagagggatggagtgagatggaatggtcccatcacctgtttggatagagggataaggtgggatatctggataaaaatacttcctcaactagaattggtgaggttacttctcacatgaacaatatatttttagcacctacaaaaatttaataaactctcacacaaaaaatacattcgtagcagccccaaaaatttaacaaaaagataaatatgttgccatatcatgctcaagcactaattaatcatctcatcacaaattacttgcacacatcacaaactaattcttgctcacatgaaaaaaatgtctactgaaagaacatgtacagatctgaaacgaaatccccatccaatgctgtcgttgggattctaggaggattggagaaggaacatcacgcatgctgctgacattggaggccgacggcggatggaggctggttggacaccgccgtggccgccgacggctcacccctgctcgcgtgctcctgtcaaatgagtttccgcaaaaggtctcgaataaaaaaaatccagagtcagcagtcagcactcgggtaacgcaatcgacaagggttgagctagttccaagcaagtgtttccttcaacttctctcttcttttttttttttgaactgctgagattgtgttttcttgcacggatcctggtactatttggacagacgcaggcaggggaaccttgaagtcttccccggcacagaggatcgggtgtgtttcggggggcaacaaggtggcgtggcgtggcccccacatccagcctagaagtagaaggccgcgagacatcctggcctgacctcaaaagcagctccccccctccccagtctctcatccgctctaccgtgcgcgagcgagaattttaaaataacataactttaataaaaaaaatataaaaatacattttgattgattaaaaaaacacaaatttagcaccttatcaaataatcaatatctattgaacaatcattattcgatttgtatttatcaaacaacgattgttcaacaggttagggtggtctaccgaactcgataggacccacagcccacacgcatgcatgcacacacatcgaattctctatttttttaaactctatcgaacaatgtttgtttgacacggttattcgataaggtgttaaatttatgattttagttaataaacatttatttttataatcttccattaaagatgtactatttcaaaaagaaagaaagttccgagcgtgatgcggctctcgtgtggctggactgggacggcaggcagcggctggccacacgagctccgccacacgatgccgcggaccggaggggcagtctcgtccactcggtggacgggcggtgcgctctcgcgcgtcacgccgcgaaaaaccaacgctgcacgctatatagactatagccggttgctgacggcggctggtggtgtggccgaaagcgtgccggccacacgggcaaatagccatattacaataggggaggaggaggaaaaaaaaagaaactatatgctctgctttgagctttctggtggttgatggtcagttggtcacacaagaaaaaattgcaacttgagtcctcccatctctaaccgtttttcctttttcttccttttttctgcgtttcatttgctgtcatgagtcctgacaccctcctatatggaaaaaataagaagagtcttgacaccctggtcctatgaagctgtgctcgtactcctgtggcgtagacatgcaggtgcatgtggtaatgtgggataaagggcctgttcggctgtctggtacagccactgtacgtagctgttgctgctacagcagcagactcaacttactgtttgggttggctgcacaacaataaagttaagtgcagccgaataggcccataatccttgagaacgttagaaaccatgcaggaagcccattaaaaaaataatgaggtttcctataatttcgtatgttttgtttaagttccacacaaccccaagatcctatggccctctttgaaatggaaggattgtcaaaataattttagaggatttatttttctaaggatttttttaataaaatcctttgattcataggaagatgatatgaaaattttcgtaggattgttttcaccaattctttagggaaatgagcaagtgactagacctcttgtgatatttttatttggttgatttttttctatggtacaatcaactggctcatctttccgattattgtgttctcaattactataggattataaaacatacttcctccgttttatattataagactttctagcattattctcattcgtatgtctagattaattaacatctactccttccgtcccacaatataagggattttgagtttttgcttgcaacatttaaccactcgtcttattcaaatttttttctccaaatataaaaaacaaaaagttatgcttaaaatactgtagataataaagtaagtcacaaataaaataaataataatttcaaatttttttgaataagacgagtggtcaaacattgcaagcaaaaactcaaaatcccttatattatgggacggagggagtatatgaatatgagcaatgttagaaagtcttatagtaatatgaaagggaggaagtattattttaattcaaatgttttttctgttcctatgtgttttttcacctgtgtttcaaaaggggacttaaattactttttatggcaacctatgttattgaaatgtcgggcacagaacattttcagtgtaggagaaaataaccattttttcttgaggaccaataccaggggagtgaaacttgatatagttattgaagttcagagtcatcattactgaccggtcatctttatgattttgaattttatatggataatgaaaaagactagaagggcaatactaatatatatagagttaaaaaaagagaacaaaatattggaacatcactttgaattctacacaaacctatattttgtgcttaacataacattaatatcgagtgcatctttttctcttcacatgctagtgttttgtgagcgggcaaacgttgttccgaggaagtaacgcttaagccatcaataaaaactattttcacatacaatgttttaactgttaatccctctctttttaatcaccatcacatattatattatacatccccctcctatttgaagaagaagtacatacctacaaaaatgtttagtaaccttccgattgacaccctttatttattttcttttcaatcataaggactaaaacgaaaatgccaagaggaaaaaaagtgaaattccgagaagtacaagcccttgaagcgaaaagcgcaggtattttagctgccttgctccaagagagcagaattcctcggttctttcaaaacgcaagggaactaaaaacgaaacaacctgtaattaccatttctgtccctttcccctcccctccacgactccgccgccgccgccgccgccgccgccgccgtcatcgccgccgtcgccgacgacgaagccgacacagagccacacggcggcgcgctcgaagcaatcgaaccaacaagcagccgcgtcgaatcgcataggaggaagagagaagttgggggcagcaaccaacagctaggggtgggtaggtggtggtggcaaagcagcgggggtagcgggaggagaccggggcggcgggcgcgcgcggtgccctcgggagctagcccttggccccgccgcctgcgccgtcgcgccgatctccatcgccaccggcgagcagcggcgccgggggcgtcccgctgctgcttccgccgcgtgctctgagcgtctgattcccctcggccccgcggctcccgtctcctcgcgagctcgtctgcccgccgcctgcgccgatctccatccatcgcgagcagcggtgccgccgccgtcgtcatggtgagcaccccgtaccgacgcgcatcctcttcctttctcatctccatctcgttctacgcacacttttctcgaattcgcgttatccatatcttctcttctagatctgggactggaagctaggttttctatttgtcttaactttagtacgaaaacagcattttttccccaaaacaaaaagttaggggttcaactgaaattgctcatagtagttccatcattacttggtactactacacaatttttcattgctctcactgtagtgtagttacaaattgtttagctgcctagtttgccaccttacgagaaacctggactcatgcaaaattgggatagagcaacttggtttggagctttggatagtagtaacttggtaggtgaaatggctcctgcgagtgacatggatgacaacaatggttagctattatttgcggagaaattgattgtgcaataatgtgaaggacgcggaataagatgtttgcttatagcttcgtgtgaagcatggtattgtgttttacttttggtgtgcttgttgaagtttgctaggtgatgtttgaaatggaaccgtgccctttcatatgcattatgagcagtttttaggtcccgagtcctgacacaactttctgaactcgaatatttattcgaaaagctctaactaaaacaatttgaggagactgatattttcatgtttttgaaccaactagctaggattaagcttaaatattactgaaactctgcaaaacttaaatactaaggttttgaagcaactagtaaggaaatgctattatactttgcaaaacttataaatactgaggttttgaaagaactagtaaggaaacactattatactttgcaaaacttaaataccaaggtttttatatcatgaattcatgatactctgataccgcaaaagacaaatactaaggttttcaagccttaacaagtttgcacatcacaaaactgattttgacatattgcatggtaagtggactagtggagtgaatgttagcctgatgttttagtgctctgatttttgaatcttatcaatcttctagatgagaccccgtgtttttgctgtgggaaaattgcatgataaaatggtaggcataatgagcgaagtcggaattttcttgttaccaaatggtttatttcatgtgctttgtacgataagaacctttaatcatttctccaaaggctatacataattgatatgcatggtgtggaaaagagagacaatttgtaccttagaacaatcacctaaaatactatgaaaacaattgaggtaatgtgtctacatgagagatgagagaattagcacttactacagttagtgggaggcaactatgtaagtataggatacaatcattggaggaattgttaactaaaattcacctgcgagatctactatgaatccacctatgacctacacgttggaggaaaaaaaaagaagaggacatcgaatcactcattccactaaagcaaatcctgtgtttacctttcggctaaaatccctatttcttgaaaagccttttaatgatatgtcatatgacgtattcgtcaaccctgagtgtctgatgcttggtaaagttggcagcgatacgtcatggacgtctcctttttatcctctgtcatgtccaacatacttatgcatattctcagttgtcagttatatatgacaatttcgcaagatgtaacacaaccctctgcatgagaatgagggaggagtattagatcatccatcaaagccttaaattattcttagttctgttttatctaggcatctgtttgattactgcaccatgtgttttgcaggggactcctgttaatattattgttggttctcatgtttgggtcgaggacccaattctagcctggatagatggagaggttgttagcataaaagacaatgaagttcatgtgcagacttcaaatgggaaaaaggtacagtttgcagtttcttatcttgcattctgcagatcatctctttctagttcttagtatttccttaaaatccttcaatggatctattttgctctgttttaatgtacaaggagaacttcgcaatactgtttgtttagttatttatatgtggcttcattgtaaccatggattgtatcattttgacataaaatggattacgagtttcatcacaagtaatgcttttgcacaggttaagacaaataaatcaaaagttttccccaaggatatggaagctccaccaggaggagtggacgatatgacaagattatcatacttacatgaacctggtgttctacagaatcttgctacccgttatgagctaaatgaaatatatgtgagtgccttatcatttctgcccaaaatcttactttagatgcactacatgactagcgcatgattatcattctgttgcattcccagacttacactggcagcattttgattgcggtaaacccatttcaaagattgccacatctctatgatacccatatgatggaacaatacaaaggtgcagattttggggagctgagtcctcatgtcttcgcagttgcagatgttgcttacaggtgaactgttgtataatattgatattgccatatatatgatcctgtcagcagattgtactttttatatacctacatttccctgatatgacctattaatgcgagcaaccagagcaatgataaatgaagggaaaagcaactctatattggtcagtggtgaaagtggtgctggcaagaccgaaacaacaaagatgcttatgagatatctggcacacttaggtgggcgatcaggagtagaaggaagaactgtagaacagcaagttctagaggcaattcattagccttctctttgtctgcatagtaatttatttttcaaataaaaaaaattccgttggctgattacctaataactgatataatttcagtcaaacccagttcttgaagcttttggtaatgcaaagactgtgcggaacaataactcgaggtaagttaaccttgttgctttcattttcttttcctttcattgacacttcttgctttatttggacatcaccaattggttttttgacatcctcatttgctttacgattctggtaaagtcgctttggtaagtttgttgagatccaattcgacaagactggacgcatttcaggagctgctatcagaacttacttgctggaaagatcccgtgtatgccaaataaatactccagagagaaattatcattgcttttatttcctttgtgctgcacccccagaggtatgttttcctgttgatttactgatatttgtctgatattaatctctgtttcgaacgtggaactgaatgtagcctaaagggtattctttactatggatatacatatgcaggatacacaaggtataagttggccgatgctagatcctttcattacctcaatcagtcaagctgtattgaagtagaaggaattaatgatgctgaagaatatttagcaacaagaagggccatggacatagttggaatcaatgaggaagagcaggtttgtattgtattgtgctgaaggcctgaagctgttggaaatactagtttgaggactaatggtaaatacgtaattaccaaattgtattacaggaagctatattcagggttgtagctgctatacttcatcttggaaatataaattttgctaagggaacagaaattgattcatctgtgatcaaggatgacaaatccaggttccaccttaacactgcagcagaactgttgaagtgagtaaatttcttcttttattattttcctatatgttcagggtgaccaaaaatcatattgctaacgactaaaatttcttaaaggtgtgattgcgataatctggaaaaagcactgataacacgagtaatagttactcctgaagaaattataactagaacacttgatcctgcttctgcacttgttagcagagatgcattagcaaaaacaatatactcccgattatttgattggtaatgatcctttccctttgccctggcagaaaaactcaattagatttcaactatgcatcttgacatttccccactattactgttatcttcttctcaggattgtggagaagatcaatgtctccattggacaggacccaaactcaaaacagttgattggtgttcttgatatatatggttttgagagtttcaaaattaacaggttagtgttttgcacctttttcaaactaggccaaaaatccatttcataacatacgctaaaacagcaacgtgttgcactcctctaaacagttttgagcagttgtgcatcaattatacaaatgaaaagctgcaacaacattttaaccaggtacatcttgaatttgttcttgaaagagggctttgctctagagattgctggtttgtgtctaacgtgagatgtttgtcctgcagcatgtgttcaaaatggaacaagaagaatacaccagagaggagataaactggagttacatagagtttgttgataatcaagatgtgttagacttgattgagaaggtacacatttcatcatatcttacatgctatgagatggcatattttggctatgcaaatgtataccaaaatcccttagattatggggcggatgtagtataatataagctcttcaaaagaatatatattacaagctaaatttatctagttccactataagcttttcggaatattagatgaagagatgggataaaatttcccaaaaaaacctattctcatcctacaaatgatggttgggcaacaaggcttgttcagctgttcctatggggttatatctgcagtactattcctgccaataatagtgtcagtaattataaatcagtaagaaaatgatccaatttgtgttctcattttgaaatgattatcatgtaggctcctagtctgtttgatgtttgctgctcgagatagcttaacttaggctagaggaaaatctgttttgtaagttttgaaccttcagggccctaccatctgggagtttactgatttcatggattaattaaattaatctgtttatttggtgttatgtccttaggttgtaggtctttttggtaacattgtacttgcagtgcatataatgtttcaacagacttgtgtcagatagtatgtggttggtagaagaaagtctcctagctataatgagctttacagattcccttcatacgtgcgatgcttctagttctaggatgagctaaggcttgtccagacagcatattgcttgttagtatttgattgtggaaattggaaacaacatattgcttgtaataaccttttattttggagttctataaaatggcaataacatatgtttccgtactcgcagaaaggtggtttgatcgcacttctggatgaagcatggtatgttctggaattcacaactatcattccaaaccacttgcaagcaacatatatatcttcaatcactataacatctggatcaattgtagattatctcaatcctgtgacatgtaactgcttgcgaattaataatgttttgcaaattttgttcgcagtatgtttcctagatcgacacatgagacgtttgcgcagaagttgtatacaacatttaagaataacaaacggtttgccaaaccgaagctttcacgcacagattttacaattgttcattatgctggtgatgtaagccttcttcattaaaacatatgtgtattgttacagaaggtaaccatcatactaattagacatcgttatgtatcatccacaggtgacgtaccaggctgattttttcctagacaagaacaaagattatgtagtggctgaacatcaggatttgctgaatgcttcttcttgtcctttcgtagctgctttatttcctgcactccctgaagagactgcaaaatcttcaaaattttcatcaatcgggtcacgtttcaaggtgaaactttacttgattttgttctagcttccacaatatggttggaaaaatttgtagtagcatacaccttacttatttacacatcctaccttgtttgtagccttaaaatggtaccaatgtatcgtatcagaagttatctagttaatacgtgcatcctttttaaatgttatgtactacgtatgtcgctgcatcagtgttattcaaaattcctagcatgtgagttctcacatatccttctgaccttcccttcgtactctcctttggttgccataatggcggcgtatgacaacactgttgctcacttcctcctgctatacatagtgacatagtcattaggtctgcatgtatatcgtacagaaaaaaaatggtgttgttacatctgtaaagattgctcaagtcttcactaattatatttataacctctagcaacttagcaagtcaaacaaggcggtccctctgtctcaaaatgtaagttatcgtgcagtcaaacttctgattcatgtaaaagtatatatagattcgctgcatgctaatgataccattcaatttgtcttcctaaataatttcatgtgataatataaatatgattaaaattcagtgcagaagtcttgctttatttctatctgggaaagtatatcttgtttacagtgctgctgaccttttttgtgtttacattcctgctgtccaactctcagctgcaacttcaatctctcatggagaccttgagctcaacagaaccccattatattagatgtgtgaagccaaataacctcctaaagccagccatttttgagaacacaaatgttatacaacaactgcgatgcggagtaagattcacatgttctattattgtttttatgctagcttctggtgaactaatcctgacaaaatgcagggtgttcttgaagctatcaggatcagctgtgctggatatcccacaaggaaaacattctatgaatttgttaatcgctttggtgttcttgctcctgaagttctagaaggaaggtaagaaatccagttgaatagaaaacatagttttttgttgcataagttttttttttttgatgtttcaagctattcacttttatcttgttcttgtacctagcaatgatgataaaattgcatgccagaagattttggaaaaaatggggctggagaactaccaggtaatacatgcaactaggccaaatgcccatggtgtatacatgagtttgcgccattgtgttaacagaatcagtgaaagcaatgtttgaaaaagatgcatgctgtgtatacacgttttgaggttttattgttgtcgtctttgggttagctcttacataatctcttgattgtctttcagatcggaaaaacaaaggtatttctgagagctggacagatggctgatctggatgcacgaagagcagaagtgctaggaagagcagcaagaattatacagagacaaatctctacatatatcgcacggaaacagtttgtttcgctcagaagatcagcaacacagctacaatctttcgttagaggtactcctccccttctgtataatgcagtttctgcagcactggacagattttatgcagctgtccttttccctttttttttttgtaatctagggaccttggcgcgtaaattatacgaatgcatgaggcgggaagcatcagcagtgaagatacaaaagaatgttcgtcgtcacaaagctcgcgtgtcttatttacaactacaggaggctgcaatcacgttgcagacaggattaagggcaatgtctgcccgcaaagagttcagattcagaaaggaaactaaagcagctgtccatatccaagtatgtacggtttcaattacattgttttgtaatagtatttcatcaattttacaaattatgccatggcttgagaagtttaggtccatcatgtttctgttctatttgtagttttcctttgttgttgttaaaacacttattgtaatattttttgatgaaacacattgtaatattgtgttatggcatttttaaacataggctcgatggcgttgccacagagactatgcacattacaagaatctgcaaggagcagctcttacttatcagtgtgcatggagacaaaggcttgcaagaagagagcttagaaagctaaaaatggtagcttgttatccctttgcaatcttcaaatattctttaccatagtatatgtcatagttgtgtttatccatgaatcgtctgcaggctgcgagagaaacaggggcccttaaggaggccaaggataaacttgagaagcgtgttgaagaactgacatggcgccttggactggagaagcggttaagggtatgttgaggctgacgtgacactatttgggcttggtagtttggtacttgatgcttaagtgtaacattctcaatttgcagactgaccttgaggaagcaaaagcccaggaaattgctaagctgcaagagacattgcatgatatgcaacagcaagttgaagaagcaaaggctatgattgttaaggaaagagaagcagctagaaaggcaatagaagaggcacctccagtaatcaaagagacccctgtattggtcgaagacacggaaaagattaactcactgacagcagaggttgaacaactgaaggtatggtagaatctgaaagtggttcctagtagttggtgcatgcataaatacagccttatttttacactgatcttttaatgaaatgatctttagctgaggcatttttcattgacaacaatattagcttgccttgtgaaaatttgcaaggtttatgccatacttttgcttatcttatgaaggaaatgttattaagtgtttagtgaaaaagaggtcatgtggtttttgttatgtgtgctaagtttgaagaaatccctatacgcttagaaatcccatttccacaatttgccaccctcttcagaaaaagactgatggtagtagtggaccctgtgtatttggaattcaaaatatatgttttttgtatagttgaacttacgtcaagtttgaagaaatccctatacgcttagaaatcccgtttccacaatttgccaccctcttcagaaaaagactgatggtagtagtggaccctgtgtatttggaattcaaaatatatgtttgttgtatagttgaacttacgtctgactgtgatgttttcaggctttgctgcaaacagaaaggcaagcaacagaaactgcaaagaaagaatatgctgaagctgaacggagaaatgaagaactaatcaagaaatttgaaggtgcagagaaaaagattgagcaacttcaggatactgtccagaggtgaagtctaaacaacgctatcagttgtcattatttcatttcgttgtttgtaatgcttttcttttgttaaggatgatgcctctgtttatacttgtattaactcctttttcttcattctgaatggtctttatgtaaaattgagcacaggctggaagagaaagcaactaacatggagtctgagaacaaagtgctacgtcaacaggctgttgctatttctcctacggcaaaatcattagctgcatatcctaagtctcccttccaagtattccatgaccctgactacttgcattctgtattaatataattcttttcaaatttcacattgatggtctaatatttcaaatcaattgtgctttgttagcttaaaactccggagaatggtgtagctccgtatggagaagtgaaaccgttacctgtaagtggaaagaataatttgtgcatttgatattcattcaaaagttgctgatatttggtatctctgcataggatatcacccctatctcactcaaccctaaagagcctgagactgaggagaagccacaaaaatcactcaacgagaagcaacaggtgtgtttttctgtttgtttgacatttctgtcctgaagcaaatttcacacctctgtttatttgaccctgaagttatgactattgtgagttatttttcatactgtatttgttttatgcttcaggaaaaccaagatatgctgatcaaatgtgtatcacaagatctaggtttctccagtgggaggcccattgctgcttgccttatatacagatgccttctgcattggagatcatttgaagttgaaaggactggtgtttttgaccgtataattcaaacaataggcactgctatagaggtaataaataatatattgcttgtccattccgctttacctcctttttcttggaagttggaaagctgcatatgatattctgtttgcctattacagatatcttaggcttttgctgtagaaattgaaaaacagaaatactggagcttaaaatttttaatgctgctataactcgcaccctccgtccccccaaaaaaaacaacttctggggatactgtcagattcatccccagaagttgtccttttttgggatggatggagtatagattaaaattcgtttacccttaatgttttttatatccttaatttgctatatagctaagtttaaattcttactttccaaaggcccaggaaaataacgacaaactagcatattggctctccaattcatccacattactcctactattacaacgaacactgaaaacaactggagcagctggactcacacctcagaggcgaagatcttctgctgcatcatttgggcgggtgttctcggtaaaacatatttcatctctgtttgttttactcttaggattttctagtccgaatatcttttaattcaccatttctgaaattaaaagggaatgagagcttcaccacagagtgctggccgtccttttctggctagccgcttgatgggaggaataggtgatcttcgtcaagttgaagccaagtatcctgctctgcttttcaagcagcagcttacagctttccttgagaaaatctatggcatgataagagacaacttgaagaaggaaatatccccattacttggtctttgcatccaggtatgaattgggggcactagcttggtatttgtttataaaaagagagtgaacttcaggtttgttttttttgtgatgcttattttttgcaggcgccgagaacatctcgtgctagtctaattaaagatctcgttctcaagcgaatgccttggcccaacaaaccctgattgcccattggcagagcattgtgaaaattctaacgaactacttgaatgttctgaaagccaattatgtacgtaagcaatgtgttctcacatacaattttgattgagttgacattaacttgtgctgtattaaatgtgcaacaggtcccttcattcttaatcagcaaggtgttcactcaaatcttctcatttattaatgttcagttgtttaacaggtaagatttggtttttgctttacctgttctacgtactctccttctgttgggattttgagatgctccttatcttgtagtctgcttcttcgacgagagtgctgttcatttagcaatggagaatatgtcaaagctggactggcagaattagagcagtggtgtatttatgcgactgaggaggtatttatggaccttttaagtttcctggagatcattttaatcttgtgctaacatacgcattaatatacagtatgcaggttcttcctgggaagaattgaagcatattaggcaggctgttggattccttgtaggtgttctataccgattatttgttttgtttttgattttctggatcaaaataggataatctaactggttgtattattaggtaattcatcaaaa

SEQ ID NO: 79041 - DNA, 17928 bp, Oryza sativa
aaaatcccttatatttagggacggagggagtattataactaaaaagtaagatattgataatatatcacaagaacgtaaatatacattactattacattgcatacagtatgcaatgaggataaaaaaagaacttgggatacaaatgactcagattgaattgcaagcatcaactaaatcaattctatgctgaattgcaacaagcagaacctttcaaccacatcccatcccaatttaccccaatctgattaatcatggttttggtttgatcatgttttgtggatagatctcttcttttaagtagctaatatcatatggatgatataatataatcataggcaactgtttgtgtgtcacgatttcttgaaggttgtgctatactacacatgtgcataattgggtgtgttgactcttcaatcagatataactgactaaatttcaatggctgataggtttgaaatctgcaacattaatttttaacgtgaggcttcttaatttcacaggtttcttacattgaaaaaccttgcgtctgtttttcttcaacaagggtcagcattttatgataatgctcttcgttgttacctacaagctgtagagcttgatgcaaatgattcagttgtatggaaccatctgggaacactttcctgctctatgggtttgttgagcacatcaagatgggcatttgagcaagggcttctatgtagcccaaataattgtatgatgtcttttttcattattcccttctagtttattcccactgccttttagttcatctattgttcctaaaatccatgatttttttctggttttcagggaactgcatggagaaactcttggaggtgcttatagctatctgtgatgaagttgcatgcctttctgtagcaaagttaatacttaggagttggccatcacatcatcgggctttacatgtaaagaagaccattgaggatgcagaaccagtaccctttgcacctcgaggtatcgacatacttgaacccaagcatgcaaaactcaaattttgtaacaaaagaaaatctggagatgatgaaacgcatcatgaaacagtgacaaagaagagtaggcagaatgctaaattgcagttgactgaagccaaatggatggcccttttagatggtatcctaagcttcttaagttcaaacaacacaaaatctaatgaagatcacggtgccaatacagagagtcaatgtgatactaagaggagtatcaatgggtttgcttataacatgatggatgtctccttatctacggaaacattgaaaactatggaatctgcaggtgggaatgaacatgatttgtaccatgatggtgaaagtgtgctgtctcatgactgcagaactgcagttaaagagaaggacaccaattcagatagagaacatcctcatgaaaggagaagcacacgtcttgagaggctgcgaagtcgtaaatctggtaaagatgaacatgaatccaatggaaaagatatatcacatgctataactcaatttctagattcatttatcttgaagcgcacaagtattccagaaaagatcgattgttctggaaatggtgatgcttctacccctgaagctctaacatatacacctgatcgtgaggcaagtgatgtgaagcaatttctttccaaaatatcaaaaaattgtggacctcttcatattggctatatgttacttgaggaaatagctcagaccaacataccttttcaagattactttgttaagttcattgaactagacaaaattactagaggctgggctcaagatagatctgcacaatgcagcttatttcttgctgaattatactatgatcaagctctttgttctggaagcccattagcatcctcagagttgtccaattcatcttaccatctttgtaaggtcatccaatcagtagctttggaattgccattcagaacctctgatggagcagcaaagtccaccaatttggatttgaatatggaaagccatatggaagaggtgtgttcaagcgataaaactgagaagaatgcctcaaatatgtccagaaactctgtaaattctgtcaactcggtttccagtaacattctttgtgatgaaacatctgaatgtgattcttcttcaaacactaattgtgttttctggattcgcttcttctggctgagtggttgtctgtccctttcatcagactgcaaagaaaaagcttacaaggagttcaacattgccctgtcacttatgagaagtagcaacgaagccaaaatcaatagagagtttgtccttctacctcacaataagcttgtaaaattgcttacagctgataggattcttcgtgaaattaacttggtcaagcttgaatctttactttggcataatgatgaaaacatcaataaaataactcatacagagttcatggaattgcttcctccacttttgctttccaccaaagatgtctatgttggcagtgcatatggtccaccaagagaaagtgagaaagttatttcactagagttaggtgccttggatgttttaatatcagcatgtgaaaatgctaaaccaatgaacatccaggtataccttgactctcatcgaaggaaaatgcaagttctaactgtggcagctggcatggttggatcggttaccaccaatgaggggaaaaaatcaagtgatatagagtttatggaaacaatgaataggaatcgactggaaagtgttgtagaagcagtcaaagatgtttctcgaaatgctagtaaagcgaaagcctttgttgatcagtgtgataaccctgtaagttgactgttctattttctgtggattttcttgactgtcattttaattcaagtctttcatacttggaacgctatctaccaagcttcacttttatattataggtcaatgcacaacactgcaccagactaaaagaatattagaaacaaggtataaaggaagaagtatgtgtggagctaaatgataatttcataaaattccgtaggtctatataagttggtgaagctgcatagaacagtggaggaggaggaagggaggaaacttaaatattcttattttatttattttgtggagaataggcaggagaactgtgtatcattgcggttagaagtgagctaggctcaagtatagggacacaccgctaagctaccagagagaaaaatgcacacaaaaaagaagctaggtatacaatttaagaattggtatattggtgactgccaaacttttttttactttgaccatttactcattagaaatatttgtattgcatgctcattgagtgctgtgaaaaataacctctatctatgattttaggcttttagtaacatatggtaataaataagtatcttgcagacagtataaaggaaattttcatgtttattttttgaacaaaggaatagataatactatgaataccataaatgatcacagggaattacaatatgtagaattgtatagcatgtcagaggtaaatcttttgagcttctctggaacatcaactcgcccccgagctatctaatatacaatttaacccttaaggatggttgttagggtaaaggttatgctgtgcattctaggatggtttgtactgtccttcctgactgtttactgctttatgtggaagttgtttatcaatggtgtgttccagtttagcttaacactaatgctatccagcatgagtgaaattagtatatgagcaattgtaagacgcccattattctgagatttttcaatttcatatttgtttctatattgcctgtatcagtttctttaatctatcaggctgaatatctatatttctaacaatctcggggatattattattgattaattcctcaaagagggctactgaaacgactgttttattgtcatatttgcaggatgggcaagacggtttcagttcactagtttctattgttggtgattttcaatcattgctcctcacaatcatgtgtgctgctgttaagatgatcctatccagaaaacactcgtgtactggaacctcctatcaggctgaccagttggagagttcctgccttgttgatgcagccatcgcattttgcaaacttcagcatcttgatcctatgatatctatcaaaattcaggcacgttctgcgcaccactttaccaaaaaactctctagtattgattttcatgattaactttagttgcttttgttcacatatgattctttgcaggttgacttgattgtggcagtgcatgatttgcttgctgaatatgggctctgctgtgctgggcgtgatggtgaaggggaggaagggacattcctcaagttcactatcaagcatctcatggcactagatgtgaaactaaaatcccaacttagtaggtgtttcctagcaaatttattatggtatcatgtttctgtcccaattaattactagaatttgtttattatctctatcttattgttagatccaaatgggatggaagaagatgcagcagaaaatgacagagcagaagatgttacgactgatgaggcatctgtttgtgacaataaacataattctgaggatgaggaagaatctggtaggccatattcattgcgtgtaactattccattttcctatatatcttgtggtagacatgatgtacaatgacagacaatactgtctgattatgtcgcatgcatattgacttactgacacgtaaatgcctggtgatatagtcaaattagaatccgacaaatgattgaataaggtttctgttaccgacttaccattgaccctgaaattctctgtttttgcagaattggatgaaatacagtcaagcattgacagtgccttggaccaggcctttttctgcttatatggtttgaagataaaccctgattcttgcagtgaagatgatttagcagtacacaaaaatacaagccgtggtgattatcagacaaaagaacaatgtgctgatgtgtttcaatatgtcctgccatatgcaaaagctctatctgtgagtaaattcatattgagttccttcattttgttgtttcagtttggtaagaagcatcaattgcagcgcatagtgccttggtcattctttattcattttcttcagaaaactggcttggttaaattacgaagagtgctgcgagctatacgtaaacactttccacagccaccttatgacttattggtcaataatcctcttgacaatttcttggatggacctgattcatgcgaaaagattctctctgaaatttacgaaactaatggatctaaggaagctgtcctgaatgtactgttcccaggtgaaaatggctacgaagcattcaagaaactgtccaatgctaggttggctttgtgcattgtacctatagtccctcctctccttttatttttcttttgcactggaacaagtttagttgtggatataccctaagtacatttttgactgattgctgcagctcagagccatactcagaagtttatgggaacctgtatcactacatagcgcaagttgaagatataagtgcctctgacaagtatacaggttttgtgttaaaaaaagaagggggtgaatttgttcaacagagtgctaaccttttcaagtacgatctactgtataacccattgcggttcgaaagctggcagaagcttgctaatctgtatgatgaggtatgtttatttggttacagcagttgattgaacctgttccattgtatcatgcatttctgttgcataacaagtttttgtcttgttcaaaaacaggaggttgacttgttgctgaacgatggtagtaaacatattagcattttggactggcgaacaaatacaactttaatccaaagagttgagatgggtcgtagacatagtcgacgctgcctattgatgagtttagcattggctaaaaccgcttctgataaggtgtgtcctcttgttctgtactcatctatgagatgccttaggtgctatttttcttctttctatcttgatgagaacttcactaatattggcaatgacgtctaactcattttctttcaggcccaaatgcatgaaatgttggccctagtttattatgatagcctgcaaaatgtggtacccttttatgatcaaagggctactttgccagtgaaggattcaacatgggagacattttgtcgaaattctatgaagcactttcagaaggcgtttgaactgaagtaatcttacataccttgttagtaatctcatattctgtgtgttgtttgccacaagtaggatgataatgcttatttccttcacagggctgagtggctctatgcattttaccttgggaagttgtgtgagaaactggggcattcccctgctgaagcattttcatactacaacaaagctgttgtgttgaatccaacggcagtcgacccggtttacaggatgcatgcatcacgcatgaagttactttatacccaaggaaagcagaatctggatgctatacaggtttgtctaagattcatgaatcagtttttgcttcttttttttttctttgtaaaagtgttacgcacggttgggttccttatttaatagtttgtgtacagtcttaactaggctattgacatgggcactggccaagggccaaggaaagggtgcagccttaaagaggggcctgctcctcccttggcctcactggtctagcttactactagcagtttctggttttcccctcgattgtgacaggctagtttataatagatattttgatattaactctattgatttatgttttttaggttgttgctgattatacatacaaacagtcaaccaaggaagatgtcttgagcatgctacagtccataaataatgtcaagaattcaccctctgatcataatgataaatgtgtccttgatagcacagcggagaataagtttgttgaccctgatctacttgataaagtgtggcacatcctatatgatgattgcctgtgtgcccttggtacttgtgtggaaggtgagctgaagcatttccataaggcgagatacaagcttgcacaaggattgtatagaaggggtgaagcaggggacctagagcgagctaaagaagagctttcattttgtttcaaatctactcgttcttcctttacggtgaacatgtgggaaattgatggttctgttagaaaaggaaggtaaagtttttttgtccttgtgtaatgtcgtaattacccatttacaaatgcatgttgatttatccaaccattacagcttacaatattattatcttcccaaaaaaactctggtttaccttccattttccaggaggaaaaatccaaatattggtggatccaaaaagaatctggaggtcagcttgtcagaaagttcacggaaattcattacatgcatcaggaagtacatgatactttacttgaaccttttggagaaaaacagggatttgtggaccctagagagggcgtacacttatctgcgaactgataagagggtaccccctaataatcacaacaatgatgttgagctatatttgttttgtggatatattataataataagtctatttttcttgtagtttgctctatgcttgggcgatatcgttcctgttggtcttgggaagtaccttcaagttctaacttcagcaatccgcaatcctgagattcgtagagtttctggcgatgcttccgttgagaacctacttgagaaaatgtttggtgtgttcatggaccatgcaaacttatgggctgatataagcactattccagaggtcaatagtcccgagctatcagaaagcaatctttacaggtaattactagattagagtgcaaaatacatagttactcaagccagatggttttcatactttatttccttgtggcagttatatccaccaatacatccatttgcttgagagtgatgtccgactggatgttcttgaaggactaaatgagaagataagaaagcgttttaaaacacccaaactgtcaaacagcaatttcgccaagatatgcaagcacgcttctctggcatggtgccgttgtattctcatcaaacttgcatccatcactccactgcctgaatccatggaaacaactgatcagcctgctccactatccagcggtctagtgctttacatcgacttgcaacctgatgagcttctcatctcgtctcctgatgggcctgctcaattcaaaggcctcgatatgaactggtttgagacttttaacagaattaagaacattccgatcaggcaaacatccgaagataacatggagactgctgttactgtcatgaagagcacctacaacttctatcgggagagctcttgcggaacattcccatcgggtattaatctgtacacagtcaccccatcgcagccacctgttgaaggcctacagcaagccccagacgcaattgagaaccttgacctcagtattccaaggaagctccttctatgggtttataccttggtccacggccgttactccaatatatcagccgttgtaaagtactgcgatgagatgaaggtatgaacatgatgcccagtatttaaccatataaccttcccccttcacctcaactaacgcctacccgttcttgttgcagtcaagaagtaaaagaggagccccgacatcgacagcgacagcttcacagcaaaccacagtttctccccaaggtatcgcatcaaacttccgccatctgggtatcccttctttccgtacccgaaaaaatgcctaatgcatgttgtgtgcttgatgttataacagttggctccaaagagaagagcacccacattgaccctagcgaagctcaagaagcagcagcccctactccagctccagcagcggcgattgctccttcccagcaagaggcaggtgttgcagttgcaagcagccctcatgaggcccagaaaaccgccgccgcggcggcggcttctcaactcacccgtagcagctcatcgagggcgatggagagcactggtcaggatggcggtagaggaaacgacggcacggcttagctttgccccatgtctactggctgctagtaggctaatttctgcagtgtgtgtgtgtgtgtgtgtgtccatgtgaatatgtgtgacctgtgtggctgtgtgactgaccccctcctaatgttgatgtctcacaacgctgatgattaccgtcgcaggaaaatatgctgtacagttattgaaaacctgtaacagacagtagtggcatgcttattgtcactcaatttacctaccaagatataggtggaaacataggtcaagtgcgaataggttcacaacctggaatgttgttcttacccatggtgtactcggtactccttacccattagtgctatgtaaagctgcgctcataaaactgagtagttttttttccccgtaggtgacttgataacactgagcattaacgatgataaattagcatacccatggctcaattgcacccaaagaaattcagaaaaaaaagcaactacaaaaagaagaaaaaaaaacggtacagtacaaccccattaaacgggctggcccatcattaggcagcaaagcttattgggccggtccttggataaactccaatcgcacctaagcacaccgaggtcgccgcagaggcagcagccgtcagccaccacccaccgcgaccgaggaagaagaagagaggagatcaggaggaggggaagaggaagtagggatgggtttcgtgatggagttcgcggagaacctgatcctgcggatgatggaggacccggggaagcgggacgcggcgcagcgggagcacgtgtaccggatgaaggagcggtgcgagcgcaccaaggcggcgtggagcctcccgctccgcccctacggcttctggaccttcgaccgcttcaactcccagctctcctgggatccccagatcagccacgcccccggccgccgcgacccctacgacgacgtcctccaccgccactccaacccacccccctcctcctcctgatcccccgattcgatccggaataggtaacttgcccctcgatttgcttcttggatttctaggtttagttgttcgttgctcgattcccctcttggggaggtccaattaagcgattagggctcgtttagagggtttaaaatgtcttagctgttcgttgctcgattcccctttttggggaactccaaagttaagcttgcttgtcgaacattcaatgttcattgcattcggatagtttgtatatgttccattaggttaggcttggtcacctgtgagttgctaagcttgaggtgttcactgaactaatttccaatctgactgcactatttccaatctgacatcaccaacagccactcaaaattcaatcccctaaatcattttttttagatctctaaaaaggatttaaggtatgagtatagctgtatctccaagagattccaaaaatttaatccccaaaacaaaaaaagtgggccacatcgacaactaccaacagaatggtcattcctctcctccactcacgctcgcacacattgcatcttcctcccggctcctttcaggacattcagtgatcaatctctttgacatcattactgacagttgaagcattgaacaatgtttctattggcctcagctaccatctgagtatttgtcccaaaatgatatttcacttgattattaccacgatctcctgtattttacatggaaaaaatattggttctgcaatcatcaacagtgggggtgtcagcccagaaaaaaaatcagcttttttagtgtgaatggtgttaattaacaacatgaagttttcagcagcaaacaacaagatatttcagcagctgcaacagtacttttcagtactagcaagcagcagtttttagcggcaaagaacaacagttttcatcagccagcaaacaacaaatttccattaccagcaccaagcagttctcagcaacagcaagctcaaaatttgagcagcagcaacgatcagttttcagctatcagcaatagcaagctaacgaacagccatgttccatcattgaattgcaacaaaaaagcactgaccaacagcacttaatcatccaaggtcgaaaatatattgtggagaatggaggaaacaattatcttattaaggagaagaataaatatttgaatgcctagagcaagtttgagcaatactccaaatagtttgggatcattgacctgcaccgctgaacgagtcgatggtaaattgttttgacggacgaactcctcttcatctgggcatcaccgcccagagaccaatgaaatcgactccgaccgaggtgcacgatgattcgatgaaggccagcgactgggcacctccggctgtcgccggctggtcgcatggggcctttgtctcctgcacattaccagagggcgccgggtggccgggagcctgagacagtgcagcgccagtctgacacgagggacaggctgtgttgcgggacgcggtagggtcgagggacgattggagatgaatcggggcgacggccgaatcgattcggtggtggttctggtgggagtgccgacgaaggtctgcccaattggggtggagatgggtccggcgccgccactgagaaaaaatgtcgatgctgtgaaagcttgggggagccatggctgctttccagacatctgcggggaagatgaggctgctggcatgatggattgactcacaggcggacgaacgcacaaagaaaaacctggtaggaaaatttttacccagcacgcgcgaagtgcatgctatcgaaggattgggcgccgagtctcttccctacaagtcgagaacgaaatatacgggtttggaaacgccaagcttttaggggtgatttaggtatactgttggagcgattttttcctgcaaaactcctcaaaactggtattgggaagagtattgggaaactgttggccatgctctaatacatggttgattgaatagattcgggagatgtcgccggaatgtatcgagtcaaggacagggaaataatgcttgtttggaacctgtaggttcgttcaactattatcctgggagtaggttgttgactcatacagtgcagatggatgtcacagctctaggttttctttaaaacatgaagttgagtgaggaagaaggtgtgttaaatacttaatggtttcttaactttgttttggtgtcacattaaggaaacaatatttttgaatttgaatctagcaacttgttagctcttccaaattcatagatgatgcatgacgtgttggtaactatgcctgtattcccaagcggtgagactaagactttaaaattttctaactacatatatatttaacagactcggattttaaaattgagcctaaagtagttattatgttttcagttgacatatccaaaaaaaaaatcaaatgctggaacatatactcatataattgctgcatatgctagaactgccaactttagtaatattttgtttatgtttattcctacaatgcttttacataactttacccaccaaattgttggtatcttcaatagtatcttgttgatgtttggatggaagccttttttttccaacactatcaaaatttctctcctaactagtataaattttaccctgacaaagtttctcgcactatcaaagttttgttaggctagtgtgcttatagtttcgcattatcctagttttttatgattagttggttgctgctattaacttatagactcctgtatgtctttgatagtttgatttacctaattttagagacagagtatgtccattgggattcctagttatgaaaatgttcgatgggcctctatggtctggatgataagaaacaattatagtttgggcgctggagtcagtgtcttactcttttcatgtgtttacctctcatgaattgttcagctcccctaatttgaaataatgggatattatataggtatattttacagcgtatccatgttaatgttgaatggggagtaagtaccttgactgccttcattgctcttttcttttattttgaactgttggattatgatatataaatagatgctagtaaagtccatattaatgcttgacgggaatctggggaagtgcacactgagtctctcagacccaccctcagttcgagtatggttgctacattatcagaagcttgcaaacaaaagaaaaccaagttgttaacttcaggcttatagattgcgagcaaattattgcaatattttgattttccaatcaacctacgaaaattatagagttctttgggtgttcattttccacttgatctaacacatttgttgaacatggcaatagcctcataaatgcaagtagtttgttcatggaaaaatgctatcagctcagctattgaagtttgtctttagacccctgttgtggtgtttagtatctctgtttatgttgcctgatgataggatcttgtaaattttatggttttgcaggtcacccagtcatgtgttgttacctacaaaacctgtagtccatttgtgttcttcgtttatcttttacttggagcgtcagatgatttgatggtttcttaattttcttttctgcagatgccgttcgtgaggaagtgtggtcgcaataagaaacccgtttccatccaaatgacgtctttgaaaattttatccttgaactaccgtgctttggtcatatgctttctgtttggttaaaagctcagatccagaaggtcttagagaggccgttctgtatttccgttcttgattttactgttctgtatggctgtaccacagaaggttttaataatcgcactgaggaattgcttgcgtcattaaaatttgaaaaccattccaattgttgtggtatacaaagcttgctagggcattttcggtgcaatattatgatgtgttctttagcgtgggttgggacgtggtacgtgaaacgagtgatggattagcgcactactctctccttcactcacaaattgatcatcatataacctcatgaatacggattttattggagtgcaattcatgcatcacaggaggagaatacgtgcatgctaagggtgtacttgtgcattatacgtgcatgctaagggtgtacttgtgcattatcttaatcaatgtaagtatgtatattgtacaaacattatatagaacattatataatgatcaatttggaataaagggagtattaattaagtattagcttaaaaattaaaaaatagataaatatgatttttttaaaagcaatttttttatatgaaagctttgttaaaatacatgccgtttggaaagcatgtgtggggaaatgagggagtaaaaattgaaaaggagaaaagaatacaccctagagccaccgtgtagggcatctatttgtcagcgcgtagtagattgaatgctctaagggcaagcacaatgttggctgtcgagttcacaccctccacattgttttagtgcaccggaggggaataaggcaggccgaccaaaaaataagtcacctataataatccccatgactattgcgtggctccttcccatgacttcttcattttttaaagtggtatatgagcttattcgatgggtgcgatctagtataaaaatcttggaaaactcgtgttccgatacacaaacttgtataggtgcttgctaggtgttggaactaattgtctggataaaaaaaagttgtagataaatttatgttgtttagcaccaagatgtgtttactaccccctccatttataaatgactagtgaacttgcacgtgcaaggcacattatcataatatatattattgccaactcgcaatgtgaatcgttggatgagaggatctgacggttaggaacgtgtgggtgtactaaatagaaaactggtgtttttttatattaatatagattgatatagatgtatgtaaagtttttaactctcaatccgcttttttatctcttcgataattaacgggaaatcccgcctaagatgaaagtagccatcagtgacggccaccttcttgaagttgatctccgccatcaagaagctgagccacttgctctttagctccgggcaatggtacctctcggcgtaggcgcgtagcctagagtcatcgccaccgtctccaccgacacactctcccacagcttctgtgcacacatcagcttcaacctctccaatgcgtacctgttcgccgccacgagcaagctctcgaaaaatccggtcgtcgtcgacgttgagccggcaccgcctcggtcggcgacggcaaggcgtccatgtacacgaagtgtagtagagctttgaacgtggccgggtcgatgttgtgcagggtgacgcacggcatggtggactccgccatggacccgaggagctccatcttgaacaccggcgagcgcgcggcgagcacggcgcggtgtgcatgaaacgtctcgctgccgacggagaacaacacgtccgagccgtcggcacggtccgcgatgtcgtcgagctggccgttgaggttcgaccgcgggatgggtatagtgccgtcgtcatcaccggcatataatatatatttaagaaaagtaaaaatagggggaaacagtgtgcgcaaggatatattcatacactgacttgagaaacatggcaaggctgtgtccacacgctgaatttagatacattccatgttcacgttcacaaaataatctggattttataaatacctagaaatccaaatcaattgttaagcatgaacttgtataatatgaatttagtatgaatttgtagagaataaattgtaaccttaaatggtaacaggagtatattgtttacacaacctgcaagggccaaggtcagacactaaactcagacaaaccttacatccattggtgaatttgtaaaatttcagtacttgagctataagaactcataactttaattagctcgcagcaaatcaaaacattgagcaacatgtagctatggtcatgtagttgtcagagggaatatagaactgagagatcaagcaatatgtaagtacaaacatgtgaatatcaaatattattctgacagggaaatatgcttaagtaatggtgtcctccaagcttacaatcgtgattaacttgctccacttaagtcatgcccatcaccttgcctaatgccatccaccaaacctgcaatcctgataaaattgctccactgaagtcatatgcatcacattgtgcctaattccatcctccaaacctgtggtcagaggtgccaccaggtatatattaaggttgtctcctcttgcaaagaagaaaataaaaggactacctattagcaacttgcgagcaatggcaggataatcccagatcaatgccgatataaaaatgaaaattatgtatgctgtagtagtgctcgatataaaaatgaaattatatatgttgtagtagttctagacttatagagcatcatggaatgcgttttggtcgcgtcgcatgcccctggggcagaggttggggatatagcacatcttctgcttcaaaataaaatatcttctttatctaaaataaggtttatctctttggaaaatatatttcaccaaaaattaccaaaattctatcaattcaccaacaactgctaattgggagcatttaagccttgctaatgaaaaggtacacactcaaattcgtagaccagaaaaggagagtagcaattcctattcagaatcagttgtttgtacctctacatacactaagctgagcttatctaatatctaataggttcatactatgaaaatatatccatttatccttgtctattcatagtaaaatagtaaaaaacctaaagtaaagaaataatcttgcatatatggatattaccttttttttttttgcctgtggagtacatgaactcagatatatcaaccaaaggccaatcaatggcaaataaaagaacaaaatctccttggccctcctcattgagcatcttaaagctaaaagccatcaaataaaggccgttcttccattatgctcactccatcccagcatatttgcatatgcttgtattaactgcagagacaattatggcagtttttttagcgtggctagctatagaaatcaaatggtggattgcagtaccacattaaatcagaaattcagatttacctttttaggctacataaataaaatataaatctttcatgttctcatgaataaccaataaaatcaaccttttcaacattaaccacatccttgggagtagtcataatgttgtatccttcaatttttgcacaaattagctttttatgccaaaagtaaaaaaagaatgtttcgttataaccaagggagatcgaaccaaaagagtcaaagaattagaacatctaaatacccaatatactaatcagctccacacacgctcttccaaagcacaggtcccgcccgaaatacttctgtctgatttgtatcacaattgggattcctctgaaagaacatgatccaaatttataactctcgttgatctggcattgctgttccataatggacctctagctttgttttcaatggcatgttgcagaacatatcatgatgtatttgataggtgcatgtacatgctgtcaagaaaaaaatcaaggtctattagaattaagttttacaatgggaataattataagcttccatcgagcctcttctctatcagtgatttggattatctgcacttaaaaagatgcattgtcagcttgcctcagaagtttgaaggtttcaagcggctaactgtcctgaatctgaaatatttctcctcaaccagtgacataaataatctgatctcctcataccctttgctgaatacattgtatttgaaactggtaatggaggattagaagatatgtctcagtacattagcagaaaagtgtcaatagcacaatcaacattggtcacccaggaaaacggttcattaatcaaactgatgaaaaaaaattgatagcatcaaaatctacactctgcaattcgttacagtatccgagaccacaggagaaatcgtctttacctttactggaggggaggaccagcggatgggaagggcccgcaggggcggatccaacgtgggtgcaggggggac

SEQ ID NO: 79042 - DNA, 2115 bp, Oryza sativa
attattcataatcacatgagacacctttactaattaatttagagaataaatctattttcccaaacttatttacaataactaatttattgaagtatactttatagttacgtcaatagtgtgtataatatacatccatcaaattgatacttgatgtgttggaattcctcaactataaaaaaattatatcatgagtagtttattgtgcatgttacttgattgttcatttgttgccaaaactatttagaaaagagaaaaacatagatatatgaccataaatctcatggtggattaaatggttgtattatagcaagatcattggtatgaaatatttttttcataatttctttacatctatgcaacatttatgttgcccacttattagatactaatgaaatagttctaaagattccaaaaaaaaattgagaatcttagtctcaaacaaattaaaattaaatgaaatatacttaaaaatacacaactaaattgtgttgttttcatttattttacatatatggatttaaattaccattgtatagtcgtcaagtgatatttgacacatgaaatatgatgtgaaattatttaaaataggaaaaagcaataattaccccctaaacctgaaaaccagacatctttcaccctcaactattaatatcggatgaattaccctaaccaacccggagtgggtttgttcctacgtgacagtccagttagcacttttttttaaaaaaaaaaataggtggggcttacctgtcacactctctaccctctatatatctctctctcctctctctctcttccacaatcccattacctagcctctctctcttctccttctccttgctacaggggccaaccgggtaggcgagccgccgccccgccacacttttccttcctccttcatctattcccctgcacttgctctcttaattgatccaccttgttgttcttttattgattggtgctttctgtctcgtcaggagaaaggcattggtggtggggatcgattaagaaccatggtgggatggcatgctgtggtagacagagctacgggggcgtagccgaacttggccatggaggaccagcgcaggtgctcgcctccggcggccatcacgtgatgatgagatgtgacagaaatgatggtgaagacagcctccatcagagtgcgcatgtggtggccgagatagccgaggaggagccgcctctgctactcactgccctcgttcgcctccaccgcggttgtcctcttcacgcgccagtggatgttgaggagaagccacacggccatcaaggaggcgcgcgccagcagagaccgagaggacccgctcactgcccttagccttgcctattgatagacatggagggagaagaaagagaaagggggaggggtgaggcagagatatgataggtgggtcccatcaatttatttttaagaaaatgctgacgggactgccacgtaggatcaaaaccacttcaggctgtgtcagcggggtaattcgttcggtattaatagttgagggtgaaagatgtctagctttcagatttatgggggtaattcggtctaccataatagtttaggagggtaattcgtcatttttccttgaaaatattatcataacattatttattatatgtcagcctcatgtgttatgatgtatttaggaacatagacatcaatagtttatttaattaaaggaatctgactggatcacaaattagatatataattttaaaataatttaaagataggatatttttttatattgtagaagatctagtttaacttaattttatagagtattatacttttgtttttaaatagtagaaaatcatatattatggaccatcgatttttttatggcactacatactacctatgttacgtaagtttttttactttattgattttatcgtcagttcgtacataggttttctttaagattcattgattcttttccagcacgtaagtacgtacaccaagtatacttatgtttggtttcttttttgggcccacattatgagaggaaattattaccttcttaaaataatacatctaatctaacgatctaaaatatcgggtccaccaacttaagtgaaaattaacggtgagattatata

SEQ ID NO: 79043 - DNA, 582 bp, Oryza sativa
cccccccccccccccccccccccggtgatgaaatgaaactttcaaaggggtgtgattgaaatccatggagctaaagcatgtacagatactcctaatctcctagtatgtgatgtctggtctcaccggtgatctccattgcatgatgatgagtcatctgataggttggttttgcattttggaaacttggaaccccagcagtagcactactagtagtaccaaccaaccaaactactaatatgactagacaacaataatggtgtcacttcctgtttagcatcctggaataatccacttgatagatatgcaaatcaaaatgggagcgtccacattcagaacagcaacatcatatcaatgcagagacagagagcagcacttaattacggcgaaccacttgataaaactgattgatactacctcgtcccaaaataagtacagttttgcactattcacgttcaacgtttgaccgtccgtctttttgaaaaatttgtgaaaaaattaaaaacatttagtcacacataaagtactattcatgttttatcatctaatagcaataaaaatactaatcataaaaatttttcaaat

SEQ ID NO: 79044 - DNA, 6773 bp, Oryza sativa
gactagggctgatgtagcaaaaagtatgaaaataaacataatatctagacaatcaagctcttgactgatttttagggtggtagatagcttacctagtctaatatggtaaagcaatttagccgatgccagcataaacgttaaaacgaatcttagctgatataagtaaattgattcttatatgcattctagacgcttctcgcaatcttccttgttttttaattttaatttttaattatttctaaattgaatttctatatgaaatgtaaacttaactttatttttttaatattttgactttcacttctaaattcctacatggactctagactattattttaatattccttattttttattttggattttcattatttctaattgtatttttatatgaattctaaactcatctttcaatattccttatttttaaatttggaattttagttatttataaattatatttctatatgaactctacacactttttctaatatttcatttaaaaaaaatcgaattttatttatttaaaactatatttctatatggattctaacctctatttttaattttcttatttttaattctgaatttcaattagctctaaatttattcatgtatagactctagtttccttttctaatattttttactttttaattttgaattttagctgtttttaaattctatcatatatgggctctatcttttccttttctccgattaaaatgagaatttctaagcagtgagagcgaaggtgatggctcctttttctattacatttataagttaacagatagatttggaaaagatataaatgtctggatgcaccaatatttcaggcaaatataaaattaatgcatcccaaatgaagcctcgtgccaacatttgatcatcagcacttagtgattggtttctgttcgcctgtactacgaggtaatacaatctgatcaccactccaatgcctacacgttcgcacgcccatcgaccggggattaaccgatgattaatcactgatcagcacgcagtcaggatgtcctaatcactcactgtcaccgatccagcacagtcatcagcatctaacaaaccgtgctgttaaggtaagaaattgacgtgcctttactttagctactcatcttgccccctcccgccgaatttcacggccacggcacgagcaaaatggagcacccacctgcctgcctaggacgagaaaaggtgtagctacagatgtgggcgatgtgggcagctaggttggcttgcttgcaaggcagccaaggtaagggggaagagcactactcgctcgccgaaagcaggctgatcatagtacaagccagtgaggtcatgtacatgtgcgcagcgtggtttgatttgctcgctttgccggtctgtcgagcggagtgtcgacctttgaatggagcacttgtcccttgctgctattccacaatcagctggacaagtgggactctccgagttgatacatataataaggtgctatttgatactactcatgaagatgaagattaagttgacgtgtgtaaaacgagaaaactattagcatataattatttaagttttaattattacaaacttgatacaaagtagtttgaaaaacgtgctaaccgaaaccgaggtaaaatctgtatagtaagtgatcaaataattttccttgggtcagctcgggctcgttagcgggttgcaacgtatcagtggtggagccagaaaattttcggagctcgaacaaatataaatatattataccttaagtatctgttactgtcgatgggagatacccgcaactatattttagggtatttggctacattggtacgaggatctacacgatatggcatcaagcataaaaaagataaggattatactggttcaggcctctcataaggtaatagccctaatccagtttatatgggattatagaataaaccacagagtacaagagagaacaacaaaactccaagattaccaacgagattcctttcgagagagaggctcgacgagatctatcagcgaattggcttcaagtcctccggattgtaatagccctaattcagtttatatgggattatagaataaaccacagagtataagagagaacaacaaaactctaagattactgacgagattccttccgagagaggctcgacgagatctgtcagcgaattggctttaagtcttccggattgcttctgtggtgttgagtgtcttgcaggccaccttggtctccaagtacaattcggaaacaacggaccccgtacgatatgacaacctcattttcccctccgagtagtactctgatatttcctattcctataaattatttccgtaagagcatcaatcattactgtatactttataatataccgtatccgtatacctcacgactcctaggataataggtatgccttatctgtaaccctgataattgaaatatcactttaatcataaagtagtgtccaaactataaggcacattcgagcctaggctgtcactcggggtcagacactgcaactctctactccatccgttctaaaatatagtaattttttggtggatgaaatatattctaatactataaatctagatatactctctatccagattcatagtacttgcatatatgtcttgttaacggctgacaatatttctaaccatttacacatgctatacgttggctaggcttattttttttattataaatatgtaacataagtacttaaacatgagagaaataatttatcaacaacctgagatttgaaatggaagttatctctggcaatgtttgaattgggagatatcttttctcgtactttgcagtagtacttggaattgagctcttccatttccaaaattccaagcggaagtcctcagtctttgctgtccatatcacacttctccttggaacccagtgggtggatatatatagttctagaccctgctagaagggaagaggaattattagagacatcgggaccgggattaattaacaagtaatgccacttagggtccttatcgatggagacagtgtgtggtagtagcgtagtagcttttgtggtcaggagaggcacggcggccggtgtactgctaccgccagccagccattctacccgtcacccacgacgcgtccacgttggctgtcgctctcaaggccggctgcccgggagacgtttttttatggctctaatcgatcttgtgtcctcgctacctttccctcctcccggatcctctacggagctgtttggatcagggcacgtcggatgtttagatattaatttagagtattaaacatagattatttaaaataattaattatgtgaatgagagttaattcgcgtgacaatttttcaggggcaattgcttatttgaccccgttttaaaccgtaactaccaatttgaccatactttttaaaatttgcttatttaaccctcattttcaaaaacgaagctccggtctgaccctattctgtttgggtgagttaacggtgttaattttagggtaaatagtctattttgcccttacttatttgaccatattatatcttgcttgtttgcttgtttgaccctataatgttgaaatatttgtaataatttttgctcaagtttgacagatttgccattaatttaataaattttaatcattttgtcaaataaattaaataaaatgtgacgacagatttgccataaattttgacaaatttgattcattttgacagattttgacatcacggcatgagtggtatatacgaccagaaactaacaaagcagatgagctcttgagtgaaatattcaaaacattcacatccaaatgaaatcttgatgccgccactggaaactaacagcatcactccgccgccgcccccacagacctctcccgcgcctcctcagagcgccgccgctgccgccctatacctccacgagccggaggcccgctggcacccgcttcacgacgccgccgtccccttagagcgctgccgccgccctctcgctgccgctgccccctctccaccaccgtccccatgccgccgccgcccccacagacctccgcgcctcctcagagcgccgccgccgccgccctatacctccacaagcggaaggcccgccggtgcccgcttcatgacgccaacgtcccctccgagcgccgccgttgccccctcttcgccgtcgtacccacgctgccgccgcccccacaaacctcctccgtgcctcctcagagcgctgccgccgccctatacctccacaagcggaaggcccgccggcgcccgcttcatgacgctggccgtcaccttagagcgccgccgccgccccctcgccgccgctgtccccttgccgccgccgtccccacgccgcgctgaccccacagaactccttcgtgccccctcatagcaccgctgccgccgccgccctccacctccacgagcgggcgccggcggggctctgcttcacgtcgccgccgccgctcgctgccaccgcatgatttgcatgagagagagagtgttgcacgagacagtagatagggtttgggggtattttgggcattaggaatattagaaacattttctctttttttttttttaaaaaaaaccaatcctatcggagtcatggaatggggtcagacgagagcttcatttttgaaaaggagggtaaataagcaaactttaaaaaagtatggttaaattggtagttagtgctcaaaacagggtcaaataagcaattgtcccaattttaattttttaagcctaactgatccataattaggatatgtttactgtagcatcacatagactaatcatggattaattaggctcaataaattcgtctcgcgaattagtctagagttatagaatgagttttgttaatagtatacgtttaatacttctaatcagtgtccaaacatctgatatgacaggaaccatccaatcagggtctacgtcgcgtccaccattcactgtcactagaagaaccgtactagatggtggttaactggctattaagcagtgagattgcacttgatagtgcagtggtaagaaatgtcgtggtctcaattctaaagtcctgtgttcaattctcaatacgcttaaaatttcttcttaaaaatgtttggagggacgtttttcctttatagacaaggattaaggtcatttcgtcccaaagtttcgtaaagttttgtcgtttagaaactgacccctttttttttgaaaaaaaatgaactgatttcttctatgtagaaatgttgtgaagttcatctatttctcttttttttttccccctaaaagcacgatacaaatgccaaccatgtgaacaccttcggagataggtacgttatctgaagttaaatccgaataagtttcaaaataaactaataacctaacgagttaagttacgtttatttcacagtttctaattagggtttggttgatatttctctagaagtgatgcatatgttgattgggtaattgagggtgaaaacaaggtgtagaaatacccctaaacacccctaaacacactgctgtgtaatttatttgttccgtacattaaacaggtaataaatatgtgaccgtagaggcgcagaggatcgtcgaaactaacataagtaccaccaactaaaggataaagcacacgacgggtgtaattagtgcgcacatgattgttcttagcatgctaagtgacaaacattcttgggtggctaatcctcctctctcccataggctagatcgagctaaagccagatcttgtgtactccaaaagtcagcaagtgctgctactctgtctcttggattgtattgcctcttatctctcggcaagcagcgcctcctctgcctttgcaggccactactgagttcatcgtcagatttgttgggattccgatttccatttcatccatccatccatccatccatccatccatccatccatgtagtcgatccactattgattgatccatgcgtgtgagcgtgctccacgaccgactctggtaaaaaatggagaatatttttcacttcaccgcccgattcgtgccgtcagattctgggtgtctgttcctatctgctggaatgtgcgatcccctgactctgaatccatccatcaggagacgaccggcagaatttcttgtgatagggatgcgcaacttgtagaattttaacttggggatgcaagatgcatatggtttaatttcgttaatttgacatggccgtgacaaggacttattttgagctggtgcaatggcggttaaattatatggttgttttatacggcgattattttgtactgccataatttgttttgactacttaatagatcagaatcagaatgacacatagaagactgatatatacttcagcatgaggtgaatgataattacgccacaacttacagatagaaaaaccagtcaaattgtttctgatagaggcacagaatcaaactaaagtatctaaaagtcattaactactatataatatattctgtaagaccataaagcattacaaaagccatgcattattcacgtatgtggagtggtttttcactcctaatctcctccgaaaaattgtactaataccacttgcttttctttcccatatctttgatttgcttatagcccataatcttgtactcctacatagcaaacgccaaaacacacataattcagcagcagtgctccgtaaatattcaagtcgcaaaccacaactaacctagtcctcttggtcggcagactttgttgctgatatgacgatgatccagacaaaacacaagtaccttgcacccaatga

SEQ ID NO: 79045 - DNA, 6401 bp, Oryza sativa
cactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccattatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttaccgtgctcctcctgacggatagccttatccaccagcttctcaaagtcctcataatctctagagatcaactggttagtcaattcatcatcaagaccagacagaaacttctcctgcttctcggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcttcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcaccgttggcacgtgctccattgttcggctcttcgctgccactggcgttgttcgagtcgcgtgaaccattccttatctccatctgaaggggataggtagaaatatgagaaaaggaggaaaaacaggggggctcagaaactaatcttgcttatgaatttaagtgcaattatcttaatcttgattaaaacactgaaaaagaggcacgcactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggaccgacatctaaagtagacaagggataggaaccaattcatgctcaaatccaaattaaaccaagcaaaagaagactcaaataaataaccgagcatgatgatttttatgcatagaacatttttcatgaactcaaataaagacactaatgcaactaaacaataaattaatgcatagactagttgcatagaaaatgatgcgcataacattgcccccatcgaatatagacacgacctaatgcataacccccaataaattcccgactgactgtcgaataaactccaactaaaatttttctaaagccctagactgagctaataatttttttttaaaaaaaaaatccgatccgaatgaacgaccaagatttttcccgcaaaccaaagaggcaaaactccaaattttcccgaaacaattccaggtgcaaaaaggcatatgcagatgaaaaaaggggttcagagggctcttagggtttccagttggcttgtcttacggtcaaagtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagataaaccgggaagcttgacttaagcagcgagcgactccactccacaggcaatccttgacggcagcgacgaaaccaactttgacaaaacagcttcaactaggaagatcttcagctctggtgtgggggaaaagagagcaagactgagtactacccactgtactcaacaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgttgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcataaccatgcacccacagcccaccattcagtgtattttaattaactaacaccattgcggtggcaccaatctaaagctataccaatagacaaagtctatgtaataaggtgatccccatttgtgtgctagttgaactaagcatggctaagcatttcctaaaccaacatctagtcattttgatacctaagttatcaatggcataaggtaaacaataaatggctgaggaataggacccatcctacatgacattgtaaaaggatgcaacatttaatagaaatgcgggatatttgtaaattgggtacaatatgatcaaacgtattgcatgacttgccttgctctcgaactgacgagacctcagcaacgtcttcgagaaaccgcggatcgacgaaacggccgaaacctacgcgacaaacaaagcacacaagcaaaacatgctataagactactgaaacaggaaacaaaactatttttaatggattctttgcatttttcttgatttactgagacttgaatggacttaaacggagctcggatgaattacttatgaattttagaagataaactgcgtttttactaataaagaaaagtccttaatcaatttattgcgcaataaagcccagggctgacgtcagcggaagggagggggtggcgccgacaggcgggccccactggtcagcggcactaagggagggagagggggcggctggcaagcgggccccactggcagcggctctagggggaaggagtgggcggcggcatgctcggcacggctcaagccggccggccatggcaaggcgacgacggcgcacgaccgccggcggtgaccggcggcgcggggagacggcggcggccggcgcgaaggcggcggcggcagccgaagacgacggcgcacgcgcggagggcggcggcgctcacgggggagaggaaaggaaggaggaaaggggattcctcaccggcgagcacgacggccggcgcgaaggaagaaaacggcggcgacgaccggtgatgccggggcgcgaacgggcggcggcggcaccctaggagagagcatagaggggttagggaagggaaggcgaccatggcggcttgaattgccggccggagacggaggggagagagggtctcaccggcgcgcgaggagaaaagggctccggcggtgattcgcggcaatgaagcggcggccgaggtgcgggcgggctcggtgagcgcgacggcggcgactgcgcggcgcggcggtggctatagtggcggcggcgcgtggccggagacggcggtaggcggcggcgcaaggggcgagcggcgcggcgacgataggaagcacgggagggcgcggcgagtgcgaaaaacgagagaggaagacgcggggagcgatttataggtgcgggagggggcggacgtggccggggaggtggccgatttggccggcgacgtggggaggagagagagtgagagaggtggattcgaaatcgaatcccgccctctcgagcgcgcgcgcgggccgggagatgcgggggaagaggcggcgacgtggggaggacgcgggagcggcgcggcgtgggcacgggaagagcggaggaggcagcggcgacatgggcggttggagcttcggctctagcggccggaggtgggagacgaccgacaggtggggcccacctgtcggcgtcccgagagagaggagggaggggcggcttgggccggcccacaaggaggggggaccgcgggagagggatgggccgacggcccaacaaagaaaaaggagggaaaagaaaagaaaaagagaaaaaaggattttcctgggattaaaaattgcactttggtgatttttaattggtaaaaaattatttccaaggctctgaaaattccactaaaaatcctgttaatgcattggagcatggggaactcaagaaaaattccaccacgccgaattcaattattaattgcatttattaattaaggaattagctctaggttaattaagataatttcttcggacgatttatttagccaatttttaaagcaagcaaaggggggaaaacttcagggcgtgacaccgtgtccaggtgatcgcgggacatcggggtgagtccattgtaaaagttctacaggatcagccaatcgtccatcccatgatgaggacaggtggccacatactcctgcagtcgttcccatgcatccggaatagacttgtcccttgtctgctggaaactagaaatccttccacgaagggcattggttttgcccatcgggaagaatttcgagaggaatgccgtagagcacttgtcccatgtgttgacagcagcatggttggcatagaaccgctgcttcgctctcccaagaaggaagaatggaaacagccttagcctgacggcgtctggactgacgcccttgatggtatatgtgctacagatctccaggaactgttgcagatgaatgttggcattgttgacggcggaagtgctaatgggcgatcgatcgcccggcgacaagggtagcgatcgatcccccttccccctccctccctccacctggtttccttttttggcaccgtattactttcctattttagtaaatttatgaacctaaagtttatacacctcaggtttacacatctaaagtttagagaccaaaagtttataagtcaaaagtttatatatccgattcaaattcaaatttgaattcaaatatttttttatatataggatttctatacatctaaagtttatagacctgaagtttatagacccaatgtttataagtgaaaagtttacatgcccgattcaaatttgaatttgaattatatcgggattcaaatttgaatttgaattcaaatattaaaatatatatatagtatttttatgcatctaaagtttatacacctaaagtttatagacccaaagtttataagtcaaaaatttacatacctgattcaaatttgaatttgaattatatccgttcaaatttgaatttgaattaaatattttctatatatagtatttctatacatctaaagtttatacacctaaagtttatagacccaaagtttataaatcaaaagtttacatacccgattcaaatttgaatttaaattcaaatattagtttatagacccaaagtttataggtcaaaagtttacatacccgtttcaaatttgaatttgaatttgaatttgaattcaaatattagtttatagacccaaagtttataagtaaaaagtttacgtacacattaaaaatttgaattttaattcaaatttatatggtgtagtagtaagagaagaagggga

SEQ ID NO: 79046 - DNA, 6820 bp, Oryza sativa
aagcatggtagaataaacccccgtccgatcattcaccagaatgctctccatgcatctcccttccagataattcaaggcacaatttgcttggttttgtcgctgcattatattattgccatctctggattgagaagtgatgtgttgaagtgcagttgtttgaatttaagtttcagactaagcgcgcaggggtattgatagggatgggtattgcccagccataccgaccagttcaatcaaaaagcttaagctaataagaaaatgtgccgagtagtagtgctattgttttttttctactatttgttagggaattataattttgcaagaatgcttagctgttcatcataacactgccgaattaaggtagatggtcgaatctccacgagtaagaaataaaacctaggcttagaaacagctggagctaaaaggatatcttcttctttcttttttaacttgtggatagtattagcgttgtcgccgtaggagtataattttgagaagacagtgacttgtgagctaactggagccgatggtgagacgcctgaagaaacctgtgtgatgctgggaatagaaaatggtatttggcaggccagcagctagcagaggcattgctggtaatggaatgatgaggcaatgaagttgtttgattaaccaactaataaaggtcaccgtaggattaacaaaatctcatgctagtatcagcccccagccagccacaagatattgtgactgtagtaggttaccttttcctattagcccccagcacagaaacaaactcaactgacaaaaatgaaaatgtgaaattaggagtagcaagaacaaattctccacttctaactgttgtatgcatctgatctgatgatctgaacccaccagagctgttattacaatgacagtatggcacggcccaatccagtttatatgggctactctatacctgtatcatcgacacggccgttcagcccaagcaaccgagagcccgtgagctgaggactagtttgcacctccgaagctttattttacgggactacctatactacatttgttcacaaattttctcctaaaaatttgacaaatgtaattatagtatcattatagtgtaattttactgtaacttatatgtaattacactgtaacttgcatgtaactaaagtgtaacttatatgtaagtttcacataattttgaattgttagatctattacaagatttattttggtgaggaagaaaacaaatcatagcacacacatatgtgaaagagtttgttcccacgacctccattttactgaaataacatgttacggagagatttttgaaagttacatacaagttacactatagttacagtgatattacatgtaagttacagtgtaattacactatgattgtactgtaattacatctgtcaaatttttggaggaaaatttatcgacaaatatatagcaaaatcgttattttacacctgcaatttccctaatcgatcgaggttttgacggaaaggtttattacgaaatcatatatgttattattactattatttaattttactataaaaagttttactaggtcattagaacctcattttaatattttgcacggggacccaatttaaccgggatgcccctgccgacaacgagtgccgtggcggagtcgaaccacagcatgacggcggtgggcgagggaaagtgggaggtgatgagcatcccgatcaaggcggaggatcaggggagcaagacggagctgtctcaaggtgcgcgccaggagtacatcgacgccctcatgagcattgtggattgcatcctcttcccagagctccgtgagcacatccgcgccaccatggccggttttggcgagactgtcaggatggcccaggctgagcaagccaacgctactagaaaaagcattttcacggacgtgaggtttttttttccagacgggtatgacttttgaagttaaatgaccgtctatgaaaatataaaccagggtgaagctcggcgtccgcctatgaaaatcaattttttctagacggaccacttaataggttcacatacgaaaatacctttattttcgtagagtgacctcttaagtggtgcgcttaaaaaagattaattttcgcaggagaaccttatgtggcctgtaatagtaaataataataataataataataataataataataataataataataataataataataataataataataataataataataataataataataataataataataataataataataatagcagcagcagcagcaggagggaatcgctcgatacgtaaacttaaatacattctattgtgacagcagcagcatcagggaatcgctcgatgcgtaaccttaaatacattctattgtgactcatgaattgttttgcgagaggaggacagataaataaatatcactgagtcttgatggataggatcaaacccttccaaggtaaggaagagagagacctcatcatgcctctggacagatgtcctccccagactgaagaaaacaactctatttaagccgtacttgatcctacaccacttgtccatcagtagtacttactacttttttctgctctggctgtggtgaggtccgtgagaaatttgagagcattagagctagtagaagtcttctaggtgggacgcacgggtagaacagcaggagacctggcaagactgcgcccattagctattttacttaatcatctctaactaaatttgtttacctgtattatattaagatggtgatactaacaatctaacagtaaatattattaacatccgaataatagatcgatgattttatcagtgaaaataataatgtgattgtgatactaagcctgagacgaccgatatttgagacaacgatatcgggtcggctgatatcagtgtgagatgaggaatgcctcacacaagtagggaatttggcggcgtgattctcagatgagggtatcactagttggggaggaaaatggattgaaggaacgagattattttaatacctttgtagtgtatatttaactcatttactctgtgtaatgtcttttattatttctcagttgttaatatctacgggcaatattatttttcttttaaaaacatatatatatagctatatgtactaatcttgctgagtatgtacaacatactcatatattattactatttgatgtgcgcagaaactaatcaagatgagatgtctgagggaaatgatgacacgcaaacctagtggggagtgtggtctacttagtatttagagtcatacaagaggacatatacctgcatgctaggtatagggaatcgtcatggtgataataagttggtcagtgaaccaaccgatgtattaagcaatatagctggtgaaaaataaatggaaccattactgcaggtgtccaagctccagttgtcagggtaagacattacatctcgccttgtatccttgtggacatatataagtatttggtatatatgcttataaggatacgacagactgccacaaatttttttttggtagtgacatagtctgcctgcaaaaatcatgcctacagaaaaaaaatctaagttctatccttatcttttcctctagcatcttatcctctccacccctcattttcctcacccccctctctctctcatttccctccagctccctcccctcccctcccatattaggcggaggggaggtgcggctgccctctctctcctctccctcaggtctactctccctccgcggtcggccgcgccgacgccgacgccgactgcgacaacaccaccgcctagatccgggcatgggaggggaggcagtggcatagacggagggcgggggggggggggggaggggcatcggcggtggcgcggctcccctctctttcctctccctccgcggctagccgcaacaacaacgacgctaatgatgacgccgcctggatctagggaggagaggggagacggcggtgacgaggagcttccatggcggcacggcaggaggggaggtgtagctccccttcctctcatctccctccgcggctggccacgacgacgacgacgccgactgtgacgatgacgccgactggatccagggaggggaggggaggggaggcggcggcacggctgaaggggggcgtcggcgtcggtgcggttggagcggcacctcccctccctctcctctcccgtagctctactcctccacgcccggccgtgacgacgatgactaccgcgactgcgacgatgacgacaacgcctggatccggggaggggaggccagtggcaccgccggcggggtggtggcgccagattttttttattcgctaaaaatatttttgcaggcggatggttctaccgcctataaaaatagatgccgcctgcaaaaatgattttcaatggtggacccatctattttcgcaagtctttgcatgcaggcggtcctttcccccgcctgaaaaaccatttttggctgcctcgaaaaactatttttctagtagtgcaacatcatcgagcagtacagcgcaactgcgttgcctacgtcgatcgaggtcttcgtcaatcacgacaacaccgagaggaaggcacaagtaatgtaggatagatcaggtgtcaaaggctaatcggtgttggtttgaaaatctctcgtaagtgccggtttttccaaccgacaaccctcacacggcaccgatgaccctataacaatatataggtactggttgagtggttgtcgacgataaacaacacttgcagctttgaacgagaaaacaaaaaggggaagctgatgaatcagctcattcgagccggttttgttttgcatctaaggtccttcgtccaacgaatttgatgtttctgctaagacttagatttgctggatgtggcactcagcgcttaccagattttggactggcctaattactcagttcaacatcaagagatgctaacgtacaaagcaagcatcagagcgaaggagattctgaaaaaaaaaaaagtttagtcggcaaatttctccgggatgtggcggatgaaaccataaaaaagttaatccaggatctgcaccgtcgcgccgactgccccctaattgaaaacgatatttgaagagaaattcagtgcacatctaataattgagcacaatagagcagcaacaccgaccaccgtcatgaactggtgaaagtccctgctaataaaagatgaaatatttttggggcaattgctgttctctgccggtctatatgatgtgtactctaatttgggcaagacaaggacctaagaacgaacaggaaccatgaaaaagacctcagtgatgtaatgctgttggcccttgaaagggctctttaacttgcagcattgcagtgacgcatgcttttgttgtttagcctcggaagatgtcgctgttaccaagaaagaaaagtgaaggttggatttatttggcatattgatcgacaattttttttggtgaacacacaaaaatattgcacgtcaatggacacggctagatcgcgcgctagcggcatatcgctaaccagcgacgcccttctcttcccaaaacgttactagtacactcaacagtacatgccttttttttttcttccttgagaattttctcctaaattacttatccgatctataatccgattacactgttatgatcattgcaattaaatctttacaacaagatcttaaacgattatattctgataaaaaaatatctatgttgtaaattacttttattatatatgtaagttacttttgtcctatatataaattacttatagattcaagctctttaataacttatatattttaaatcacgtattattttcatgatctatttatttacatcattgtactctacataagatatgagacaaaacaatatccatgttgaatatattcaaacatttcattaatttaaaagtaatttatttaaattgtagtagtaacttagctatgcaatagatgtaacttagctatgcaatagaggtaagttagtacaaaatagaagtaagttgttacaacattagaagtaaattcgagagaaaaatattttgtatctaaaaattaaatttaaagtccataaattatagaattgactaaaaactataataaacataatcgacttaaagcattatgaatatataaaaagtaatttatatatatgataaaagtaacttaagtatatgataaaagtaacttaactatatataataaaagtaatttacaagtataaatattttttcatcgtagtataatcatgtaagatctagttttgaagatttaattgcaacgaacgcaatggtgtaatcggattatagatcggataagtaatttgagagaaaactttgtaagggaaaaaatacatgcatgtgtaatagaaataaaaggcatgcatatgcgctggcttctccacggtttctatggttggcgtcacgtgataagacaatatcgagaggcctcactgattagtttttgtgcacgtcaatgtattagaattctgatcgataaggaaaaaaaacaatgtacgatggatggtcatctaaggggcatctacgacgcggatgttcgtgcaagaaacaagtcaacgaacgccacgttaatgcgctaccggttttccttgatttggtacgttttttcatagggaaatttgtatgatcaacagctaccacgcaggtgaatctcaaacccttttattcatctatcgctatatggcttcaggtgtacgtgggtcatattgctatacacctgaatcgtttgtatagtgagactcttttctcacatttattttctcaggtccgtttttacgcactttgatcaaaaaaatactccggg

SEQ ID NO: 79047 - DNA, 4912 bp, Oryza sativa
  unsure (1)..(4912): unsure at all n locations
ccgcccattaggagtaccctgttgacggtccttaaatcataatatttgaccgtcaatgcctacatataatggaataaaacatggtatccaacttagtggtaggtattattactaatcatttccactagtgttggtgaaatatgtgtatgcaggtattttgaggagaaaacacatccgtcatgcgacaaaatgcacctctgcgcattcaagacgcatttacacggattggagggcccatatgtcaaccaaaaccacttagaattgggccaaaacattgtgcaagatgtttggggcccaataagcaacctaccggccaaaggagaggccggaaggacagatttttggttcggncnnnccnncnnntnnnncnnaccaannctngcnccnnccgccatctggcttcatgtggacggtttggatttctcccctatggcagttgcagggtgttttggccatttcccatacccctaaccgtcatttggagcctatataaggagatcttcatctcattccaatacacacaactttgagctgaattacaagagactctattgtatcttttatacattagaataaggtagagagtgagggggagctttggaggagtgcccggaagtttggcacttatctgacttctacctcgatgagtgtagcttcgtaggaggaattctggaggagtaccggagcttttgatacactctgctctggggtcggagaacttcttctataaagtaagcattcgtgttcctttcttatgttatttaattactttctttgagtaagatagatttccatctttgcgggttcattgtttagtatttatactaagtgctctagtactaggactctagataaataaggaagttcctgcgcaagtattagagtagtaattaataacttaggcgtggtgtctaggttagagattacctttgtttgttgtgtatcccatggatttgtcagaggtagacggcaggtggtgacagccctgaatcccgtcctagtaatctccacgttcggatgcatcatagagctatagccgaaaccacgctggcagaccagcaggggtcggtgcctgatgcaacagataggaaattacctttgcttagcttagatagttaagccacatagaaagtcctctcaagcctgccgaccatcggttgttgtccttagatcgtcttagccttaggtagattacacacattccctgagttcgatatccttttggggtcacccgaaagtgaagtgctacagcagtattccgtgcgcttgcggatttatctgtggtcgtaagaaataccaacaggcatcctcgttaggcttgccatagaatgggctagcctgcgccatcgtgatgagattggacttcaagtcgaaatccacgtctcccatgttgatctgcggcccaatggccacattgtcagtagagggagcagcgaactcgtgaagggtcttgtcagccatagtcctgaaagttggtggtgctggtacgactggtttctatgtcgtagagttttctgcagagcaacgactcgcggtctgacgcttcggacgaaagcttttggattttctttgaagttttccgacaagttgaaaccagtcatgcactaccctgttttcacaataaaagcgaaaacaaccaaggttatcctgctattagttcaggtaatctctattacgaatcttcctcggcaatggcgccagaaatgtttgttggtatttcttaacgacattactagaaatataattcccagcaatggcacagaaatacttctggtatattatggttacagagttcatccacaagcgcacggatataccattgtagcatttcactcgagagtattccaagggtattgtatttattttatcccatgggaaaatcatgtagactgataaacaagcatcagctactgagaatatattatctaagctaagtggaaagaaattagaaaaggaaatctatttctatacttctaatatacatacatacattcttgttaactaatacactagctaataccctatagccgatgtcctcctggtacttcgacaagccacacctgagtgccgagttccttatggcagcccgtcaaacggcggctgtacgtgaaacaagactaaaactcaaaaaaccagtggagctggtgcagcgcatagaatttaattcctagaagttatcagtggcaatggatagaggaaatatcgtgcatgcatgtaggcagtcggcagtggatatgcatgcagatctggagaggaaaacaaggatttgttgcatgcatagacaatcgagtagatcaaccaaataaatcaagagatatacatgcttgtccagtaaaatagcaagcagtacaggagatcgcggccagagggaaacggtcgtgcaacaacctcgtaatttcagaaacaaatccaccgatcagaaggaaaccacagatcttctatttttctgggcttaagtgcaagcgacaggaacaaggacgacgacacaatctgattagaacaaataatatgctaccaagataaacgggacccgatctgcatgcaatcaaaagcaaaactcaaaccacaactaagaactaaacgaagccagcactagagacgacaacggaccagcattcaaagacacaaaactgaatgaaatttgcaaatcacaaacctatgtttggtaaagggaaaagtggtgcggtaattttgtatattgataggtatggaaaataaatctataaaaaaaaatcctcaccatgctaccgaagctctgataccaactgatgacgctctctctcgtggcccgatcttctggtgagaggataactctcgttttgactgagtgcgacgtttgcgacatggctaccaaccagaacaagtccaggactgttgatacgaaaaatacacactggcctggaagatctgcttaacttcagtgcaggtccaaaaatcttacctttaggttcgtcagcgtgccagttgatttgatcctgcaatcaacaagaaataatgatagaaaaatagtggttaaatccataaacgatagccgatcggccagccgccgatgacatatcatttatctttgagccgatgtcatatttgaattgatcagcagtcataaataggcaagaaagaactaaatctattcgaccggctgtagatatctgatgaaccctgagttcctctcgacactcacggctgttgttggcccgatctttcggtgagttgatgataactacgatttgggagaaacgtcgacgacccgactacaaccatacaagacgttgcgttgcgccttagcgatcgatacacctttccgtgggttgttgatgttgccggtgcaaatcaaccttattcctgcaagcaaatcgaagaaacaagcaagaacaagataaaagcaatctgaaatgcaaataggagttgaatacgaatgataagttggggtttcaaatacaagcagacggacagtctagccgacacgcgcgctgcaaggaagtagcaatggctaaactttcatccaaacaaaacccaagaaaccctgaaggggtacctacctatttataggggtgggaggacgactaaggggtgccaagggtcgtcctccacctggttggggcgcaccccacatgggccccacttgggtaggggtcccaaacaaagttacaagcccagaggcacaagacaggtgacgcagcaccttgtttatgtgattgcggccaaacgacatggaatctggcgatgaggctagatccgttggaaagaaggctccaagagctttccatcaagtactcacgggccaaaaacgaaggtcgtatgcagattcggcggccatttgaaaacagcagtgtagctggtggccgaattggattccagcacttggaggacttgaacttaatatcgtgctgttcatccatgatgtgagcaatggttgtgtccgtagtagccatggtcacatcaatatcaatggtatataatacttccgtcgatatatacttaaatcaagtgatcgagacagtataaatcacttacatcgatatatatattaacaagaagattatagacgtttatggcatagccgatcaaatagatccagcatgcatcggctaatactcctatactattctatattaagatattaaagcaagcaaaatatatcaaacaggaagcttaatatacctaattgtgacaagatcttaacataaagagcggatttaacatgtcaatcaagcacataagatataaaagagttaaatcaggtaagatcggctgaaactccgatactaccctaatcggcaaccaaaaagtaggctagagattgagattctaatcacgacttataaggtcaaactcaactaatgcagctataagtatgaaaagaaggataatatctagacaatcaagccgttgaatgtttcatagggtggtggatatcctatataatctaggtcaacgttggtatttagcctaatcggctgccttccaatgatagatattacccgattaaaagttaaataacaatatttgtcacgcccggaatttctatccaaaattccaaacgcttacatgtgtgttaaaccctcgtccaggaatcaaccgaggcacacaatgacaatattgataatagagtacaattaaataactatttaacaatcgcaaataataaattattacagaggtagatagttcctctcaaaaaaaaacattctacgcagcagaaaaattaaactaaaacaatctacggaacagctatggcaactccactccacaggcaacttaaccaggacaagcctaatcctccagaccatcaccttcactcaagtactcctcttctgatgaatgaatattgcaagaatgagcatatgacatactcaacaagccacacagcaaatatgcaagtgcacaggataacaaaggatggcatagggct

SEQ ID NO: 79048 - DNA, 6497 bp, Oryza sativa
aaaatatattaacaaggaaaaaatcactaatttttaaaataactaggaaggtagcccgcgcattgcgcgggtatgtattttagattgtgtttgaaaacttatataggtggaatatcaaccggatgacaccagtttttcaaaagtactactacaaaaaacttatattgccatgtttgaaaaacttatattgtacgggcatgtatttagattgcatttgaaaagcttatataggcgaaatatcaaccggataacacctgctttcaaaagtattatttcttcatcaacattgcttagatatttttccatgctatttgttagcttttaaaatatataatatttaatccatcggtataaacaattatgtatgatccatataaacgcctgccatgtttcaaaaatatctatttttttctttggataaatctaacggtggtaaataacgggtccacctgatttaatgaaaatcgatggctagatgtttagtttttatttcttagaatttttagaaatttctctaatttaagatgccacgttgtggcttaggagcatttgtagtaaaactctcttaggccgtcacgtggtattctacaatcttattgttgatttttatttaaattggtggacctgttattttagattgctagattatatctatttagaaagttctctgtcgattttcatttaaattagtgggtccattattttagaccattagattatatctattttagaaagttatttttaataagataacttatgttatcatcatagattatatattgtgttacaaatattatatataaaattaaaattatgctcatcatagactacattaaaatccataaactttagactgcactgaaattacacatcagattatatgtaatgggtcacaattatgctcgttgcaaagaatcccatataattgacagctcatgccatcctcatatttcaaatatgtattttttttcccgtaaaatatgagacccatgaagacacattttttacttacagtaacatcgagaccactcttttatataacagtgattgtgtgttcgctcccggctaaaactccatggaaaaacagatcttttgattccacggtaacaaattatggtgtgtatttttgactgccttaattaggaaagaaaagaagagattgatgggggaggaatttgtacgtaagtacgtacacatgtggggacggccaaggaaagggtgagggggattaagttttgatctaatggttaatagtatcgggtccaccgttttaaatgaaaattgatggttagatgttttttcttttttcatattttttctctaatttattaaagcgtcacgtggtggcttaggaacgtttgtagggtgccacatggcggtttaggagcgtttgtaggaagtttaatggacttttagtatataataatagatagatagatttcaaaactccatagaaaactttgactagaaactaaaaatctttatatgtaaaaacattatgtacaaaaacttcagtttattataaaatagattcaaagagaaaaaccactcaatctaaaaataatttctataggatattcaaaactttcatgtaaagactaaaaattacatgcccgcatgcaataggcatgtagatgcaggggtgggaagatttgaaattggaattttttttgcaatactaaaataaattcatagacaagcggaacatccgacacacattatgaaccctgcttacagctcagtcataatacttccaccatttgcccaattaattttagtggttcttccttggcttctggttgtaaaagaaaacggggtactttttaagagagattttacagtacaacaggcaatccggtacaaaatctcagtcattggcagggtctgatcggatggttggtgttaatcagtaccttgaggtaccatttactccatcatcaggtggtaactgaccatgttgagcgaggtggatggataaaattaaaaattcgtgttggagattaggatcaatcaatgtgagcgatatgtttcggcgaggcatgtggaaactggaaactgcagtttctaacccaaatccctgagacggcgatgcacaattgtcgtcggcagcgaggtggccggtttgtgtcaccgtgtggagcgaagatgctccaggagtggtggtcaagcaatggatttggcggtgctcgaggactcaattagcagtggtggcagcggtgcttggcaaaagcatccctccatgattctactaccactaagtatggtggtagtagaaatagatatgaactattaaatcaaatgagatcaatcgttcagatttttttctacggtaggtagagagcaccggagtgagacttctcgatttttagataatggaaatggattacatctccggcttctgtcataagacacacagccataagtttaataataataaaaaggtaagataaaaataaatcaagtattttcttctcgattaccctcctagattgaatgtcctgattcttgaaaaacctggtggtattggtaccttgaggtacgttggaccagaacaaaccttttacttttattacaccaaacatggaatttatgcttagttcttcgcaaataagctgtacgaatcccacaatattttgttaagagaatcaatagaagaagcgacacaatttctcctcatatcttgcattcattcatatatatcataatttattcgatcgaacaatgtcacacttgcttttgatagcgcacacacaaaacacttgagggtgcaggcttcactcttcttaattgaagccgcttctactactgatcaccctgtgctctgttcttcccattcaccttaaactctgaaaggagaaagagcacatttgattgcggcttaagcattgctccggaaggagccgtaccccctggcgctggcacgaaggacgatctggtggtacagcgctgcgatcgccgccccgatgaacggcccaacccagaagatccactgcgtcacacagatgaacagcaatgcaattgcaatatcagttcatagcttgataattcagagttcaaccgcatgatgaaaccatgcatatttttctgtttgatagtagtaatcttggaagaacatatgtacctgatcactccatgccttgctgttgttgtagacgacggcggcgccgaggctcctcgccgggttgatgccggtgccggtgacggggatggtcgccaggtgcaccatgaacacggcgaacccgatcggcagcggcgccaacaccttgattgattaattcattgaaaaaagagaggcaatgagatcgagttcttgcaacgtgcaatcacaagtatgaagtgtgtgtctccggtgcttaccgggacatgggagtcgcgggcgttgcgcttggggtcggtggcggagaagacggtgtacacgagcacgaaggtgccgatgatctcggcggcgaggccggtgcccttggagtagccggcggcgagctcgttggcgccgccgccgtacctgtcgtagaacgagctctggaaccccttgacgagcgcgacgccgcagacggcgccgaggcactgcgccacgatgtagaggatggcgcggaccagggacaccttgcgcgccaggaagaggccgaacgtcaccgccgggttgatgtgcccgccggagatgccggcggtgcagtacaccaggatgaagatcatgccgtccaacgcccacgcgatgccgaggacgcccacgccgccgcacgccgcgtcgtcgccggacgccgacgcgtccgtctggtgcttgtacccgatcaccgtggccaccgtgacgtacaggaacagcagcgtggccacgaactcggcgatgacggcgcggtacagcgaccacctcccgagctcgtcgatgtcgacgagaggcgccggcggcgggtcctcgtagtcccggacgccgccggcctcgacgtcggcctctttgcccattgcgtttgctctcgcttgcctgattggctcgacggacggaggagagcaagaaacggaaatgcttgggggttgcaagtgtttgtgttgtggaatcttgggtgccatgggggaggtatttataggggtttaagggttttgtgagaagaacaagaggatggtcttattgtatggtttaatttggttttcttaattttggaaactttgtagtgatcttggctatagctgtcaacattattgtacagcaaatcccatgagctgtgtgtgcctgtgaaccatgtagtatgtacaactcccttaatgctccattaaatgttttgttctggcaccatagctacaacataaatccacggcgacatagctcggttttgtggaagggatgacctgctgatgagctgagttatgaaatatgtgcaaataaatcaggaatgcatcgaaatagtcagtagtttaaactgaacttggtattcaaatataggcaaattttgttacatcacattgtaacatcatgattttagctataccgtaaaattgggagaacgacactttcaaaggttggatatttattgatggacaccataactttaaaatatttatttctaattgaataggagaaataaatcgtttgaaatgtcaggaatactcacgggcccacatttcagctttcccactcctatctttctctcatcccctccgtccacatcaacacaaaagtgtggtgaggcagggactcgtcgtctcctgagacggccgacaactccctcgaggccgagctgccactgctattgttgtgtcaccgcctctccttcttcctctacctggaccacaatggcgttaatctggacggggaggaggtccacatgggcgggagggaggcgaggagttggcaagggatggacaagaagatgtggtggtagtcgtcggacagcggtgatctacacaagaaggggatttgcgcgggccgacagggggagggaggtggccttggcagccaaggatggcgacgatagggttgtggcggcggtcattggacagctggtggatgagaatggactcacatgggctgattgctagagggaggtagtgaaggcgattgagattggggacgagagggcagtggcggcggtcctccggcattgctgatgtggatggaggggatagagagaagagaagatggatgggagatatgacatgtgggctcaaaggtattttcgacatttcacacgatttctctctccaattcaactaaaagtaaatattttaattggtgtagtgtacactagcaaatatccaactttgagtatgtgatcttctaaaggttcacttttgtggcttcctatgttaaaacgtgaagttaacgatgttatgtagcaaaatttatctcaaatatatacatgtatatataaatgggataggcagcacaaacttttcaactagaaaagatgtccgtgcgttgcaatgggtagagccaatttaatttgcacatatgtgtcagatagaaaggggatgacatataggtcccactattatttttaaaaaattttctaccgacttagcataaacaattgtctaaaccactaatggagctaatttgcaatttgcaccggttttttatgttgagggaagcattatacccggttttgggttgagagatgccatttgatcataagcaaaacaggagataggtaaaatagacttattccttttcctcaagtttacaacccatatatgttagtttggctatctttctacagcccaattatatttgagagaatccattatatgccactgactttgtcactcggctatgatttgccactgactttgtcatgttctacaatatgtcattgaatttcgcctaacttctacaatttaccatcatcgtccggttagcctctgttagcattgtacaattttgtctaaatgaccaaaatacccctagtacaaaacttccaaaatttggataaaattatcaaaatatcatattataaacataagattgtaaacatccattttttttccaaaaacttaaaatatgatacttcagaatttttatccgaattttgaaaattttgtcctaggggtattttggtcatttcaacaaatttgtacagtactaacggagactaactagacggcgatggtaaatcgtaaaagttaagcaaaagtcgatggcatattgtaggacatgataaagtcagtggcaactcgcgacgtgtgacaaagtcaatggcatataatggattctctcattaaatttgcacacataaagcaagaaaataatcattttctttacatagctcgattcaatcttcattgtcagtccgagcgagcgaacggtggctgaatcatgccgaactaaactgatacgacaacggaaacaaatcggacgacatacacaatttttaggcaaaaacaccttaaacttttataataataatagtagagattacctaaagatgaacttgtgcacacccaccatatcacacaatacacacgcacacattacacttgtaaacttgcaaatgcatctttggggtgca

SEQ ID NO: 79049 - DNA, 844 bp, Oryza sativa
  unsure (1)..(844): unsure at all n locations
atgtctgctgaatactagtatatgtaaatcatagccaatactacgtatctgttcatctctacatctcaaacacatggcgtgttcttcaaacttcacaagaaatgnagaatggatgatacagaacttgattttactcatacatatttgcactgtcgaattcgatctaattgactcgaccgatggccatggagatgtatgcacatcctaaataatttcataattanctctctctctctctctcattgattgattgattttttttaggaccgactatttgccattgcacataaatcatcttaaaaatttcgtgaattctaaaccattatattgctttgagattcttacggtacctcctaacccctcctgactcctagcttgatgcccctactaccactaccgtaagtgttgcccaaccttgccagcgaggctaaggcaataacatcagtgagaggcccctagctgacctcctccccctccgctctctcgccctcttcctctcctcaagttggtaatgacgaggtgctcttgccatgctgtctttctcatatccagtggctcttcgcctcttcgccactagtagaggtagagccacttgtggaacagcttgggcttaagccccacacatggcaaagaatttcaatggatatagaccaaattttagatagaatttcagtaaaaagaaattaaaacagcatggttcaacccttctcttggtgaaatatttcctccgcccctggttgctggagacactaccactcccccggctcatatccattcactccgctttgtgcctgtcgccaacactaggccacaacccattgttgacgggctgcaggaatacgag

SEQ ID NO: 79050 - DNA, 8467 bp, Oryza sativa
caaaatcccttatatttagggacggaggaagtaatcaattagtacatccatgccaagaatcaatgatgcaatcggggtttccttattatgtggttactgtgataaccgtacgtaccataggtttattgtctgtgggtaggtaacgtgtcccacgccattacctgaccaagtttattttaaacataaattaaaagttttgataaattttgttccgtttctatcggtttattagaattaccgtggttggatatcgccgggtgctataaccctcccccaaacggctaaactgaaagagaaaccttggagacatcgtatgcaataacctgactcaaattattaaactaccacagaaaattaacatcaaaactatggttcaactgcctcaacaagtaattgtcgttgagaaggtaataattgaataatcccatgatgatctattggtttgggcagccgttcagcgccgaccctcatccccatctttgctgcagtatgggcccaccaccagcatcatgtatccttccatctaaatcctgtggccaggaaacactaataaaagctagattatttaaccagccagttcagtgatctcaatcaagacaatggaaaggcttaaccacataattaattaatacaaacgtaccaaatgtaaagtgtacattctgcctctggatgttgtcatgctgagccggagattcaattccatccacaattaagccggttgttctcctgtcatgaactatggatataattatctcacctttttctctgcatatctacctgctgcctgcctgcttgatagctatcatttagtatcaagatttactgtttgcctaattagatatagaatgagatcgagccttctctgtttggtattatgtatgcatgcgccgaccaaataatctagattaattaagtaaattcgtatgaccaaaaaaggctgagatgaggagctcagttcactggatacaacttgattagcccatggtttttacacttctgaccaccattagttggatggattcgagaatttacttgccaattgccattgtcttggaccttgtggatgctggattggcttgcattatatttgacatagatgtggtaatataatccatggctcctgattgttttgctattttacagttgtgtgtttatcatgcgaagacagtacttagggtgtattatgttgataaaaagtgagctgttcaagttagtatgtaagatatagtagattcttttctataaaaagttagactctctccagcaagtgcggtaagttgataaatgcaagcataacgctgacaataaaatctaggcaagttaatttgctcgtgtaactatgttggacttgagcgtagactgcttgttgcacttagagcaggtacgatagtagactataaatcagctataaacatattttaaggagagataagagtagcggtctacagatttgtagccagctgcaacacgaactccaagatacatgtggatatgacaagtgggaccatgcattaattatgtagtacatgtttatatgtaactattgtatgaattagctactaaattaactatagatgatttagagccaatagttggttatactattaaacttgctcttactcaaatttttcttttgaggtaatattttaatgagtaaattttacaaaactatagatactatgaccaaattatcacaaaactacagatttaacttggtgtatcacaaaactacacatataacactaaatttatcacaaaactacacatttaagatgaagtgtcacgaactacatatttagtaattaaattatcacaaaactttaggtttagaatcaatttaatcacaaagtaatgatgtttatagctccaccataacaatggtgctagggatataaactccaaaagttgtagttttgtgataagttcaatattaaatatgcatttttatgatacttaatctaaaatatgtagttttgtgataaatttggtgctaaatatgtagttttgtgatgcaactccttaaatctatagttttgtgataatttggtcaaaatacttgtcagcagctaagggtatatgtgctcttttagatttggaaaaacgtgcacatatactttcctcatcagttcaccacgctccatttaactcactaaatatttttttgttgttattctatgtttgtttagctattactcctatattattacaagaagaccgaagtagaagtagaaccagaaccactgtgcttactgtattggtaaaaaaaaatcatgttagaaagagatgtttctactgtcaaatcatggtgggtctatcttatgacggtgttgattgatttatatagctataatgtataattgtatttatgaaaatagtagcaatagttgaatatcaaattcaactatagttgaaaatatcttactatagcagaatttataactgggtattgtccgtcctttagctctcttcagggatatacaggtttatcccaggttagacgcacgagagattttacaaagttgtaggcctttctcagtgtaacaatcctacaccctattgtatatggaaatagttaaaagatatatatgcagatctagtctagtcctatatatgtacatagtctcgtcgggaactctgatggcatggcttgatgaagcgtttggctctatagattaatagatggctcgttgattgtagacttgatgcttgattcaatacttgatctgagattcaaagtcctggctctatcttaggtccttaatttgaacccctagattcttttgtatttgggatggacttaaagatttattcttggaagtcttcggtagagttaggtctttgagatcttactgaagttggtcttgtgatccttatctctgtttgcggtcctatacccatttgagaaaatcctttccatagaagtatatgtattcatacatgtgtatttaagtctccaatgtcatcgggggtatctcatattttaccaaaagcaaatttgctactttagtcaataccttcaagctttctaaggcctactcatccgtttcatattataagatgtttgtttttttagtcaaacttctttaagtttgactaaatttagagaaaaagtataataatattttcaatacaaaacaaatatattatcaaaatacattcaatcctagatttaataaaactaatttgataatttagatattgctaattttctataaacttggttaaacttaataaagtttgactagaaaaaaaagtcaaacgtcttatatatgaaacgaagggagtatgtagcaatcaggtttcatgtggttttggcgccattgggttcagagtatttccatacggatactttagtactttacacatgcggattcttaatcactatgtatggtttggtttgggaatgtggtaaggtgtgttggacttgtacttgtttttttgatgggatgatcccattcatctgtttaacataagggatgatcctatgtaataccttttaagtgatatccacatgtcagcaagagggaaaagtggattgaattgttctaccagttttttagggacaaagtcaacccggatattggattacatctatctccaaaccaaacaccgagaaaattttgttcagagtatgatccatcctgatccatctcattcctggaacccaaacacacggtacattggtacatttgtacatctcagtgtttagtggatttcaaaaaattattgattgattttcaggttcaaaccgaagggcatacatagaaaaaggtcacatttgcacgtacgcacaaacacacgaatgcttgcactgctgcagcactgcaatcttcacacttagactgaagctgcatatctccactacggataaaaagccagcgctctagctatctgttccctccatttcatcttaaactctgaaggagaagcagagagcctgaataataatggcttccacttggccatgcagatcacaggacgaacgaacgagctaggttaggcgttactccggaaggagccgtagccccttgcgctggcgcggaggatgacctggtggtacagcgccgcgatcgccgccccgatgaacggcccgacccagaagatccactgcgtgtgcgtcaatgcaatgtcagttcattatcctggcttgtgatcaacagcattattaattattctcgcacaaatttggcagcaagattacgttacctgatcactccatgccttgctgttgttgtacatgacggcggcgccgaggctcctcgccgggttgatgccggtgccggtgatcgggatcgtcgccaggtgcaccatgaacaccgcgaacccgatcggcagcggcgccaacaccttgatttttaccacagaagtgaagcaatgagctcgagttcttgccatgtaacacaaagttgtgtactccgatatatgcttaccggaacatgggagtcgcgggcgttgcgcttggggtcggtggcggagaagacggtgtacaccagcacgaacgtgccgatgatctccgcggcgaggccggtgcccgtggagtagccggcggcgagctcgttggcgccgccgccgtgccgcgcgtagaggccgctctggaaccccttgacgagcgcgacgccgcagatggcgccgaggcactgcgccgccatgtacaggagggcgcgcaccagggacaccttccgggccaggaagaggccgagcgtcaccgccgggttgatgtgcccgccggagacgccggcggtgcagtagacgaggacgaagatcatgccgccgaacgcccacgcgatgccgaggacgcccacgccgcgtcggcgccgttcgcggcggcgtccgtctggtgcttgtacccgatcaccgtggccaccgtgacgtagaggaacagcagcgtggccacgaactcggcgatgacggcgcggtacagggaccacctgcacagctcgtcggcgtcgacgagcggcgccggcggcgggtcctcgtagtcccggacgccgccggcctcgagagtggacacgtcaacctctttgcccattgttgccttggaagagacaaatggagaaatgctcaggaagttggaagtgttttgagctgtggtgtttgtggttgtgataggaaccatttatagagggtttatgagtgaatcagggaaagaagaagatggcttcatcatggtttgtaatgaaatttggaaggcattttcagctgtcaatgttgatggacaactaacggcgtttagatccttccacatttattttgtttgtcatttggatttttcttatctctactgctaaaaacagagtcatcatcattccatcccctcctcccacaacacgttcgtacactcagcgtacatagccacgaggccgaatgttttattcttaatcatccttctcgtctatctctaattatatgaacctggttcattacattatacagaaatgttattactaatatatataggaagacatacatatattacttatacacgcaatcaacgtatacaacgacaaatctctaataatgctaaatttctattgagaacatatccgcatacgcgggcagcataacatatattctggtgggtgtaggcatacaccctaaccgtttttttttctattatagttttagagtttcttactatgttttcttatttggacaatacatttttcatactccaactagatttatatatttgattatgattcttctcgttaattgaaatattttacattgacaaagtttgaaatctggtaagacctaagaagttcgttcaaactattgctaacgagctggtaataaggatggaaggggttatcttgaaacacatgggaatccctattaatgaatgagactgttatgaaatggaaaatgctacgtatatgatgtttttgtacgatcaaatgaggacggcgcttggcatcttaacgttacgtggtgcacgcgcatgttgcagcccaatcccatacgcatatactcattatttttctttgccttttttgctctatctatatccaaataaatataaaccatgtcaaacattggctcatacataaacgtttgctgcatcttatcctgatttgtgccattggaaatttagaatacttacaactaggggtgatgctaccagggtccgagatgcaaggaacatatttgcatgggtaatcctatatatctataaagctcatccccactaaatgtagttaatgctaattctctcttctctcgtgaagccacgtcacctcaattgtttttagcccttggatgattcatcaagggtgcaaattgcatctcttcttcctaaaagccacaacatataactcaaccatttataacttttgaataattgatcgaggtacaaaatatacaagcacataaaacaaaatcatatagtaaataagatattttttctacaactcatatctaactattttatcacacaattctcccgtagcaacgcgcggggtacctatctagtttacttaaactaggttcacggtaaaataatttacttaacttaagctgggtcacatgataagtgttaagcgacagtacgagtatataagatttattaggaaaaataaattactctggttagctgtgccaggaggcttaattgtaagatgtcaggacgatgatgtgatgagcttgggtttttggatatagggtcagcgctagaagaggtccagtgtgggaccagaacttgcaacgttaataagctttatgagcctagaagagaaacaattcatcgtacaactatcgtaacaaattagtcgtatgtatagcagcgccggttataaaatacgtgaggtgtactagtacttgagtcaggactttacatgtcctctagcgtttctaaaacttcttgtggtcataaagttttaaagttttgtataagatataaaaaacacgaatattagggaatgacttaatatcaaataattagaagtggtgagtccccgcaaaaaaaaaatagaagtggtgaggttctgaaactctaggtcgtttagcccaccaccttgtggagctagccggaagacctctagacgtttctcttgtgtaagatttcatcgaacttttaaaacttaaatataggacagtttcaatagaaatcgttgaatttcatcaacaaatcctgtgtgttgtatggtctgtcttctaatttatagttgatgtaggttcattctgccacccttattagcgtttgttagtgttcctttgctaagtggcacctctggttgtaacaaaaccgtccatcatatatagcctcattcccggagctgacaccatctctccatctagcacactttttggttcatgtcttgtggctaagatgcactgacactcatcacctaactgatagaattaattaagttagctcactttcaagaattaacaaggacaaagaaaagcttgatcacaacacagttggatcggtcatcatcagtcctctggcacgttgctagtgctgtcattctggtcaccggaggttcaattccatccacaaggatgaaacaatttgaaaagaagcgagcattctgttttcacgtcaccggccggccaatctgtacatcctataccaaaagcttgtcatgtattgagcaatatcatcttaaaaaaatattctcatgctttgatcttaaccatccatttatcatatgtattaaaactcactaaatatagttattgcacattgaactatgacacttagaaaactaatagtcactggatccttcttatgtttgatacataaccatccaagtatcatatagaattgcaatttcacatcaactaatatagaaaaaatgttatctatttagatattatgtgtaaacaatttacttattatattgttttcttcgagatttctttgaagtatattaaattttccgttgtaatgcgtggggtatctaatagttattttagccggcacttcccctaagcttgtcaacagccacattcctgagctcgccccatagtgttgccatcacttgcatcatatgttgctgccgctagcctcatgctcactttcgcatgcacatgcgcgggcatattaattatgtttcatagattttattatgttaagatgtactggtgattttactttattatttgttaaaaattaaattatatgatcttcatcgaaaaatgtttggtattgctgatccttcactggttgtatatatttacaaaaaccacaaaggtatttatatagataactgtgcgggcatcttgttaatatattacaaaattatacaaccatgtttttttttcttttgaatatgagtgtttgatattttaaaaacaaaatgttgaacatatttggtcactaaaatatttgaatcaaattaaattatattctatatgacggcttagtccagcatcgtaccattatatcttttcctcacgcgtgcattattactagtttcttcgataaaggatttatagttctggcctctacatgccaactaag

SEQ ID NO: 79051 - DNA, 18850 bp, Oryza sativa
atttaaattatttcttaaatgcaattccatttattacaaatactttcttagctcaaataaatcccagaaaaatctaggaattatagaattaagcaaagtatttaatgaaattttatctgggcccattttatattggaatttattaattaaaactagattttcttttcaagacttttaaaattatttctaaaaattccatttaaacaacaatttatatattttgaattttcagggtgtgacaaacctaccccccttaaacagaatctcgtcctcgagattcggaagaactggcgaacaggtgcggatgagctgacttcaattcatcttctcgttcccaagttgattcttcttccgagtgattactccactggactttgcaaaaacggataactcgattcctggttcttctctcacttgtttccaggatacggattggtttctcaacataagtcaaatcctcttggacttctatctgctcaatattagcttcttcggtaggtacccttaaacactttttcaattgcgacacatggaacacattatgtactcctgccaaagattgaggtaactccaactgataagcaacctctcctcttctactgacaatcttataaggtcccacaaaacgcggtgccaattttcccttggtatgaaaacgatgaactcctcgtagaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcgacacttccgaccatacagtgcttcgtaaggagccatctgaagactagcttgataactgttgttgtacgaaaattctgcatagggtagattcttatcccaacttccaccgaaatctagagcacaagctctcaacatgtcttccaaaatttgattcaccctttcggtttgtccgtctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgctaagcgacttccggaataagttgtctttaccggaatgaaatgagccactttggtaagtctgtcgactatcacccaaatagagtcatggcctgatgacgttctgggtaaaccagtaataaaatccataccaatttcttcccatttccattcaggaatcttcaaaggttgcaacaaaccggcgggtttttgatgttctgccttgactcgctgacaaacatcacatactgctacgtattctgcgatttcacgcttcatacttgcccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaacgaaacctctatcgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgatgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatgcacttgaaaacccttctttggatcaggcaaaatcaaaataggagctgatattaagcgacttttcaattcttgaaaactctgttcacattcttccgaccacttgtacttcacatctttctgaagcagtcgtgtcatgggcttagcaatcttggaaaaattctctataaacctccgataatatcctgcaaggcctaggaaactgcgaatctctgaaactgtctttggttgcttccaattggttacggattccacgttactaggatcgacggcaactcctccggctgagatgacgtgaccaaggaatttcacttcagacaaccaaaattcacacttgctaaacttagcatacagttgatgttctcgtagcttctccaatgcaaggcgaagatgttcttcatgctcttctttggttcgagagtagataagaatatcatcaataaagaccaccacgaacttgtctaggtattccataaacaccttattcatcaagttcatgaagaaagcaggggcattggtaagtccaaaagacataacagtacattcaaacaacccatacctagtggtaaaagttgtcttaggtatatcctcctctttgattctcaactgatgataccctgatcgaagatctatcttggagaaaacagtggcacctttaagttgatcaaacaaatcatcaatcctgggtagtggatacttattcttaatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcgtagataagaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctgggcagggacaaccttcacacgtcggggcttcggacacttgtcagcataatgtcctggatctccacagttgaaacacaccacgggcttgttgccttgctccctcttggcaggttgttgctgtgctggagctgcaacaggacgtggagcttgattacggatgttgttgccagcattgttgttgaagaactgacgttgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggaaagcgacctgaactccttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttttggggaggtgcatgattattcccttggttttgctgattctgaaattgctgcatcatcatgttcataagctgtgtctgttgagcaagaacttgggccagagtgggattctctccattgttgttgttattggggttgttgggaccattcccattgctacgagtgttcaccatctggcatggacagggcacaagaagagaaaccggggaaactacttaggacagagaattactttaacttttattgatcttaactgagtttcattattacaaactgaagactctcacaccactaaactcaccaacttcctaacactcaaaagcaaacaaacacatgcaattacatcccaccactgatgtaaatcacatgcgagacacacacaagcaaacttaaagcaagcaaactaacacaacgatctaagacaacgacttaacaagtcactctagttcttccaagcatcggaggtcgattgaaggctcgtcttcatcatcttgagttgctacccactcaatcttggaattgttgcgcttagattcttcttcttcatcactacttatgatgatgaccggaggatccgcttgagctggagcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccgatcttcacgatcttgagctgctaacacagtctccgcacgactttcatccatagcccacaacatctcaaccaaatgtttcgtggtaacatcattctcaattccttcagtctcaaggtaactgccacggtcacttccctgaggttggcgaggatggtagcgatactcagtgtcggccaattgatcactgtagcgatcacggagctctcctatggcgatccttgccacctcctgacatgcatggatgtagtttcttcctccagcttcaaacatcactgaggggacctcttcactattgctgttcaaggtgactctgactcggcacttctcttcatgacgatcatgaggaatctgggcataaaaaggggcagtcccaaatccaatgacaaaggacatcgtgcgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaagaggtaagtaaataaagtaaaccaagctttgcgaaataaattaaaacagttggaaacgaggtcacaaattttgtaattttgaataactggtttcaaaagaaagttataaaatcaacatactaaatttattttattgcagcaagattaaataaaacagtattgtaaaacttttgctggtaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacaaaacagttaagtaattacacaatattaagccaacgctatacaacataccctgttgtataggcccaaccattctgaacaaccaccccggctgcacagttctatctccaaaccaggaatgtaccattccaaaccaggagctaatcaaattattatcagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgcccacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcaagtacgaaagggccataacaatcaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaaggggatttattgcgtcagcgggctagggtttggtggaccgggcgcacgggcggcggttcacgcgaacggacggccgagatttaaccgatccaagatggacggccgagatcgatcgggtccacggcggctcacggcggacgaccccgatgacgtcagcggtgacgtcaccgacagcggcggcggctcggcggagaagacggctcgaacggcgcacgctcgccggcgaacggcggcactaggacgcaaacggagggcaccaagacgtagaggacaacacggcgaactcaccggtgacctaaacggcggcggaagaccaacggacggcgacggcgacgaggaggaagcggcgaagctcttcgggtcgacggcggcgaagctgatccggtgatctccggcgacggcgaaggggcggacgaggacggcgacgacttggcgagcacgacggcggtcttcccgagcgacggcgacggctgaaacgacggcggcgcacggctggagcgacggcgacgacggcaaagctagggcacacggcgctagggcttttccgacgacgagaggcgaaggcgaaggtggcgacgggtagagaagacaccgggggtccttttaaaggggctcggaggcggcggcgaaggcccacggcgacggcaacggcgaaggaaactcgcggcttggagagagggaaaaccgatccgaatcgaactcgattccaaagctttccaaagcgatttaaccaaagattccaaaggagaaaaggtagaggagatcccagagatcatttcccctctaacaaatcggccggagaaggaaaggaacggccggatttggaaagcggcggcgacggcagctcggcggcgcgaaactagggtttcggcccgaggaagacgacgaccgacaagcgggacccacctgtcagcgacagcgagggcgcgcgcgcggctgactgggccggctgggccgaggagagagaagagaggttttgggccgactttcggcccaaagccaaaagaagactttttaaaacctttttcaatttaaattatttcttaaatgcaattccatttattacaaatactttcttagctcaaataaatcccagaaaaatctaggaattatagaattaagcaaagtatttaatgaaattttatctgggcccattttatattggaatttattaattaaaactagattttcttttcaagacttttaaaattatttctaaaaattccatttaaacaacaatttatatattttgaattttcagggtgtgacaccaagtctatccgaaactctatgtctctcttaggtggcatacctggcaaatcctcgggaaacacgtctgggtagtcttgtactataggaatctcttgtagagcaacttggtttaagttcacaccatgatatttaggggaggacacaaagaaagaaacggtttcccaattgctactggttaaagtcaccttacggttggcacaatctataactcctctgtgacgagataaccagtccatccctaagataacatctagatctttggattctagcaagataagcgaggatgggaaaagaacttcttctatttctatagtaacagaaggacaatactatgtcgaaaatacttgattgcctggggtattaactagtaaaggtctcccaagactaacaacttccatcccatgtttgctcgcaaaacttttagacaaaaaggaatgtgtagcaccggaatcaaaaagcacagttgcggtatagagttaacaggaaacgtacccaaaacaacatctggtgcattctgagcttctgctgctgcaacatgattaacacgtgccttcggtgctagaacattggagttgttcggggctggagcgttcttcacatgccgaggcttaggacacttatcagcataatgtcctggatcaccacaattgaagcatatcactggcttgcttccctgttccttcctaacgggctgattctgagctggagttgctgcaggacgagcaaccatgttgcggttgtcattgccacgattaccagtattgttattgtagaactggcgttggggacggacaactgatgaagatcctccttgagggtacgatggagcttgaggtccagtaacgagacgcggcctctggttactgccctgttgtgccttgaattgggcagccctgcgcttcttctgctccatccggttatacttgtcttcctgacgaatcgccttgtccaccaactgctggaaatcccggaaatccgtagacatcaaggcataagacaactcatcattcagtccctccaagaacttctcctgacgctcttcatcggtgcgaacatcttccggagcataacgagctaaacggttgacatcatggaggtactcggtgaccgaacgagatccctgattgagtgctctaaattctctcttctttagagctacaacacctgacggtatatgcgtcttcttaaaagcagtcgtgaactcctgccaagtgataagttctccttcagccctgccttggcgaaaatgatcccaccattcagcagcaggtccatgcaactgatgcgaagcaaaagaaactttctcctgctcagtacactggatcaaatccaacttcttctccaccgcatgcaaccaatctcctgcttctactggattggtggtgcttgaaaaggtagggggtctcacacgtaagaaatctgccaacttgttttggggaggtgggggtggattctgattctgattgtttgcctgctgattctgtgcctgctgcactaacagattgatcagttgtgtttgttgggccagaatctgagctagcgtgggatctcctccattgttagtagctccacttccacttccacttccgcttccacttccggtgccagtgcgcgtgttcaccatctgatgataagcagagacaacaggaaagaacgacagagagacacccttagaacggagttacttaattaatttaaattctatattgctcttaactgtgtatgattacatttaagtggcattaacactatctcaccaactatcttacactctgacaagcaaaagaactagactcatgctgttacatcccaccaatgatgtaagcaacaactaaaacccacacactcacaaacaaacttaaacaagcaatctaacacagcgaactacggcaacgatctaactaagcgactaatcccgccttgcgtcggaacgaagcgatggatcttcttcctctggagtagctggctctctttcttcagggtcttcctcttcttcctcatcacttatgatgtcgatgacaggttcagcacgatcgggcacagcttcacccatcacgcgaatcttcgaagctaactggagacgaggtggcggacaggttctctttcttgcgacgaggcgaagcttgggtgttggcggcggcgtttctcctttgagttcagctaattccttctgtagacggtacaccttgctctccaacttgcaaatcttgcctcgattccagttttccctgtcatgagctgctttgtctcgctccacacttactgcatccatagcactaagcatatgcaccacatgcatcagagtggcactctcttcaccatcaggacagatataggttccatagtcttgaccatgaggcttgtgaggatgatactggaaagctgatgaatccaactcttcttcaaaacgttgacgcaactctccaatggccaccaaagctgcttcttgacaagcatggcagtacgatcttcctccagcttcgaacttaatagacggaaggtcttctctatcactagccaacgtcacacgaacacgacacttctcctcgtcggggtcatgggaaatctggcgatactcaggagcaacttcataacctacctcaaaagccatcaacctcagctccctgacgaatcctaacacctcgatcaaatttctcggtgaatggggcggcatctaaagaaacatggaagagaagaattaatgcatattttttctaagttagctgcaccaactagacttaactgatttttgaccaaaaaggaagaaaataaaagaaaagacacataaaaagctattttataaatatttttagaatttaactttttagatagagacaaatatattttttttgacaaataactaaaacaaaactaaaatacttatgatctattttaagcacggtacagtgtcaccacaagaaagatgagtagtactagtgctaccatgattatgtcgataccataatagatgtacagtgccgactaatcaataagaaaaaagaaatattttgagaagaacaactttttgctattaaaagaaaagaagttgaattaaataaattttgtgcataaccttgcatgtgttgccaacttaattaatttataagagaatagagaagagcagttctattttcaaaatattttgaaggctacttaaggtttaccatttggcttatcctaaggtcaaggtggctctgataccaacttgtcacgccctgaatttctatccaaaattccaaacgcttacatgtgtgttaaaccctcgtccaggaatcaaccgaggcacacaatgacaatattgataatagagtacaattaaataactatttaacaatcgcaaataataaattattacagaggtagatagttcctctcaaaaaaaataacattctacgcagcggaaaaattaaactaaaacaatctacggaacagctatggcaactccactccacagacaacttaaccaggacaagcctaatcctccagaccatcaccttcactcaagtactcctcttctgatgaatgaatattgcaagaatgagcatatgacatactcaacaagccacacagcaaatatgcaagtgcacaggataacaaaggatggcataatacagttcatttgcagaaaacagcatttaataaatatttaagagaatagtaaaacagttgtataattaaccaatattaaataaacaccatacaacacacccgtgttgcataggcccaaccacatttgaacaaccaaccccagttgaacaaattaaacctcgaaaccaggaattatccattccaaactaggcatcaaattaattaccacattattaccattaatgggtagtgtgagactaatcacgaaaaatattgctcaactcacccataaccgcgggtacggctattcgaatagattaaactctgatcagaggtgtaccactgtacccacaagacacaaccccacatcatgtcaccatgtgcctcagtaccaccacggtacctcggaaaggagtcgtgacaatacccctcgcacaacataacccattacagtgctcctttcctggatcataatcaccccctttaaaacaaggcatggactccccagcgacccccatggacttctcgccacttctcagtcgggcgcactataatgaatcacgctatagaaaagataaagccgttgcccacgctggcttgtggttggcacgataaatgtttcacaacagtagctcgcgaaccggtccttaattgtcatgagcacaaccatcaaaaccatatgctcacaacccaccttatccaggttttaattatcaattaattaacatcacacgatttaccatcgtgagctaccattgaatataaccctaattaataataacaattatgtaatataatttatatttaactccttttgttagctaatgtttctaagcatggctaagcaaacttacatatagcatttagccgaaccaatccaatatataaggttcatgctaatcaaattataacccataggaaaataaagtcatcttcggccattaattaattgggaaaggttcaccacccgatgacattcgaaaacaatgcatagttgaaataaaataatagctttaaacatgatcaacatgctcaaagggtcgtttgggatctgtgtgacttgccttgggcttccacaaacgcgtcggaaacttcctcaacggaaacactctcctccggaacgtcgaaaactaaagcaaataaacaaaatcaacaaaacagtacaaaaacaagcataaacagtacatgtgaatatttttaacatgtagatcttgattttagaaaaatttagaaacttgaaccacctgaaacggatctacggttatttagttatgattttccgaagttttaatctattagaaaatcgggaaaaagaaaaagaaaaggagatgatgacgtcatgctgacgtcatgctgacgtcggcaatggcggccggctagggtttgcgagctcgccggagctagggcggtcggccgggtgattggagggcacctacgcgtagaggacatcgagacgaacccgatggtactcaccccgacttcaaacgacgaacgatggcggccggcgacgaggaggatggcggcggcggctcggcttgacggcgacgaggggactccggtggtcggcggcgaaggggaacgggcggccgagattcctctcaccacggcgcacctaacggcggcgacggcaagcggcggcgacggcggagacggcgcgacgacgacgccgaagacggccggcggcggcggcgagcttggcgcgcttggcggcggcgctacggggcacaggagagctcgggagagggggcaaacggaagaggacgacgaggggaagctttatataagctcggattgaagagatcgaactccaaacgagaggaatcggctcggaaaagattaaaactcggttttagggataaaatcaaaacgaactcgattcggatcaaatcctcaacgattctctttgattcttggggaaaaagaaagaggagaacgagaggaacaaaacccctcaaaaacccgaaggaatcggagtcggattgaggcgaatttggaggtggaaggcggcggctcgggctcggtcggcggctggaggtaggagatggatccgacaggtgggccccacctgtcggaatccacgagagaggggagcgggcggcgtcggcttgggccggcatgggccggttcggccgcgcgagagagagaggatgttgggccgaaaacggcccaacggcttagggaggggtttttaaacttttttgaataaaacaatttgtgaaatgttgtttcaattattaaaaatacttcccttgctcaaataattcccagaaaattctagaaaatagaggagcaagcatagtatttaataaaattttatctaactcatttttatattgaaaattttcctagaaaattagggtttagcttgtaggcttttaaaataatttctaaaaatgatttaaaatatgcatttttaatttaatcgatttttagggcgtgacaaacctaccccccttaaacggaatctcgtcctcgagattcagaagaactggcgaacagatgaggatgagctgacttcaattcatcttctcgctcccaagtggcttcttcttctgaatgattactccactgaaccttgcagaaccgtataacgcgattcctggtattcctctcgcttacttccaaaattctgactggcttctcaacataagttaaatcttcttgaagctctatacgatcaggatctgcttcctctgtaggtacacgtaaacatttcttcagctgagacacatggaacacgtcgtgtattcccgccattgacggaggcaactctaactgataagctacttcacctcttcgactcacaatcttaaaaggtcccacaaaacgcggtgccaatttccctttggtttggaaacgatgaacacctcgtaacggcgtaacccgcaggtatacataatctccttcttcgaaagccaaatctctgcgacgattgtcggcataactcttctgacgcgactgagcaacgcgcaacctctcttggataatctttactttttcttctgcctgtcgcaatatgtctgtcccaaaaacttgacgttcaccggtttgatcccaaaggagcggcgtacggcactttcgaccatttaatgcatcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtttgagggtgataagcagtactgaaattcaaacgagtacccaattctaattgtaatttctgccaaaacttcgaagtaaactggctacctctatctgacactatcttcttaggaacaccatgcaaacataccactctggccatgtataactctgcaagcttatgtcccgtataggttgttttaaccggtataaagtgagcgactttagtcaatctatcaaccactacccaaatagaatcatgtcctgccgacgttctgggtagaccggttataaaatccattcctatttcttcccacttccactctggaatcttcaacggttgtaacagaccggctggtttctgatgttctgccttgacccgctgacatacatcacatagagccacatattctgctatctcacgtcgcatactggcccaccagaattgttgctttaagtcttggtacatcttagtgcttccagggtgaacggaatacaaagtttcatgagcttccttcatgatagtattcttcaactccttattttctgggacgcaaattgtttctcctaaccacacagttccctgctcatcttctacaaaaccgatggctttacctcttctcatgttctttttaatttcttgtatatcaggatcattcacttgagcttctctcacttgatcaaacagagtaggtttagcttctaaagcagccacaaaacctttactgattattcccaagttcaacttttcaaattcttggcataactcccaaggtaaacgtcgaccttctgacatattacagtaacttttcctgctaagggcatcggctacaacatttgctttccccgggtgataatggatttccatatcataatctttaattaactctaaccatcttcgctgacgcatgttcaaatcaggttgagtaaaaatgtacttcaaacttttatgatccgtatatacctcagtacggttaccgaaaagataatgacgccaaatcttcaatgcatgcaccacagctgccaattctaggtcatgcgttgggtagttattctcatgaggacgtaattgcctagatgcataggcaaccacctttccttcttgcatcaacacacaacccaaaccgtgtcgggatgcatcacaatacacttggaaacctttcctcgaatcaggcaaaattaacacaggcgcagtcactagccttttcttcagttcctggaaacttcgttcacaatcctccgtccacttgtacttcacttccttctgaagtagacgagtcattggtctagcgatctttgaaaagttctcaataaacctgcggtaataccatgcaagtccaaggaaactacgaatttctgtaaccgtcttgggttgcttccaacttaatactgactccacattgcttggatctactgccactcctccagacgagatgacatgaccaagaaacttcacttcggacaaccaaaattcacatttactgaacttggcataaagctgatgctcacgtagtttctctaaagctagacgaagatgctcttcatgttcttccttcgtcttggagtaaataagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtcttcggtatatcttcctcacggattcgaagttgatgatatccagaacggagatctatcttggagaaaactgtagcaccttccagttgatcaaacaggtcatcaattctgggtagaggatatttattcttgatagtaacctcattcaacgctcgataatccacgcacattctctgagtatgatctttcttctccacaaagataactggtgctccccatggcgaagtactgggtctgatgtatcctttctgaagcaaatcatccacctgtttcttcacctcagctaactcattagctgccattctgtatggtctcttatggattgggttggttccaggtaccaagtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacaaaacagttaagtaattacacaatattaagccaacgctatacaacataccctgttgtataggcccaaccattctgaacaaccaccccggctgcacagttctatcttcaaaccaggaatgtaccattccaaaccaggagctaatcaaattattatcagtttaagcatcttttacaatgatgagaggtgtgagactaatcacgaaagacatttgtagaccccgccataaccgcgggcacggctattcgaatagtttactctgatcagaggtgtaccactgtacccacaagacacaaccccacatcatgtcaccatgtgcct

SEQ ID NO: 79052 - DNA, 1254 bp, Oryza sativa
agagagagattagaggattttcacaaataagaaaggatttttattttgaaaatattgctaaggtttgggatctacggctcgtcctagggtcaagggggctctgataccaacttgtcacgatcggaattaacccaacgggcgttccttacgtgcgtgtattattccttgtcccaggaggcaaggtacaccaaaagttgatacatttcagagtttataaagtggaagcgtaaatagttaatttattacatgggcggcgaagacccagcacacacaaaaacaaacggaaaacagcggaagactagggcgacgaccacaggcgcttgacggcaggcttttgtttataaccagactgagccacaaactaagccttacctactagacatgtggaagtacggtagtgctttgcaacagaggctcgaagaccggtccttatatggccgaggtgctactatcaaaaccatgcaccccgagcccagcctaaaaccattttgaggattttgaatagagggggaggtgtgaatccaatttccacaataatcaaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacataattttataaactgggattcaatatgtttaaggatgatgtgacttgccttgctcgctttcccaaacgtcggcttcaacttcaacgaagagcggatcttctgaagctgcagcgtctacacgaccaacggaaaagaaaaggcttttactctaataaactccatataacaagcacgaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaattttaaaagggtttattgcgtcagccgaggggagggggcgcgcggaccgggtccacgggagtggggcccacgcggcagcctcacggtccacggtggaccgggtgcact

SEQ ID NO: 79053 - DNA, 8175 bp, Oryza sativa
  unsure (1)..(8175): unsure at all n locations
ggcctctgcagcttatttctggtccaacaccctcaatgcctttatgttcaatcaagggccgatgaccccctgttaacaaccaaatttggtaatatcggcatcgggaaagaagattagatcgaagtgaagtcgaaggcggagatcgaatccgaaaacagagtaggaatcggctggagtccagatcggctatgattaggatcggctgggtctgagttggactaggtaagccgatgcagccgattccgacaatacgacttgatgtatgacattgggttgaattgaggtggttcaagatgattgccgcgcatggatagagtcttgagaaggcaattgtatctattaattaggatattttatgtaatttccttagagatatgcttgggcaaaagtctgccgcaaagacttatggtatcttagagtttgttagagataatagtcgtgtctggtatggacatgtcttgtaattctggggtataaatagacctgagccctatgtaattttaaacacacacacgttcaatacaatttcggcgcatcgccaccttttgctttagttttatttcgacgagttcttgctttcgggttgagctgcgttggtttcgatcttcaacaaaaggtaaaacttgttatgatggattgtgttctagggataagtgcttccatctttacgatactctaatcttgtctatgtaattcgtcaagttatcatatatcttacataatcttcgacaatatcgtcatctaacctacaatcggctagcatctgtcgacagaaggcagccgattaggttaaatagcggcgttgacgtagattatataagatatctaccactttatgaaacatccagcggcttgattgtctatatattgttcttcttttcatacttaatgctgcatcagttgagtttgatctattaagtcgtgcttagagtttcaatctctagcctgctttctggttgctgattagggtagtatcagagtttcatccgatcttatctgatttaaccatattcgctctatatgcttcattgatatgttaaatccaccctttacgtcaagatcttactgcatttaagtatattaggcttttgtttgatatattatacttgttttgatatcttgatatagagtagtatcggagtattagccgatacatgctagatctatctgatcggctatgctataaacatatataatgctgttattaatatatatttcgatctaagtgatttatactgtctcggcatggcaaccgatctatcccagtcacttgatttaagtatatatcgatataagaactatatattgttaatatctacagccgatcgaatatatttagttctttattgtctatttacaaccgccgatcgattcacatatgacatcggctcaaagataaatgatatgtcattggcacctagccgatcggctatcatttatagatttaaccgcggtctatttgtctctatttcttgttgattacagaatcaaatcaactggcacgcttatacatccaaaggcgaggtttggacctgcactggagttaagcagatctcccaggcctcgtgttttctgtcaacacccccactctgcttgacgtcatcatgattactggtttagatgtcacctcttcaaccaatcccatgaccctgaactccaagaaccagtttgagtttaaaacaaaaaccataggtggctggtctggctatgtcgctgcaaacatgggcaaaggatctgtcaccccccaagagcacacaacctttctgctaatgtggcttgagaaattcctgttctgtggatcgagttgtggccctaccaccaactggcagttcttagccgaaagccttgaagcaaagaaacaaatctgtttaggcaaaatcctcctcggctatctgtatcagatgttgaacaacgcatcgactaaaatagccacaagctcgatagtagctgcaagtggaccatggtggttactgcaaacatggcttaacttagtcgtcatgaaagctgtgaatcagccagccctatcagagtcctagtttccaagtctaaagccgatcgccaatgaagatgggggagaactaactcatcgcagatgcatgtcctatggagaagttgcatcaacaccagccaattctggagcaaagctatcagctgaactgctcaaggactggttctctagcttctacgatggcttcaagaaagatgctcgagtctagttcgcatatgaggatacagtagactttgagctaccatcggacttccggtttgaagaaatcaactctgagaagtacgataagtctagagaagtcttttcagctgctatcagcccgtgtattcttcctattggcattcatcaaggaagaaatatacaagtatcctatgagttctatcacccaatgagctcggccaggcagtttgggatgggacaggtcccaatcggcttgtacttcactgataagatccaatgcagaggagaaatctcatcaacactgatgatggatcggctgctcaacatcccaggacctcctttgggcagcattgaaaatatagagctagcaaggttcaagagcaggaactttgacagatggtggggtgaatggaagcaacacttgttccaacaatcggcttccatgtacatgacagatctattcccggatgtcatccctcaggtatatcttgactaatctcttcttctattttgcagacaacagaatcctgtcctcctcgcaaaagcaatagtggcaaggatatagaatatgctccaggccttatcccaaatggaggtggactagctccccctgtcattggctaccatgccccaggacctcaagtttactccaagggcagctgggagaatcggccgatgttggcaaaaagaggaaaactaaggcatcagctattgattcatcaactctagcaccaaagaaaaaggccaaaaagaagaaatccaagcaaaccaatgatttgcctgccatagacccgtccatagaacaagccttggatgaagaggaaatcgaggaagatgttgaccaagcggcaaccgaactgagtgacttaggagaaaaaacaccatcggctttacccaaacagactcctccaactcctgcttctccagcccacttttcaatggtaaataactcatcttgatcacctttttgaaaaaattgtagagccgattatttgtaagtcttgtatttgcagaaaaagaaaactactgtgaagaagaaattgacactagcaccatctaaacaggttccatcggtaaggtttcttctgtaaaatcttttaaatttgctcgtagccgatgataattaacacttgtctcttttagcgtcctcctccttcacctcctgtacagctgatgtcaagtgaccgtagtccatcggctatagacagccacaacattgaggaagaagaagaaccagcagctcctgccatcctagtaagtctcattctaaaaattcccagatcggctgtataacatattttgatattcaattatctcaatttccacttttgcaggtattagctgatatgttctcctttgatatcaaggattatcttgatcaagaggcaaaagatgaaacaacangcaagaccctagcttctctagacgaagatgtcaaaagaactcttgaagatatatctcatcggctagaggcatctttaaacaatttgtgggtgattgtggtccattcgggcaagacttcgagaaattcacgctctgatcccggatgatctttcgaacaccatcactccagctgcatacctcgagccacatcaattcaagctagaaaaaactaaccaaagattacccgaatggcgagagcggaaggacatcgaagccacaatccaagccatcggcnaactcgtgcatgaagagaagtccaagcttgataaattatctgaaggtccgatccagtccaacatagatcggcttgaggcccgaaagattgatctcatggcacaacttgaagaatgcaatgctaaattggccttggaaacacagaagctagccaatctcccaaaagcaatcgaagagaaaaaatcatgacttaaatcggccatcaaaaatgttgctgatttaaccaagtctgtgaaggttatcccaggaaccgatgcccaagacatccaagaagtagaggaaattagacaatgacctatatcggctatcctgcaatacctctctaaatgattggctttgtaataagacttagcttgaaactcatttttgtaatcggctatttgtagtctaactcttaatccatctgccgattaatataattttcgcgttgaaaatccactttttttttcatatatctgcccccctaattttgcaatgacgaaggcattgataaaattataacttgtactaagggcgatatagcaaatatcggccatcatacatcggcaaaacaccatcgattataataatacagaaaaacaactaagggcgatataaccatatcggccgtcatacatcggcaagacacaaccgattatgataacaaaactaagggcgatataactatatcggccatctgaaggcgatctaaatacatcggctaacatgcatcggcaacacttagccgatcatgcaatgacccagacacttgggtaatatttcttcaagtacttgtcattaagtgctcgtccataaacttctccatcaaacccttgcaacatacaagctcctttggacacaaccttatggatttgaaacggtccttcccaatttggtgaccacttgtcacgccatgaaaatcgcctagtttaataattcattctttaaatcatttttagaaattattttagaagcttacaagttaaactctaataatctaggaaaaatttcaacataaaattgagctagataaaattttattaaatactttgcttgtttatctattttctagatttttttggaaattatttgagcaagggaagtatttttaataaatgaaacatcatttcacgaattattttaattgaaaaagtctttaaaattccctaggccgttgggccgtttccggcccaactcctcttttcctcgcgcgcggccgtgcggcccaagccggcccaagccgagccgccaccgcccccctccttttagccgccgacatgtggggcccacatgtcggggttgtcttcaacctccagccggcctgccgagcccaagccgccgccgttccccgccaaatccgccccaaccggccatctctgagtccgattggttgaggggtttttatccctttgttgtcctctatcctttccccaagaattggagctaattgcttcgtattttatccgaatcaaactcgatttcgagtttatctttccacctaaccctaggattttccggcttcgattcctctcgtttggagtccgatttctctaatccaagcctataaatagcatcccctagtcatcctcttctgtttgcccgaagtcctagccgtcgccgttgcccatagcaccgccgccgcgttgaactagtcgccgccgccgccgatgccgttccagccgcgccgcgccgccgctgtagccgtcgccgccgcttcccattcgccgccgtcgggtgcgtgcgaagaaggagtaccccggcaaccccttcgccgccgtcgcaagccgccagagcgccgtcgccaccgtcgagccgagccgcgccgtcctcggtcctcgtcgccggccgttgttcgtcgtcgtccgtcgttgttctttgcaccggtgagttcgcgtcgtcgtcctctacgcgtaggtgtccttggatagcccggccgagccctctaccaccggtggtcgcgtcatcccgcaccatggccggcgatgatgtcgtaatgacgtcataaatcttttatttaattcgtaataattttctgtatttgatgaaaatctgattaaacttcagaaattcataactaaatcatcgtaactcggattcgagtggttcaagttgctaaattcatctaaaatcgagatctacatgttaaaaatatccacatgttctgtttatgcttgtttttgtactgttttgttgattttgttcatttgctttagtttctgacgttctggaggagagcgttttcgttgaggaaggttcagaagcgtttgaagaagctcaaggcaagtcacatggatcccaaacaaccttttgagcatgttgaacctgtttaaagctaatgttttattttaacttatgcattattttcgaatgtcatcgggtggtgaacctttcccaattaattaatggtcgaagatgactttattttcctatgggttataatttgattagctagaaccttatatattggtttggttcagctaaatgctatatgtataattgcttagccatgcttagaaatattagctcatcaatgggatgaatcatattacattattatttatgtttatatatttaatggtagctcacgatggttaatcatgttatgataattaattgataattaaaaccttattaaaggtgggttgtgagcatatggttttgatggtcgtgctcatgacaattaaggaccagttcgcgagctactgttgtgaaacattaaccgtgacaaccacaagccagcatgggtaacagctttaccttttgtatagaatagttcattacggggtgccagactgagaagcggcgagaagtccgtgggggtcgctggggagtccatgcctctggttattgagggggtgattatgatccaggaacggtgcgctgtggtggattgtgttgtgtaaggggtactgtcacagttcctatccgagatatcatggtggtattgaggcgcatggtgacatgttgtggagctatgtcttgtgggtatagtggtacacctctggccagagtaaaactattcgaatagccgtgcccgcggttatgggtgagtttaacaatgtttttcgtcattagtctcacactactcattattggtgatagtttgtgataactaaattgactcctggtttggaatggtatattcctggtatggaggtttgatttgtacaaccggggttggttgttcaggtgaggttgggcctatgcaacacgggtgtgttgtatagtgttcatttaatattgcttaattactcaactgttttactgttctctcaaatgtttattaaatgttgtttatgcaattgagctgtattatgccatgctttgttatcctgtgcacttgcatatttgttgtgtggcttattgagtatgtcatatgctcattcttgcaatattcattcattagaggaggagtactttagtgaaggtgatgatcaggagggttaggctttgttcgggtcaagttgcttgtggagtggagtcgccatagctgtttagtcttatgtttatttccgctgcgtagaattttattcttttgagaggaactatccacctctataataatttattattttgcgaatattaattagctgtttgatagtattctattatcaatttgttattgtgtgcctcggctgattcctggatgaggatttaacgcacatgtaagcgtttggaattttggatagaaattccgggcgtgacaccacatgccgaatttgttatctgagttcctatcggcaaaattagcttccaaacaagctctccctcagaaaaagacttaggcaccaccttcttgttataatgttgagcaaccctttccttatccttggtagcttttgcaagagctctcaatctggattgaaccaaatcttccttctcatcggccatgagattataatattcattagctgacaactcattctgcaaatctgttcccatggtaaaactgcctcaaatcaatccgtggcaagccatccgataagaccacaatgcttcagccaacctagtatgccattgccgaggataatcagaaatctttctcttaatcaacttgatcaaactcttgttagacgcctcggcttgtccattggcttgtgcataatacgacgcagaattcaacattttgatacccatgctatcggcaaactgaacaaactcattagacacaaagatagacccttgatcggttgtaattgtttgaggaatcccaaatcggtaaataatatactcttgaacgagttgtatagcatcccccaaatcattagcttcaacattttgctcccgagatacatgctttaaagttaccagccgaaatccatccatcaact

SEQ ID NO: 79054 - DNA, 42890 bp, Oryza sativa
cgcggggtgttttttctagacagtggatcccccatggttaaccgccgtgcataaatggcaatggcgaaacaaagtaaaggacagataaactttattgaatttcggtgatctaagcctggaagccatggaaacctcttctttatttttttggaagaaagctgggattgggcaagggccatgctttggtgatgattagagtttgttgaattcggaattctgttggagatcgatgggcaacgcgtacgtgtgtggatcaagttgcgcgcgagcacacccaatttcatacgaaaatggtggagtttgtttgaaactttgaatgggggtggagtgtgatcggtgatgtgacgccagttaggcattgtgtttaggattcataagttccacgtgacatttaaatatgaaactaaaaaaaatgaataaaaaaaagacttgagcctctccagataaagatttgaaagtatcgctcttaaggagtactattttcaaaccttgcactagtcacgcgttttcggtcctgctcctgcttgggctctgagttcataattttctcatgccaaacactatggccctgtttagttcccaaaaacttttcgcaaaaacataacattgaatattgggacatatgtatggagtataaaatatagatacaaagaaaaattaatcgcacactttgtatgtaaatcgtgagacgaatttttttatctaattaattcatgaatagctataagtgctatagtaacctatatgtgctaatgacaactaaattaggttcaaaagattcgtctcgcgtttccaggcgagttatgaaattagttttttcattcgtgtccgaaaaccccttccgacatccagtcaaacgtccgatgtgacacccgaaaattttcatttcaccatctaaataggccctattacatggcatatttgtaaattataaacgccctcatacgaaataatcgactttataggttttgatcaaggtagttcaattagaagtatatattaacgtgtaaaaatattggatttatagctattaaaaatataatttatgataaatcaatggtcaaaagttgatgagtaaatttcattttggtccaccttttgttatcaatatttcgctttggatcaccatttagccaatgtttttactttggaccggataaagttgtttttgttttattttagaccacccaacctacttctagagcatctgaacgatctcgattatgtcgattatgtcagttttctacttgtcaatgaactcctcagctatatatgagatcatttcttcagcatattataagtttaatatagatggataaaagaattaaggatggttcaaagtgccacaaaggtaaaagtatccgattcaaagtgaaaacattgtttttatggtggttaaaaacaaaacatcagtaataaaaaatgacccaaagtgaaatttactcctgaatttttctaaaaaaaaagaatatatcatacataaaatttttaaattagaatacatcataccgaaaatcaccaaataccggtagcatagtagtgtgtgtgtatatatatatatatatatatatatatatatatatatatatatatatatatatatatatatatatatatatatatatatatatatatatatatatatgcaaataaataggaattaggcaacctatatgaatcttcacatttgctaaacctttcggccgtgcgaggacctcgctaattaatattgtcaaaccatcgatcgagagactgatatacacaccttgtctttttaggatgtcaactgtcaagtgccccataaattacactccatccctaaaaaaacgccaaaagataagcgaaagagcttcaaataatttttaattagtccactgtacggcatcaaccaccgttttcgtctcccattttattccgtggaaatggaattgaacaacgacggtgcgccgcccatggaggaaaaaaaattgaaaattaaaagatgacaacgcatggtcacgtcccacgcgtagcaacctttgtttgtgcggcgagttagttagtccagtaatttatcgcgtaaacacaatgggacaaagcatattaatccaggtaacgcgttgtttttattaagatatggattttatctcgtttccgttaacacatttttcaaattactaacctatatatttcgtgaaaaaaattctatatagaagttaattttgttttaaactattagataaataacttaataaataataataataataataataataataataataataataataataataataataataatattcttgttttatgtattttttacttaatcttcatcctccatgaattcaaacggagccttacagcctttactgtttaagcttgcatggtaggagtaacacataattaattatgtagctaatgacaaggtctgctagctaatgacgaaggtttacactgtgaatttagctggcacacgcttaactaatttgcttcgtgattaggcaagaccagcgatagcctaaaaactaactgctgtttggacgagccgtgccacgtggcggccttcagcatgcttcgtgccttcgtctcggagcggaggaggcgaaacgaaagctgcgaggatctgacgtggcaagaggcgataggctcgatgacatggcggcggtcaaagatgccaaagtcaaacgcgcggtggaaatgcggtcaaagaagtctacgggcggaggcggaaagttgactttgtggagattttgcatattttaaaggtgaagcttccttccatcttgtttcctcgaccgtgttctcctcctcgacattttttttccccttcgaatttaattttttttgttgccgtatgttttcaacttctgaatttgcaccatggacgttgttttttaaaagtgtgattaattagtctttgttttcttttgtcatataggatattaacagttgtacctcaatgcactattgactttattttgttttaatgtataactttgacccgtttttcttattaaaaatatgcttccatagtctgtatttaacttcttaaaatagaaaggaaggtgatgtctgtatttaactctctaaaatgaaaagatgatcacccttcacctaggcattatcagatcatgccacccatttagctagcagggtcattctcctgcttgctcttgagttgcagtctcgctcaaaagatgaaatttgggagagaatggttttcaacttgtggagagtgagaatgaaagataagggaatttcgtttttgtgagagagcagggaaactattagtgtatttttttccgactgaaatccccaaaaatctatattgggaatggagtaggggcacgatgttcttagtatttcatctttatattttttgaaataaacaaataaaccgacagagtaatttacccatagttcagtcacgtggctggacatgtctttttttttaaaaaaaaagaaaagataaataaaccgacagagtaatttacccatcgtcgtcgccggagatgtctcacatgaccgagacaagatttggagctttcacaattgaatagctcgagtgagttcaccatcgtgccgtgaaatgcacaagacacagcatgactgcttgacattttcacctgaaaaaacgcaccgatttgattttcccaattcctatccaatttgcgccgtgtttagttccaaaatatttcttcaaacttttaactttttcatcgcatcaaaactttcctacacacgaacttccaacttttttatcacatcgtttcaatttcaaacaaactttcaattttagcgtgaactaaatacagccatgaagtgttttttcccctgtcgcttttttgaattcgttagcaggaaagtgccacgacgaagcggcagcaccaacctttgaagggagctagagatttttcaagagaacccaaacgagtacttgaattaattactcgactgattttattttcttttttaacaatactcgactgattttttaagagaatctaaacgagtactacttggatagttggattaattattggacttccttttttttggctcatatgatcgtgttggtattgtcttatacgccagtgcatgcaaactctatgatggaatcctactcatagttactgtatcagattcatctgacctactcctacttgtaaagcatacttcctccatactcgtaaagaaagtcgttttggactacagcgacacagttttcaaaatataactttaacttcttgtttctataaaaaatatttatggaaaagttatattcatataattttataaaaaaatttcaagacaaatctattcatataatttttatatttacaaactcaacaactcgagagttatttataatatatattttcaaggttcgacttaaatattgttttaaacgactttatttatgagtacggagggaatatatacttgcgtatatgcatcctttggtgtttagcattaactgcaacttgtgagcgcagacgaatgggcagtggatggcctacgggtttggagcaagaacagccatgcctttcgcctcggtgactgatgagtaggagcagtcgagcagaaccaaggattttgccattgccaccttttggttcccttctcttgtagtcttgtcacgtcgccgtggacggcaacttgggcagcacatcgacgatcttatgaattttgggtgttcttttaagtttgatttatctgttttgattttttttttactcttgtcctaggatgtcatggactcatggctaactttttttaaaaaaaaacaaaaaaatgtgttaggttactaaagaggatcttagcatccattgctgataaagtagtgagaaaacatgtgttaacatccaaatttgacatctagacatgaaataagaaaatatgatcaaatttgaataagatcgggatttcctacatagggctagtatgatcgccggtgtgtggctgatcgatctgattggcgacaaatggacggtcaaaccgtctaagtccgacttcgagtcgaatttcgtcgggtctcaggcttccttgcttgggttgaggtttttgagtttttattggtatctaccttgagtaagacgtggagaagattctgtaggagacaagaccagtctctttataaaggctatggccggttcaactgaacacataatctcttttcaatacaattagccaatcactttttttctttctagttttcatccatctttgtcggtttgcactgaaagccgtccatcctcgatgtgggtgtgcgaatctctttgtaggtctgtcccaaaaaccttccgttccacccacgagacaaatgtttatccctatttcatctaagccagcttcaactagtcagttttgaattacataaaccaccttggtttagatttatctagatcgagatggttgacgactttgtagcaccgcaaaacattaggtgttttcatcatgattgacggcgtaaccaaaaaagttaccaacaacatgcactgaaagggattcaaactcaggctggtgcactgctcgtctgctcctaacagctccctgccagtcgaggtaggcaccattcccatggctagctacagaaaactacggtgaaaaaataactctagaaaaatagtaacacgattccaagttctattatgcgaaagtttatgtcgatgacatcaatctattatattatcaaaacaaacttgaaaaaaaccactgtactcattccaaaggcctagaaattacaatattaatagaagacagagaactttgtaaaccagtagatcatgatgagtccaaattttaatagcgaggattgatcgatatagctgtgcatagaacagaaaattgtatttggagaaacataattaacaattatatacaagatacagttacatctgtgggatcagaagtaaaatagttgtataccgaattaacataatgacgtgatagtaccccctttttattttttttctaggcacaggagtttacagctgaaaaactagagggaaatgtattaacaacaccgacaaattaatctacttctttcctccctgatatataaagagtttaacgtattgtggcttctggggacttcagcaaatgataaagcaggaatatatataccagccacatggcaatgccctgaactcttctgacaaaaaaaaaagaggacacaaataatccccaaatctgcaaaggaagagacaaatggaaggataccgatctacattcagatgcatgcacacgtatcaaactgacatgagctaccaaaaagctttgatttgcatgatctctctctctctctctctccagataggctaacacaccaacctggcagtacttaattaagcaaatgatgcaccaatcagtgacctccctatcaccctatgctaatttcttattgaataccatagatttgtcagtacacaaccacaccaatccctttctaacaaactgcaaaaaaaaatgagttgatgccaaatggcaccagctcttgatgattcatacccaacaattcaacaaaagcatatatctatgggtcttaagacctttatcataacagagaacattgtttgggaaatgtgctggccacactactaaatcaacttgcctgtattggcatgctgacaaagcgataatgttgattagtgagctaaacacatagatgatgaaaggaaacatctaggtatcatagcttttgattgggtatgcactgaggttgagtacagtgagatgagtacacaacagcatgcccaacatgcaataaatattctatctgtatgtatcttaataacatgattagtccagaactggtttcttcttctgaactggtacgagaactggttttctcctttttgaggacttagtcgaactggtttatgattgcacttctgaactagacatgtgaaaaccaagctagaagcacatgatcacttcagtgatgcttagcagttagcacagatccagtattaaagtacacatgcacaaattgcgtgaaattagcaattatataacaagaatacagtgggcacaaggttgtaatagttgcaggtagagtaatttagagcatgctacagtacaaggcagagaattggccagcagaagactactgggattgaaaactgtccacattcagttctaaaatgagctggtgatgtttcgttttgtgagtaatcccaaaacaatcatcatttgaaatgagtatagctatcaaccaatcactgtcacaggaaaaacactgaatgtataacgcagaatgacgaaagaatcgcttaccaaagaatagcagataataaaatagaagttgacaaatgttgttccaccacttcatgtaggaaaatatccactgcctgtcattttaagtctgaccagctcccaaatccataattaatataaatgcccctagatcatcagaacttcttttcaaaagagcaaaactcagaggtgatttgtcatcatacagatatctcctttggtgagggtctcagcccatgttcttaattggttcccaaagctcctaagctgtgttcttcccccatctttcccaacttaccttcctcattttccacacacacgcttttcaaactactaaacaatgtgtgttttgtaaaaaatttctatatgaaagttgttttaaaaaatcatattaacctattttttaaaaaataaataaatcaatacttaattaatcaagtgctaatgagtcactcagtttctgtgcggaaggaataagttcccaacacaagaaaacgaacacagcctaacataacaagttattatctattaaacacaagacaaatgaatagaataataaaacagtagaaaactacgtttccagcactgcctctttaaatactaaatgcaaaggtcatttcattgcttttttcaacaaattaatattctacaatccacagtgccaaacaatgcgtcggtgaatcaaattcaactttatttccatcagtatgcctctttgtgtctcctttaggttgacacaggtattctatcttaaatttgtcatcagccactagcacttgggtgccaaaatattgaagtgctggctcatgtagaaccatcaggtttgattttgcacctagtggttggtttctcagcatacaacttatacataatgtaatgcctctttgcctacagaagatatgatatttgtcccagttgcagagtacaggaaaagtgaacactaacagtccataatgtatagggcactgcattgcagaagaaataaactacctaccaagggttaagaaaacttagccatcaacaatcgaaaaattgtttggggagccaatgatacttttccagaaaatacaaaattcacggtaagatgagcagttttacaccagcatgtatgtcgtcagaggaatccacatatcagctatagacaggagtacaggtaagtatcactacaagagaaacagggaaactggagcaccaccgtttcagtgaatgacagacgtgcattcccagagatgacatgtatagtacaataatcaaagaactaagtatgcatatgagatatgactcaggatgctctcacaggctaaacaaagaagctttcacctgaaaagacataccttcctctggaaaccaactaattggggctgaaataagttgtagtgctgcaaaatccagtgtgcaagatgtctcgattaaggacgatacctttttcagtcagcaatggtggatcacatgtaagatcccataataaatatgtggaaggtgtcattacggtgctgacaaagccaggagtttctgctgatcttatgtatcattaattagattacagtttgagtattccacagcccacagcagcgagaagcaatactgaaagctgctagtcatttatagcatttggacggtccagctcaagaaagaacataaagttggactcaatcaatgaatcatatctcaactggactaagtcttaaagcttcctattagattatttaagtttggaagattatatcaatagatacggaagatctaatccagtgtctaaatggacattttaccgcaaaatttgcataatgattcaactgactactgttaaatgtactctaacatttcaattctacatagtaaatgcttgggctgatagaaggattcctgtaacaatcaacaaaatttcacagataacttacataagcttgtggaccaggactactgatctggcctgttccaaaaggctcgtattgataaaggaccaccgtgtttgattgaagctactatattcaagggccaaaggcaaggctgcagtgattatggtggatccctttcataaattgcatagcgatcttcagttgtacaaatacatactacaagaattacacaaagttgtgttggttatctgaacaatgagttcattttaaaattctttcggcagttcattccatcatcatttactaggtttcatatagtgccatccaatgatccttgtgacaaaacaggtaaagtttgatcatataccctccatttagattgaagttgaggatttaccctcctggtccacatgtcagcgatcttagatgatcccacatgtcagcggcgcaggagggtaaacaattcatttcaatttaaagggagggtatataataaaatgttctcattttgttttgtttgtcaaccaagatcttgcattcctcttaacagtttgttccttcactttggattgatatcaagctatcagcaatgatgtcagaaagaagaaccaaatgtaacagattggacaagaacaataaaattattaaaaaatcaaggatgacttaaacagttaacgttctgccattttttgctgtttagtttgtaacataaataagaagataccacctgcaactgaaacattaagagattcaaatgtaccttgcataggaatgtttacaagctcacaggcttgaagggtatctgccgaaaggccattgccctcacttcctaacactaagcacactgattcactcatcagtgaatccgctagttctttagatagaacatgtgttctttcagatccattactgctgctttctggatgacctgccagcatcttcatatcagatttagccatcaaagcatgcagatcagaccagttaccagaaacaactggaagctgcaatgaggctccacgagctgcacgaagagctttttcattgaaaggatcacagcaagctggaagaagaaataccccatcctgttggtagttggttttaaatgctgttagaagcatagaaattggtaaagactaaccgaacaacactactgaaagcacttgaagagttagtataaatttctggtaggctacacaccatgcagatatttttgtgtgatggcatattggcatgtgctaactgctaactaaacttcatctgatgctgtataataggagcataattttttgtggaaatgtagaacacgtatggggtttctagccttctaacccagaatgtactaaccttttgctttcaaaatgtcattaatagcattacactatcatccttagatgtaaaaacaagtgcaaacctaataattctacatactaccagtagtattagcttttttatcacttaagttctaccttattattgagaagtaaaacaagctgtgataactactttatatgaaacaataggatggtgtgatccatgagaccatgaaacatcaagttttgagaaatgcaatcagagacgcttcaacaattagtagtaaatgacatacccatctgaaagcacaagcggatcttatcaatgttccaaggttaccagggtcctgcaggatagaaccattatggacacagtaaaaatttagaacccttgcttaagaggaatcaaatggactagttcaaacttaaaataaacaataaacaacatattatgtgccgtcttatgcacaaaatgacatccatttactatggataataacggaatattgcacacttctttttacctgaatcccatccagaaccaaaatcctctttgcagagccgagccactcatcaagaacagctccaccctggtcgctgtcaaggtcgcggaaatacttaggcatgtgaatgatagcgattgcctcagttgaatcaactgattgcatcccagaaactttcttcatcacagcggcgctgacatacacgacattgccagagaacccgtacaattcctccggtagctctatgccgtccaagagaagcaaggtttcgatggtggagaattcgaagctacacatctccctgcaccaaggcgtacgagtgcagaattaggaaaaaaattcatctcagaataaaacaaaataagggaatttcgcagcttagaatagagaaaagtttacaggatggggatgagtccgacgaggagaatgcggcggcaggagcggcggtacgcggaggagagcctgagcctaacgcagtgcttcaccagggggttcgccacgctcgctacctgcttgtggttttgctcgccccggaaaggagcagccttcgccacggcggccgtcgcaacggagccgcgggtccagggaacgcagtatgggcggagtatgctctcccgttgcggcggcgagctgaccgccgagggcatcgccggcggcggcggagcgcgcgccagtagcatcgcggcgggcggcggcgaggcgcgtgtctcttccctcgcaaatcgcaatacgcgccttatctactcggcggtgggccaaattaattagcggaaagaattcgttattgggcctaaactgtttgggaaaattaatgggccaaatgtacctgtggcccgatttcgttgactggatttaggtggccgaaatcatttgctaacgataattaagtgggccaaatttagtgatgggccgaaattgttcgtgggagttacgtcgttccaatacgattgagggcctaattcgttgacaagaattgagtcggccaaatttattgacgggccgaattcattgatgacaaattagcaggccaaatttagtagcgggccaaaattttttagaagaataaagtggtgcaaattccgtggtgggctgaattcgttattgggaattagtaggccaaatttcgttattgggaattagtgggccaaatttactcatggcccgaattcgttgaaatgaaattagtagcccaaatttcccagttggttgacggaatttagagggtcaaattttctctcgggctcaatttgttgacgggaacccatgagaccaaatctactcatgggccgaattagtttacggaaaatagatggaccaaatttatttttgggccaaattagttgacagaatttagtcggcctaatttactcttgggctcaatttgtagacgagaatctatgaggccaaatctactcatgggctgaatacgatgtcgagaataagacggccgaatttatgcttgggctgaattcgctaatgggtagcagatggaccaaatcttttagcgggccgaatttgtttgcgggaatttcgtgggccaatttcactgatggagttaactgggaccaaatttgttggtgtgctgaattcgttgagggtgggttgaactcgttgatggatgtgttgggccaaattcactagtggatccaatcgtagacttctgtgggtatttgctattttggtttgggaaattcatttgtggaccgtatttgctgacatgaattaagcagtctgatttagttgatgggaagaggtgtgccgaattcattcgtgggactaattcggtgaagaataacaagttggctgatttccggcctaattgggcagaggatttgtctgaattcatctcggctactccagtttcagagaattgagcattctcaggttggttccacgcagaattggacaacggtgtaacctgaggcaacatgaacataaaaccaacttgccctgcatcagtactctagtttactacaaattctcagctacaacgaactctagaagctcattttcaaactggttgtatagaacggaagtatttgaaactacatttgctttgaatataaatttaagattcaaattcactcaattcaaggttttcatggcagcatatcattcccaaactcataactccggtgatcattattcattattcgcactcaagattaggtgttcagtttacaactttacatgtaatccatggtgttcttcgtctgtcaggtgcgaactagaaaatggtatttttacaagaaagcacacttttttacatgccaaacaatcgctaacagagtaacagcactgaagatggaaaattgtgagctgaggaaaaagcccctttctccactttcaaagaaagtccttaagacaacatgagctcccgactgcaaacaccactgtgaaggacgagaactgagagttagatgagaatataaggggaaaaatgaacagattaaacaatgtagagattgaaatttctggtggtgtcacctctttagacacggctcactcatcacccattgcaagctccagtgcataatcatccctttcctgaaaaaaaagagcagtccactatgtctgagaaaagctagaagatataatttcatgtttaaagtggaattggaataacagtggtgttgacaaccacagccaacatcaacagttatgcgcttatgctataaattgtctacacgggagttcctaggcataaaaactatgagttgtgaaatacaaatttaataatacttacaacaggtcctcgtgcgaaatatcttccaaactggagccagtagacctatacattgaggtgttatgtgcttagtggaacatgtaggacttatcataagaattcagaagaatacagtctagttccttctgtatggttagataagacagttactactattaacaaggtggcttaatgcttgcctcatcttcatcttgtgtttcaacttcaacatcagaagttggaaaaccaacacacaacaatgcatagccctgaaaaaggaagtaataagacatgcaacatatcaccatttcagtttttgttatgccaaatagaagaatcagaataatgaatgttttataggcacacaactagaacacctaattcacacactaattaaagaaaacaatacaactctatcttaccaaaatcgaagggaacctttaaggatcctaacaggtcaacaattcatctccaaatcagttgttttagatagtaccatccaaactattgattacaaataaatgtgatacttttgtaacgaataaaagaaattgtgaagctgaaggccatgaaaccttgcaggaacatcaattgacttgtaaagaatactaactgggtaggatcgtgtgttactaatggatagaacatagacactgttgaaaccactgagtaaattgaggaatgaggcggatcaagtggcaagcaaactgtagcagaaacagtaaaaacatgatatacttaattaatagtgacaacaaagcataaaaagatggatgcaccttatcttttagttcagcagatattccaagtgcttcaggttgtcttatttgtcctgactttatccgaaccgcacagctagtacagcaacctgattagaaaaatgtgtcttcagtaattcagaagtatagtcgcctggttgtatttggttttttgttttggtcaatctgctggttttgcatgccgaattgctgatgatgtaacttttctttctccatcttaatacaaagtgagcaatccatttgcacattccctaaagtaattcatttgcttatctatattgtagatcagaagaaaagggagaaatgatacgctagccagagactacactggctgagtccaaaagtaagcaaccgcttgtgtcaattgatcaacatggtacggcacacgtttttcttgcttaatgtgttcctttgccgtgattaagcatacataatacaatacgaataacatttgacaaacaagtaaaaaaatgcttcctttttgtgcaactaaaatctagcagagtatgatggatttgtctaagcaacgactaagccttaaagtccagcacagattaacttgactcttagggcagtcccaactcataatatccataagcagtgtctatggtgccatgttaataagacatcacaatcaaaactacactctacaacccatggttttttaaagtgggccattaataaatacatcatctctcttctctaccaatcatatttaatcttcatctattatgaagacactattctctcccaatgtaaaacttgatagtgtctagtgcataggttctcgtgttgaagctgtgtcttgcatgagacccagtttcttcctctcttcaatctctctcttaattaatatagtgccgcataagctaaaagtcctacatggcaatgtagttaatgtcatagacaccatactaggtggagggttgggactgccctaataagcttgagtgagcgagtgagtagtgagggcaaagtgtagccaatcagaagaaaaaatgtgtcctgggaaaggcacgaggatgggagcctaccatggcggcacgcgaagggcagcgtgatgtcctgcgcctccgcggtgtgcagaatgtactggtcctgcgccccccaaccacggcacgaatcagacaaagcacaagaaggagaattgcgctactgctgcttgagacggcatcgaaggtgtgtgtgtattgattaacctgtgggacgacgaactcgtggacgacacctctctggcggtcgtggacggtgaccttgtgggtgggagcgggcgaggaggacgagtacgccctctccgacacggggccctccacctgccgcagcccggacgcccgcgccttcgtcgtcgtcgtcgcgccccgggcgggtcggcgagccgtcgtcgcggcgaacggcggcgccccaatgcgagttctgacgatcgagagagggagagaagcaaaaggtgataaggtgataaatgtcagagaggaggaggagtgctgggtgcagcggacgtacgtggtcgcggcggggcacggagccatggcgatggcttggcagccggagcagctaggttgcttgtcccgcgcgcggtggtggccggtagggagcggcgcgagcgagcggaagggggaaatcacgaggggggaatcggggcgaggctgtggagcggagcggataaggggaagggaagagggacggacgcgcgcggccgcgggggcggtgtgtgagctccagcgcgcgagtaggcagttggttggtttgggccgcggggatgcgcgcggttgggtgagtcggcggcccatcccatggaacatgtcagcctgtcgacggcgccgctaggaaaaagtccactttgactcccttaattgttcaccgaatctaattcgtgacccttaactagaaaaccgggtaggacgattcccccaattactagaaccggtacaaatcgactcctatggtagtattgtgggcggtattcgatgacgtggcaccttgaccgtggtcagcactgtgaacttagctgaggatggagggaaatagataagtagctgacagtggaccatcgtgagctaagtcagatccagatggggcgacggcttgggtggcgctgggggccgcatgcgtgttggcagcggtggactgcggccgtcccccctccccttctcgtccatatccggtgatggcggcggcgatggagaagactggcgcgaaggccgggcggagttgtggcgacggcggcggtggtggtggcgacaacggcggtggccccctctctccaccgtcgctcgagaggaatgacctggcctctccactttaggatgtccgcgccgcctaccccgacgaccttagccccatccgccccctctctctccccgcctgcgccgaccgccgccacctccccccagccgcttcctcgtgccttcctcgccgccgtatccccgatgccggcaccgcccacccccgcccttcaccggccgctgtaggatcaaggaggccgactagagggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaaatagcacaaatgtaaatgcaacaaataaatgagacaagagacaaggaatttttcaccgaggttcggaaactctccggtttcctaatccccgttgaggcgagcccaactccaccgctcaaccacgaagccaccgcacgcccccttcgtcaaggggtgggcaaggcgggagccggcccacggagaggactacccaagcctcgatcactcggggtagttcttctttcactccgaaggtggtgaactctaaaccactcacaaacggtgctgggcctcctccacaatctcctcggagaggtcactgggcaacacctccacgagccgtctaggaggcggaaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggaatgccaaaaccttacccttgctgctggggagtgggtatatatacccccaaccaccaaaactagccgttggaaccgaaatccccaactttgtgctctgccggtcagaccgccgttgtgaggccggtcagaccggactactttgtaacggctagaaaactagccgtaacggctagaaaactagccgttacagggcaatcattgagcccagtcaacctggccggtctgaccgcagtgtagtggccggtcagaccgtccacggctcggtcagaccgccgtcggctcggtctgaccggttgcggctctggcggctctgtatcactaccaaaaaccagaccagtgcaacagaccagtggggccggtcagaccggccttaccacgccggtcagactggctaacagacccggtcagaccgtcctaaggcccacggtcagaccgcaggtaacttttcagctcaaccgaccgttagtaaaacggcgatatctcttgactcgggtctcggaatttggcgttcttggactctatggaaagcttattcaaagggccatccaacccatgaaaaatccatccaagaaacacaacttaagtcaaggataaagggctcacactccaaaggatattcaccggacatacccacaagatgttactcactcctattggacatgcccacttctctcttggtttaggacttgagaaaactcatcacacttggttagacaagcccacaaaatgcacctacatgcatatgaactaatatggcacaagatcatccacaagctcgcttcatagacccctcttgatagtacggtgcctatctagcaaatccggtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatcatttgtcaagactttattctcatcacaagcttgacttcattcttgccaacatgacgatgtccttggcttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatggatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaagacatatgtagtaatgatgtagaccaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattatttaatccaagatctttcaatcttttctctctttggtgatggataataacccgatataaacaatatagagagatgagatgaaaactgatttcaaatcaagatagaaatcttataataaacaaaatatagaataagctccccctcaagatgtgcatacatatggatatgaaggaacgcatatgcacataatcaataaagatcaaataggaagctcacactatattttggatccacaagagagaccaagttagaatatgtgaagtttaatacatacctctcatcatttttacttccatatccaaatgagactagtcaaagaaaggctcataaaaacgttagtctcatataattagatttgtcattaatcaccgaaaccaaattaaggcacttgaacttacagccgctctcatgttaccgccgcccacggtatcctctatcccgtcgccacgtcctccgccgcctcctctcccctctcccctacacgaagatgagcagcggcggcggtgatgactggaggggaggccgatctgcatctgtgtcgccgctgtcgccactccagcccccgctcgccatcgccgctgatccgactcccgctcccgaggtgcatccaaagggggagagaaaagaggaagaagggagagagagggaggaggaagaagggaaggagaaaggatgacatgtggatcccacaatatattttgtgtgtgattgacagatgggtcccatagatattttttaattctaatgccacacaagcgccacgtgggacgaagactgggtcaatgccgccatgtcaacaaaaccgccctcgaaaaccgctggaggagtcgatttgtactggttctagtaattgggggagtcatcctacctgattttctagttaagagtcacgaactagattcggtgaacaattaagggagtctaagtggactttttccatgccgctagcatagctagctgcatgtgggctggctgtcggcacccggggagggggggtgggggtgtgattaaggtcatctttgggggttaagggattttggagtttttaaccttaaatttggagctgattttaaggtttttttcatcgaagtttatttttcagcatttgcttttagatcgttaagaacatgcatataaaagttttattcacaaattacttttcgtttggatatatgtcgtttcgcttattccgcgaacactcccattttgctctgtatcttactttagacttcatattttagcaaggtcattttcataaaatttaatggatttacatgtgaaaatggagagaaaaaagttacactaggcttgttggttgctttcaaaacctttcgacatgttcagcttgttgttttgtactaactgataacaataaagaagtattcttttcgaaaaaaaaaagtatataaatagaagtataaaaactgtaccctaaacttattttctttgtttcgatcacatgtgttcaactttacgcagttaaaaaaaaaagtcaatcagctgtacgttcccagatcctcattgatgggacgattatattgtttttattcttcactaccataattcggctgatctccggtgtactaaagaagttaggaatctgattcggatactcgtatgttattgtgccctagtacattctgggaaaaaaacatggtaaagactgatgagattcgagtttgcatgttaacctgttgtcattcttaaaagaacaaaaacattattgttcacgtactcacgttggatcgggtcagaccatcagggtagcacaaaccatgtaatcacattattcttagattagatgaagattcatctcatattacatctctggagatccttttttttaaaaaaataaaagaatggccaataacaatggtagataggactttaactagatgtttcaactcgtatcttagttttagtcaactatttgaatacggaacaattttgacaggcatgaacttctttcggtacctaaatttgcaccaccatgagcataataaaaaggctactagcccatccttcgatagttgtttattggttagctcagtggttgcctctttgatcagtcccaagagccgcctcctgtagtcctctgctggattctgtccttatttttctttcctaggaggctggattacaatgtcgacactcgacagccaggctatgggcacccggcattgcacatgcaaaataatttcaacaaattaagcaaattgcgcatgtcagaccccagtttgttggtggtcagaagttgtaaccatcttctaatgtaaggtgctgtaacgaaatatctattggagacttacagttggaacaacagaaaataaattctaagtagggctgaagacaatttgtttgttagtttttcaatcttcttccttcaaagattagaataagtggaaatgacgcccttgatcagcaagtaagcgagcggtagttcagtctccgacaagtgaggccgaactagcccctagatcggctctcatggtgggggaatcagagtcaagttaggtgcaaaagaggtaagtttggaactgatccaatgcaaacatatgcaatttttttaacgaatcggcgagccgctaaacaaggaaggagtaaactgcacagtataaaagaaaaaacaggaccaaagctttggtcctaacaaactaagttataagccaatttcccagatgttttgctcctgctaagatccatgctctggcctcctctttgattttcgtcagcaagctattcgacaagagctccttttgctggaaggttctacggtttctttcattccaaatctctcccagacgaccagcagcgtcaacgaacggagggccttcttgggggcttctttggtgcttgtgattaacatatgcaaaatttaagatggaaggagcagatactcgtgcagtacaaggaatatacaaacccataatttgtgaggagacaagaacaatcaatatcaaatattgaaatttaactagccaagttaataaggctataaaatgctcagattcttttctttcttaccggttggggatgttgtcagaacctgtggtaaatagaccatctctagcacttgccagcattgcggccaatgatgatcttcacaccaaaatataatcagatttcgcttggattcatgccgcccgtgtaacctgtcaccactgaccacatgaacagcatgtgaaagcaactggtaccatctgctgtggccagatagcgatgagcaagaagctgccaaggagcagcaacggatccatgcctctcccctgtgatccaaccagcatatgacctggatcaaaaacggaagaaaacatgggaagcatatgcacttgtcagtacagtagtatttgtttactatatacttgttcttattccaggcatcaacatctgcgactctccacggcgctgaagagctaagccgccttctcttcccctcacgtccacccaagaggccatccatctctctctctctctctcttgaccctatctcctcttcgccgctttatcctgcccatttaaatacccatactgtgcttcttggggagagagaaggggagagagagagagagagagaatggcattgcagcaacgaccggggatgctcggcattggctgcagcaacgtcttggcacgagcaagggtgcagcaatgtctagcagcggcgtcccactccaatatgccatgtctacccgtcctcctgcatgtcaatggcagcaagaagcagggtagcagcttcctttcttctcagaggatcggcttaagtaggaggaggaggaggagggacctgagcggcgtcgttgtcgcggaagtgagcgccgccgccggtgtcacgccggcgtcgtcgtcgtcgtcgcctggcggcatcagcgtcagcgatgttctttggccctccgccggtgagtctgaaacttgaaacttgtcttcttcgtcggccttcgttggctgggtctctgaatctccgtgctttttcgccaagtgaattcagcgagggcttggtttcctctctgtgatatatttttgttgaatggttgtgcagagaaaaaaaaagactatttcttgcatatagtagtggcaaaaccacaaaagccgtcgagagtttgatggttttgccaataaattttatagaaaagaaggctcacctgacatatttttcctcaaataatgataacgtgcaggtgcattcctagcaatggccgtgctgggaaggatggatcagatgatggcgtacaagggagtatcattgacaattgcccctctcggagcagtctgcgatgtgcttttcaccgctccaggctcacctgctgccaaggtatgaatagcttaacagttaaatattttagttacaacatcgacagtgactcttcaatactacaagaaaaattttctatgcataatgctaccttttattttttttatgggaaacaaatgttctattatccttttctaagatttttgggcaagtcggaaaccctaagatgcacagatgaattaatcgctgccacttactgtactgactgaatctaatggacacccagattatgttgatttgcaaactagtttctcaaattagaaaaaagatctactaaaaaatctgcagcatgtagtagcaatataatgcttctaaatttcagggtgtccatgttgtcgtcgactgaaaaactatggctcatagaactcagttgaaggcttggaaccatacctctgttttcctttctgtagtcatgactgaaccacaaaagtagttatgtacgatttttcggtgtagtaaaaatcattaggtgtttccatttgggttaattttttgagattggatgaacacattccagttggagtcctacaacaaatctaaaaacattcttagatcatacgtgaaatcaatactaatactagcaggtgacaaaatcttgcagaaatacaacatgtttgttgcccagattggttgtgcggcatttggtgtgttagccctttccttatttgggcctggatggttggcaagaggtgctgctctttctgcatccatagcattcatgacaattacaggcgcctcacaccctccaggtatataatctttctttcaacagggatgtggtgctttagatgtgctcagcaggatttaaaaaaatatttctgattgacatctgtttttgtactctacttaaatgcatcatagcaaagctcaccatttccatgatgattgcagctgcaagcttgcctctcttgtttattgatggtccaaagtttcaccacttgcaactctggtatgccctttttcctggagctgcaggctgcataattctttgcttgattgtaagtatatttcccctcccagcttccttaaagtaaatgagattatcaaaaagagaaatatagcattaaccctcatactgtacttgtttcagcaagaggtggtgatttacctgaagaagaatttcaagttttgattcaagcggtgcattacttctcgtagcaatgacatgactaaaattcaagattgtaccacaatttgctagaactgcattggggagaaatggaggaaatgcagatttagtttccttggtcttatttactaaacaggaagaggagaaaaagcagattgatcgatacctgattgtgaatttgtgatcacagtgcagaacatgcaaatatgaagtacataccaatatctcatttaatgaaatctgataagtgtacaaataaaattccttcttttgtgattcataattgctttcttcatgtaatatacaattttgcacaaaaagaaaaaagggaggaaggaagttcacctctgttaatctgagggagattgaactatttatcctggctcctggggcacgattgcaattgcatgtacagttgcaataattacagattgcacatgtgaggcaactagaattcaaaaggaattaaaattatgaaatataagtggaagcgcaggaacaccaaaaaccatctatggaaaacctacagcaggggcacgctaaactaatactccctccgtcccataatataagggattttgagtttttgtttgtattgtttgaccactcgtcttattcaaaaatttgtgcaaatataaaaaacgaaaaagttgtgcttaaagtactttggatagtcttattcaaaaatttgtgcaaatataaaaaacgaaaagttgtgcttaaagtactttggatagtaaagtaagtcacaaaaaaataaataataattccaaatttttttgaataagacgagtggtcaaacagttcaagcaaaaactcaaaatcccttatattatggaacggagggagtagaaccacaacaggatacattgctgaataacttaattacataattcctcctgcactagtcctccccctgcttccccaccttatatacttggctaatcagtctatttgagtctcaggaataaagctatccactaatatgtgtcactatacatcccagccatcacctcggctgttaaagaacctcttagcagttaaatttccatatatttctgaaaatttagccaggcatttgctcctaacatgatagtgtgcttgtgtgtttcggctgatggcaactcctgagaacttggacatatcaattgcccaagctggctttacatactccactgtgcttgtcaagcttgcatttgcaaacaagaaatttagaaggatatcctcacaattgaagaaactgtctacaatctgtcttcctacctcagcttccttgctccaatatttcttgaaggccaaaccatggtccataaatgctgcgcctgtgagtaccatgttataacctccttgttgccgagcatacctctcattgcggtattccagtgggctgccttcagaaaggcgtggatagtacccaatgatcctgtcagggtgctccctccacaccttgaacccacgctctaagtcatcgcatgtcatcataatatcatcatcaagctccataacagcttttgtcttaatttcactgtctatgttgaatctgttgttcagagagttcctatcctcaactctgatcctaacaggaacgactgacttcaattcaccttgagctgggggctgccctttgttccagaccactacaatatccctcaccgatgcacaattggaataatgctccacaaacatcttcagattccaaagccgggcatcgtaggtcatagtcaacaatgtgaactgtgagtacttgcccttgattggatacggttcttctgcaccgttgcccccatagatgtagtgagttccaacacaagttagaaccactaaaattaacattactacaactacataaactcgccctttacaggttctgtagttaatccttccacaaataagagatcccagtttgttcaaattggagatcagagagcttagcttatggtatagaaagaacctctgctctacattgaagagcccactccttttctcagtatgcgggagagaccatctgagtggtaaggaacagttaattgtaccaataagcccaccagtgacaagaactagtataagaacaactccataaatcatgtaacctatggtcagacggtgaactgagtcacctgaaggtactctgtcaccatccattacaccaatccaaggtttacctgatggaagctgctggacatcaaggtgatgtgagcgtgccccattccatgcattccggcccttgagttgcttgttgatcacaaatgggacttcaacttctttgtattcatttgacttcaggatttcaactttgaacacttggataccatggccagatccacccccttggcctttaccaacacgataaagattgccattgtaaatgaatggcctgcccccatttctagtgcttaacattttacctgtgttatgaatcagattctgcttgtgtggaatccaaggactaagtggagaattactgtaccaaatactgatctctctatttcgttttgcaccataagaacttaaatctgttccaaggagccaataggaaccctggaaatttatgataaccgaatctaccaatggcttctccaaaaggaccttttccaattcccacttgagcggaaaatctaatgcacgatacaaacgaatatctccattcttgctgctttcaggcatcatatagacctgtgcagttagtcaagtaaaagcatatgtgactatgtgagaatgattgcaatagcagttttctccaacctgtgagtgaaatatttcaccttgtttttgtaggtaaacacatatgggtacgaaagatgccattcctcatctaacactactcccagctgctgccatgtcactccggcgtcctcgctcacagcagcagcaatgtcgccttgcgacgtaatgggattctttgtctcaaaaaacatgtagatggcatccccctgaaaacaattcagttgcacatccatcagggctggatacagaccaccatgatcgtgagcgaggacgcagtaaatacacataaaagtgacatgaaaaccaataaatttacatcctcagatatcagatactccagacaggtgagttagagatttgaatgatttaatgcccactgaagtaatcgaatcgtgacattcctgccgagattgccaatgcgaagggatacttcaaaattgagatgggaacacagtgaaaagctggttcgaagaacctggaggaagaggaagggcttggcgacgaagctgctggggaacccggcgtcctccacttcggcgcacgtcaccaccgggttcgccaccggccacgccgcgccgtcggccttcgagatcccccactgcaaggcacggagatcagccaagtcatctggcgtcgttcgatcggcacccccccccccccacgcatcgcacaccgaaacctaataagcaggagctctcgcgtgttctagggagcagttacgtgttcgatgggctcgagggagaacggggagtcgccgaggaagacgccggcggaccaggagccctcggcgtcggggcggcagcggcgggtggcgggcgggtgcgggaagcggtggccggcgcgggagaaggcgacggcggcgaggacgaggagcgccgccgcggcggagaggtaggcctgcgcggagggcgggcgctggatcagcccccggcggtgcgccgccgccgtcgccgccggccgcggggacgacgccattggcggcggttagagatggagagcgccacgtgtgcttcgccctcactgacttccccttcgttccgcggctccgttcggctagtagtacgtgtctacgtgacgcgcggcgttagcgaaggcgagcggcgcgcgcgcctcccaacgaacggcgaattggtcgcacacgggacggggacatctaccgggataactacagactacagttggatttgtagttgttttactagtgtacgtacatcaatatttgcgagatcaaaatattttgcgatcggtttgaatgtcacaagtttagcaggtacagcagatcgttttaatcgatcatactacatgcatgcagactaatatgctgagttggcacttggcagagaaataagggggagagagtgtgaatcggtgattaatagttgcctactacacttccatgttgaggcgataatagtaacaacggattgttccttactgtcccatataattatggagtctacaaaattagcaaagtgtgaagaaaaaaataacagttataggcataacattaaaaaaaagactttggtaattgcgtgatggcaagcttgtagacttttgttgtacatgatatctgtttggtggagcagcactctatgtgtttgataggttttagagctgacggcttactcttctattgaaattgctcttaggccaatttcaatggtggttaatgtaacaaaaaatttctagtggtagttttatagagttttttctcaataaatgagatgccattcaaacaaatttgatgacatggcaatatcattatgaagagagattaaaagagtttcatatatatggaactggatgtacactgtttctaagactataaaactatttgaaactggcattgaggagctcgagtattccatttcatccaactgcattcaatcccatgcattattattaaatgttatgactaacctaaaaagccacaaaatgaaattgtacactgaaggttttatttcatttatcgattcaaaactcttttgacgacataacaatattggtaaccgtgaaatgaaactttttgctaagaatggacttatacgatttgttattaatactttttgtaatttgtaaaagatgtgcccattgttgtattaagaagatgttagtacaaattttaagtgttgtctactattttatggaacatgtaggttttatccacaatgataatgttttaaacctaatacgtaaaagatgtgtatattattttactaagatgtctctacaaactttaagtaatgtctattatttatcgaacatgtaaaatttacccgtaaagatggtgttttacacctgaaatttcatatgtcacattatcatagacgaagttagatcacaagatgcattcgctatacctctaagaatcagagacattgtttcctttttctcattgcatcctcgggtaaatctgttgagttatttcttttcttcacacctaattatgtatgtggcaggtgttttttttctctcgattatcacacacaccttaccttactaaaatcctcctgttgaaaaccaacttatatgtgtataatatttgtgaacaccagaatttaaagaatgatggatagaatcatgaacctatggctctaccatcaccccactggtgctctctctacataaatggtaggttattttcaattacatggaaatgcacacaccaccacatgtacccacctaccaatacacttgtcggagtacggaactcctctagcggggaagctaggcactccctctatgtgagtttggctgggggagcaagttttgagcttgggtcctgattatgcaaagggaatggacacaaagcgagtatacatgttcgaaccgcacatatacgtaataccctactcttgtatggtggacatggatgatgaagataattataagtaagatgtgaaaagttcggctgtgttcgggagtaagggttgggaaccctcactccccggcacggaaaacggagcagcgattagcacgtgattaattaagtatttgctaattttttttcaaaaatagattaatatgatttttttaagcaactttcctatagaaactttttataaaaaacgcaccgtttagcagtttgaaaaacgtgcgcgcggaaaacgaggagaaggagttgggaaaatgttctaccgaacgcagcctaagtgaggaggagaagatcctttctcacccaatgtttggctaacctagattagatgagtgtacgagcccttttatcggtggcatggatcctccttttatacgtgagggggggggggtcgtcaatgccgatgcatgcatgtaggagtggcgcccactccactaaacttgatatgtttagccttgtcgctatccctccaagctagttggccagatgtgacaatcacacctatagactaacaagtggattagataggcaaaagtcttcgttccaattgtccctatgtctatctatgctcacttctacaccttgaagatgtagatctcataggtctgtatactcttattgataccttgaaactatagatcttttgagtctcatactcttcttgacactttgaagatgtagatcttgtaggtcttagtatgagccacaacgccccgaggggaacccctgttcccacttctccgataacactcaatagggatgtcacttgcaaaacttcatagtggaaatacactgcatttctaacatcacaggcaccttcttatatccttattcagtcccgaaattagtgaatcactgatatcccgggaaactttagtgtgtgtgaggaaaaaagaccaaaaccccttattaatagaaaactagtacattaaaaaggggtgatttgtggagaacctaggtaagaaagtagaaataaacttatcttgagacaaagtttcaactctaaaaattaacttattttatgacggaggaaggttcaatcacgatgagccaaatcttaattacacgtggaactgacacaggcagcctgtatgaaaagtgaaagcacaaggggaaatccatgcgcatgtcaacgcgggacaaagttggatccaggcaaatattttcaaagataatcagtaacattgatcaatctagagttacactgttcagcactctcacccagtgcagtcatgaaaaccgccacggctttatgtaagagatgcgaaatactatggtcttggtgctaggctgctagcttcatcaggcgtgcagcgaacgcttggtccaaagttcagaaccgacgcccacgacagcattcgtgggagcatcaaagcaatctcatatgaatctgtacgtgcctccatcaatagctttcaaaatgagatcaaaaccgaattatttacattcctaggagtaccgaatgctacagagttttacaatatctttctagtctttaggtatgagtacatgatgaaaaatccagccactgctccaactactattccaccagttgtcgcccaaaatgcccactgctccaaaataaactcgtcatcaactcatgctatatcaagtagtgccagtacgtggcagaaagcagaattgaactcaagagtgcaatgctataccgcgtttgtctcgaggtacgatttaaggttcatgccaaatattcctacaggaaacaaatacaacggttcaattatagcattacttcaagaataaagagtgatagaaaggaactgaaatttgaaaatcactagatacaaaagcgctgacagatttttgtacctgcaattaatgctcctatggcgacgcagaatgttccaacctgaagaagcaactcaactctgcttacttcaagtctccgggagctgtaaggatgcccaatgtggtaagaattaagaaaacccataatttatgaaatgtttgtgatgttgagctagttcacataaatttcacatccgccaaaaagaacaagatcccacaattctcaaatagtttattgtgattgtatgctacacaaacagaggtgcaggaacacaccaccttataccaagacccactctcataatttcatcttaaatcagttctaaaaaaataaaattatgggaatgcaatttgaagcactcaagcagtccccctttcttttatctggttatgctttgataattgaaacctgaaacataatgctggcattttatgttgcaaagtacacaccgccatggcctgtggacacccgcacaccacagagagtaaaggatggaggataatgaagtcatgcccccaaggccccaacccacaaaagaacatttgcaaaattttgagactagtactatgtacgtatccggtacataattggtgcgtcctccatttccaagtaattcttgcatttgctttcttaatttcatctatgttggagacttggagtgtattgtttgctcttaattggtattttctcgctagtcgccacaatatagctataaaatttaagaatctgaaatgtccatttgtagtgatgctaattgtagtttggttgtactgcaaatatgtgaaagatcattttacagttatctgatggatataaattctatttccatattggagaacgtgtttctctttctttttgctgaaaagctaccatgctacatgatcttctagatgcacgcagcctagctttatgataagtacagttggactcagtcgcttggatgaagggttcacaaagaaatagtagctgctagaaacagtttagaggcagcaaataaaatgcgatgtctgtttagatgcagggcttgcaaatcaaagaccattttagtccaagttggagtgacttcagggtgttaaacaaattatggaccatgcacatgatttggaatataaatgtagagagaagagtagaaaacaatggttgattgtctggttgaactagtaatttatgttcggttgtcaccttagatcgtttattaaattcaaaatatagtttttattaaaattcatacatttacacatatatttttactgtccaattatattcaagagcaaaaaaatcacaaaagtgagcattgttataaattataagaacacatgcattgatgaagctaaactttgtgagatcatgtggtctgtgagagtagacagaccttaagttgaccgcaattgaatcttccatttctcttgcagaatcaagaagtctctctgcttgaccatggattgattcacatctgacagtaagaatacacaatgaaggtctgcaagaaagaaacaagacatctgaaaagattgtattgcagatgaatacctttgaagataattttccaacaacatttcaatttcttcctcttcttctgttaaaacaaaaaaaatacagatgaaacaagtaaaacagaatcaaacagttaactactgacaaataagtgattgcaacactccttgtgaattccgcacatgccatgcttggaaacaaaaaaaaatccatgaaggcagtaatatgtctccaaaatataaaaagtccaatgatgctctcaatccataccttcagcaatctgcttctctaaaggaacggagcactccatgttatcacttaatttgtcgagcgtgcaatttcttcccattatgcatattcgacggatttcatgaggatcatctaggagatcaataagcatttgtttgagatcacctgctcgtgaacccagctcaaccttgacacatgaatagagacaaaattaaacttgacaaacaagtccaggaaatgattctaaagcgcagctttaataccaatgcttgtttgcttagacgaagctgctccaacacatcagctgtcaaccgatttggtagaacttcaagcaaagcacccacctgagatataagcccagatacccaaattattattttttccattataaatagagtcaatttgaacactggcatgttcttgatccatacatgactgaaacacaaacacaagaatacgacaacacctaaaataccacatgaaaatgcagggtcagcttggtagggctctttccgactgtttcccattttttttaaaaaagaaggaattctgcagtgatcatgtggcacggacacatggtactggtctatgtcttgtctgtgatttacaagggacttcaagaagatccttactccctagtgttaaacttagtaagtgctcagcaaaaagctaggtattgacagtagcttatgatttgtgcagttgacttgtgtgaagatcaggtgcttcaattagtccatttggtaaagatgtataaaaatatagaggaaggcgtgcaaatctgcagtcagggacttctaaatgccaaaggaaagagttagggtgcaggatatggaaataacatgcattattattggttcagttctgtatatatgtgctttgaatgaagttttcaaggttgaaatcaagaaaatagaggacaggaacaggaattcgtaagtgtcttaagtcacctattgacaatatatcagattgctccataaattgaatatgcaccagaaagtagaactaacaacatcaggatatacaatcttgtacaagatgtagagctagcagggacttttctggcactcacacgaggctcgatacgcattagccttcgctccaacctttgtattctagaaagcagggcagcttcgacaacctgaatataagagaaggcaataaataaccagatcatcttggcccagtatttggcaggaggatggtactctcaataatcgggtgaaaatgcaagcatagcatgacatgttggcaaatgcatgatggcgataaaaatgttttttgtcagcaatatatgttaaatgatttaatataataactaatgagaccaaaaaagatattgtacaatcaaaaagaacttttaaaatcaaagatgataatcctattcttgttcaagattccattcgaccgttaagagaaactaggaaaactcatggatgacaatcttattcctatgtgagttgaaaacaaagtaaaccttccatggaggcaaatataaatgaaacaattgacaaggaaaatatcatcatattaagactgttccagaccacaaatatggattaatataagaatatccatatgcctgatacctcaagttgaaatggcattgctggtccaccattgatatttcttggatttaaccgtggcagtaatgaatctaagaaggcctttcctcctgggctactcaagtcagataaaataattgataagtttcataacaatagtgatgttcaccaagtaaaatacaatttatattaaaatgactagtgtacaaactgacctgttgtaattgaatataagaacgcgttcatgcatagcaattgctcgcaaggaaccaagatttactaatatggcttgttcacggacctatatgaaatggtacatagaagcaatatgttgaactgtgaagcaggttgataaggcaaaaaattaacttctacataaatctagaatctagtaaccatgcaaacatagagttcaaatatattgatatggaagtttacatgaaaagctatacacaaatattctatgtatgttatcagttcatagtaatgaacagtggttgtcaagattacaatcacaatgcaggttactgaaaaagacagctaaacgaaatgtgagctggaaaatattgcagaattaaaacctttttctttacttctatctttgaataaaaaaaattgaactctgactctgtgattgactataataacataggtaattttgacaggcaacctgagatacttgtaacagagcaattgtactatcttcagactcttgtacatacacaattattagcatcactcattccattgtttgtgtaactgaaaattgtaggaaaagatgggaaacatatacagagtaaagtctacatgattaattattgaaagtatcttattaccagcaaggatggcattgaattcattagccatagcgatgggtcaacgcttctggtatctcgtaggcggaggcctataagaaaaggtcggtgatcaacataaatactgtcaatgagcttgacattcacaagaatgaacaaaaccacaagaaatggcagcattttcaaattctaaaactgttaccagtaaattatcaagcactatatgagagtttggtacagactacataatcatgttttttacagtccttgagaaacatattctttctacctaccacttgatttcaatagctgcctccggcttatttttttggtagacatcctcccattagattttacttctatcacctgagtaaaatttgatatccgggaaagttaatttgcatcttgcaatttgcagaagtcccagaatatgtaacaggcatttcattccaaagcaaacctacccttacagaaacatgcatcaaattagcatgacaattgcagatttattttagataagggagatgattacatccccagcctctgcatctaggatgcacacggccatttgagtttgcaaagaaaatgatctcaacgagggacataactccccatgacttgaaaaaaagagagagcaaaatctgaacctagagaaagatttattatgcatgaagcctactggtagccctccatccaaagttacacgtttggattaacggcatataatgtattgtttatttacgtttggacactcacaatgatcatattgcaatatttccatttggcttgttgagtggacttaagaccttgagaacatgagctattgcaatccataattctgactaggaacagaagttagctgatgcacgaccttgcaaccttatccgaatcgcttattagcaaataaaaaatcatttgtgagtaaagcttttatatacgtatccttagtgactaaaaaaacaaatgcggcgaataatctacaatgaaaaaaaatcaaattcaaaattaagttctaaaatttaaattttgacttatatgatcataagaatgagtcccttgctgtctccaatttaccattaaccattacaaggcgttcgatcgccgatcggttacctcgtagacgggctccctgatgccgagcgagatgtagtcggcggagaatcgccccgaccccgatcccctcgctgcggcctcccttgacccatcgtcccctggcttgtcctcctccctcctcacctccacctccccctcctcctccaccgccgccgccgccgcctcctcctcctcatccttggtcacggcccgcccatccttcccctccgccgcccgcagcgcgggcagcggcggcagcaggaggaggccccccgctccgccccgccctgccgcggagagccccagcgacgtagctacggcattccccctcccctgcgactgcgagccgcggtaccggaggcacgcgccgccgtgcccgtgctggtgcggcggctggtggaggaggaggaggacggcggcctgcgacgagtacgacggggacgacgaaacggacgccatgggcgcgggctccgcgggggcatccacgcgcggcggcggcggcgacgccggcggcgaggtccacgtggcagctagctgccgcggcgcttctcctgttcctcgcttgttttttttttctattttttctttttttttttttgggatctcgcgcttctcgcctcgaagttgaaggcgacgacggcgaggcgagaaggaagaagcggcaagggaaaatgctatccagtagatgagctggtggctgagcgggctcgcgcgggcgggggcgatctgggccgtccgatcgcggatcggacgggggcggatgctccggtgggatgacgtttgtccgttacttctggctggtggggcccagttctattcatggtggggtgggctgccagctgttcctctgtttcgtcgtcttctccagcccggaatatgaaggtactggagatcagaggacccatgtgggtcccactggcagtgtccaccggcatggattagatatgatctggctactactataccgtcgtttgagttattgagtactccgtagcgtcgacgtcgtatagcgacggcggagggtcgctatatttagccccgtcccgtctcggcttgtttgtttggttcatgctattttcagccttgccggatttttttgggaaggacaaaaattggtttttgctaaaattttcgagaatgattgccatcgggtgatcgggcgggggagcagaactcgggcacccccccccaccccatgcacgcgcgctcttccctggtccaccacgtgtccacacacacaaccctattacaacaaattacccacatattttaaaaaccctttgttaagagaatttggtttatttgttgttccaccgaaaatgtttcatctactacactcataatgattcactatctatagatctaatgttgcagtgaattgaaatactccattgcaacaaatcatccatatattttggaaaccctcggaattcgtttcttttttttccaccaaaaaaatgtttcacttagtgtacttataatgtttcactatgtacggttctaatgttgcagtgaattgaaacttttttttcgttatttgctgaaacattgtttttatataaggtgaaacaacacccgattctaacgattgaaatatttccgttctacttagtgaaacaattccgatataactggtggaacatcgtgcaacattttaaaaaaagtcaataataagctaaaaaaatttcgtcgaaatatatccatgtgtggtcttgttttgaatatttaattacaacgaatttaatggtgcaatcggatcatgatttggataaataatttaagagaaaaaaaattttagaagagaaaaaaattagtttaaagtggttttacacatatgggtagcactgacgtcagcgcccgatttttggagatttggatcggacgaccgatccctagtcacctcctcaaatttttggcgaaaaatagctatgatttgtctggtctgcttaccaactttaagaagttatactccctctggatataattaattgacatttaggacaaccaaatatccaaattacaaagaaaatgaaaatgctcccgatgccgagtagttcaactcaatgagcggtaatttctggaaaatccctttgaactgaaattacaaagaaaataagccaggacttttctctaaaaccatgaatataactggccggaggtagtattttgatattcaagtaagccaaataatttggcaatgccaattttgttggctacaaagcaaccaggtgagacaaatgctaaagcgaaccctacttactattcaggtatacgccataaaaaagtttgcagatttctttcatgttatcaatggcacaaaaaggatttctgagtgcatctgagaattcattctcttttaccaacatgaaaggttagtattactctggacaagtttctttgggataaaagtttacgtctcccaaataaacccatccacgacatgaacgaccacaatgtgagatgctcgaaggagtacatattagccctaacaaaaactacccgttaaaaataggcactggacaagtgttaggaagggctacagcctacaggcctacagccaaacgaagcatctgagcactggagagaacaagaggtcagggacactagcgcttcatcagtgggctagcagccgagaactgcaagtaaaagaagttgaaggcctcaactacttccatgtaccacattgattcacggtcgggctgcgcggaaagatcgactagcttatgcacctgcaacaatcaagttcaaagtcgttaaaagcaagatgctgataagagtcctcaggaaaactaatgcagtgggtaatgtttaagtgcttgtacgtcttaaggctgaagcccaacaacagaacttagtttctagttcttttttgagaattgaaagtgacaactacagtaatctgcctagatatgttttgccaatgcctaaatctaacccaagcaaaagtgtactagattaaaagtatgaacaacaaaaatgagccaccatcttatccttgtcttttcatgtcaccaaaatagaagagagcgtggttgatacttaatacatgcaagaacaagccttccacatgatttcagtagctattgcaagcctgtcacataatcaggaaatacatggttcagcaaagatgaccattgcaaggggattacagattgcaacttgtcagtaacccgtcactctgctgcaaccctgcaactgttgttaccaccatgctgattggtcaatgtcaaagttactagttgtttctactatggtcatttccctcaaatttaggttggctcaagaataatgttatgtaaaattgacagctgagtagaaagttcttcaaatctccagatctaacacccacttttgcagactaatgttggccaaaattcagaaaaattatctcgaatgtaatcaaccaataaagctccaaatgcagtacatagtagtattagtaatcccttgttctttcaacaaatgtgttcagaatgtcaggttatgtttcatatcactaactaaaccgaatggagctttctaaaagaaatcatgtattcatggtttcaagcttttcagctacggttatcacttgaacacaaacagcaaccagaaaggcatgaaccaaagatttgcattaagactcctttacctattaaattgtctcttcaattataatgaatacatcatgaagatggcaattgcctacaaattgaacacagggtgttgggaacaaaatagaactgttggatacgcgaagttgagcaaactaacaatcgaaagagatatgataattgcatttgcttatagagaactgacagagtaatagataatggaaaaattacacttcaaataagattttgatatataaatggctcctacaatctgatatggacagataacaagcacaatgatacaatatgtaaccactttgtttctgtaatagtaatacgaagttgaagtaatatgatcccggatgaatcaagggtcttcttctcatcagtatcaccaaatttaggttaattaactctaatttggcactaattatcaatatgctcgtgtgattagacacggatcttgctcttcaactcgttcttactcctaacgctatagaatctagagattgaaggctccagaaagtgagatcactaggatggattagtatttattttacaagctaaatctaggagtctagttctcttttcctttcttttaaatcatttgaccaagcaaggtttaaactgcaaatgttggcgatgttcaaactttgaaataactatatggacagaaaaaacaaaataaatatactgtatagaaagaaatatgcatgtgaaaaccgagaaggtagggacacacaaagaatgagggaagtaaccttaatcactggccgattggcccgaggaagagattcctttccactatatgacccaagaaccatcacatacatgcctacagaataaaatagggcatcaactagagcaaatgaatcaggatccaggaaaagtaccaaaatggctataggtctacagcacaaacagagtaaaaggctaaaagctgcgcaaaagattaagtagcactccactccactttgccagcaaattcggcatgccaattggatggtaccatagcaccacatggcagatgagaaatcaagcatgaagcgcaaaactattttgaacaatatgcttgtaaaccaatagcattctcgtaaataacacatgttaccatctaaggacaaacatgccctgacaataagttaggttttgatagccaccctaatggcgaactagtgattattaggatagtgtatggttccagagttgatggaaatctcaatccgtcccgccatgaatcacatgatacaactaatatgattaatccacaactgcacaactatatgtgcattttgacgattttccaacaaaaaaaaaggggacgccacgagcaaagaaacaaaccttctcgccatggctgcccctcggcctccttcggtgtgagcgtgatctcggcgacgcaggagccgtcatccacaagaatgtgcccggcgccgtcgcggtagtccgccagcaccaccacgccctgcctgccgccacaagtcgtcagggagagatggagctaggagatggggggaatagggaatggtggggaggcgacctggagccagacgcgctggaagcggatgccgtagagcatctgggcctgcgaggtgccgtccgactccgagggaggggcctcggtggcgccggccagctggcaaccgaagagcttcagcgccgcgagggtgtagtccatgttgttccgcttcggcgccgccgccgccgccgccgcgccgccgacaggttgagcaccggaaccctccattgcggcgccctctctctccggtgctctctcgggtctcaactctcaacaaacagttcaactacactgatcgcagatgggccgtgtacctgggcctaattaggcgagggccactacatgatgc

SEQ ID NO: 79055 - DNA, 48035 bp, Oryza sativa
cgaggtgccgtccgactccgagggaggggcctcggtggcgccggccagctggcaaccgaagagcttcagcgccgcgagggtgtagtccatgttgttccgcttcggcgccgccaccttcgtcgccgcgccgtcgacaggttgagcaccggaaccctccattgcggcgccctctctctccggtgctctctcgggtctcaactctcaacaaacagttcaactacactgatcgcagatgggccgtgtacctgggcctaattaggcgagggccactacatgatgctatacctttcgaagacaataaacacaagtgtatatcatagcatacaggtagaccaatcgtcttgtttaagagggcagctacaaaatagcatcccgttacaacgggatagacatgctaactattctcttacacgagtattacatgtatcaggttctaggtattataggtatatcataggtatcgggtaccatatagctggtaccacagcatgcatcaagtatcaggtaccgtctcatagaaaggtatcccgtttcaacgggataccgttgtctaggttttctacttatttaaaaaaacaactaagcgagatattgaggtgtgattttattagaatgctaaatttggtagtaaaatgagcatataaacaatagacaattggataatggttttaccgttgtagttagacttgtccaggcttcacaaaatttctagctccactattgctcatatataccatacacgatactataggtaccatgttgatgtcataaattgtaccgacatgatacacatgtccgatactagatctggtatcttacgatatcatgctactatcattttagcattaactgttacgttagaacggtataccgttttgtaatatgtagatgtagtacatacataattaactgttacatttgtatgggcctaattagacccagtgtgatctatcagaaggcccggcccggttacaagcccgagcatttcttgcttgcgagtggagttgaacggaccgcaccggcgtcagctcacgaggcaggaaagaaaccccaaacccgcgtcgccgacgccgtcgccggcacactcgccttcgcctcgcccaccaccaaaccacctccgatggcgcccggctcctcctccacctcctccccgggaggaaaagccgccgcggtgggcggcgaggcggggaaggagggcggagccgtgccctcgcccgcggcagctgcctccgaccacgctccggtggcgcccgacggctcgccgggaggtggcgcgctgccggcgggcggcgaagcggggaaggaggacgagggcgtcgcctcgaccggctcccgcactccgctggcccctggctcctcctcgggagaaggcgcgctcggggaatgcggcgaggcgaggaacgacgacgaagcgccagcgccagcgccacggctcatcgcctcgcccaccgccgccgccgccgccgccgccaccactgactacccacatgaaggcggcgaggcggagcaggagggcggcaacgcgtcatcaccatgtgaagagcaggaagaggatgacgacgacgacgaggaggaggaggccccgacgcatctccccttcgcaccctcgtcggaatcggaggtacgtgcgtttgccccctcagttcttgcggttcatcccctttgtctctcttacccgtctctccaacccattttgcgctgcattgctttcacactctcgccctcgtgggcatttcgtcaagcacctggtggcgggtggtgcttcgttactgtcatttaactcgtgggcatttcgtcaagcacttggtgtgcttccttactgtcctttaactcgtgggcattactgtcatctaagtgtccccaatgtcattcaagtgctttcacggagcgtatgtaccatttacagttgaaaacttatatatcatctttgcatgctcaaaattctcgtaatcaagtgttccatgcgaatgtgaaggtttaatccacaattccgcatggttctagataatttttagtgagatttctgtgtgttgcgagcttctgctttagctgacagttgacttattagaaatgacttctggatattttcaatcggtgttccattgctttattgatgttttctctcctgcttgtaattatatgcagttacctgatgataagtcaacagttgatcccagcttcaccatctctctcataaggaagctggtacctcagggaccagatgtggataaagagttaaggtgcaatttacttccagagattttattttcagttagagttctctaaaagtgaaagccgtgtgctagattttcatgctgattttgttatcagctgctaacctctgataccatgtaaacagtgtgaagcagggacgaacagaagaaaaggatgctagttctgatgttggggaaccaaaacagcctcatgacaaagatctgtgggacaatgaaggttgcaaactgtgggacctttcagttattgaacctcaggcagaacttatggtacttatctctatacttgatagttgatatcatgtcatagttgataactgtgcattgaatttaagttctacgatgagatattctgcataattattgattatgattgtgaaattttcggcatgcctctatcccaatagcatgccagcatcaatcaacatttgaacaggaagattagtatcttctactaggagtcgattcttatctattaaaatatattatttacaagaaagcttttcatgatctgcgggcatgtactatttgtaaaagattgtgctactgcaatagaaggtgaatcatcaattgagttctaagattcactgaaactactgcttgcaccatcatcgaatttttgtactgttgtattgtaagtctttaagtgcattgactgcttgcgggaagcgctaactgtgcggatctttaattcttgtaggttaacaaccttgtacttgaagtacttttggcaaaccttcatgtgagacaatttcttcgagcaaaggtgaagtggaatatccttctactactgcctccacgtttttgctagcaaatattttaataagtcttgcttctctgaattttgttctccacaggaaatctgtattgggatcataggaaacttagcttgtcataaatctctggccaatgcaatcacttctcataatggattaattgctactgtcgtggatcagttatttcttgatgaccctggttgccttactgaaacattcaggttggtattcatggaatatggtgaatgtgcgcgtaattatgtagtggaaacctggaaaccaccacataaaagtttccaaaagttttttaaaaaaatctcaccaacgaagtttgatattaaaattgtgtgtggttttctaatatcatctttactatatgtaacatttttcttgaaattttttggaaacttttacggggtggtttccactacatatttacctatgatgcacggcttgtgctaattaagactatctacatagcactttcttgtttgctctgacaagattaaaaacaataagcacgctattgtccctttgactcctttagcaaattgtaaattattgaacctgtaacaatatgtttttagcaatacaagttcttttatcacctgaaattaagcatttatcatgtggaaatgaatcaggcatcttactataatttatgcttacaacatatgttacatgcagacagatagtcatacattacacatatacagcatcactatttagtggattgtggattaaaatgcttgaatatacagctgttcttaagaaaaaaaagtaaaatgtaacttcttttagcacttgtaagtactccttattatgattccttattatgcatctccttttcttcatacacattcatgttatctttctactttttttttccttttctatttttgtatatagactatcatgacaacccgagttctgttctgaagtttactagttgtgcagtcatagtcacacagtctatttgtatacaggttattgagcaccatttttcagagcaacgcatctatgtcatgggctgaagctctcttacctgatgagattctttcacgtattatgtggataattggaaacacagtgcatgctaccttacttcagaaggtgaagtacttgtctatccagtcaactagatcctaataggttgataacttgtattgaccttagcttgatgttgaacattttaggatgatttatctatttgacattctatgtaataattgctacttttattcttttacaaatgatagttagttagatgtgtttgcataatttgttctttttcagttgatcttattatgattcagtgttagaagggcgttatgtaaatcatttctgttgattgttacatgtatggccactatcaatgtaatgaccagacctcttaatccattgtaatgtgtccaggacatccaaacaacttcttgattgcccttctgttaggagttcttatttatttcatcattattggcaactttgatcttacctgcagttgtttctcatgtttcccatgaggccatgagtctgcagacactgaagatataattgcaaactagttttgaccatttatggcctatgaactattttggaattcatccaaaaagctgtgcacttagatatttgatttagtataacttaatatatttgatttagatatttaatatagttatatggtgaaattgtggtacggctgaaatcatctggccaactgacttatggcattatcttttgaatcctgtacatgttcaaaatttgtgactatttcctttgtaaattattgggtgcagatactggagtttctatcagctcttgttgatgatcaagatgtcattaccattcttatcgagcccttgataaaagtgggtttagttgactgtgctattggtttgctattaaatgagcttgaaaaatcaatggatgggaacaatctagacaggtatgatttctgtgaattgaagtctgaactaacttcaaaattgcaaaagtgtacagttcatgtaaaattatctaagaaataagaacagatgactgtcaaatctagtgaactatactctatttacagttcataaagcatacaacatatcctcttgctataaatctaatgcatggataggtccataaatgccatctgaaatgcgggcacttgatgttcaccgataatttagtctttgtattttacagttttcatgttccttctgcttagtctgtttgcattaaccaggaattatggcatagtcatatttccttctaatcacttttttttgggttttcaaactttgagtgaatagtctagcacaggaatggaattttagtaccttgacttttttttaacacatttcaggtcagattctcttgattcaatccttcgacttattgaagaactgtccgccatagacaactgttcaaaagtaatgtcatcaaatgaccaattgattaaagcactaagtaatatagtcaagttaccagataaatttgaggtgagcatgatgctactaacagttcatttatttgattgcatgtcccatttaacgtcgtgtgcagttgaccctgcttactaaatagttttagtctgctgtactaattgatacaaattttaaggtatgccattctggattaaaagcatgaaatatatatttcaagaatatttttttttcttattgaatatatttcgggatcgtagttaggttgataagtgctattacttgtgagtcctcaatagcctcagttcttacctggattttagcacctgaaaatttatgcagattagatataattatgttccagatgagcatgctgatcatgttatatattcacaaactatgcttcaggttgagggctattgtgcttctgtggtaatcataatagcaaatgttttgtctgatggagaacatctcacacctattctgtcccatggtatgccacattttgctgagcaatatctcataattcttagccattgtttgcgagttgaaaacatgactatttagatacagtgtcacagtgtggtgttatattcattgtttcagatttacccttactggagggcctatttgacattcttccattgatctctgatgataatgaagctcgaaatgcattttggtgtatcttgacacgtttactgcaacaagtagaagaaggagaaaccatcacgaactcttcaaaactcgagcagtttgtgtctatcttcttggctaagttcaccctcatgaaagatgacattgaaagacatgggattcaaacagaagctgattcctcagttgagggtgtttctttgaagaatgggctacgcacatctgtatcctttataagaaaattcaatcctgataccatcatgcccttcatggagatacatagatcttagttttcattcccatgataaatgcatctaaacttaatatatcattgcttttcctatgctacatttttttaaaaacagctcaaggcgatctgcagtatcacggagagatggattgcggacaagtcctccttgggcaaagaagatgcttcactgaccgaaaacaccattgaaaatgctaaagagctgctgactttctgccggcgtgcaatgggtattgctgacctgtgagtttggaatacggaggttttgacgtagagggcaaccacgtacgtgaaaaattactaggagttttgctgtatagcacgagatcatccggaagtctgttaaaaccaactaggagttttgctgtagaggatcacagtgatgcatagatcatcagttgctaaagtagatcactactcacatagctctgccaatttacattgatgtggttacattattggtgctagcgatgtaatgaacgcgcataaaaatgatacggtgctagaggtttctgatcaacttgtgctcatggcttaacgagatgctggcaaacctattttgttgcgaccgttaccaaattgcttcttgttgtttcgtgtggtaacacaccaccacgattctattgatgcaaaatgagttcatgcaactccgtgatggtatgggctatgtaggttgaactggaaaggttactttaagttgggtatgaaaatttgggaatatttgatactaaatttgataatttgcaaagcactgtaaaacgtatatgcatcttcacgaaccttgtctcgctttagggagcttctagcaagtataattactcttacaatctccaactctttgaatagttcaaattcctattccagattgtatgacggagggttgttaatggaaccttaacagtgatggtgtttttgggacaaagttgcttgtacgatggtatttcataaaactcgttcttgtcgatgacatttcttgaaattgtgcgcatgtcaatggtattttttggattttctcaaaaatgaaatagacacccccattaatgaatgatggcgtaggatgtggattggggtccccagtattagaatacaaaatgcagaggtgctatagaaattacagcaggaaaaacctgcaccatctagcacaattctagacctatgattaacatccacaggatgaatgtgatagtactagctataagataaaatcctgatgctacaatacatgactgatttaaactattagtttttattgtgactgctcaagtgctttgtaaaggcaattgagtagcaactttgtattagcaattcaaactgcagaggatccggatcccgtaggaatctgctagtatatatacacatgcgtgaattgttcagtattgtcgtgtgccatctttgaaaaataccttttcttttaaggattatgagagattttgtgtgagcattgtgtgaatctcacctatttcctgcttagcctctccaaatacaaacataccaatgtctagtatgtacgttgggtgagttttattagcttatggactcggttactttctcttttattataaacatgattctcaaaggactcggttactttctcttttgttataaacataacatgattctcaaactgctagaagatacattttggataaaccaatttaatatagaaatttatttaaaaaatctaaataataaaatatttaaagtagttaatatttaactaattatatgttaataatccattttgatttttgcaccactaactaactcggccaaacacaacctaagatgaatccatagatttcaccatagcgtaaagccgtaaagttataacttataagcatatattcaattgcctttacaaagcactccagtttacaatggaaaaaacacatgctacaaaaccacatatttcgatggttttaactgaaaaaaagaggtgacctcgttttctttcctcaatgagagcagaggcaagagaaaaaaaaaagagtaaagtccatcaccggtccctaaactttaccgctgtgtcatcccagtccctaaactcgcaaatcgatcgttcaagttctcaaacttattcgactgcgtcatcctggtccctaaacttgcagatcacttatttaggtcctccaacttgttcggttgtgtcaccccggtccctaaacaggacggtctaaaaactttatatcaaaaaataattcataactttttcatgtaaactctaatgaagacaaactttatatcaaaattgtagccctcgacacgacctacaactttgtagttgaaaagtttttgaattaaaactgtttagggtcccaaaatattgttgaatatttatagattttgaaattttaattttaaaattacatattgggacaaaaaatgacttaaaataaaaaaattcaactacaaagttgtagatcgcatcgagggctacaaatttgatataaagtttgtcttcattagagtttacataaaaaagttatgagttatatttaaatataaagtctttagaccgttctatttgacctagatgatattcaaatccaaatttaaggaccagggtgacacaactgaacaagttggagaatctaaacgagtgatctgcaagtttagggaccgggataacacagtcgaacaagtttgaggacctgaacgatcgatttgcgagtttagggaccgggataacacaacggtacaagtttagggaccgatgatggactttacttaaaaaaaaaaaacaaaacaagtgaagtgacctcagctgctgcggtgctgcctgtccctccgcatcaccacacagcacgttccccgagctcggccacacccagtaccaagtgcacagccgcagcgccgcatcaccgccttccatttccacatctagggtttcagttgagtcgagttgagtccccctccccccacggccccacctcgccaccgccggccatgcccgacgcggcggccgccgccgccgccgcccaggacgccgacgccgtgatgcgcgacgcacccgccgacgcagcagcaggcggcggcgacaacgacgacgacgacggggatgacggcacagaagaggacgaggaggaggatgacgacgaggagggcgatgaagaggagctgccgccggccgaggatccggcggccccggagccggtctcggcgttgttgccggggagcccgaaccagctgacgctgctgttccagggcgaggtctacgtgttcgaatccgtgacgcctgagaaggtcggtctctttactccgctcatcacctcgtgtcgctttccttccgcaatcgtcctggaaatgtttagctcaaaaaaatttcgtgggatacgatgaggaatttgacgtgttagtgttcgtgcgccgcaatcggatatatgattggtatattgtggtttcttgtttgtttcgagtcattctgtgggtaggattcttacagttcaggaattctggattagtgctgctactcccacgaaatgtccctctgttttttttttaacttgaatctcctttgctactgtcacttcagctagtttacaatgttgattgttggatactgttacaccaaaaaacgcaacactagaaatgtactaatttattctatttggataatatggttgatttggtttgaagtataccgtcatgttcatgtagacttgaatattggatatacctatcttagactgttagtaacttagcgcagagcggtccagcctctgaattagtgtaagctcgcagttgcaatacaacaagtagccactattatcctctggctcatagttttagtaacggttaatatgattctctctccatcccaaaatatagcaacttgatactacgattagacaccacctatattacaaatctggacaagatgtctatccaaattcatagtactaggtggtatctatcgtattacttgattgctatattatgggacggagggagtatgtcagttcttatcactcacgtagattactagtaacacatggtgatgacttgctatttcctacaagttagtccttggaacttttcagttgtgcagtttgtgacccgagttttctgttgtttttgttcttggctggaatcctgattcatgtaaacaatatgatggcttgtataactgcttgctataatcccaagttaaatttattccagagttgagttttctgaatattcatttaggtataggtatttcttttgttcccttttatggtcctgtcttttcataagatgaagttttttttcccaggttcaagctgttctgttattgttaggaagaagtgaaatgccaccaggtttagctaacatggttttaccaaatcaacgtgagaacagagtatgtggaaataaatagttccatagtcgcttggcaatctgtattgttttcttcgtttatagttcatgttagaattatctgcagggttatgatgatttacttcagagaacagacattcctgccaaaagggttgcttcactcattaggttccgtgaaaagcggaaggaaagaaatttcgataaaaaaatacgttacgccgtacgcaaagaagtggcactcaggtttgtatctagtctgattgagtattcaccgatcttttgcaaattctaccacagaagaaggcatagatgaaccatgtggatttgctacagtcttctaaatttgtttagatcaatcatcattctttttcattcttctagttgatggaactgctttagtgtccatggggagcacatgaacattttcattaggggttctcaatttgattagcaatcaatgtgtctactgcttgattggttccatgatcataccatgaacatctaccaatataatttgcaagaaaaaaatgcaagctcaattttttgttgtccctggatgctagttgctcaatatgttccaacaattaattgcatggctccattagaataaaaatgtaacaaattaactgacttaagactggaggtctggagctgtacttctgtgtagctttaactaagagcaagatgtaccatatccattgtatcaatgagcaatggatggatgttatgagtcttttttgtggtaaaaaaaatctaatgatttatgctgctacctattactttctgtgtccgattgttttagccatcaccattgttgtcacctcaatctttccagctccatctcctttgtgaattttgtgtttgttgaatactgacagacaagaatgattggggccctggccagcagtgatggtacaaatagttcgcatacatgctaggcacagcatcaatggatagaagctaggctggagatagattaggcataggtaggaggtaaaggatgggatgatagatcccgtggattacattgtttgcagacccaggcgcataaaattctgcacatcaagctatggaatcaactagcaactaaattgtatgactagataaacattacttggcttgaaaaaattgatgttgcttctacttactctcaggatgcaacgtaggaagggtcaatttgccggaagagcaaatatggagggagagtccctatctccaggctgtgaacttgcttcccagggttcaggccaagattttctatctcgagaatcaaagtatttcttatcttttgatagtctatatactcgttctgtctaattattgtttagtagaagacttatcttctttctgtaaaatacttgttgcaggtgtcagaattgtggcactagtgaaaaaatgacaccggcaatgcgccgtggtccagctggtccaaggactctgtgcaacgcctgcggactgatgtgggctaacaaggtattgttgcatgtattaatgagctagtttattgtttatctttctttctgataactaatgggcttctcttcatctttgttttgaggacacctatcccatttcataaattgatagcattagaatacagtaatattctcgtggaggtggattgcataattacattgcttggttcaactggcaaaaacattcttcatggcatgcatgcctcttgttatggcgttacagtacagggcatgttaaggcagtggccctgttttgctatcttatgcggttgataatgcacttgcagcaatggtgtatatgcagtaccaactagggtaaaaagagtcatggtttttgaaccatattatgaagacatggacacatggttatatctgtcatattgtaccttttcttttatttttcgttggctttctaggtacgccgttgacttcaatagctatatgtcagaattgcgggtatggtcattttggaaattagggggtatacgaaaaaaataaaagtaaagagagcctaccattgttgttaattaagccgcttgtttcatgttattgttgactgattctctgtgcaaggaacatatctcaaacatcactatgtgacttcttattctgatgtttgcaatttgcctttgctggcactagtccctgtgtctggtaattgcctaattggtatctgcagggtaccctgagaaattgccccaaggcaaaagttgaatcttctgtggttgcaactgagcaggttcatttttttaataattattatcaagagtttgaaaatgaaatcattgctgaactgtcaatatttccatacccgcagagcaatgcagctgtctctccgagtggaatcgacaacaaggaattggtggtaccaaaccctgaaaacattaccgcaagccatggcgaagtgtaagtgccacatttcccgttccaaattttgttcaggcagatgatttgattgacagtggatcatatcctttccagcatgggcgacagcactccggcaaatgaagccgagataggagcgccaaaggcgcagtcacaataagtttatgtttaacctgtcatgattgaaaccaaaagattctggattctttgcctacaggctatacagctaaacatcacaatagaaggtctttttcctgaccaaagtatactgattctcctcaagtgtacaattcttgcttgccagcacatgtaaatgtaattgtaattaacataaagagcctgattggtgcctgttgtgtaaacccctcattctcatgacatctaagatagcacatcaagcagactgtcatgtacttccggctttggagctgcttctgaaggggagttgtctgatggtgcttagtgtcccttcctaactactacgcctgtaaagttgtaccaactgatccttgtacagtttgtattaatgtgtcgtctctgtctttcgttttccgttttgctttgtgtatgcctctctaaaattggcatttcgctgtcaagatgggaatatgggatgatgccatcgcaaaagggaaggagcccctgtgatgatgcgacggtgcctgctgggttacgaaatccctggggaaagaaaaagcatccactcacagggagctcgtgctacggttgatgaattatgatgatggctggctggttggctgctgtgtgtagagcaccccccctgacccaaacgtccagggtgcatcctcctatttcgtttgtatccaacgacgttttctttctgaagctaaacacgttacacggacaaatattgtaatggtacatatgatcttaacagaacaatcgatcactttaaaaaaaagaacaatcaattttagtactctctttatctcatattatataaaacttttgtattataaggctgcattctttcaaaggagattggggagagattggggagattgtcactcgttttccgcgcacacgcttcccaaactactcaacggtgtattttttgcaaaaaaatttttatatgaaagttgctttaaaaattcatattagtctattttgaaatttaaaatagttaatacttaattaatcatgcgctaatggctcacctcgttttgcgtattttcccaatcttctcaatcccctcaccctcaaacacagcctaagttgctttgattttttaaagactttttttacctttaaccaagtttatagaaaaaaattagtagtatttacaacaacgtataagtttcattaaatttaaccaaacaaatatattttgataatatatttgtttggttgaaaatattgctatattttttatacatttaattagacttagaaaatttagctaaaaaaaagtcaaaacaccattgaaaataccaaaagtaaactcgaaatagagcagtaacaagaaactgaaaagtaaccactctcactgaaatactactaagcaagtctaccggaatactgttacgctgacgtagacatgagtaagcgcccagattacatacacacacctatccaaaccccatcatccagttacgccgactttggggattattcgcgtcttcaccgacctaatataagcgtggttacaaatctcaaaaccaacaaaacgaaccatcttcacctaaacccgtccacacgccgggtggccgccagttcagcgagtgacgacgacgaccccccacgcgcggcggccgcgcccatctccgtcgcctccccgccggccatgtcggtgccgcccgccagccaccgccaggttccccctcttctccacgccatggtagattcctctccctccgcatcgctctaccgtggctgattttttttttgtttttttctggttgctgtaggtgtccctgaggggatcgagcgcgagggagatcacccgcgacgcgctgctgcagaaggtctccgaggagcgccagctccgcagccacctccgccgcgccgccgccgcggcgctctccatccaggtacctctccactcctctcctctccgcggcctacctaccagcctcccgatcttatctgggaatctcgtcgttcttcatgagatatacttttacttttacgttttattcttttgcgaacttcgattagatcgtgctgtgccttgttggtgtgttagaagcaatgcttttctggagattgtgtggagatggatttgatttgtttgaattaagtgcgaggtcatatgaagattttttttgggaggttgatgtaattattggtccacaatgattacgaatttaggatgcgcatatcaatctgaatgaaagtgttgctggtgctaaattttgagagttggtttaagcatgggtgagaggtctgacaggtagagaatattgagaaacccataattgctcagtgcctttctagatatttcattaacaaagtcctgcaaagatactgagaagcttataattagtttttgcataaataatatcagcagctaaccaagtctgcgaaccaccttatgtggccatttcaaaaagaagtccacagagtcattaggcatgtggctgttgttcatatgtgggtatgagaaacacaaaaatgatggatggttaaaacataaaagtaggatagaagtcttcatgatcctcttgttgctcgatgtggttagattggcaggatggttttggtgctacagttgtctgtgaggtggagaaatcatggatggctactagagtactagacaggttgataagttgattagtggcttgatatgtaatatatttaacgattttgtgtttgcacgaatttgctacattagggtaagactttcaatttgatgcaaacttgtgaggagtttgtgataatcctgtctttgtaggtagccttaacacacaatagatgtgcagatggtcaaatcaaatggattaatttattgcaggttcaacatttaaaattaggtttatatgtgattttccctcagtgcaaacagcaccgggagttctctgacaagaaacttgatgcccttgcaagctgctggagtacttaaaatatgtcttgattattaacgtgtttggagatcagttagtcgattgttatctcctttctctttatagacacaacctcagacagtagaatttttttaggatcatgctaatccactatgtttctttttcctgtgtgtgggtcgttcttctgaccattaagcttgatgcagaaatagttatttttatcatgggaaatatacatccaaagtagacataaaggccctctcagtgctcttgtatatgatctagatttctgctgtacttctttcaaactactctactgttgcacttgtacacttatacaattgatgcttttgttttttgctttgttatgccagcgtgtttggagaagatactcagtcataagaattgtttcagaacagctccatgaagagtgggaagcattaataaaccagcctgacattaatctgacaaaacaatggatatcaagcatgatgcttagaccatttcttttcttcgttactcaaccatcaagctggtacaagggacaacaggacaagactctaaactcgatttcggcatgcttcaaaatcatcttgaatagcataaactcaatgggtatgcctttttcataatcaaagtttgactttaccgacttccatcttgacctttttgtactttattttctcctccttaatgaaatgacacgcagctctcctgtgtagtttgaaaaaaaatgttttactttacccattccactagttgtggttaactcctataaaaatttatttatgtaatacttccttttgctgtaaggattataatcctttatattattcaatccttgtatggcgatgacctaattgttagttctagaatggaattatgtacttaacagaaaagaaattgcagtcgacgtgagataagcagatactccctccgtccctaaatataagggattttggttggatgtgatgtatcctagtactacgaatctggacagagactttaatatatatcatatatttagtactaggatacatcatatccaaccaaaattccctatatttagggacggaggtagtatttgttttgatatatatatatattagtactgtttggttgagcagtgcaatatggaaggaatattacagtaacttttttcttgaggctcttgatccactgagctggcacaaatgggtagtctcttctcggtgagatttttttttttttttttggggggggggtggaatgtagcctctagatattactgtttcaagaaaaaagaagttctttgaatttgaatgtaaagtgcatgctatgctttgatagacaagaagtatgaagtgggtctacgatatgtaaccttgtttaataatggacagatgcatgctaagctacagagcgaagctcccaaccagctggcctccatgtttaaagataatacaaatattaccacataactagtttagaatgcataggtccataactgtccttcaattatcatttggtagatgaggttaaacacaaaaagcatgaactatcttggagagctagctttcctttaaccattacagtaacaataagaacagcctttagtcccaagcaatttggggtaggctagacaggaaatccaagtcaaaccacatgaaccacaagaaaaaaggaaaaaaaaaactacttaaaccacaaaaagtgattttctaggccatagttctggcacatggatagctactttccacaaactcttatccaatgccaaatctttcgatacattccaagccttcaagtctcttttaattccttcatcccatgtcagttgtggcaggtcatgctttgatttaaccattgcaccttccttttcaactgacatgtatctttcctctgtagatgcaagcaaaaatttatgttcctttgctgtgggcacgccagaagaaaggtctatttggctttatcaggcaaaaaagttgatttcactgtgctcattcattcttgccaggtgtaaccattcttgctgtaaggatggaaacatggttcagattactgacactgctatgaggttggctgtgtctttaactgattgcaaaacatggaaaaaaattacaagtgaggatactagagctgctgatgcatctgtggagagcttgattgaatttattggtgcaagccagagtggtacatatagttgtcttaggagatatatagtaaatcttggttctcatgccttggagaagaaaatttcttcaatctcaacagatgatcagttcctgattactgctagtgcagtcaccattgcgctacgacctttccattctatgagagcagggaggggtgctgatctaaatggtgcttcaaaggaatactttacacttatactcacaattccggatctttgcaaacgcttgccacctctgttgttgcctgctataaagcacatatctatactacaaccatccctagatattttactggtaagagtttcaagattttgatatggacaagtcactctattgcattttgtatagtatagcatttagctgccgtggaagccttgactctcctagaagtcataggttcaacagttcttttgctgctaacatgataattgcacactatagttgatctactgattttcaaatgactctcctagaagtcataggttcaacagttcttttgctgctaacatgataattgcacactatagttgatctactgattttcaaataataattaatttgttaatagcaggtatttattaggtttattgatgtaccatcataggagattgattttaaaatattgacatattgtgagtgcgaaactgatcaaggcatggcaggtggtagcagatctccaaggacaaaatatttgaggaaataactaaattggagaagtcaggggtttctagtggtggttctggtaccattccctactgtggatgggctcttggaaatcttgtaactttagctacagagcatgatgatttatccaattcagggtgctttgttcaagggctagattgttgcctatatgttgatgcaattaactgtgtttcccaaagcttactgaaattttttgaggagaacaaggaaatgcttcttagttttggtgatagtgttgatacatctttcatcaaggaaaatgataccagtgacagctgcagcagaacactgtttatggatcttctgaagccaatttaccagcagtggcacctcaggaaacttttggtgttggcaaaggaggatgctgtgtgcaagaggcaaaataatcatgacccagatacacagacccattcgcgtagcctaaaattgctggacattgtatgcttttactatcacatgctccgaattttctctttactgagtccatctattggttcattacctattctcaacatgctctcattcacccctggatttcttgttgatttatggggggcattagaaatatatatctttggacaagcagtccacaaattacaaggaccaaaacatgaaagagaatcagctacaagtagttcaggtgagcatgtatcctccatgaggcaaagaagaaatttcaaggatacatcaaacaagtggtcgaatgtgttccagaagattacaggaaaatcaaatgacgcagaggatacaaatttggttgacaatcctttaaattctgagcagaatggtgaagcattaattttatgggatattgaagccatgagacaaggatctgagtgtattggaaaggatttaatgcaaatgttgtatctgttttgtgctacgtatggacacctattgcttgtgctagatgatattgagttttacgagaagcaggtaaagattggctcacaaccacaacctacttcaccccacctccttttctgcacatcttggttatgtatttaaacttctctgaatccgcaggttccttttaccctagagcagcagcgaaagattgcatcttcactcaatacgttcgtatacagtactttcattcagaatggtggaagcagcagcaaaccacttatagatgtgactgtgagatgtcttaatctactgtatgaaagggacagcagacacaagttttgtcctatttctctgtggctggcacctgctaggaatggccgaattccaatcgcagcggctgccagagcccatgatgcagcatttgctacattgccaggaaatcagttttttggaattcctatccggagctctgtacttactacaataccacatgtatatccatttgaggaaaggtatccaactttgtttagctcttgaaaaaaaatctaaacattctaaactcaataagtcattactgtatcatttagatattcgattattgcccctagtggctacttccatacaccatttgtagatctaacagcaatacttgcataacctaattcctgcagcatcagttctctcttgccagttgccatgtaaatctcgtgtttcataccgtgtaaaatatttttttaattattatttttggaaagttcagattgccaagaggcgatgcttcatttgatcaaaaagtttagatttttttaattatcatttttagtcttgctacatttgttggttgaggagagttgattagcccatttattttccactagcgatgcttcatttgaccaaaaagctcatctcaatttcatcacgctatctgaacattttcacttgcataactgtttctaacattttcgtctgggatttcttaaatattagctcaaatgttagcccttagcaggacatgttccatcatcagaacttatctagaggctttatttactaatattacagttaagcactcgatgcaatgctgttctagcttagcagtagtactttaatgcacaacacctaatttattaaatattttcaaagagtcaatccataaggattgattcttgtgtcaaatcatgctattcaagtgaaccaccctattagtgaggcccatatgtgtacaaaacagggaactccattaatattttagcacttttctctgttacagaagtgctatttgctcttaacatatttaatggcttttactcagagtgcagatgtttagagaatttattgagttggacaaagcatcccgaagagttactggagaagtatctgggccaggtccaggatctattgagatagttattcgtcgaggtcacattgttgaagatggatatagacagttgaactgtcttggatcaaaattgaagtcttgcattcatgtgtcgtttgtcagtgagtgtggccttcctgaagctggtttggactatggtggtctatcaaaggagtttttgacggatctgtctaaagctgccttcagtccagagtatgcctactgtggaaattttagcccttcaatattttagttttccacttcagaatgtttatatatgttttcactgacttgttttctgtcccctcacaacagatatgggcttttttcacaagcatcagcatctgatagcagcttaattccaagcaattctgctaaacttttggataatggcatcgatatgattgaatttcttggccgagttgttggcaaagcgctctatgaaggaattctattggactattgtttttcacctgtatttgtgcagaaacttcttgggcgctatagttttttggatgaactatcaactcttgattctgagctttacagaagtctaatgcaactcaaggtactgtttttttctttaagaaaaagattctgctgtaatcttgttctagacccaaaaaaaacatttgaattattatgctactgaaagtagcaatttacatgctcttagtacgttgatgaatatcaattgagctatggccattgctgcattgcctgttttttcaatctcgaaacatcatccattctttatgttcaagacatgtcattagtttcggctgactcaatataaaacatggatctaaacctcaattaagtttttgtggttttctgttgactgatgtttaccaagtatatcacttctaatatagagaccatatatgatatttaattttcactgcttttgtgtatgatgttgtcacgaccggtaattcacaatacagaattccagacaatatgtgtattaaatccccatccaggactagccagggacccagggaacacaagagacaaggttcactgtgcacctccctccagcctcaaactccatggaggaaagttatgcttatgcagactctccaggcagcaacaatttgacatgacaagtctcctcctctcaatgggatctaccttcgtgtacttagggatacacgctggtggaccccattagtttgtgatatgtaagacgtgcattgtataccaactgtctcttttgtaccccagctggtcctggacggggatttaatacacatatagtctggaattctgcatcatgaatttctgggtgcgacaaatgttatggggatgctatttttgtgtcatcttttttacacaaacaatctagtgcctttctgatgttttcatccttatgttttcaaactggcctttccttgaaacagcactatgaaggggacgttgaggacctatgtttggattttactctgactgaagagttgggtggtagaagaattgtccatgaactgaggcctggtggtaaaaacatctcagttacaaatgaaaataaattgcactatgttcatgctatagcagactacaagctcaatcgtcaggtttgttacttggtttgctttcttgtatgttctaaaaactgttgttctttatcaataagcagcctttttgataataccataatctcttgcagatactgccttttgcaaatgcattttacagaggactcggtgatctcatttcaccatcttggctgagcttgtttaatgctaacgaatttaatcaggtaacatgaatactgaaacaaacttttcctttacaagtgatgctaaaaaggaatttaaaatatttaagttggaaccataaaacatagaactcgtaaacatagaacttgaagactcaaatattgtgaagtccacatgatcatattatattttgaaattgaacttggtctaagcaacagaattccaaacggaacaggtgcatgtgctgacgtgcatgtccttccattcacacatgtaataaaaacagactaattttcacacagccaaaaacccaattatatcaggtataacccaaaatgtactgtatgactgacatgcagttcctgctatttcctgctatgtgctatcggctattagtttgtatttgctatactgtttcagaaataaaactatgatagtctgcacttttggaaatactgctaatgtatgactatgattgccacatacagctgctttcaggcggattacaggattttgatgtcgatgatcttcggaacaacaccaagtatactggtggttataccgagtcaagtcgatctgttaaactcttctgggaggtatatattcatctgaattcgttttttttttctcctaatgctatcagaaacatcaagtgcaaagttatgtataggtagaacatacaaactaatatgtggatatcagttggattttcgtttgtgttggagtctaaaaattacataatctcaatgtttagcctatacacggtcacctctgcttaatgcggaatactttgatctactgacctgcttgagaagccatctgggttgaagttactctctgttcttccttccctttctaattcttttcttcctttgactttccttctttttcttgcgtcaatggaaattcccgagatcgccgaatcccttccagcgctcaagccgatcaggcaaattagggttttagggttttggcagagaactcaaagtccctttcctttgcgttaagaattaattttacccatcacaaaactaactctacctctttgttatgaaatggatttcccaattaactaaccggcaaatagctgataaaatcaaccaacaatttggagtagacatatctacccccatgctatttgttgttttacttgtaggtttataataagggaagtttttttttttacttatcatcagcttgactgccaagatcgatgcaaacacatgtcagatttggaaattgcttagttcatctattatattctactgtgtggtgaggactgaagtcagtattttactgctgcgttgcaatctcccctctggttggaggaagttggttgccagatgcccagacacatgttgacaattggtattgtttacttccaaaaaaagagaacaattggtattgttctagatggagaaactaatttagtctgtggtctttgcaatcatttttactactatcctgggctgccgggggcttaaaactgtcacatttttttttccttttgtaaaacagtatctccaggctatttgcttgtggcgtatgcacttgctcgtacatttgttgaatatgatatttttctctcttttctttttgtggccatatggtcttgctctttagtgtctgttggcatgtgatgcacaaaatcaactggtctttagctaaatacaactatttttgtttttttttaaacaagaaacagcatgggagggcccctacagttaaatttttattgataaaatcagaaggtacaaaaaattacaacgacaagatccaatctttcatttaatctaagaagaagagatctcccttgaaaaggtgcctccaagacaaaggatggaagctactcgtattagcttattatcaaagatgaagctatttttactgattgacaataaacaaaagaaattttggtgaaggctgaagtggaatgatcataataaaaatatggtttttggaatgtgcaggttatcaaaggatttaagccaacagaacgttgcatgctactgaagtttgtgacaagctgttcccgagctccattacttggattcaagtatttgcagccttctttcacaattcataaggtttggtttttatagtcctgtgtgtacattgattgttttgtactgctcattgttcaattttttatgttctatcgtttttgtctaggttccatgtgatgttacactttgggctacaattggaggccaggacgtggatcgtcttccatctgcttccacgtgctataacacactcaaggtaaaaactatattgcttttatctatgcaccctgctaatatgataatttttattacatgtttctcatcgcatgttcctaatttcttataggcatcgatgccaaattgctgcattttatttgacctgttctgttcattttattactttccagcttccaacatacaaacggtcaagtacgctgaggagcaaactgctatacgcgattagctcaaatactgggtttgaactctcgtagaggtatgaagattttatgtggatagattaaaaaattgggtttggcacgtgaattgagtgccatagcctagataatgcacttgtaattggtatgtgcatcgctgtaaatttatctgcctattccgatgataacctgcatattcgcattgatttaatatcaaacttgccatcgaaactctattgaaagttgtatgtaaattttggtttaagttctcaggaaccaaacaatttgattttattaatagttcctaaaatcaaaatcagtaattataaaattatgtatagtatcatgagtcatgacacagtgatgccttttgcactagctttaaagttttcttgatataataattctgagattaggtttaaatcgtagtttttttcttaattagtaaatagaaagttcgtttggagtgttaattataattttttttcaggagtcgggatttcaaaattcggaattagtaagcatcgagtcgtacttgtcttaaaattgcaatgtattaagaaattcaaagttaataattacagagttgtttctaacatggtctcttgttttaatctgagccattataatctggtccatggatagccagattttccaattttctcctccttggagcatccaatcagcaattcaagctgttgtaatttggtcccacctaaagggattaatagatttattacttactattttttgagtaactttctgaaatcccctgttttatatggtcaaagttacacaagttacacaaaaccacatgtattatgacgtgtaacacataaacacaggtttgatggtatatatgttttacaaaacctcacctttattaatgttaacatactaccaacattcttctttaaagtagcgaagagttaaactgtcaaccttattcaagaattttatagttaacaattttatatgcacattttgttttagaattataagtaaatttgtgctcaatgtatatcataataccgaggttgtgccatatgttataacgcctgtgttttttctggaactttaaccttaaaccacagggttttataaaatttactcttacttttagattaacgcatgaattttattagattagaatgtctaattagtatatataggtatagaataggtagagcaataatctcattagttagcgtggttgtggagttaagcacatatatgttttcacttatcgtctctcaaatcgtagtgttcgtgattgaactgtcacgacctacgtacgtacacgtgattgcgctttttatgaggctcaaccatctatgtgatcatggatttctcatcgcgtatccatggtaaaacacgccacatatggatcacaaggtaccaaagcacacagctgcaaaacacccattgctagcgggatagtacaatccaagcgcatgtacatgacatattacaccaagcaagcagttcattcatactacagcaaaacaactaagcccaagcccgtgcacatgactgcacgatagagagaaaaacaaaactaaacaagcagggcaaccgaaacagcagcatgcagcacgtacggcggctactcgatcgatcgctagcaggagaaacaaatagcaacttaactaattaagttcacaggagtagagtagagtagttgagaagcagaagcgagagcaagaagctagtagcgctgttggctgtgcatgcgtccgtcattctcaggaaacggatggatggatcaggagatgagctggaggccctggaggaggagggcgtcggcgagcaccttgttggcggcgtccgtggggtggaatccgtcccagaacacgtaccccgtcgcgttggcgcacgtccccaccgcaccctggttgcacagcaccgacgtctcgatcgtccccgtcccgcagcacgctctccgagactcgaagaaacctagttaattggagtagtacccatcatcacataattaattatcagttcaatttctcactctcacaacatcttcttcaaaacaaaaaaaaagagagagaattcgtgcattgctgccaaagaggaggcgtgattaggggctgtaaatagctagcctgcgaacccattcatagatagatcgaaacaaacgggtttgtagtttgttttgatctataagtatgcttcacggttagtcacttacacctaaatagacgtaattacgtgtacgtaccggcggcagtggggttggtgacgaggtcgaggagcgggttgtagatgtcgaagacgacgagcttgaggtccgagtgctgcttcctgatgctgtcggaggccgcctccagcttcgcgttgaacgtccgcgagtcgttgttcagccgctccacgcacccgccgccgcttccgccgccgaacagcgtcaccgacgccgggaggcaccccatcggcggcagcgacgtcacgccgatccgcctcgccccctgtccgtacagcccctgcacacacaccacgcgttcccaaaaaaaaaaaaaaacccaagatcaaaatcgttgaattgattcggtaccacgacgaggccattttcactgcacggtacacatgaatgcatttctacctcaaataatatgaaacgcgggaaaatgtttgtgattttgtacctatttactccccccgttcatctttgtttgtttgacaacagatagtacgtactatgcaagtacagactttgactgctcatcttcttttttttaaaaaaatacgaacatttgaaaacatatcattatctatgtaatttggcaatttgcatgctaaagaactggatatactactacttgtatttatcaaaacatcgtaattcagaaaaaaaatattattgaccaaaattaaaattatactagtcaacagtgtcaaataaaaaaaaacagagtgtacttggtgtactggctgtttcagtaaattcaaagaagtaaaaaaaatgtcctgcgtatgtgagcttggtggatcgactgcgttaagtatgccattacacccaacagtagctgctagctgtggcattgtgtattgagcagtgaaatcggtggcaagcaagatcgacaacaccggccggtgcagtaataaagagagagattcatgcttgtcttgaatctttcatccacccacatccacatggtcaagacagatctgtgaaatggcaggcagcagcaataggttttctgccactgccactgtccaatctttctttctttccttttcagtgaaaccactcactatacatgcatatggacaacacggcctagcttggaactctagcatggaaatgggtcaatttccatggtgcatttactagaggggattggtgtgagggaattgtggatttactagcttggaaactctagcatggaaatgggtcacaatttccatggtgctgaaaatgttacattggcaggggcagatcagatcagtccggaatgtcactagctagagcattgtattatagggggaaagcctctagttgtagctatataattgcaacttttgtagtaatctcgtttagctttctctcgcaaaaccggggtcaatttgggataggactatagtaaaaatgtctcttcaacaagggctaatcaacaggcctctgacccccttaattagtttgcctttgtgccaatgaccagattagcaattttaatgtactaatgtagcgattgctggcaagcaagcattcgcattggatgatctccctacatgtgacaccagcaacagtagtactccatgtaaattagaaaattaaatgtgtatctgcgtgcattaactgatgctagctacaacaacgtatgtactgtggagaatggcaggaacatgcatgttttggaagaaaagaaaaccatgggaggttgaagaattgagatgcaggccattgatagctaccggtcctacccatagaacctgtgaccttttgatccatccatttactcctctaacctcctctgcaaaggctattcaattgcctgtctgtccgctcaagatcgatcgatatgtcactgtgcactacgagcagggactgtcccatgccgttactcctatagaagacttctttagagtgaagtaatttttttttctaaacaggagaagtaattaccatgaaaattctactcgtaaacaggaatactagctacttacgagttctaaacttgttgctaatggccaatgggatgaacaatctgacactacaaatattgctccatgcacattttacaaaacgtttagctatttcagttatcctgggattagcatgcggtttcatgaaaagtctaactgtaatttggtgcagtaaaagataaattgactgtgcctttcttcaaaaaatggaaaaaaagaaaagaaactgattgttaatttagctgggtttttttttgctaccttacatttagattcatttagtatagtacccttgcccattgtgtcatggcaatggcatggaccattgtggaacaaacggagtataatgacttgatgcatgtaagcatttgcatgcatggttgcatcatttaatcaagtgatagattggagaaccaaatgtcaagtgctttgcatgctgtgcttaatcaatcagtgcttagtggtactaatcaattacaataatatatggatttgattacctcgatgaaggtggtgaagggctgcatgaggacgtcggagaactggtcgggggtgtaggtggcgcccagcatcgggttgacgtagtagttctgcacgaagtcgctggtgccggcgctgaccacgtagatggactccgacgtcagcgccgccgccttcttcccgccggccaccgcctccaccttcgtcttgtactccttgaagtaccccagctgccggctcagcgatatcgccccctgcatacgccacaaaacacaccacatctctgatcatcgattaacatatagtgattttggtttacaagctagtattatggcttaattggtcccgtttgaactggctggagataaagattaaatgcgggcaccaaaaaacatcaacatgtaactaattaagttttaattattttaaacttaaaaaacaaatttatctgatttaaaataattttgtaatacaaaattttcattgaaaaccgaggtaaattttgtatcttaattagaaaagaatataacaatttgaaacatatcattgagcacattgtttctgcagaaaatattactccctccgtcccattttaagtgtagccatatttttccgcgtcaactttaaccatccgtcttatttaaaaaaaaattaaaaaaataaaaacataagtcacgagtaaagtactattcatgttttatcatctcataacaacaaaaataataattataaaaaaaatttaaataagacggacgataaagttggacgcgaaaacttatggttgcgattaaaatgggacgagtgagttacttagactgaacaactaacttaataagaaatatattgaagacgaaaatgcattttttttaaaaaaaaagaaaaaagaaaaaaacgtgaagcagataaacaaaccgtacgtagagggaggcggtggtgtcgaggtagccggaggcgccggaggcgaagttggcgccgtggaggagggagcggttgtcggactgggcgagctggccgaggtagggcggcgggtaggaggtgagccccaggttgtcgacggtgtagtcggtggccagcttcccgttgcagaaccgccccgtgggtgccccgtgcgtctccgggaagtcgcggccgtagggcgggaagtcggcgcgcaccagcgtcgccagccggttgttgttcccggcgtccaccaccgagtccccgaatatcatcacccccggcaccagcgccgcctgctgccccgcagccgccgccaccagcagcaacgacaccaacaccgccgccgccgccgccatcgcggtcatgatgctaataatgctactagctgcgttctctctctggttagtggagtgaggtggtgatgtggtgagcgaagtgaagtgcgtgggtttcaatttgttggcctctgttatttaaattgagacgtgcggtcaagtgaggccgaatttagttccaattttttttttaaaactttcaacttttttatcggattaaaactttcctacacataaacttttaatttttctatcacatcgttccaattttaaccaaacttccgtcacaccgtttcaattttaaccaaacttctaattttaatgtgaactaaacacacctaagttattgctggctggctgcctgctggaactactacagtaactactgcaacaagttacaactattacaggcatgtgcgcattcaatgggctaaccaaaatgtactagtgcgaaacttatcttcctatgcatagtgctccaatacaacgaaataacacgtactggatccaactttccacctacagcgtcatgcatatcgtcttgccttgttttgccttttcttttccccctacgtgcgtgcgtgtgctaatctggagcgagtaaatcgtatctaaccctatactgcttaataaactaccccaacgataaattaacagaattattatgttgagatttgtgaaacggcttttaatttctgtgtgagaccgagagcttcactcgaataaaaccatttttatccgtgaaggcttttctgctactcaaataactagtactttttaaaacttcccctgtgaaacagtgagacctcaagattgatccagtaggccagtaattatcaactaatatccattagaagatcaaacggaagataaacgggcaatatttaagaggttaagattgcttacgacggctcaagaaggctttacagccgcatgaactgttccaactcaatacggttcatagtactagatcgtacggctgacataactccattaccacggctgatactttactacgggtcaagctgggcaaaaccttgaatagctgatttgagtgcggaacaatagcaaacggctgcgaagtaaatcacttcatcgacttaaaaacagaaacatcacaaaaataagctagagatttgtcaaacattcgttctgttcccgacatttctgatcatgatttcacataatcacataccaccaaaggaccgaatgaaacaaaaaaaaaggataatctaaaccttccatggtctaaagcctaaaacagccaattaatcaggccaaatgtaccagaactagtgtataaatgctgtactgcaatcagtgggcatcctagctcctactgttaataatacacaaatgttacatgaacttacaagcaggggagcggatactggacacgatttccaggtcgcaaggccaagacgcattccattggctgtacagtatccgaaaaatccagttggttttgcaaatcaggtggcaggagctgagctgggaatcttgaattgcttcttcacatagtgcgaagcctccgaatcatttctgtggcaaaggaccctaagcagggttttggaatcggttccaaacttacttttagcgccctgagtaacttctcgtaggtcatcgatgagcacacgtgtctggtaaaaacatgcagaagcaaaccgttacagatgatgattatgacttggcacgcactagtcttttttgggaaataagagtttcctacggctaaattttactcccttcatttttaatatactagaaaaattgtacgtgcattgccacgggtgaaggttattttaatcatattattgttagatctttttgtctaaaaagtatatgggatttttattttgataatattgatatctaatttggaactcttattaggcctggcaagaattttgtagcaattaggagtccgactcttgttccaaattaacatgcgagttttttaaggatttcttatacgactccttattatgtattcccaaaagtgaacaaacttaaaaaccgactcaaatacaaatgacgtaccaaagtatcaacagaaacatctttaatttttataataggagagacagagataacgccattgacattttaagattaaccttttaagatacgttgactattcattttattcaaaaactttatgtagttatcattcattttgttatgtcttatttatcgtacaaggttcttttaagcgtgacttataagacaaatggacaaacgtatgtataaaaaaaatcaacgatgttatatattaaaaaacggaggtagtgtgattttgggactgatttctgctctagggcaaagggcatggaacaatgtggcacgattacatgcagcttgggttgtaaccagatctgggcggaccagctacctgaaatcctgaattggtttgtttgctgtgccaacgacttaggctgtgttgaaccccttctccccggcgcgcaaaacgaagctcatattattgcatgatcaattaagtattaactttttttttgaaaaatagattaatatgattttttaaaacaacttttatatagaaagtttttgcataaatcacactgtttagcattttaaaaagcgtgcgcgcggaaaacgagagaggtgggttgggaaaatgggggggaagaacacgtgattaattaagtattaacttttttctttgaaaaatggatcaatatgactttttaaagcaactttcgtatagaaattttttgaaaaaaacgcaccgtttagtaatttgaaaagcgtgcatgcggaaaacgagagaggtgggttgggaagatggagtgccaaactcagcctgggataactagctaatggaacagagaagttccatctaaacgaacaagttatacaggtgcctataatccaaacagtgaagattctactttttttttaccaaaataagaaatgggacataattaggttcgtttgagtttgacatgaagctaatgtgtgttctgtgcctacgacttagagataactagctaatggaacagagaagttccatctaaacgaacaagttatacaggtgcctacaatccaaacagtgaagattctactgtttttttttaccaaaaataggaatgggacatgattaggttcgttgttgacatgaagctaatgtctgttcactaacaactgctagacacctatgtaaccattggagctacgtcattatgttacctccacgatctggagttccacaccctaggttctgttcaccggtttacccagtgtcaaaatgagaaattaaatccaaacttacctcttgcttgatcagatctattacagggcgaacacgtgagaccaaattctcgacagttccacgaggtaggccatctccaccagatataaaaaattcctatgcgaagtgaaaatttacatcaagactaacagttttttgtttggccagcaaagagaagacaacattaaatgttccagaggcataataagcacaaaacaaccaacatccaggtaatactatgttccttataacgcaaaaaacagccaggttgtacttcagataatgatataccttcagaatttcaagatcttcttccaaaagagtggcatcacttggagagaagacacgcgtaggacctccatccaatatcacacggagtaggccatcctgccaagcaaggtaactttaagataacatatagctcacaagctgtcacaacaatcctacagaatttattatccggaaagattaccagagatgcttgtagaagccctgtaaccacacgatcccgtagttgctccacaatgacattacaaagctgattaagcacctaaatattgaggcgtggaatcaaatatctccattagttcaagcgaatcttacaaaccaaatcacaatatatatatttatcaaaaaaacactaataaccagaggtacaggattcaagattgattatcgatttttgtgatatagcaaatggtttgcactttggccacagataattaacttatccatatcttttgaggaaataaactatattcataacagaatacaatatgtgttctgtgaaaagttgatcatctaagtagctaaccagcattagtacatagataaatggtaggtttcatgctagctgtcagatcatagggttttgtttctccaatttaatgttcctgaaaggttgcacgattcatgagcataccgtatcaagtacttccataatagcatccagtcgagcttgagaaacattgtttttgtacaaattatcaataaatggctgctgtaggtcccagaagataacctttagccctaagaaagaaaaggttaacatgttaatagatatctgtcagcttccaagaaagcactggggcatgtatattttcttacctgtaaactcacatatccgatcaattgcagcattgatttcttttctgctgccatcaaattgattcttctgactcgagacagcactctttgatttttcactcattgatcgtcctgacaaagttcaaatattttcaatataacagatttagtctgatgttatctataaggggtagatcaaatagattgatttgcaaacttatcagaatattcaacagataaattggcaactaaaatattttttttctaaagaaaatcataacagtatacattttttttcttgaaaacgcataacagcatacttactgatgttaatgctctcacttttcctcctagcccaccgctcatttatgctgtcctccagcttgcttagctggctgataccatactgtttgacaaaaaaaaaagtgcttctggttcaaaactaatgaaaatggacacaattcaaagggaagagaaaagtcaaaagatgccatgaggacactgatgtagatcatgaaaaaaaaaactagcaatagctaaattcaaaggaagccaggctggaaggtgaagatattcacctataggttatagcagcataattatcaacacacttgaagcctagaaaataattttaatgagatacatacactgatccccaaatgtcatagttttaaattaaattttttattaagattggcatataaagaagatatatcgttttatatctcacagaaattgctcgggaacttgacaagtcattctagtcaaagcaacaaatccatatagcagtgctctgttgtaaagactcacatataggctgttaagccgtacacaaagctttggcatagtaagttgtattatttcacttgctttcctctcgtcaactgttctaacttcatgtatttccttttttacgaaagccttgattccaagctcctttttatatcgagtaagaacagggacaggtggaattaaatcttctctatcaactgcaagcaaacaaaaccaacaattacagaaaagttattctggcgtccacatccacagtaataacttttaagttatgatcttggaagcgatgcaccatctacagcattgattatttgccatatactcatgtaaaagagaatattttcctttgaaatcactcagacaaggaagaaaggaacaaaaatatgatgaccgaaagatatacagaaagtacttcacagaaaaagggtgccatgcaaacctatcggtcctgtaacaagttgtgtgtaaacttgaaatgccttgtcaaaaccacggcagaggctatttagttctccagttctcatggggaccttgaatgcaaaaaattgatctgcagtctgcaatagtttgcaaggggcaaatgattgctctttagagacggatggaaatcaatccataacatattcaactaccaagcaaaaaaaataaatctaaagaaaactaagggcatctttgggttgcaacccaaacgaacactaaaaaaatttggtaatgccaaattttagcacattttggtaatgccaaattttggtagcattggtggatacatttggtttgaaaccttaccaaataaaggtataaatttaagagtggtaagcttccagaattatggaattttgttatggtagcaattgttgggatatgtttgttttattgccttaccaaaatttggtaaggctgaaggtggtaacaaaccaaacaggccctaaggcatgcaaatatctttgaaatgttgtggcataaaaaaatctctacatgaaaacaaaaacagactttatcccgtaagataatattaagcaaaatttattcaaggagataatggagtgagggacaaaaaggagcacctcttctatgattctgtagacttcgacaatagaagccccatggcgttgttgaggggatataggatcccaagtctgttgagcaaaaaaaagtttggcataaaaaagatgacagaatgaataagataatgttgtatccaaataatgtataagaagcgatggcaggctttgagagatgtaacatgacatttatgtttgaaatatatcatgaaaaatagatcactttcgcaatataccacgaaacattctggttcacttcactaaccgaaaagcatgggattgaaaggtaataaaatggatataaataactttaggccattcgtatagcatgtggaatagaccagaaattactttaggtcattcatatcatggtaagaaagaggatgttggatatagataaatcaaacatactgagacagtaagagctttgtaaaaaagtaacttgagtcaaatagtgttacctcttgttcagcagctcttttaacccaagtttcaattctctcaagctgcccatttacccagcgtaatatcaacgtgccagatttactttcaatctgggataaaacaaggactaggatgaacaacatatgaactcttaacacaaaataaactaacagttcattgctgagcatcgtatgctggatgataaaatggcaaatactgacataaattgataaacacatcatgtcaaggtgaacaatcaagcaaatggattggataccattttgcactgttgtgagtgctgctacttgaagaagatacagttaaataagcaaacctgataaggagctagcttttgtctgcatatgctgtccaaaccatcatctcccacaacagaagccatcacagacattatgtactgctccaaagcatcggctgccggaaatacagaaaccacatcctccgtaagatgctccgcgtgctcaagaaacggtttctggcacaaatgtcatgcaagcattaagaatcctatggtggtggatatacagacatttcagataagagtgtctgacatagcttaccaatttgcttccataaagtttatggagaagtgaagcagaaacaactgcagactgtgggtgccactttgacaaaaccgatgaaaacacagttgtatctttcttcagaagcttctttgtctcctcagctagagatgctaaaacatgttcatgtgatgtgtctgctttagcctctactgagtgtgccatctgaataaaaaaagaaataaatgtttctttagtccatattatagatataattcataaggggaaggaactagacaagtctatgacaactccaaattgcagaatcttgacatggatgatgctgtccactttaggtgcacacagtgagtgtccaatccggtaaacaaaacaaacaaaaatattggtttggacagagcatagttacaaggtttagatcccggagtttctatctcttgatatgtaaaggacagccatgtactgagattttgttatatgaatgtggcatagtaatattgcattcaagacatttcataatgacttttcaggaaggtagtggtaaaaaagcggaattcagtttatttaatgctactaaaagatatagacaaaaagtaatttggaaaatataaaaaactgaaattcaatcacataaaccataacatccaccaatatttaggcttggacatctctcatcaaactatggtcatgttataatttctaatacatgaaatagacatttcaataattaaacaccccaactacaaagaaaattgctaacgttgacaataatatggtatgatgatttcctacgagcgaacatggtcagatacgacattactggaacttcaaaattgaagtacatgtacaaaataacggattgagactgaaggtttcacatacatacaagcatgattatgtaagcgattttacatccatctcaattgcgaaaagtgtaggaggcaaagtgtatagctctgctatcaaaagaagccgctaagaaagtcacctttacgaaagcacttttgacagaagaagtgatgtaacggtcaatctgatctcgatcaggcgactccattccctgatgtacaaaacaaataaagcgcgacatcagaattttccacatgtgcagatggtagaagtattgctttctacattccagatggcctgtatttactatttagaacagaatttattatatcctttttttttgtgagagccacccctgaattattatatagcggaaatgacttttgctcatgaaatatctagctacactagtgcacgagccggcaataaacgatctaattttagattaaaaatggtgtaatagatgaaaaatgaagtgaagtataaataccttgttattttcttcaccaagaattctcctaataagcattgccactgttacaatatcagccatcatgctagggccctgtaaatgaaaataaatattaatatgggaaaataatcccttgttgcaaacaaagtccagatataatggttcagtgtgatctatggacttggtttcagtaaacaccaaatgttgaacggctgaagtctgaacagaaacagcagcgtgaaaagaggaaattgattagaaggaaattacagctccaagtcatacacataaaaatgccctaagaagaacaattgaagaaaatgataagcttaacagtgaaagtcaaaaccatgaggcacggaaagtattggtacaatatgaaatcgaggatctaaaaaagacaatatgcatgaatgactaaatagtactcagctgtaatgattgactgccttatgcatatatgagttgcacactaacaaaaaaaaaagaagcaaaagccaataccaggggatataattgatctacactgaatgataaatattttatttataaagtacgaacccaatggaataaaaaagatgactgtgaaagagtaaaggagatcctttccacaactcatgcatgttatgaagcacgtgagcaaaccaggagttggcaaaacaaacctctgagaagtgtaggtgataatcattcaatttcttgtccacccatttctgaacgggagataggaaagattggaaaaatgtgaagtcttgaaagctatcctcagcatcaacagaactacgcaaacttttcaagtgtaatctttcctgtggaccacgctgttccttcaaaggtatcttcctcaaatgctcaatcacaactttcaagagtccttgctcacctgtaaaaacaaactgtattgcagaacatccattaaataccatactattgagaaggttacttagtttataagctaaaaaggtcaattgcacaccatgggatatggtttacaagtatatatgggccatattgttagtgaagcagtctttatgcaagagcacctatggtatcaagagacaaatgatccactggcaacgaacactagtgatggatcatcctacttcatgacatgcttaactggaactacacatcaccatttccacaaaatagtaaaggctaaccaagattttgcaccgatctccttttcagatgaccgtgtctgacattatgaacagaaaaggtttgaaatcatttcataaaaaactgtttatgcttgaggaactcacttgcttttggcttatttgggctattaagagaagaacattagatatcagagtagacctcaatcagtggttatggaaacacatagggttattgcagaatgtagaggtacttagggcctatcataaatccataatgcaaccacaaaatattccagtaagggtaacctcaagtaatagtactgcttggctagagctatacctgtctaaataatacccatgcataacatgtatcatgaatcgtctctgtaatgcctagtatccgccaagttgattttaggagctccaggatttcttccacttcctggtagattgaagcaaaaatgttaagagaaatacctgcaactgatagtgtatctagacagaggaaaattacaaaagatgattttaagtactggcctctgtaagctttccctcatccaagatatcaaaaacactgccgagcattttctcatacagtgccacattcagatggtagccatcagaccaatgacaaacctcaccagtaagatcaccccgtgcaggtctttcagagagagaagtagcaacttctctcagtgatcttaggcattcagtgcgttgaacctccacagcagatggttgcaaggactagcaagtaaaacaccacgatgagcctcagtatactggatagttttacacaattgttctaaaagtcaactataagagtattcactgagtaatctctaaataataaaacctcagattcttcaatctttctgaagaggtttcgtagctcattgacctttcgacctaactctccaaatccaacaacaggatggtttataaggccctcctccagcatgtttagctaagcaaagatacaaatgaaacatataatgttaaggcatgatagggtggccccaaatactgtagaattcaagatcatttaaggcacaataagatggctaacctgtctcttctgccaacgaagatatgctttcatgtctgaaaactcggctcttgagatacagcatagtagttccaatggaatcaagagattgtccatccgttttccaactttgcctaccatagcattgagcaatccttgtctagttctaatatccatggattctgttatctatccaaaaacagcagggaacacggaggtcaatgtatgtaagattagcatgctgagatgctttaaaaaacctggatgcacagaaacataatgaagggactgatggccttaaactcaaagagttgtagtttatggactttcaagcgacaaaagaagcttataagctgctaacactcaaacttgctaatctaatttaagttgtgtgaagcattaatgaacatcagggaacagaaaggtgaacttcttttattcgtttattattcagtcaccagaagcagaaggctaagacaatatacctcaagttgtgctcgcatggtttcaagcaaaccaaccaaacctggttgccgctgagtttgggattgagtactctcactcttactacgtccgagtttcctcattaatttgtttctcttctctttcttcttttctttctgtggaactataagtcccctgtaggtatggaaataaggtaaatgatatggtatacctggaagactttcaatcttctaattggaaaaaaaaatgagcacaaagaaatgcataagcctaccctgaagcaccagcagcagcaacaagaatttcatatgctgtttcacggaggtcatcatctgttatacctggaaaaacagcacagtttccgttgtcaataactttcttgacccaatgtatgtagccataccagcatgaagacttctaaagaaaataagtcatgaaaatttcacttctatctgttattggatatctgaataccataatgacataacagtcatcactattacctgtttcaaatagtggtaaccgcaatgataaatcattggcatcactttgatgtcttctagaagcccttcggctatcgaattcatcttcttcatcctcaaaatcttcaatgtcatctatggttaactccttctcagttggagaatcaaatgattgtgattttgataaatttgtggtagagactggtgagtgcacagcaactggtggtggatccacaattggtgccggtatcacaacaggtgatggtgcaatagcagggacagggggtggttctctcgctggagctggtccagagtactctggttttgtaagtaaaaagaattcctccacagttccactgttattctgacaaaagtataatgtcaaggcattcaaaatcataagaaatgaactttaatgattctgaaatgatgtgcacagcatatcaactaaacatgaaacattctctattaaaataggaaaacacatattaaaatgtccatatatgaacataattgtatccatggagtttagtggaatggttaggtcttttatcctggagctttaaaatgggcaactcaaatagctcctacattgcaaaatggctgacaaacttttcaatgaaacaaaataaatgcagcagctactatagatcagctcaccacgtaagggtagtcaaggctgtcatgaaaaagccggatggcatctccaaggtcaagtgcttcacctacacggtcgaataattttcagaatatacatatgaaaaatacagagtggcatacttgggtaaatctaaaaccacctcacctttcttagcacaattgaggacgtaatcaacactgacttgatctatatccacatcatccaaagagatcgcaccaggaggcattacaactttcttgatcaagttaccagaaagcatgtagttgagcaatacatgacggtcacggcgataacgttgcagcagctcaacaacattttctctggttaagttgatatatagaaaaagcttagctcacaattgaacatgcatatactgatctataatacctattctgaaacgatcattactcgtccatatcgtgtgcaggggagacagcaatctgagttcagaaacactgttggaagcaccccaagtcgctttcagccagcatcgctctcctgcaaaacaaaaggggttaactacatgaaaaagtgctggggtgcgtaaatcggttggggctgaacagtttatgttgaaaatagctagtgaatcatgaatctgatcctacaatcggtccattttgcctgtacaaattcacaaactctcgctattaaaaaggaaatggaaatgacagccatgcagtggccaactgatgattcattcaagaatgcacaaactgagatgatccatgcctcctctcagaccggccaactcaacctccctactaaatcacatccgacatccaccagtgacagaactgagatcgcattggcccgcagctcccagatcatacatacccgatccatccatccaaaccgaattcgccacaccacagcgcccccgcatttcaaacaccgcaaaaaccacaccaccgcaacccaaaaacaagtcgagccgaaacgaagaggaagcgcatatccaagcagctccgcccaccaccaccaccaccaccatccaaggccggagggcgagggcgagggcgagcggctcgggggctgggtggatctgggcccgaggcggaggcggaggcgggggtgggtggctcgtcgagctagttacctgcgcgcgcgcggagagggagatctccgccggctaccgacgacgacgatgccgctggtcactcgccgcggcgcttggggagtcgggcaaggtggtagctggcggtggtgggcgcgactcgctttcctggtggtggtggtaagtggaggcgaggagaagacggccgcggccggggatccgtgcgcgcaggctgtggacgcgcacgaggtggcgaggccacgagggcctatttttcttgggctacaagggtttctttggcccatctcacctgccctgggcctttgggcctaattttctacgaccccagtcgccaagctttccttgtcagaataagtccactttgactccttaaagttacccgaatctagtccgtaacccacaagaatgactcctgaactattcaaaccagtgcaatttgactccctcagtggttttggataacggttttgctgacgtggcgatgttgacttggtctgtggtattgacgtggcgcttaggtggcattagaattaaaaactcagtgcgccccattcgccattcacacaaaaaaaaaattgtgggaccatatgttatccctatctatcccttcttcctcctccctctctcccttctctgtctgtttctgcgcaggatctggagcgacggctgcaccggcgccggcaccggcggcaggacgaggatcggagcggcggcggcggcactccttgctgtgtggcagcctctgcttgccggtggcgtcgtcgtcgacgtcgtagagcatgttggggtcggacgacagcgccgcggcaacgaccgcttgctccatgcggcggcggtgacggcggccacctgggtgagcggtctccagaccagcttcttgaacctgtacttcctggtccccgagaggaacacgacgaggccggcaaggatgcccacggcgcagatgtcgtacccccactggcggccgacattgtcctgcacgtacactagcacggtgattgtgagcagcgcgacgaggctgacgaagaagtagaaccagttgaagaatcgcatcattttcttgctctcgtcgtcgtcggactcatcgaactggtcggagccgaagccggagatgctttacttgagcccccccccccccccccccccgtgcccagcgctgtcaggtagagcaccctgagttgtgtcccgttcgtcaccatgcaattcgcgctcggccccttgagtcgctgcacgccggcggccgaagccccaacatgccgtcgagatcgtcagtatcaatgtatcatcagttcatcaccccctgcagcatgagccaagatatacaatcagtatccatccgtcatcgagcacacattagcttggttgaacagaggagtaagaggaagacacgaacagtagcttggacagcttcaaagatggcgatggttaggtagcggccgaggtacgtattggcacagtagcgtgcgggaaatgggccccgactagtgtggcgcgttgctctagcaccgctccggccctcgccccgccgccgccccagatcctgcaccgaagtggggaaagagaaacagagaagagagaaggagggaggaggaagaaggatagatagggatgacatgtgggtcccacaatttttttttgtgtgaatgacaaatggggcccacatagtttttaattctaatgccacctaagagccacatcaacaccacagaccaaatcaacatcgccacgtcagcaaaaccactatccaaaactactgagggagttaaattgcactggtttgaatggttcgaggagtcatcttatccggttttacggttgagggttacggattagattcgggtcatttttaagggagtctaagtggacttattccttccttgtccggtggagggaaaaagtacaccgaaggtccctcaacttatcatcgagtttcaaaatcgtcccccaatcacaaaaccagatatatgacatccctcaacttaacaaaaccgtttattttaggtcctttggtggttttcaccccggttttgtccgatgtggcggctgagtcagcatgggacccacatgtcaggatgccacctcatcacttctcttatttcccctcttctccctttctctctctctctcttctcaggccagcgacgggcgatgctgtggggaagaggccgccgggggggaggggagaggaggaggtccggcggccagcgtcgcgccgatggaggaaacgccgccgtccgcatcctcgttgccaccgtcgtggcacagcgtcgccgaactcatcctggaagctatgcgcgagcacgtagaggccgtagaagtcggtgggctggcgatggcatcgcaccaagtagccgtacagcgtcatttgagcgacggtgaacccctctgccaagtggaagtcctgcgtcatcgtgatcgacccctccgtggggctcgtcctctacctcgcgccgccgtccacagaacctgctgacttcggcgagctgtagtcctagactgacgtcgacggcaaggtgcacacattccgcatcaccaccatcccgacatagcactacttcatatgcgacatcgccgcccgcaccgcctcctacgtccctgacttggagagacgcgtcttcaacaactatctgagcatcatcgtcgcgccaggaggtgggggaaagtacctggccgtcgacttctagttcatcgttggcggcgacgaggccaccctcctatgcttctcgtccgagaccagcctatgggaaaagaagcacgccaacaaccccctgccccgctagatctggagattctttgacgtcgtttcccacgccggcaagctctactgggtggacactgcgacaggcatcctcttctgcaacccgttcgttgacgagctgcacatggagtacgtcccaatccccagggtcgacctcccgctagaacacgacggagactgccacggccgtggctactgcgccgagagagcgctcgcctcccgccactgcgtgcagctgagcgacggcaagttcaggtgcgtggacatgggctctgcaagcgatggtgttactaccaaggtccccatgcacacgcagattgatccagggaccaaggtgtggactcttgagtacgccgtgagcttcgccgacatctgggccagcgagagctacaaggcgactgggatgtcggagaaggccccggtgctcgcgctcgtccaccccaagaaccccaacatggtgtacttcttcgtagaagtcaccagcctgcgcaccaccgacttctacggcctctatgtgctcgcgcacagcctccaggacgagtctggcggtgctgtaccacggcggtgacaacgaggatgcggacggcggcgttgcctccgccggcgcgacgtcggctgccggacctcctcctctccccccc

SEQ ID NO: 79056 - DNA, 24821 bp, Oryza sativa
taagaacaaaattagctacgatactattgcatcacgctgatggagcatgaatatcttccatcttatgaaaacctacaccatcaaaaccatcatcactaccaaagcaaccactatctatcttaataaatagaaaaaacaagccaacttatccatcgtaatgatgtcttctttccaaaaaaaaaaaaaaaaaaaaaaaaaaaaaaaaaaaaaaaaccctctgatgaatcttctttgtaatatgccacgtacttcatccagatcctttgggttctcccagttctctcgtcaagcatcttcttgaatatgccaccatcatgttctcctagttctctcgtcaagcatctgctaccatcataatactgatagacaattggaatatataccattaggaataatacactgtaacgtagcaaaaatgatgtaggactggagagatgaaccttaccataagaaaaccaacttacattggttacatattaattgtttataaatatgtccaacaccaccgtgtcatcctcctctcaccaacactaatccgctctccttcatcctacctagggttgtcactgggtattcattaaccatccccatatccatatccacattttaagtggtctctctgaatgaagcaaactggaatccgtgcaacttcgtaatccatccacatttatatttcatcctgtacatacatgttagtaaaagcaaatttgccaacaattgtaagtgaacttcagagttaatgcataagttcagaccaaagcgtgctacacataactggctataattaaatttatgcaaattgatctcattaacattagaaaaaaaacaatcagtttacgacggccaattgtagaccgaaccgaaacatcaaaaccatttccactgctttataaaacataacctttatatagaagcaaattaaagctgcaaattcgcccaatacctgtactcaaagaagcaagtagttagttcattctcagattaatcccaattatgccacccagcagtcttagtgtagctatccacaaaaatatgtgcaaaggcaaccctcccaaatggttcacatcaatgacccatgaacataaaatacgcatgaatgtgttcatccatccaaatataacatcaagcaggagaaaaataggcatgttaaaaatgatcaaatttattgttttctgtagtgcaaatagtgtggcctgaattctttattggataaaagtaaaaatcttataaaataacaaaagtaatgctggtgtatcatcttaactaattaagtgatttaaacaagagttggataagtgagcatacctgccaatgaaggaacctgcaataaggcacatctatatgttgttactacatatatttgcccatacccctgcaccacaactggtagatcagttatctgcactcatcagccatcacataggtgtctctctatggaacgcgaacaagttttgttagaaaaaaagaacaagtaaacattaagcaccttaggagctgagttgtcaaacatgacaatctctgcagtgaaaataattgctccacatccaaatgttcccgtcccaataatagtggatgaatttacaagagaaaagggagtgatgattaattaaaaagataacataactattcaagttacacaaaaaagggccacttagcattttgcagactctgcaatcaaaattagaagggtcagttatggtattgcctactgaaatgagcattgtttttctaataatctcaaatgccttcacttctttgggggtaaaggtgaaacttgaaagtgctctacacctatctcttcataataatctacagaggtacgatagacatacaatctgctaaaattacctatttattcctattaacatactattggcagtcatgagtagaagaaatcgatgaacataggaaacacataatggcatattggcagtcatgaaacagtgtgatgagtgcacagggatatgcataaaagtacaccattacccatgctctcaaattaaagtatatactactgactacttctcaggacctgtcaagtgttaaccacaaggatagtgcaaactaaagaaagtgaagaaacaaaaactcttacaaggtaaattatgttccatatgtggtggtatagaaccagtaggaaatattcatggcataggcctcaataggaaaatcgacctcccttcttgtttcagtccaaactgaagaaaagaaagtgctcatgtcacttgatgctttcacgcagggatcatccattctatctgaaatattcagaaactgtcaagctaggaatgataaatattcatcccgcattgttgtaatctaaaacatgtagctaaagttatgtcaataaatagagcatgcatgccaaagagatctaacaagcccaccataagttatttcatttagctggcctcatcaaaacaagtgcagacaaacttggatgaaaatgagctcgtataactctgtttttcttcaatggaaaactattatactaaaaacagattatggaagtgctcatatcaattcagaaatatgatccgtgaaaatgatgactcactatatttgtttggacatgctcgtgagtatccaatctggaagcatggagaagatgctacaatcagacagaacggaaaaatagaagaacgtgtccttgagccatgaacgagtgtgaatgatatgattcaagtaaacaaaaataatcatcctccaggtaattccaccaagcatattgtgcgggaaaaaaaaaaggcacaatggccagtgtcgatattgaacgtgcctccacccttccgacgtggatgcgcatcgatatatcccctctgccgcccctctgtcgagccccttggtggccatcgccagcttcgtccgcggcggccacgcacctccgatttcacccgcgccaccgccgctgccacccacgacgacgctggtcctatagatgcggcatcggcggcggtggcggcggcgatgaagcggaggaggatacggggcaatggctgcggaggaaaagtgaacgccgcaagatcggagtttggcggaggaaggtcggcgactcccgtcgatccggcggcggggcaggtgaaggtgctgccgtcggcgggggagcggcaggagggaggaaggggcgcgaggggtgggtgcacggacggagggggcggttggcggctgaagggatggacggatggtggcgcagcgatatccggaggaaaagaggaggcgtggaaggaaacaaagattttatgcccggtgactacgcgtgcgcgcgatctccctcccactgcgtgatccgcgtgcgctgctatcattgaatcggaaatgtttgatgattttcatccgttggatttgatgaatgaagttagtgaattataggatagatatgagtaatcatcgtagcattagcacctgagtgaccagttcttatcgtaaactgtaacctaccaccatgattatgcttcataagaatatacattattatgtatttgctaatccaagagccaagagagcctagcaatgatatttgccggtttattgataggaatgagagaacttcaatcgtacatgccctattattcaataccattacaactacccatcacttggtaaactattggaacaaactgtaaaaaggaattaaggtttgctaagattgtaaggcaaatatgatgattttcattggtctttaataacttattgggacaaattgtgaaaaggaaaaaagatttgctcagattgtaaggccaatatgatgactttccttggtcttcgtgcagtcatctaatatgacgatcaattaggcgaggtaagagtactacgcgtacacacgtactcagtcaaaaaccaagaattggaacaatacagtatgacaggttttcatccttttgatccagtgaaatggggcagagaagctgactggactactcacaagttgcaatcacacagcatctccagccaatcctaagggaacgccgaaaatcaaaatgatcgtgacaacgataatcacttgtcatcacatacatactagtagtgtagttatgtatcaaaaagacctgactgaaaacaagaggatatataacttgtactagaaaggcaagacaagaacattcttaatgctaactcctggcagagaattggggaacagggcaatatcagcatcttagaagagtgaagttcccttgcccttcttgtctccaccgatttcaaagtgcttgcacctctgaagtcagattgcaacaagacgggtcagatgcttctaaaaaaccgaatgctataacatgatgaggaggaaaaaaaaaaagaagctgaaagcattgataaagaccttgatcgggtgctgagagtagtgcttgcagctctggcactgcagcttcagaacgatcttctttgttgtcttggcctgaatgacaacaaatattagaggtaagtaaattaacacacagaagcaacactaccaaacaagctagtagctatcctttaaattcgcaaggcatagagaaatcaaggtcaaaccttcttgtgaaaaacaggctttgtctgcccaccatatcctgactgcttgcggtcataacgacgcttcccctgagcagaaaggctatcctttcctttcttgtactgggtaaccttgtgtagggtgtgcttcctgcattccttgttcttacagtaagtcttcttagtttttggcacgttcacctaaaaaacagtgataacatattcaatactacaagaatacagatgacattaagcataaatagtgctcactttctaatgccttatttgcaatatcagattaactaatttgaaatgcaaatacagagaactacaaaaccaaaaagctacaggcatgtcagtacacacaacacactggaaagaacagaagcaagtggtcatatgtaagacaaataggacaattgtgaaatcaagatggcacttaaattataccagtgaattcagggtgatttaagaacgccaaacaggaaatgtctaagcaagaactcttaacatacatagaaaatatagaagatgtcacgctaatttctgtaaccagtactgttcaggtccagttcattcacaaaaataagaaaccatacgtcatcagaggctggtcttttagaaaaggaaaaaggtaaaatagctcataacagggtaatatcttctggtatcaacaagctttccagaatagatggactaattattttagaattttcctaaaaaggattattttttggataatagcagaacagtgttgttagacaatagaatgatgctgattgctgaaaactaatatgtcaggcatcgcattagtgtaaggatttagtacacatgcagatatgacatgtccaacaccaaaataatgaaacctatataaattttagattaatgccaacgtacaataggataaaagaacccttaaattggttcacttaccctaacttaaagtgaaatacacaatactaaagacaccaccctattctaaccctattctaactagtactccctccatcccaaaatatttgacgccgttgatttttttaaaaatgtttgaccgttcgtcttattcaaaaaatttaagtaattattaattcttttcctatcatttgatttattgttaaatatacttttatgtatacatatagttttacatatttcacaaaagtttttaaataagacgaacgatcaaacatgtttaaaaaagtcgacggcgtcaaacatttagggaaggagggagtataagataagatgctacaaagtagcacggtaacccactgataactagtcacactaacatacaattcggcataattcaatttccaaatatacttccagccaacagagaagcagaaaccactttctctgttaaggtttcagctcagaagctcaagaggcgcaaacgataacagccatcatgccgatagcaaacatcctctattgcaagggcggatcagcaatatctcaaatactgaaaatcctaaataacagagaccacggctcatttcctctctggaagaatcagaaacaccgcccaatgggctacaatttgagatgcaaaagccctagacaacaaactctatgataatgcagccaccaaagcaaatccctgcttaaaacaggccgaaaacatgacatccacagactagccaaccaaaaacagcctaatttggcatattttcgatactgagccgctggaacccacacccaagatcgtgcacgatctaggcaactacagaaatggcaagaaacaagcaaaatctaaacagggcaaagagtaggaggagagaaggacgagacacggggattctgaccatggcgccgagctttgggttcctctccctccttcggtgggtgcgatggcggcggcgcgagctcggtgccgaaaaccctagcagcctggtggcggcggctacaatatagaggaagtcaaacgggccggcctgtttgtaacctatgggccgaacggtcggcccaaatgattggctcgaaagagagaagaaaaaagaaggaataagttcatcttaggtcccttaattttacgccaaatccgattttcatccttaaccccaaaaccagatataaccggtccctaaattatcaaaaacggtgcaaatgagatctctcggcggttttgaaggtggttttggctgacgtggcgtctacgtctacgtggctggtttaactaggcctccgttccacatggcattgacgtggcacttacgtagcaattatatctaaaataataataaaaaccatgggcccacctgtcagctaaaaataataattttaaaacggcgtggcccacgtgggccccacatgtcattccctctcccctctcagctctccctcttcctcatcaagccatctcctcgcgccgcggcgccgcctcacagccggcaggagcatgccgacgaagcggagaggcggcggcggcggcaggccgcggggtcggtgcctactcccgcgccgccacatcatgttagatgctgcacagcggtgaggaggagaggcagagttcgagctcagtacagcgaggattagtgtacagatcgagctaaacagccaacaggattagtggcaggcaccaacaagcagttgctgctgctgctgctgctcgagacatgcatgagctcgtgttcactacagtgaggccggccatctgcaagactgcaaccatgtcagatttggcacggagacgaaaaacacacatgttagtgacccaagttgttgtcgtcgtccatgctcgccaaggccgccgccattgccgccggtgtcaatgactgcccgactgaccgtctgtcttcaactcgttcttctcgttggcagagagagaagctgggagagagggggacagaggaggaggtacagccgcatcgcctcgctgatggtcgcgtgcagccgtgcaggtagtgcatccgcttcagctcgtcgtatccgtcgcagtcgccgtcttctccggcgtcggcgcggcgagcgtccgcgtgccgcgacacctcctcgtgcacgcgccgctcgcagcgcgggttcgcggcgaggagccacaagagccacgtcagcgcgggtgctcgtgctcgtcctccccgcgacggaggcgctcctccgacgccacgtcggcgggagaggagggagcggcgcgcggagatgtcggcggtagaggagggagcggcccctcctcacctgcttcctctccaacctcctcatcatccccggccgccgcctcctcccttcctagttcctccgggctccggccccctcatcttgagcctcgtcctcctgctcttcccttcgccggacgccgtcgacctcgctttcctggtgccgatacacgcctccgcccgcgcgagccaacccgacgctgctactcctcgatgggacatggaagcatgccaaggagatgcaggccgccagcctcccgttcttgtcctccttcgtctcgtccccgtgtcattgctcgtctactgcgatgtcggcgccggcggggtcgaggtggtggagtatgacgacggtggtggaggcgggttgcggcggagggcgtgcgccgctccctcctctcccgccagagccgccgcgcgctgcgccctctctgttgcgcctgagagaggagatggggagagagaggaggaagaagaggaggggagtgagaatgacatgtggggcccacgtaggccccaccattttttattaattcatgtgtgaaactgacatgtgggtcccacgggtttattatttttcttagatcgaattgccgcataaacgccacgtcaaatgaagaacgaatcaaattagccacgtaggcgccacatcagccaaaaccaccatccaaaccgctaagggacctcatacgtgctggttttgacagttgagggactcgttgtatctagtttttcggttggagaatgaaaatcggattcgttgacaagttaagggacctagggtgaacttattccaaaaaagaaatcgatgggctcgttggggattctgttctgtcaatggagttttccttcgaggagcaagaagtcaacgggaatggcgatgattctgagcgccttcgtgtccgcgtgcgcctcgaagctcgcgggcctgatcgccgacaggagcgccgccggcctcggcgtggaggacgacgtccggagcatgcagtggcggatggagcgcgtgggtgccgttcttgaggacgcgggcgacggcgccgacgaagcggcgtccgccggcgcgtggatcgacgagctcagggacttcgtctacgacgccgacgacgtgctcgacctctgcaggtgccgcggtgaccgccttctggcggaacgccggccacgctcacggccaccgatggcgccggtgaatctggtctcgtcactccaaaaactgcaggctcggcttgagattggggcacagattactcgcctgaaccgcagattcgaggagatatgcaaggataagctgttcttgagcctctccgtcgatgactccaaggcggaggacggcggctctcgcggtggcggtggcggcggcagccgggttcgaacacgtacgagcacccctgtgctggaaaccaacgtggtgggaaaagaaatcaagagcgcgacggaggcgctggtggagaagataatgcgcgacgacggccgtggagaggtcgtcgccgtcgttgggatgctccgagatttacagcatttgtcaaggagggaaagcatctgcggaaatttacaggcagtcggttgttcttcgtcccttatcaagctccgccgactgtcgctgatgaacttagaagaggcaatggtgccatgcaatgcaatctcccgtgatcgaaaatgtttccggactctttctaatggccatcccaaaggttgatggtaggctcgtggtaaagttttgcggtcttcggacattgttcctcagtgactgtaacatcggcaaacttcctgattcaattggggatatgatgcacttgagatatctaggctttgacaacgttgacatgccagcactaccggagagcatcggccaccttactaatctgcagtttctgaatgttaagaggtgcgcattgcgcattgccaagagcactcactcggattcaaagtttacggcgccttggaattgaagaaacaccgataagtttggtgccccgtggcatcggagggctgcattcccttgctggtttgcaagggttcatagtgggtagtgcaattagtagcagcacaatgcagcaagggtggttcttgacagagctagaaagtctctcccggctaagggcccctttgaatcaaaggatttatgtaggaatttcataggattcaaatcctatagggaattttcctatttggccctttgattcaaaggattgaagctttccaaatcctatgaaattcctatagaatggcacattgcatgtggattttggagcaaatttagtaagagctccaacctcttggaaaatttcctttgagtctatctctctcatccgattcctgtgtttttcctgcactccaatcaaacgacaattcctatgtttttcctgtgttttgcaatcctctgttttacacttcaattcctgtcagaatcctgtgttttttctattcctccgttttttctaccctactattcaaaggggccctaaaatggcttcgtattgatagttgggaaaggcagcaattgacaatgtagatatcgttgctaccgaacaacatctgaagagattagagctgtcatgttctctaaaatcaaatggtgaccataacccatgggatgaaatagaggttaaaaagactgaagcaatctttgagaagttacttcctgcaagttgtttagaggaccttctcatcagaggattcttttgccgaagatttccaacatggatggagtcatcttctctctgcaatgtgacatggttgaaacttattgattgcaggttctgcctcaaatttccaccactgggtcagctgccacatctgaccttccttaagattgtgcgtgcaaattctgtaatcgcagtgggctcttagtttcatggccatggagcgactgcctttcccaaacttgcgccgtgtttagttccaaaatatttcttcaaacttccaacttttctatcacatcaaaactttcctatacacataaacttctaacttttccgtcacatcgttccaatttcaaccaaacttccaattttatcgtgaactaaacacagccttgagttcttgtggattgggaagatgcctaactgggaagagtggtcatttcacatagcacaagcaacacacagttcttctcttcagacattcccttgtctgcatcaacttgaactgaaggactgttcaaaactcagagctctacctgaacagctgaagcatgcccccaagatgcagaggctgcgcatacagggagctcatgcactgaagaagatcaagaaccttcatgaactttcaggctcgctacgtatcaacggaagccactctctcgcgagcatttcagacctgtatcagatcaaagagctctatgtagctgactgccctgcactgcagtttgtgaacaatctaaatgcgttgaagtggctgtacctcgaagatgagacgatggactgtatcccgatgtggctctcgaggctggcagagagtggtgagcaagccggtgaggacggcctcgagttggagctgcattgcagcactgaaatgctcgataggtggctaattgagcgtcaggattggacaatcctggagaggttcacaagtgttgctgcatattgcaaagaagattacatgtgctattcgagacacccagttagctaccacacaagcaagagtggctcaaactcaaaaatagaaatgcatctaagttagctactgccttgtgtatgtctgtttggacaagaaatgcaagattagtcaattcatcaaacttgatgcgcactgcttcgtgcataaaatttccctgttaaaataacagaatgttcgacagcaacagaagaacaaagcagcgaaatgaatcaccagctggggaatccaccgccaccggctcgccgcgccgtcgaattggtggtcatcacgacgaggagtaagcatatgtgtttatgattcgatacgttttgcatatttcggggaaaaagattccatgtctctgatctctgaacctgactatggaatttcagtgtttcggttagctctgtctgcctcggagtggcaagcattcattctgctgattatctcgatgacagagatattggatctttagatcttgtctgctgattatctcgatgatagagatattggatcttcagatcttgcccctgagtggcttgcattttgttgaacaacccaaaacagagttggggctgcggtctagtacaatgcttggaggtttttaatgaggcttcaggactggggggccatcatagttcatttctttaattttgttgcttcttcaacggaagaaatgtgaagtatgtaagtatgtactattccaaacacacaattaaatacagaagtagacaattaaacacacaattcctctgtgtactagtgacagtttttctttccataagtaagaccctgtttagatggtaaaacttttaagtccctatcacatcgaatgtttggacactaattataaaactcatccataattttagactaatccgcaagacgaatttattgagcctaattaatccatgattagcctatgtgatgctataataaacattatctaattatggattaattaggcttaaaaaatttgtctcgcgaattagctttcatttatataattagttttgtaagtagtctatatttaatactctaagggcctctttgaatcaaaggatttatataggaatttcatatgattcaaatcctataggaaattttcctatttggccctttgattcaaaggattgaagctttccaaatcctatgaaattcctatggaatggcacattgcatgaggattttggaggaaatttagcaagagctccaacctcttggaaaattttctttgagtctatctctctcatccgatttctgcgtttttcctgcgctccaatcaaacgatcattcatatgtttttcctgtgttttgcaatcctctgttttacacttcaattcctgtcagaatcctatgtttttcctattcctccattttttctaccctgcgattcaaaggggccctaaattaatgtctaaatacagggactaaagttaagtccatggatccaaacaccacctaaaactatcacaaaccgcttagtcctagcagtctaacagaagtggtcagcaaattaatgtactactacttgtagtactagtagttaccttcagaacaaaatcatgcgtgcaacctgaacactcgacaaatacacatgtcattagcttgccacaagctgcctacaagctacagctacaagaaaacagatcactcaaaacatcagatcaaaccgaagagaccatcataagtaagatcttgtcggtctactagtacatttcatcgcctagcatttactacatctacaagatcatctacatctacaatgcatcacggagaaaatggccaccgtcgacaccggagatcgcctccggcgaacacggcggcggacgccggtcagtcgagttcactgcagcatccggctggttatgcgggagatgtccgccggtcggacgggcttgagcaggaagtcctccgcgccttcttccaagcatctgaaaccaatagagaaaaaaaacacagcatctttcttttgtcaagggtaacacttggcaagagaattaaaaaaagcatgtcacgcttgatcggtgaagagacgggctcactcacctgctgatccttgtgggcacgttctctgacgacattatcaccaccgggatctgcttcagctcagacgattcctgcttgcagatttcgttttgttattcagaagctttgacatggccgcgcaatgtggtgtgcacatcaatattattagagcctttttagaggccaattaattgtgcacagtgatgtagttagaattttctcaagtctaagattcaactagtataatttacataatttaattttatctttcatagtttgaagttttgaaatgtaaattttgatggatattgaaggttaggagtaggtgctgcttcccctgtttcgggcactgattatgcggttgcagtggttctgttttgtgttaattaattaccttgatcttcttgagcaggtcgtacccggtcatctccggcatccagtagtccgtgatgatcatgctcacattaggttcctgattaaacacatcaacatttttttagaaactagggcttaataatctgataaaagaataaaaatggagaagaatgacagaagataccgagcccaatatctccagcgcccttttcccactgtctacggcagtgactgcatcaacaaaaattaaaacgcgccatgagaaactgatgagaatagtgtacggttgttgccacgtataacaaaagaaaaatgtaaaaataaatcttaatactacctgtaactctgtaaatttgttggcacgtgtgttgggtgtatgtgcttaccgcggtacttggatcgccggagcagcgccgtgatgacggcgcggtcgacggagctgtcatcgacggccatcacgtacggcggcgccgcctcctcctcatcgtcctcgtcgtcatcatcatcatcatcttcgtcatcgtcttcttcgtcgtcgtcgtcgtcctctgccgatgcgttgtcgtgcagcggcaccacttgcgccatcctcgtccagcccttgacgacgacactcttcatctcatcatccttcccctcctcccagtcggcgagcttgccaccaccgcggcagcaacctccgccgccgtcgacaccgcatccgcaccctcccgtcaccgccgccggcaccctcatctccatcgatcaacaacgttaacaacaagtattcaacaagggatgaatcgatcacacgtagctgtgatatatggaccaagtgattgatttcctagcaacggaaactgtgtgcatatatatatatagcggaaggagaagatgaatcaatactacacgatcgaggcgtatcgctgtatcaggtgtaaggcagggccggccgattcgtcgaatcgggacagggatcgcgctcgatctcgcgctcacctgcccactccctcccggccatatacgtgatgtacgttggtacagaaccgtacgtcgtcggtgagcagcagcagagaggagcatcagatgatcgacgatatacgagtataggagtatctctcagcggatctcacgtactacgcatagatcgaattatttatccaccacggacggccgcatcgtactataactctcgtatcacgagggcgcagagcgagcgcggcgggatagcgtggcaggcggcggcagagaagggtcgtacacgcgcgggcggatgctggtagagatttcgggtgatccgctagctgctgcacgccgtgcgcgatcgaggacagcgaggtgcagcgtgccgcgcgctggctaggcagctggctgtgtgccgggcgctgggcatgatggcatgtggagtgaatgttcacggcagcatcgtggatacgcttgccggccgctgaaaccccctttgcctccgaatctcgcctgtcgcgcgggccagcggcagcggaatcttacgctcggctcggcgtctttttggggggatatccatctcgcgatatggacgttcattgaaccgccaccggcctcgttgctgtctgcgcggccggcatgtacggcagtatgtactccaatatcgatctctcggcgcagcgccggcgtcggcagcggggacagcgccctctgcttacagtacgtatgcccgtactgtaccagggggtcggggtcccgtccccaggcaacgtctcctgcccgtcgtactccctccgtcccaaaaaaaaaaaaaaaaagacaaaccctggtttccgtgcccaacgtttaaccgtctgttttatttgaaaaaaaatttaaaaaattaaaaagacaagtcacgcataaaatattaatcatgttttattatctaacaacaatgaaaatacgaattataaaaaaaattcatataagacggatagtcaaagttggacacgcaaacccaaggtttgccttttttttgggacggagagagtatgctgtgggggtggtgggtccacaggattatatcgctggggagaaatttgcatatctgccattttaaaagccagcttcgttagaatgtcatggttaaaatgagatttgctctaatgccactcttaaatcgtgagcattctacaatgtcactctagttgtttcttatatttctaaatcatcatttttcatccgattcaatttatctcggacacttttacccttgaaccataagtttttcatctcgctcttattcatctcacgcgaggagagacgaggagggggggggggggggcgaccacgaccacgctggcaccacacaccacctgctccgcccgtactctctccctacctcagcccccttcctcaaccgtgtcacctctccccaccgccacctctccctgtcaggtgttcctagcctgccacccccatgcacgtaggccgctatcccctgaacccaccgctcccccctggcttccctgccaagcctagtcgccatgtccttcggcggcaaagtgctgatggccacaccagtagcgcgcgggggcaggaggcagggtcgaggacgaggatgcaaaagagtgtcctggacgacgcggcgtagcgccaacggtggcaggcgagtgcggcgtggaggaggtcggcggggaccaggtggcgtaggatgctgcggatgctgtcatcggtgaggatggcgaccatcgtcgtcagcgcttctgacaccatcgatgagcgagaagatgtggttcggttcaaccacaactagggggcaaaaatgtccaagaaaaaatatttggatgaaaattgtcttacaaatgtaagaaacgcgcggaagtggcattgtagcgaatacccccagcttaagagtggcattgtagcgaatcccattttaacgatggcattctagcgaaactggattttaaaaatagcacatatgcaaatttctccttctcaacctacttgttgccccttttcttcgtcatttgaattctaaaattcgatcataatcatcatttactttttttctatacattttagttgtcctactctttcatggctcgtccgctcaccctctcccccccccaacacccctcttttgtcatttgccaccattgtgttataaacagacggttctttcagatttaattttttaattccaaattttttttaattatatttcttctcgaactctttttttttcaaatttgacaattttttattcataatattctcaaaattctatttcaattttattttttctaatttctgaatttattttatttttaatttcgaattttacttatttctaaattatattcatacttcaactcttattttcatttttctaatttcataatttattttatttttattccaaacttcaattaatctcttgttgtaatcaagatggtttctttttcactaaaactttctttactctgaattttagttactctaaattatattcctacttgaaatcttttttagttttataatttcattatttattttatttttactttgaatttcagttatttataaattttagtcctcttcttttttttctttttttctgattattatgtaaatttttaacccttacagtaaattggttatctccttttaaagttgttttggtaatataatagattttctatatctctaggcctctcttgagagatatataagttttactatggagaaagaaaaaaaataatatcagataatagaataagtttccaactacattaaaagataaccagctgaattaaaaaaataagacaaatcatatactaagtaattttataggtattacaacatccaaagcagaataaaaaatccttgttggctaccaaatccaacagtacagcatcactgcacaccgtatcccacttcttatgtgatagtatcaaatactgagctagcaggtatatgtgaagatatagggccagtttggtttggtgccctaccaaaatcttggtagtaccaaagtttaggcaacttttggcactaccaaatttgggtggataaattttgtactacctaagaactggtgttggtaaaatttagcaccaatccaaacatatagaagcactattcaaaattaccaatgaattggtagggcataatttggcaccaaaccaaacaagcccataacctacactatcgttttgacaacgcaaaattaaccaatacagttcactcaccccaaatatttttgggttaattagatccttgccattaaaaatttgccggttttgaaatatatcattactatttacgtatttgtaacgatatcactgctacttatttgtaatctcaatggtgccattgaaatacgtattttgcacgtattggacgaaaatgccctcattttctacctttctcttccccatcttctacccctctctctctcttctctactgcatagcttgctccatagccgttcccgccgctgcttgctccgtcaccgttcccgccgccgcgcgcacagcttgctgctccgccaccgtagttgcttgctccgccgtcgtccccaccaccgcgcgcgccgcttgctccgccgtcgccgcagttgctcgcgccgccgtccccgccgccacgcaccgcagcttgctccgccgccgccgcagatgctcgctccgccgccgccctcgctgttgctcgctcccccgccgtccccgccgctcctcctgctgttgctcacgctgcagcttgctccgccgatgccgcagttgctcgcgccgccgtccccaccgccgtgcaccgcagcttgctccggcgccgccacagttgctcgctctgccgccgtccccgtcgctcctgctgctgctgctcatgctgcagcttgctctcccgccgccgccctcgctgccgccgcccgctgctactcgcgtcgccgtccccgcttctcctgcccgtactcgctgtgctgctccaccatcgccgtcgagcgggaagaagggagaagaaggggaggaagaagaacggagaagaagggcaatttggtctaaaatttattataaatgcatctaagaggtaagtagtggtatatctcgaacacgtgcaaaattataatggcatggttacaaatacctgaatactagtggcatattttaaaaccggtaaatttttaatggcacgtatataataaaccctatatttttttacatggaaatcatagtaagccagttagatttgtgtgctggtacctaagaggcacctactagatctaaatattgacacgcatctgcaaccaattagatagtatagttcatataaatatatattacatcattaattaatatttgacccacctatgatacacatggtgttttaaacatgtactacaactatctacaaatttataccccttttcttctctctcttctacctaatcacaaatctaatgtgataatttctagagcccatttacctcacttaggccatgtttagttccaaattttttctttaaactttcaacttttccatcacatcaaaattttcctacacacacaaactttcaactttttcatcacatcgttttaatttcaaccaaactttcaattttaatgtgaactaaacacaccccttattgtactatctctaactacagtacatctccgctgtgcgctcagctcacagtgaaggtagtccaaccagggttcacatcatctgcctttgaggggccaaagacaaagtttgccattgctttcatccacgtcctccattttcgatcaacagttacatggtttaggcctcttccatgactaactaccgctatttaattgatagaatttactctgtagaaaaagacaataaaacacctctaacggtaagcgggaaaaaaaacagaaaatagctacacattttttcgctttttggaaccgtttggtatagaactaatattaggagcgtcgcgctcctaatattccaagcgccaaacatgcattagcttaggctcaccccacccccacatcccttcattccactcctaccgttgtcggagtaaacgatttactcctatcgtgcgctcaccacccacctttatttgagtaaacgacttacttcgataatagaaacaactccccaactttcgatcccaccccacgtcccgcatcgtgcttccaccattatcggagtaaatgatttacttcgataaaaacaacttctctgcttccgatatatattctattttcccatacccaaccaaccactctcacccccacttcaattttttttcctttttttgggatttgaatcgatccaccatcccagcccacggatcggtgatacaccatagaggaggacgacgacaccgtagcggttgatggcggtggcaggcggcggttgaggcgaaggcactgcttcgggcctcgctgctggacgctgggcagcaccttaaccagcaaggagatgttcacctgggccaatagaaacaaccagtggctgctccacgtcagcgacattgatagaacaagcaattaaggaaatgacactctgatttgcatcttcatactctccttcaacttcacgcatgaaggcccgattttttttttcaaatcaaattaacgtgcaatctccaatattacctgatctcaattgatgggctgcacaggtcctacatttacagatcgtgctccatgtggctagctgcagaggatagggtgggagtccgccggtgatggaggttgtttgctatttttcttttgctcgtcatctctattgacataaacgagaatgtttttggtattttttttcatgcttgctagatgatggatagctgctactactcaatgtcgagctcatctctataccacacggctacatccttctatgattccatcgtcgactactgctcaccacacggttgccctctccactaccagttacaagatatagaccgtgctctttatccttatagtaagatccaacaaagtcaccagatggatttttggctgaatcattttttttcttttttagtttgattcacctgtgagtaattttatcgcttgtgtgtgattgagtctgtaattttttcattcatacgaatattttttgatacagatcaacaatactcttagtattagcttttactcttatactgtacattgaacacatcagtaaacatattactacatggtaactacgagatcatggctatatcgagaggaaggtggtaattgttttactcgcagaccacaaaatctcagtttttactcttatcctgtgtattaaatacatcagtaaacatattactacacgatggctacgagatcatggtctatgttgagaggaaggtagtaattgttttagtcacagaccacgaaatctaaacaatatttataatattggtaaaagaattactagcgttgtaagccggtagtaattcttttacgaccatctaggtatggcatcatacaatgtgaaggcattcatgcgagtaaatttgttacttttgaatgagtagatatgggaggctgggagtaaatgaaaaactccacgaagtaaattcgttactttttatacgtgcggagatactagaaaagcggaaaacttggaaagaaatactagacagtaaatattttactaaaacgcgaaaacagaaaaactagatagaaggaatgaaaaacagaaaaatttaatattttaccgggcccattgatgaagcattgatgagatagaaaagagaaaaaagaaacacgaaggtagagtggtaaaaaaggaaaaaacgaaccgagaaaaggtgggatgcggaggaaaggtggggtggtaaaaaacggaaaaccaaaagaagaaagcgttgtgcggcgctcgaattaatattatgcgctgtagagcgcggaatagcgctaccgccatttgatatgcattcattcaggaaaacaatttcatcatacaatactattatatttttgttgttttatcgaaagaaaagtaatagcgatagctaatctttagaaaaggctgtagggaaaaagttcttacaaatcttttataaacgctgatttgacacggtgggagtaaatacagattttctacaggtttcctctagtgaaatcaaatggtagcaggactttttttttaggagtacattgtgaggatttttgaagtacgtgcagcaaaactaatcaatcaattgtattataaatatgtccagcataactgatatattaattaattggttgataataatctttgaagtgggaaaaaacatgcaatcattgagggcctctttagttggaaaaaaaattggcccctgcttatcacatcggatatacggacacatatttgaattattaaaagtagtctaataacaaaacaaattacagattccgccagaaaaccgtgagatgaatttattaagcctaattattcattattagcaaatgtttactgtagcaccacattgtcaaatcatagcgcattaggcttaaaaaatccgtctcgcaattttctggcgaactgtgtaattggttttttctacatttaataccccatgcatgtgtccaaatattcgatgtgacagcatgaaaaactttgtttgggaactacggtctcgcaattttctggcgaactgtgtaattggttttttctacatttaataccccatgcatgtgtccaaatattcgatgtgacaggatgaaaaactttgtttgggaactacggccttgtttagttggggaaaatttttgggtttgattatcacatcggatatacggacacacatttgaagtattaaacgtagcctaataacaaaaaaaattatagattccgccgggaaactgcgaaaagaatttattaagtctaattaatccgtcattagcaaatgtttactgtagcaccacattatcaaatcattgcacaattaggcttaaaagattcgtctcgcaatttacacgtaatatgtgtaattgtttttttcatatattaatattctatatatttattcaaatattcgatgtgacagtgtgaaaatctttattttgaaaactaaacagagcctaaacaggccctgaataagagatggatgggctagagatggcagcaacagtaaactttgtctttggtctcaaaaggcagcggatgtggacctgaacccgcccagccaggacataggtagtaatgaatgtaggcagctcaggaagtaatatctcgcggactgtggcatcattacgcagcttcaggcctccttcagctgatctattgaagtagctgagtattgttacgagcttacggtgcacggagcacctgcgttttgatccatccgcctccgtcaccggccccttcctcgcctctggctgactgtgactgactgactgcctttcaattcctccgtatatggagacgtcgcagtgggagctggcttcccaaatcgctaggaggtcagctaatccagcatctttagggcaaaacagaggaatcgcaggttagaaaaaatgaggagtaggaaaaatacaaaattctgacaggatttgaagggtaaaacagaggattgcaaaatatagaaaaaacacagaaatggtcatttgattggagcgcagaaaaaacgtaagaatcggatgagagagatagactcaaaggaaatttttcaagacgttagagcacttgctaaatttcctccaaaatccacatgcaatgtgctattccataggaatttcataggatttggaaagcttcaatcctttaaatcaaagggctaaataggaaaattttctataggatttgaatcctatgaaattcctacgtaaatcatttgattcagagggacccttaagatatctaatatacctatacactgtacaagcacgcggtccgaggggatctgtcctagcaaaatactgtagcgagatctactcccgtactacggcgagatgaatgccttcttgtcgagaagcaaaatttgcacggatcaagtatagcttgagcaatcccgggagctcagatcggttctcctaacggctaacggcaaatatgtgtgagctctgtgagcgatgcgtgctggatttttcatcatttgattctattgaaattttctttttatatatagatcctaaaaaattttattccacaaaaagacatgtccccctcaccactcccccccccctccccccttccccctcaaccgaggaaagttaaagtcgctaatacgaagaatgactataccaatatcgttggtcctaaggacctatttgtaatataaaagaatctaattgtaataaaaaatatttacaaatacatcctcagtgacacaacactatcgtcgatgatgtatttgtaattttttttacaaacagatccttttttattacatataggtcatttttcgaaaagaaaatacaaatatatcatcggtgccaatgacattggtgtagcttccatcgggggctagagggacgacgccaatgtcattggcgccgttatattggaccacgacgccaatgacatttgcgttatagaaatgatttcttctagaataagttttttagggtctacttatagaataagttttttgaaaaatcaaaaggtgaaaaatcaagtcaatgcatgtgtatgacgtcttttaaagccaagaactactgaactggttcattgacttcagaatagtctcttcagaataacatcagaggctagaacaatatactattaaaccaatgtagatgtggataattaatcttttttttgttgtttatgcgctaagagcaggtacgatagtaggctataagccagctgtaaacatattttaaagagataaaggaaaagagagaagagcaccgggctacagatttatagctagctgcagcacggattccaagacgacaagacgtaatgtgtgtatggcaggtgagactaggtattgatagtatagtaagcaactatggtatgaattggctattagattggctatagatgaattggagctagcaatgggctatactattaaacttgctcaaaaggactcactaccgcctatttgtgtttttgataaggaatggctatgtcacatttgataaaaaaaccctctcattttagtcattttttaaacgactcagaacgctttgagatcaatgcagcggccattaccttatcatctcccagccctctcccttcctctctcgcatagatccatgcgcaacaaccataccccccatgcaattgggctttgtccttggcccccagcctcactagcagcgacgaggttccctcgcctta

SEQ ID NO: 79057 - DNA, 6888 bp, Oryza sativa
acttaatatcttaagccctgaagcagcatcaaccaatttatcggcaaccggcattgggtacttgtcctttggggtagccttgtttagatcccgaaaatcagtgcacactctgaccttgccatttttcttgataactggaactatattagaaacccactcagcatatcggcatggacggataaaaccagcatcatataaacgtgtaaccttagccttgacagcatcgagcatatcggctttgcatctcctcggcaactgctggtatggtctaacccccggtttaataggaagccgatgttcaacaatcgatcggctgagtcctggcatctcataatactcccaagcgaagcaatctttatattcctttaaaagctctatcagcttggctctgaattctggagataagttattgctgatgaatgtcggcctgggtctatcacctggacctatatcaatttcttccaaatcatcagctgacatgaaaccctgtccttgcttgtcatcgagatcatctactgtatccttggtgtagacgtttgaacccaccacgatgccctcaaaataataatttgggctctccatcttcaattgtgtcacgcccggaatttctatccaaaattccaaacgcttacatgtgtgtaaaccctcgtccaggaatcagctgaggcacacagtaacaaattgataatagagtgcaattattactctaattaataatcgaatataaagtcattacagaggtagatagttcctctcaaacaataaagatctaagcagcggaaaataagataaacgcacagacgactccattccacaagcagcttgaccaggactacgcctaatcctccacaccttcagcaacactatagaactccacctctgatgaatgtttgcaaggtgagtatatgacatactcaacaagccacgcagcaaatatgcaaatgcaagcgataacaaaggatggcataatatagtgtcatttgcataaatggcatttaataaatacttcagaatttaataaagcagtaaagtatttaattaagcaatattaatccatcgctatacaacatacctattgcataggcccaaccattctgaacaaccattcccggctgcacagttctatctccaaaccaggaatataccattccaaaccaggagctaaacaagttattaccaattacagcatcatttattacggtgagaggtatgagactaatcacaaaagacattgttagacccgcccataaccgcgggcacggctattcgaatagttttactctggtgagaggtgtaccactgtacccacaagacacaacctcaacatcatgtcaaccatgcatcgtgatacttaacaagtacccgaatagagatggtgacaataccctatgcataacacaattcaaagcagtgcaccgttcctggatcataatcacccccttataaacaaggcatggactccccagcgacccccgtgggcttatctccgccacttcatagtctggtgctctaaaatgaaccatactatacaaaaagtaaagccgttgcccatgctggctaatggttggcacggttaatgtttcacaaccgaaaatcgtgaaccggtccttaattgtcatgagcacgacagcaaaacgatgtgctcacaacccaccattatcagtttcagttgacaaattaattaatgaaccaatcacaattaaccatcgtgagctatcattaagccatcattaaatcatagtgaatcataagttatcccatttatatgagctagtgtctctaagcaaggctaagcatcctaagcactttagctaaaaccatataatgttctagctaatccaattattaaccaagtgacaaaggatagataatcaataaccaaaaaggctataacaaaggcaataggtcattcccacccaatgacattcaaaaatatatgcaatagttaaatagaaacaatagctttaaacaggatcaacatgctcaaagggttgtttgggatctatgtgacttgccttgctggcattggaactcttcaaagtcttctcctgcaaaatcagactctccgggaaggtcggaatctaagcagaaaagagcaaaatcaccaaaaaacggacggcctacgaaacggacggccgagatctaatctaatccaaaacggatggccgagatctaatcggtctaccgtgggtctacgggtaacgcaatgctgacgtcggcgatgacgtcatcaccaacggcggcttggcaactcacgctcgccggcgtacgacggcggtgctcctgcggtcttcggcggaaacggagggctggacgaggacgacgacgacttggcgatcccgacggtggccttcctgagcgacaacaatgaccagagcggcggcggtgcacggctggtctcccttcggcggcggcggcgcacgacttgacgcggaatcggcactacaagcggtggcgagctaaagcgagggtggcggcggatagaggaggtcccgggggtccttttataggggctagggggcggcgacggaggcccacggcggccggcgaaggcgaaggaaagcttagggttcgggaggaaaaacgaatccgaatcgagctcgaatcctacgatttccaaacgaaattagatgaagattccaaaacagaaaaggaagaggggatcccggggatcattacccctctactgattcgattggatcgggaaaagagtggtcgaatttggaaggaggcggcggcggcttgcgcgcggctagggcacggctgcggcgggaggaggaagacgaccctgacaggtgggccccacctgtcagagggagagaggagggagagcggcggctcggctcggcgggctgacttgggccgggcgcgcttgcaggccaaggagagagagagaggggttttgggccgactttcggcccaaagccaaaagaggacttttaaaacctttttcattttaaattattcatgaaatgcaattccatttattaaaaatacttccttggctcaaataaatcccagaaaaatctaggaactatagaatcaaatgaagtatttaataaaattttatctagcccacttttatattggattttattatttaaaattagatcttctctttctaagcttttaaaatcatttctaataattccatttaaacaacaatttataaatttaggattttcagggtgtgacaaacctaccgtcttaaacagaatctcgtcctcgagattcggaagagctggcgaaaagatgcgaatgagctgactttaattcttcttctcgttcccaggtagcttcttcttccgagtgattactccattggaccttacagaaacggataactcgattcctggttcttctctcatctgtctccaggatacggattggtttctcaacatatgtcaaatcctcttggatttcaatctgctcaagattagcttcttcagtgtgtacccttaaacactttttcaactatgacacatggaacacattatgaacacctgccaagcattgaggtaactccaactgataagcaacctcacctcttctactgacaatcttataaggtcccacaaaacgcggtgccaattttcctttggtgtgaaaacgatgaaccccccaaagaggcatgacacgaaggtacacatgatctccttcctcaaaacttaaatccctgcggcgattgtcggcataactcttatgacgagactgagctatacgcaacctctcttgagtgatctttaccttctcttctacttccctcagaatatcagtcccgaaaacctgacgttctcgcgtttgatcccacaacagcggagtgcggcacttccgaccatacagtgcttcataaggagccatttgaagactagcttgataactgttgttgtatgagaattccgcgtaaggcagattcttatcccaacttccaccgaagtctaaagcacaagctctcaacatgtcttccaaaatctgatttaccctttcaatttgtccgtctgtctgcggatgataagcggtactgaagttcagcttggaacccatctcttcctgaagcttcttccaaaactttgaagtaaactggctacctcgatcggatactattttcttaggcactccgtgcaaacacacaattcttgccatatacaattccgccaaacgacttccggaatatgttgtcctcacagggatgaaatgagccactttggtaagtttgtcgactatcacccaaatagagtcatggcctgatgacgttctgggtagaccagtgatgaaatccatccaaatttcctcccacttccattctggtatcattaagggctgcagcaaacctgtgggtttctgatgttctgccttgactcgctaacaaacatcacacacagctacatactctgctatctcacgctttatacttgcccaccaaaatttctccttgagatcttggtacatcttggtactaccagggtgaatggagtataaagtgtcatgagcttccttcaagattgcatttttcaactccttgttctctgggacacaaattctctcacccaaccatacggttccttgctcatcttccaaatacccgatagcctttccccttctcatgttcttcttaatctcttgaatatcaggatcattgatttgagcttctctaacctggtcaatgagagtgggcttcgcttctaaagctgcaacaaaacctctactgacaattcccaaattcaatctttcaaattccttgcataattcccacggcaaccgccgtccttccgtagcattgcaatagcctttcctgctgagagcatctgctacaacattagcctttcccgggtgataatgaattcccatgtcataatccttaatcagttccaaccatctccgctgtctcatgttcagatccggctgagtaaagatatactttaaacccttgtgattcgtgtacacctccgtacgagtaccaaagaggtagtgacgccaaatcttcaacgcatgaaccactgcggctaactcaaggtcatgactagggtagttcttctcatgcggatgtaactgacgagatgcatacgcaaccaccttcccatcttgcatcagaacacaacctaacccaagcttagatgcgtcgtagtacacatggaaacccttctttggatcaggcaaaatcaaaatgggtgttgatattaagcgacttttcaactcttgaaaactctgctcacattcttctgaccacttgtacttcacatctttctaaagcagttgtgtcatgggcttagcaatcttggaaaaattctctatgaacctccggtaatagcctgcaagacccaggaaactatgaatctcggagactgtcttcggttgtttctagttggttactcattccacattactcggatcaacggcaactcctccggctgagatgacgtgtccaaggaactttacttcagacaaccaaaattcacatttgctaaacttggcatacagttgatgttctcgtagcttctctagtgcaaggcgaaggtgttcttcatgctcttctttggttcgggagtagataagaatgtcatcaataaaaaccaccacgaacttgtccaggtattccataaacaccttattcatcaagttcatgaagaaagcgggggcattggtaagtccaaaagacataacagtacattcaaacaacccatcttgagtggtaaaatccgtcttaggtatatcttcctctttaatcctcaactgccctgatcgaagatcgatcttggagaaaacggtggctcctttaagctgaacaaacaaatcatcaattctaggcagtgggtatttattcttgatagtcacatcatttagtgcacgataatccatacacatcctctcagtatgatctttcttttccacaaaaatgactggagctccccatggagacgaacttggtctaatgtattgtcacgcccggaatttctatccaaaattccaaacgcttgcatgtgtgtaaaccatcgtccaggaatcagccaaggcacacaataacaaattgataatagagtacaattattactctaattaataagcgaacataaagtcattacagaggtagataattcctctcaaacaataaagttctaagtagtgcaaaataagataaacggcgcaggtgactccattccacaagcagcttgactagggctacgcctaatcctccacaccttcggcatcactgtagaactcctcctctgatgaatgattgcaaggtgagtatatgacatactcaacaagccacgcagcaaatatgcaagtgcaagggataacaaaggatggcataatatagtctcatttgcataaatggcatttaataaatatttcagaatttaataaaacagaaaagtatttaattaagcaatattaatccatctctatacaacatacccgttgcataggcccaaccattctgaacaaccaatcccggctgcacagttctatctccaaaccaggaatataccattccaagccaggagttaaacaaattattatcaagtacaacatcatttattatggtgagaggtgtgaaactaatcacgaaaaacattgttacacccgcccataaccgtgggcacggctattcgaatagttttactctggccagaggtataccactgtacccacaagacacaacctcaacatcatgtcaaccatgcgtcgcgatacttaacaagtacccgaatagagatggtcacaataccctctgcataacacaattcaaagcagtgcaccgttcctagatcataatcacccccttataaacaaggcatggactccccagcgacccccgtgggcttatctccgccacttcatagtctggtgctctacaatgaaccatattatacaaaaagtaaagcc

SEQ ID NO: 79058 - DNA, 10202 bp, Oryza sativa
ggtcggcgcgcacgccggtgggtccgccgcggagggggcgcagctcgaccgggctcgccggcctcctcttccctctctaccgcctggcctcgccgccgccgccgcctcctccgccgcaccccgccgccgctcgcctcttccaccgccgccgcctcgcctcctccgcgagcagtgcgagctcccgccgctgctcgcctcctccgccgccctgccccgccgctcgcctcccggcgctcgctgcctccaccgccgcctcgcctcgccgccgccgctgcctccgtcgtcgtcgtcctcgctgtccccgcaccgtccccacaagccgcgagagagaaaaagcaagagagagagaatagagagagaggaagaagagaatagtatggcatgcgggtcccacaaatttttaattaaaaaaagctgaccggattgccacgtgtgcgccacgttggacaaaaccgctctgaattggttcgaggggggtaattcgtccggtttgcatagttgggggatgaagaatgtccgattttgtggttcaggggggtaattcggacgaccgcgatagttcggggaggtaattcgtactttttcctaacttataaacgggaacggtataaaaaggcaaattttccattatggccgtgtttagtttctcctccaaaatttttttacgtatacgtacgtatatttgaaatattaaacgtagactaataacaaaacaaattacatattccgcttgtaaattgcgagaaaaatttattaagtctaattaattcatcattagtaaatattgactatagcaccatattgtcaaatcatgggtaattaggctcaaaatattcgtcttgtaatttacacgtaaaaactgtgcaattggtttttttcgtccatatttaatgctctatgtatatgcctaaacatttgatgtgacggaatttttaaagtttaaaggaacacagcctatatttgtatcactcctaccactaaaggaagagatagtctgcatagctgaagtctgaagattatggtatatggatgatgaaacgggtcgacggccagtgagaggtctacagcgaaaccataccacctgttatctccatctattttatattctgaattaatattcttaggcccaatttttttgaccagtgaactgagatgctccttgatttttttttacacgtttcaaaatgcgctaaatgttgtgttttcttaaaagaataactttttatatattgaagtttatttgaaaatgaataaatcattttttaagtttataatagttaatccttaattagtcatgtgcaaataacctatcacgttttatgtgccacaatcatcttatcgaccaggctaagtcgaatggagtcttaactttgaccaaatttataaaaaatactttcctcttccccaatcctccctcttcatgggaagctgtcgcctccacctggggacttcaccaactagcacacactagagccgacgccgtggaggaagtcgatggtgcagaggcgttggggagttcatcagccactgccaccgctcgtcatccctgagagcaagttcaatagtatagccaactactagctccaattcatctatagccaatctaatagctcattcatacaatagttacatactacactattaatacctggtcccacctgtcatagacacactgcgtcttgaagtccgtgctacagctggctacaaatctgtagcccgctgctcttctctctcctgatttatctccttaaaatatgtttacagctggcttatagcctgctattgtacctgctctgagagatggggatgtgaggagagaccaggaacacgatgccgctaacatgtgggtctcacgctgactcatcaagttgaacgcagtcaactcatcacatatatgtgagtcccacaagttttttattttcttttcactaactagggtgccacgtcagtgtatgctaccatgaaaccaaatttaagatggttttgtaagttggagggtgtcctgaagaggataggaaaaagtacgaattaccctcccccaactcaaatactagacattttacaccctaaactatttataccggactaatgacctctcctgacactgttctgagcggttttgacttgagctagcatacgtggcgctaacatggcagactagtcaggaaaaaaagtttaaaaacccctggacccacctgtcatccctctcttcaacctaacctctcctagccaccccccccccccccgcgttctctctccatcgcgtgcgttcactcggggggcagtggcggaggtgggtggagcttacttgcgcggtagggggcgaaggcggaggcgagccggttccccaattctggtcgtcggcgccctcttctcccctttggccgcccgcagaggaggcagccggagctcgctcgggagaggcgtgtcaaggtgggcggagagcgattgctccatggctccggcacgctcccctactgcactgcgctcatcgccgtcttcgtcaagggcctcatcttcctcttcatctctctcttaagcgcacatggcgcgcatagcggcgcggggacaggcggtggatggatggtcggctcggatgggcggtgtgcggggacaaggcatgggcaggcagacggtcggagcggacggctagtgtgcgggggcacggggaagacaaggtggcccccgcctgcctctctgtcatggccctgcctcgcccctgccattcgccagccactcgccacctagctcctgcctccacctccgcgtctcgcgtcaccgcccacctcccaccgttgcgccgtcctgtgagagagagtgtgtgtgtgcgcgcgcgcgcgtgtgtgagatcagcaggaggtgctccatcccgcgtggcttcactgcgctcctcgccggcaaagtcgcggcacgcgcgccgctgtctccgggtatggcgttcatgtacgtcgctgcgatgaaggaaggtctaatgcggcttctgctgcaaccattgttcgccgcagtgctccccacttcgagcttgtgccgagccagctcacgcccaattcatgacgcctcctcgccggcttcgccgcactctgccatcgcgtcggcgtcgcgccgctgccgttgaccgtgttccggcacttcttcacgacggtcgggtgctcgcctggggcttggtactccttccgcgccgacccatgagagagagagagtgtgtgtatgtgtgtgtgaagagagagagaaagaggggaaggggagatatgacaggtgggtcccacaactttttaaaaagaaaatactgactggattgccacgcgtatgtcacgtaggacaaaaccgctttggattgggtcgagggggtaatttgttcgttattaaaagttcagggtgagcaatgcctggtttttgagtttagagggtaatttggtcgaccacgatagttaaggggtgaaattcgtactttctccgatgaggatacaatttcaaactcgacagaatgataagagacctaaaatgaacttattgctaaaacaaaactaaacagagttagatttctatcgggcttactaatggttactaggcctatgggctgatttaccggcctcacttcccagcccgactggcaacaattaagcccgttaaccatccgggccgtaatatgtgaattcaccactccggttcggtgatccgggcccaatttaccatttctaagttgcaacactgaaaatattttaggttgcagcgaggagggttggtgaagatcgaagaaataatcccccggtagggagcatatcgctcctccgctgctgtctcgcgcgagcgtccgccgcctcgtctcggtgaagaatcgccgcctcccaccctctgcgagcgccgccgccctccccaactccggcgacgactattcccaaggttggtgtactcaccccccatcccgtaccctcctcttggtcctaggtttattaaagattgttagtaggtctctaaatctgcatattcgccgtcgatttagggctgcgattagcttgtcttctttaaattttactgtccatttctaggctgctaagctacagaattaggggcgatttgtgagctcgtcccttggtagttgatacggtttaatatggtgtaggattctggaatttagttgttcctttgagccggttacatgaattattttggtttcatcgccgtcattggatgaaatacttctcatcttattgacgtttatcgttgatctttcattgtaaagttgtgagaaaatggaatggcccgcctatgataattctttggtgtcgattttcctatgtgattgttttgcagtagatagtttacggtggtgtttggactcatcatttgtcattgtttgccaatgcaaacctgcggaaatagtctgcatcatgtgagttatatataatgttacagatcacaaattgtagcaccagtatttatttgatttataatatagaatacaactaggtgcttccattatctcaaaaaatatagaatactactagttaatgtgccaaggccctgtttagttcacaccaaacttcccccaaactcccaactttccatcacatcacatcacatccaaaactttcctactcacataaactcctaactttttttccaaactaccaactttccccaaacttctccccaatttcaggaactaaacacagctcaagttactcctatgctttacggtattaaaacagggcaccacacaagtaagattttaaaacaagtactacagtaactctgatatctttatgtaccccttgccattgtgaaaagtgatagccacgatgcaaagttgcaaacatatgaaaaaaaaggatgtctgtgatgcgaaatatactcataagctagtggccaaataaaaaaaggagaaatttcatttgatttccatccaatgttttatggccttcctcttctgctgccacatgggatcccctagtccatgagccaagcttatagctatgactgttcaatgaacctggttttcaatttgttgtcaatccatttatgcttcatcgccagcatgttctgctgctgcagtcaggagtgatgctgcctgtagtggcctctgctgtggttttgaacaggttggctagcttgtttttgaataggcctacatataaatggaactctgtgtgatatgaataagtggtggtatctcagacgctgtatttgcatattctggttgaggttcatctatgccctattactcttggtagatgggcttgtctgaaattaatcttgtttcacgtatgccgtttgagatatcatgattttcctttttctgcttgtagggtgcagtggaagtgtaaacagtttctgtggaaggacagaaaaggcattcatttgctaaatggcatcaaagcttcaagccttttggaaccatcctgctggccctaaaactagttagtttccttatctttattatttcctggctgctcctgcttatcttagatttctgtgtatcatttctgatcctggttatcatctctacttttatcatgtaaacatggaaataataaaggaatcaccataaacttgatacaagtctatctataatgtttattatttatttatttgacatcccttgtctgcattcttgggtatttgatactgaataaaccattactatggaaatgtaatcttgcttggtactttaaactgaatttttgtattaatgcaagcgccccatacctttgtatttcactataggaaattgtgatggatatctatcatttattgataccacctataacttatatgaccttaattattgcagttcatttctgggctccaacatttaaatggggtatcagtattgccaatgttgcggactttgctaagcctcctgaaaagatatcctatcctcagcaagtcggtatgtttaggttaccccattagcccatcatattcattcattccagatatcagggccatatcggtttgtttatgtattcttgtgcactgttagcattcttattctgttggatggcatgcagctgtggcttgcactggagtcatttggtctcgctacagtatggttatcacaccggtaagaccttttttacttgtctatatgcacaccatgttgaaactttccactatagtgatcatgggccgctttgtttgcaaactacattttggtttcaaattgaacgtatatactcccattggtcacaaatacatgtcattgcagacaaacatgtgtttcaccttttaaaacattaagcatcaatatgcttgataattatgcttttacatttttctaaaaagaatatactttagtgaaattgtggttttagctagtttattactaaattacaaaataaaagaaaagaaaatgaaccatccagtttacattttgaatattttgcccatgcccaaaatgatgtgtatttctggccaaagagagtattacacattgaaataatttgagttttacctatgtgagcacgagatgttgtcatcacatgttgtttcctgttttaattcttgctcttcgttggcaatgctataatgtcacagaaaaactggaatcttttcagcgttaatgttgcaatggctggtacaggcttgtatcagctttctcgtaaaataaggtttgtatgagagctatgctaatttccgccattcgtatttaatgtctcataagagcaacataacctttatattcacttgcaggaaagattacttttctgatgagaaggatgctgctgcatcactggaaggataatgacgacagattagattaaccgacctacagcctttgagccagtctcagttcactctggagtctggacgtactgcagatatctctggctttacccaagacaagaacctgttgtttctttctgtatttcttctacacccactgctggagcagttgaaaatattgtccccaaaatccaaataatgcttttttgcattttgtgaaaataatatgcatatactcaaaacatccgtttctgttatgctggtggtgcccattaaaatctgtatcggggatacttcgctaacagtagtcaaggatcacttctgttatcatcagaaagaagctatatatactacagtttcccctggattcagagtagcgttgtctttgctggtagaaaagcagttttagccctcgacttacgttacctgccatttcttactgttatatttttgggtacttgttggttttgttgcagtggcttgcgcaatcaagcatgaagtcgttgcatagttgacagcaactgttcgaaacatatataaagttgttgtggttaatcagaaatttgatctttcagagaaagaaatggagattgtttacaggtttgttaagcggcacctttttgaacagacattatccttttagagcaccaatgtgtttggttggtagtaagtggtttatttcgaaacagaaacagcaagttcctcgcagcatgagccttctccagttgagtgagtttggcattttgagagggaaagagggaggactgcaaagttgctgttgaatgttgatccatgggctgtgtttagatccaaagtttggatccaaacttcagtcattttccatcacatcaacctgtcatacacataggggtggacaggaagctcgtggctcgttagctcgctcggctcgtgacaggctcggctcggctcggctcggctcgtttgaattttctaacgagccgagctggcatttcagctcgttagagataacgagccaactcgagctggctcgcgagccgctcgcgagccttaacgagccagagcagatgaggcccaggcgcctagcccagcctaacagcccatcacccagcccatcaccttgtgaaaaccctagagtcaatccccttctggcttgtccccatcctcaatccccacccaagccaccgccggcctcatggctgccgctcgcccgtgcctatcctccccggcgccgacgccgccgcccccgcctctcctccccggcgccgacgccgccggccatggacgccgccgcccgcgccgctccttcccgccgccgccgccaccgcccgcgcctctcctccccggcgccgacgcggccggccgtggacgccgccgctcgcgccgctcctccccggcgttgacgcaaccaaccgtggacgccgccgcccgcgccggtcctccccggcgccgacaccgtcgtggacgccgctggccgcgccgctcctccccggcgcccctcctcggctcctccccttgttcactttctctcttgtccccaaagctcacgagcctaacgagctggctcgagctttcaaacgagccgagccgagctgggtttctagctcgttaggataacgagtcgagaagagctagctcgttatcctaacgagccagaccgagccgagccgagccgagccgagccgagccagctcgacatctacccctacatacacacacaacttttcagtcacatcattttcaatttcaaccaaaatctaaactttgcgctgaactaaacacagccggtctggttcttttgatttttgaattctcgctgtagtcaggtactccgtccatccaaaaaaaactcaacctaatatgggatgtgaagtctgaccaaatttattataattatgtcacatctcatactagtttgggttttatggaacggagtccatactcaggtccagctcccctttcaaactaggcaggcacgtcattgcagacctgcagttgcaggtttgctgtaaaattcctttcaccaattgggcaacagatccttgtcaatcgccatttgattagccatgggccctgtttgatccggagggctaataattagctcttcggaatcttgttatttaggagtattaaatttaaattattgacaaagcccatttcataacccctaggctaatttacgagataaatctaatgagcctagttaatccatgatttgctacagtgatgctacagtaatcatccgctaatcatagattaatatacctcgttagattcgtcttgcgaattagcccaggggtttcgcaagtagttttgcctaggggttaattattagtccttcggatccaaacgagcccatggttagctaaacgtgcccaggtcaaatcttttactccctccgttccaaaatataacaacttttagccttcagtatttgtaccaaaatataacaacttctccaccaatattatcttcccaaccaatcacaactctccaccatttactttttctacctacctcttctactcatctaatcacaactctccaccattcacttctacgtatttttttaataaccgtgtcaatctctaaaacttcttatattctggacggggggagtaacatgttttacttggaacccactccttttgtaatgacggcccttcaacaaagtgcaaatagtgaactaccaaacaaacctagagatggggcacctaaatacattgatctctcttatccgatatataaaaaaatgcaagtcgtttcaggtgcatatgctctccaatcggcacatttgaccattgtacgctactagtaaaaaaattcaaaaaaataacatttcgaaagtaatatttacatacaaatctaccaattattttcatacaacaaatacatatatctattatattaattaagagagagcgaaagaagccatcacttttttgatctagatacacagaattgccactttaatcaaagaaaacgataaagatatgaacctttcgactatgataggttgaggttatacaaaatgggacgacaaattaatttcaaacatgaaaccgtacctgcatttatccaaaccccaacaaattaaaattgatagggccctcgcctatccattgccagcccctgtcactaattagtggggttgttgcgacgtcatgatctgatgatccaatcatagggcctgaatcagacggcccagctcaatcattacacgctctctttcggattgggttgtccttaagcacaatgcttaactaaactaacctaaaatttgttctctctaaccatctggagaacatgccaagcactgacgcatgcacacacttcacacattgtggagttaggtatatcattctcaactaaactactactcttttagtatatcttttaataacaagtcaagagaaaagaaggctcatgaacatttttctggcttgtcaattattttgggaagctgcactttcttcatgcccatgtgtatttccagg

SEQ ID NO: 79059 - DNA, 29197 bp, Oryza sativa
acataaccaatcatgaccagtacatgtggatatttttaacatgtagatctcaattttagaaaaatttagagacttgaaccaactaaatccgagcttagatgaattagttatgaatttttaaagattaaatcggattaaatcatttatatagattttaattgaattatgacgcaataaagaattatttttgaaaaggaaaaaggatttattgcttcagcggctcgggtttacggtggaccgggtgcacaggaatggtctacggaatggacggctgagatctaatcctatccaaaacggatggccgagatcaacttgatctaccgcggtctacggctgacgtcgacgatgacatcggcgatgacgtcaccaccgggggcggctcggccacgcacgctcgccggcgaacgatggcgcggcggcgcaaacggagggcacctacgggtagcgggcgacgcggcgaactcaccgcaagcacggacggcggcggacggcaaccagacggcgacggcgacgaggttgaagtgacggcggcgttcggttcgacgacgacggcggtgctccggtgatcttcgacggaaacagaggggtggacgaggacggtgacgacttggcgaacctgacggtggccttcccgagcgacgacgacgacctaagcgacggtatgatccttttgcttcaatgccctgaactcacgcttcttcaaagcaacaactcctacaggtatgtgtgtcttcttgaatgcctcagtgaactccgcccaagtgattggttgtccttctgctctgttcacccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttagtagtactagaaaaggtaggtggcctcacacgaagaaaatcagctagcttgttctgcggcggtggagcattgttgtttccttggttgagctggttctgcatctgctgtatcatcatgttcattaattgagtctgttgagccagaacttgagcaagagttgggttatcttcattgttattatttccacttccactggtgcgagtgttcaccatctgttgcatattagagaagatagaaggagaggggttacactaaagacaagaccttaaccaggttaacactgatctgatgtgtgtagaccattatattgttcaggttgattaagcaagcaacctagtacagttacacactcatcaatgaactactccaatgatgggaatgcaaccatacctacacacaaagcaaacaaacgttctaccctactaactattcttcaaagacactttggcggcataggtttctaaggtaggatccaaacttcattccatcttgaccacttggcacttcggtccttcctcgatccacttgactgacctccataagtagacctcattggcgtcttcaagtttcaacaactagtttcagaactactcaagttgaaagcaggaggggagaggatgataaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcatgaaatcctcgtccaggaatcagccgaggtacacaaattgacaatttaatatacagattcatcaaattaactaaaacgataaatacttacttaagaggcactaagtcctcaccaagaagaaaactgcagcggaaaataaaatctagcgaagctccggctacactcccacaggcagctcaactggggtataagccaaacgtcttctccttctggatcctttttcttcaactgaggttgattgattattgcaaggtgagcatatgacatactcagcaagccacacaacaaatatgcaagtgcacaaggataccaaaggatggcataatataggctcatttgcaaaagcagcatttagcaaaacatttaagaggaataaaatagtggagtagttaatcagaaattttaatcaacactgaacagcacacccatgctgcacaggcccaaccatcctgaacaaccatacccggctgtacagatcaaatctccaaaccaggagctaagcaaattattaccagtataacatcattaattattgtgagaggtgtgagactaatcacgaaaaacattgctcaactcgcccataaccgcgggcacgactattcgaatagttttactctggccagaggtgtaccactgtatccacaagacacagcctcaacatcatgtctaccatgcgtcgcgatactggaaagtacccgaatagaagctgtgacaataccctctgcacaacacaactcacgacagtgcaccattcctggatcataatcacccccttataaaacaaggcatggactccccagcgacccctgtgggcttatctccgccacttctcagtctggtgctccgcaatgaatcatgctatacaaaaggtaaagctgttgcccacgctggcttgtggttggcacgattaatgtttcacaatagtagctcgcgaaccggtccttaattgtcatgagcacgactctcaaaaccatgtactcacaacccaccattatcaagttttagttggcaagtaattaattaaccaatcacgattgaccatcgtgaactatcattaagccatcataataatgagtcataagttatcccaatagtgtgctaatgtttctaagcatggctaagcaatcatatctaatatctagctgaactaatatatatagctcaactagttaagttataatatcccaaggtatcaaggaatagagtaatcaatgcaaacaggccataacaaaggaatagattcacaccacccaatgacattcgaaaataaatacacagttgaaataaatagagaatttaaatataggatcaacatgctcaaaggattgtgtttaggatctgtgtgacttgccttgcaataatcggtcttcaattaatcttcttgaatacttccggcgcactcgcgaacctttgcaatgacggaaacgacaagctaacacgcaaaacgaagaaaaagactaataaaaaccaaataaacaatacatataaagtaaacaaacatgtagattataattttagatgaattatgagacttgaacggcctcattctgacttcaaatgaatttattatgaattttacaagattaaatctatttaaagcccatttaaaaagaattaaataaatttaattcaatttatggaaaattttaatatgtagatctttattttacacaatttttgcaacttgaaccacattaaactgagttcaaatgaattagttatgaatttttaaagattaaatcggattaaaacacttatatggattttaattgaattatgacgcaataatgaattatttttgaaaaggaaaaagggtttattgcgtcagcgctagggtttgcggtggaccgggcgcacggcaacggtccacgggaacggacggccgagatcaaccctatccaaaacggacggccgagatcgatcctatccaaaacggatggccgagatcgaacggtccacgacgggtctacggcagacggccacgatgacgtcagcgacaacgtcagcgatgacgtcagcaccggcggcgactcgggcggctcgggcgcgcatgctcgccggcgaacgacggcgcggcgacgcgaacggagggcaccaacgggtagagggcgacgcggcgaactcaccggtgaccaaagaagcggcggaggaacaacggacagcgccggcgacaaggaagaagcggcggcggagatcgggtcgacggtggtgacggtgctccggcggtcttcggcagcggcgaaggggcggacgaggacggcgacgcgacggcgaccacgatggtgacctccccgagcgacgacgacgactggagtgacggcggcacacggctggagcggcggcgacaacggcggcacgaggcggcacggcgctagggcgctacaagcgacgagaggcgaaggcgagggtggcggcggttagaggagagctcgggggtccttttaaaggggctagcgagcggcggcggaggcccacggcgaccggcggcgagaaggaaagattaaggttagaggagagagatcgatccgaatcaaactcgaatccacggatttccaaaccgaattagctcatgattccataagagaaaagatagaggagatctcaaggatcatttgccctcaatcaatttcacccgatcgggaaagacgcggccgaatttggaagaagacggcggcacggctcggctagggttcggcggcgcgcggcggcgcgagaaaacgaacctgacaggtgggacccacctgtcagcggccgagagagaggaggaaggggcgcggcggactaggccgactgggccggggagggagagagaaagagagaggttttgggccgactttcggcccaaagccaaaaggaggatttaaaaacatttttctatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttagacttttaaaatcatttctaataattccttttaaacaacaatttataatttaaggatttttaaacaagaaaaactcttaacaattataattagatcattatttatcaaataattactgaactgttctttgtatcatttaggaattgagctccgaaagatccgagaatatttcagagagtgtaattaaccatggagaatttaataaaaaaattaaatccattcatgctttatatttaggaaattttatttcccacatttaacttcacttgtaaattaaagatcatttaatataaattctattattagtttattaaataatttataaatcctgaaacaaaaatcaggatgtgacagaggcccacggcggccggcggcgagaaggaaagattagggttagagggagaaaattgaatccgaatcgagctcgaatccgacgatttccaaacgaaattagcgagagattccaaaagacaaaaggaagaggggatcccggggatcatttcccctctattaatttgatcggatcgggaaaggggcgggcgaatttggaaggggcggcggcggctagggctcggctgcggcggcgcgaggaggaagacgactctgacaggtgggccccacctgtccgcaggagggagagggggagagcggcggctcggctcggcgggctggatgggcctggcgctagcaggccggggtgagagagaggggttttgggccgactttcggcccaaagccaaaagaggatttttaaaacctttttcaatttaaattattcgtgaaatgcaattctatttattaaaaatacttccttggctcaaataaatcctagaaaaatctaggaactatagaatcaaatgaagtatttaataaaattttatctagcccactttcatattggaatttattatttaaaattagatcttttcttctaggcttttaaaatcatttctaataattccaattaaacaacaatttataaatttggggtttttagggtgtgacatgtatcctttctgaagcaaatcatctacttgcctcttgacctctgctagttcattggctgccattctataaggtctcttatggatcggagtttttcttggtaccagatctattctgaattctatatctctcttgggcggcataccaggtaaatcatccgggaacacatccgggtagtcctgtactatgggaatctcttccaaacttacttggttcagacttgaccttaaaggctcagaaggcaatgcgtaaacagttacaacttgaccgtcattgctggtgagagttacttttctattggcacagtctatcacacctttatatcgggctaaccagtccatccctaggatgacatcaaggtctttggattctaatagaataaggttggccagaaatggtactccttgaatctctattctgacggaggggctacgttgtgacgagagtgcttggttgctgggggtactaaccatcaacggacgtctaagatcttctacctccatcccgtgatttctcgcaaaactcatagacaaaaatgaatgtgtagcaccagaatcgaaaagcactgttgcaggaactgagttaacaaggaacgtacccaaaatcacatctggagcaccttgggcttctgcagcagcaacatgattgacacgagccttggacactggtgcggtggagttgttctgtgcagggacaaccttcacgcgccggggcttcggacacttgtcagaataatgacctggttccccacagttgaagcacactcttggcttgtttcccggctccctcttggcaggctgatgctgggctagagttgcaacaggacgtggagcttggttgcggttgttgttgccagaattgttgttgaagaactgacgctgtggacgggcaaccaacgaagatcctccctgtgacactgcctgaggtcccatagcaagacacggcctctgactattcccctgctgagctttgaagtgagcaatcctgcgtttcttctgctccattcggttgtacttgtcctcctggcgaatggccatatccaccaacttctggaaatcatgataatccccagtcattaatgggtaagagagctcatcattcagtccttccaagaacttctcttgacgctcttcatctgtacgtacatcttctggagcatagcgagctagacgattaaattcatgcaagtattcagtgacagagcgagatccctgagtgagcgtcctgaactccttcttcttgggagacaccactcccgacggtatgtgagttttccgcaaagcagcagtgaactcaagccaagtgattggttccgcagtggtcctgttgagacggaagtgatcccaccactcagaggcagggccatgaagctgatgtgaagcgaaggagactttttcttgattagtgcactgaagcaggtccaatttcttttctatggcgtgcagccaatcactagcctcaactggattggtagtgctagaaaaagtgggcggcctcacacgaagaaattctgctaacttgttctggggaggtgcatggttgttcccctggttctgctggttctggaattgctgcatcatcatgttcatgagctgtgcctgttggaccaggacttgggcaagcgtgggattctctccattgttgttgttgttgttgttgttgttgtttgggccattcccattgctgtgagtaagcaccatttggcataggcaggagcacaagaagagaaacaaggaggaaaaaactacttaggacagggaattgatttttattaacttgacttttattgatcttaactgagtttcattattacacaaaactgaagactctcacacaacttaacttaaactccctaacactcgaaagcaaacaaacgcatgcatttacatcccaacaatgatgtaaaccacatgcaagacccacacacgcaaccaaacttaaacaagcaaactaacacaatgatctagggcaacgacttaacaaggcgttctagatcttccgggcatcggaattgattgaaggctcgttcggcttgcccccatcatcttgagtagctccccactcgacctttgaatgggtgcgcttcgattcttctccatcatcatcacttacgttaacgaccgaaggattcgctgagactgggacaacttcttcttcttccaccacacgaaccttaggcgccaactggtagcgagggacaaatagagctctcttccttgtggtaagacgaaccctggccttttgtggtggtgcttctcccttcaacgcggctagttccttctccaaacgatcaactttgtcctcaagcttacatatcttaccacgattccggtcttcacgatcttgagcagctaacacaatctcagcgcggaactcatccatggcccacagcatctcaaccaaatgccttgtggtagcatcattctcaattcctgcaggttcaaggtagctgccacggtcacttccctggggttggcgaggatggtagcgatactcagtgtcggccaactgatcactgtagcaatcgcgaagctctcctatggcgatccttgccacctcctgacaagcatgaatgtagtttccccctccagcctcgaacatcagcgatgggatgtcttcatgattagtgttcaaggtgaccttgacacggcacttctcttcatcacggtcatgaggaatctgggcatacaaaggggcagtcccaaatcctatggcgaaggacatcgtacgcaactcctggacaaatccctcagtaccgaacaagtactcaggcttgaagcgcggcatctaaagacaagtgaaaggagggagttaagacatttatccaattaatagcacaagtttttggattaatttgaataaagttagaaaatcaaagtaaaaggtaaataaataaagtaaaccaatcttgcaagataagttgaaacagttgaaaacagaatcacaaattttgcacttttgaataacaggtttcaaaagaaataaaataaaagagagttataaaatcaacatgctaaattatattgcaacatgattgaataaataaataaataaatgaaaggttgtaaaatctctgctagaaagtgggccattagtatagtaatagatgtacagtactaacaacacaggaataataaataaattttgaatgagaacaattaaagggactataaactgcatgtgccattagcttggtttaattaaaagagaaagagaggagaacagttctactttttcaatctttttagagggcttctataggtatccatttggcataacctagggtcaatgtggctctgataccaacttatgacgcccggaatttctatccaaaattccaaacgcttacatgtgtgtaaaccctcgtccaggaatcagccgaggcacacaataacaaattgataatagagtgcaataattactctaataaataagcgaatagaaagtcattacagaggtagatagttcctctcaaacaataaaattaggaaaataagataaacggcgcaggcgactccattccacaagcagcttgaccagggctacgcctaatcctccacaccttcagcatcactgtagaactcctatgatgaatgattgcaaggtgagtatatgacatactcaacaagccacgcagcaaatatgcaaatgcaaggcataacaaaggatggtataatatagtctcatttgcataaatggcatttaataaatacttcagaatttaataaaacagtaaagtatttaattaaacaatattaatccatcgctatacaacatacccgttgcataggcccaaccatcctgaacaaccattcccggctgcacagttctatctccaaaccaggaatataccattccaaaccaggagctaaacaagttattaccaattacaacatcatttattacggtgagaggtatgaaactaatcacgaaaaacattgttacacccgcccataaccgtgggcacggctattcgaatagttttactctggccagaggtataccactgtacccacaagacacaacctcaacatcatgtcaaccatgcgtcgcgatacttaacaagtacccgaatagagattgtcataataccctctgcataacacaattcaaagcagtgctccgttcctggatcataatcacccccttataaacaaggcatggactccccagcgacccctgtgggcttatctccgccacttcacagtctggtgctctacagtgaaccatactatacaaaaagtaaagccgttgcccatgctggcttgtggttggcacggttaatgtttcacaaccgaaaatcgtgaaccggtccttaattgtcatgagcatgaccatcaaaaccatgtgctcacaacccaccattgtcaggttttagttggcaaattgattaattaaccaatcacgatcaaccatcgtgagctatcattaagccatcattaaataatagtgaatcataagataccccatttatacgagctagtgtctctaagcatggctaagcattctagcactttagctaaaaccatataatattctagctaatccaattattaaccaagtgacaaagaataggtaatcaataatcaaaaggctataacaaaggcaataggttatttccactcaatgacattcaaaaataaatgcaatagttgaatagaaacaatagctttaaacgggatcaacatgctcaaagggtcgtttgggatctgtgtgacttgccttgctggccctggaattcttcaaaatcttcccctccaaaatcggactctccgggaacgtcggaacctaagcataaaagatcaaaatcaccataacagcacataaacaatcatgaacagtacatgtggatatttttaacatgtagatctcacttttagaaaaatttagagacttgaaccaactaaatccgagcttagatgaattagttatgaatttttaaagattaaatcggattaaatcatttatatagattttaattgaattatgacgcaataaagaattatttttgaaaaggaaaaaggagttattgcgtcagcggctcaggtttatggtggaccgggtgcacgaagacggtctacggaatggacgtccgagatctaacctaatccaaaacggacggccgagattgaatcggtctaccgcgggtctacggatgacgcggcgctgatgccagcggtgacatcatcaccggcggcgactcggcacctcatgctcgccggggaacgatggcgcggcggcgcaaacggagggcactaatgggtagcgggcgacgcggcgaactcaccgagggcttggacgacggtggacggcaacggacggcgacggcggcgaggttgaaacggcggagacgttcgggtcgacgacgacggcggtgctccggcggtcttcggcgaaaacggagggcgggacgaggacggcggtgacttggcgatcccgacggtgaccttcccgagcgacgacaatgaccggagcggcggcagcgcatggctggactccctccggcggcggcggcgaatggcttgacgcggaggttgcgctacaagcggcggcgagctaaagcgagggtggcggcggatagaggaggtcccgggggtccttatataggggctaggggcggcgatggaggcccacggcggccggcgacggcgatggaaagtttagggttcgggaagaaaaacgaatccgaatcgagctcgaatccggcgattaccaaatgaaattagatgaagtttctataggggaaaagatagaggagatcaaggggatcatttcccctctaccaatttgaccggatcgagaaaggggcgacgaaatttggaagggggcgacggcggcttgcacggctagggcgcagctgcggcggcgcgaggaagacgacaaccctgacaggtgggccccacctgtcaacgggagagtggagagcgagcggcagctcggctcggcgggcggactggaccgaggcgcgcttgggccggggagagagagagaggggttttgggccgactttcggcccaaagctataagagggattttaaaacctttttctatttaaattattcatgaaatgcaattccatttgttaaaaatacttccttggctcaaataaatcccagaaaaatctaggaactatagaatcaagagaagtatttaataaaattttatctagcccacttttatattggaatttgttatttaaaattagatcttttcttctaggcttttaaaatcatttctaataattccatttaaacaatagtttataaatttaggatttttagggtgtgacattttcgaaccgtaccgatgccgagttgatgagatggcaccaggagggtaggaaaaatgacggtaagattcaacaccctgccgatgctcgacagtggaaaaactttgatgcactacacccggaatttgcaaagaacccgagaaacgtaaggtttgcctggagcacaaacggaaagaacccgttcagtgacctaagcagcacatagagtcatgtcggaccatcaggcttcattccattccatttcatctcacatcagggcacaacgagatacatatcaagggggacagagaggctaccaagcttaacaacgaacacccaacaggggctcacacacctagcctttctcacagagatggtggaggcgcaagtggatcgaccggaagtggggggcttcctgcgaatccttcccaacctgtgggattggatcataccggacttaacgcttgcctgtgcgactagggcggaggtgttcctgcgattcatcttctggtagcgggcttccagatccatgtactgctctcgaagctcgtccagctcctcgagtgcctgctcgtaggcatcctcgatgctgcgggccagctcggagaggagggtgcaccgactttcttgggctggtccggtgaagcggaggtggtatcggttgtcgtcctcggagcggaatgggtacaagctcaaaacattgactatacctagggggacggagagcttgcagaatcgatacagggtgtcacgggacacatcgtaggatggcggcgtccaggatgatccgagggtgacgagtctggaaagagatcatgatcatctctttctcttcctctctggggaaggggaggaagagcttcaccttccagtacttctgggatccccggacgatttgctcgccacgatagattggcccagaaaagaaaccgaggtgctggagcagctgacccagctgccaggcatacccaattgtacacacctaagggagtacctgaggtggttgctgaggtggttctggagggggcgcagccatggttactgcgaggtctaccatggagctagggtttttctggctagcttagttcaaaggagaggggaggggaggactggtgcactttctcagggtcgcttggggctcctgttataggcaccaaccactggggctcctgtgataaggtcagtagctccagtgcttatcctgtggtatggtcggtcccatttactggtaatggatagtgctctgctgtagatctcgtcagtcagagttcctgtagatcctgtcgatcagggttcctgttgcgttcccacgagtgccgtcagcacacagtggttccaggtcttccggggtccttgaacggtcagacactgtgctggtccttattccttacggtcgaagcttcatgttggtcccatgcttctgttgcctcaggttgctaagcatacgaatggcttcttcgcggtcagctaatcataattaggcctggttggatcttggtgcagctggttctgagtgcccacttgttagtggttgtcctttatcttaagcagcaccagatttagaaaattggggaaagaatccaccgggaggaaagataaggatttgagtttgaaaaggggatgagaaactaacccacaaagattgcccaaaaggtggcagctacatagcaaggaaaacaatacacaaataatggatcgctgccccttattgcgagaactcgcactagtgagcggcttaatacaacgtctacaacacacatctaacgtttttagtcagttcagtcagtggttaggatagctctagcataccttctatctcttcaaccttaatccttatggtctgtataggagtattcgaatactggggataagtcgagatttatcaaaagaaatttttcaataatacttgagaagggagagtagtaagaatctaaggttttatcaaaataggttttgaaaatatgtggtttatgtgtaataggctacgcttagctgatcctaggtcttaagggtggtcgcaagggtccttaggtcctgcagtcgtctagctctgataccaagcttgtgggccctcgattttatgcaccggaaaccccatatgttttacaataccattccctggaccagtaaatggtacacacatggcacagttgtatatcaaaagctgacatcattatacaggttaaactatacattaataatacaaggataacccaaatgggacccaaatagaccgagcatggtcatatacattacaaaataccaaaagaagtagatgagataacggaagcgaagcagcggcggtccaacgtactccataggcatcgactggtgaacctaggtcccgactccaccgtcttcaatatctcttcatcaacattgttcccgtatggtcgactccaactcctttctaaaagatttagttaagcaagggtgagtaccaacctactcagcaagccactactacaggatgcatttagtgcacacaggggttcaaggatggcttggtatatttacataaagctagttttcacaattcatttcacaaacctatgacctagcaattttaagtgaaaaacaacattaagttgatgttgtcattaatccgtgagggttcatccaccttccccaagcctcgattggtccggtccaccttcctgtccaacgagcaaagtcacacttcattctcaatctaagcaagattaaaatctatgaggctaatcaagagtagtacaagtcccggcactcattaaccgcgagcacggctattcgaatagatttgatttactcacactgcaatggatgtacgcttttaatcctgcactccgcgacttgcctaacgaatgagcctagtcccaacaaatgagacgtgtcacggcccagtttttcagtaaaccctcgcattatggcacccactccaaggactatgaactcccattgcaccccgacgcccaaccctacctcgagtcggaaggtgaggggagtcctggcgctcccgatatcacaagaagttacattacatgtaggttaggtgtgttttaagttttgccagcataaccaaaccaatccaccacactgcaacaacattacatcatcacaagtgcagaaccaccatgataggggtgctgccccacgaggatttcttagtccaccggttctatacccactcgagaagtgtggtcgtactctgatcatctcctgcatagcttcttgaattggtccttaactgaccagggcctgcgccgagtcgtttccagaaccacccatattccattcgtgccgccccagtcgaaaacatttgttttattaggtttttggttttcgcaaagctttttgtgctgcggcctgcgagtggcgctcatgtctccacccgccttctttggcaatcactctcgacaagtgaccacccccaacacattcatatccaactagtatggagtgtacaatcgtctataaataagcagtactaagcaatatcaatatttgaccacgtataacaaatagactcgggcaacaaagatatatataaaggtaacaatatcaaggaaattagcatgcaactttatttataaacaaagcatttgtaacatgggttcaacatgccttgcttttagaaatcgatatcttcgagaaatccacatctgttgaatatccgcaatatccgatacgcagttaatacgcaaaatcctccaaataaggtaccaaacatttcaaaccagaagtgccgttggatatatctcgattttaaaagaattccggaagttgaacggagtcaatcggagtcacggtttgcaagatatgaatttccgaaggttatacggattaataatccgaggaaaaggtttcctttcaatgaatattcttcgtgaggccgctctgtcagtgggattaaagaagaattagggagatgtttcaaacttacagagaggaactcgggttgtaaggggatgtagtatgaacttgtagtggataaagaggccgcaagtgggctcggcaggggatgtaatagggagatgaaatagacttttcggcagcgtcaaggtcccgaggagtcacaacacagtaggccccaccggtgggtcccacagctttttcttttcttctttttattttcttctctctcttatccttccttcctcttgtcggtatcttctcttgctctctccccctcgtttctttctctgcttctcgcttcttgtgcgcgacaaattggacattacgccactgtaaagagtgggtttcatcagtatcgttaaaatgccactcccaatgaatgccaaacatttggttttgccatattcaccattttataaagttttcatcattttccacacatggtctgaccaaaatacccttcggtcggttaaagaagacgagttgggctggcattggagaagcagctcaccagtcttcgggcgcatccacgccgagccgacgacacgacaccgcgtgtggagcggcggctcagcgcgctgctctccaagggcccgaacacgacggtggagctgttcccgatggtggcactccgcgctgccaccggctgcttctggccgagcaacgcatcggctccggtagcttcggcgcggtgtaccgtggttcccaccccgctggcggggaggagggaggaggatgggttggacgcgacatagaaggggctgcccgagcttgactttgacgggagcgactcggcgttggcgggtacggcatcggctgccgcggtccgtattggtatttcttaactacattactaaaaatagtcattccagcaatggcgccagaaatagtcctggtatatttatagttacagaaataatccgcaagcgcacggatataccattgtagcattttttatcccaagctatcgtattttttatcccaaggaaagataataagagtgaactttactaatgcagtttatacatatattacttataattgtcagagcctaaacagggtttaagtataatataagggtagagtgacacgaagcaaagctatccaatcctcataacgaataattctactaagtggaagaagaaatagaaagcactcaattcctatacttctagtatacacttaaatcctaacttacatctgttaatgtacaattatgtggccgataccccctaacagtgtcctcctgatactttgagagactaccttgggttgccgaatttcttaagacaacctgtcatggtagtccaaccggggctaaatacggatgagtactctccccaggaaattgtcttagaaatatatactaacaaggaggaatacccgtactgagctgtcaccatcagcggcccacctctactgtcctgtagcatatatacctaattaattatgcttaataatctaagcaccatacttacattattaaatactactctatacccgcatgctagacatagagtaactgataaattagacattaaacccgcaccattacacctctctggtaggctacccacacaattaacacaatacagatataaaataagactagtacttaaacaaagtaggcaaaatttgctacaggacgtccgaaaaatatgtaattagctagaggacattgtaagaacgtgtatttgctgtaaggcatcataacaaaactggtaattaactgctggacaccggcgggattattttattatttttagagggataggagagagaaacaatcattaaagaccagtttgcccttggctcaaattaatccaatgtgggccccactatgagtatgtccttctcgtgtcgccatcgtaggtgaagtggtgaaccccacgtcggcgccatcgagcgtgcagctcgctagcctccgcgagaagtaggcatcgaaacggccgcaaccgcacaccctgagtggcacagcggctgcggtggcgttgacagcgcactcctcaacagcatcgctgggtgatgccctccatgccgtctgcccacggcctgctgatctgccggatgctgtgccagtggatggcgactttctccgtcagcagcgagttcttgatgttgatgacgatactgtccctctagacgacgctgatggtgcggctcggcgtgtggccgttgatggtgacggccagcttgcggacgcagtccggggacgtgaactggtaggtgatgtcccagtcgtggcgccgcggctgacgtgacgccgcacagcgccgcagcggcgaggaagaggctgcagaggaggcggcggctacaccgcgtcatgtcccctcttgctcgcagtcgcagctgcattgtttggtttgctccggttgctagctgctctgtctgtgcgtcgttttgagttacacaggtggatttggagctcgccaagtagcgagcttaggtttttgatgtttcgagatgtttggagcctgctccggtaccgctgcgatggcattgatggaacacctcgtactcgagcgccccgagcatcaccggtagagcagcgccgcacggcagccggaccagctcacgcgcccggtgccgtcgttggcgaccagcgcaatggcgtcgacgtcgtcggcgcgcacgcgccggtgagcatcgcgggaaagaatgagagagggagaaaaggataatgaagaaaaaaagaaaaaaaatcaaagggtagaaacgtacttacacatgtgtttcactcttcaattcttccagatataataaaataatcacgcgggtgtccagcagctaattaccagttttttgtggtgccctacagcggaacacgttcttgcggtgtctcctagctaattacacttttttggatgtcctgtaacaaattttgccaactaagtaaagtaccgaagatatataaagaagagtattccattaatttggaaagtattacagaagagattacaagagccgctagagccataccgaaaactcttccgaagactccgatgacttccgaacactattctattctactccacttagtactatactactaatactaaagtatgaagaggactttagcttgcttgagtgtgttgagagagtgaatgaactcctccttttatagagctggtatgacggttgtagaaacacgaaatgtcgattttgccattacaaccatcgttgagaagcaatcctggacgtccacgtgtaaggccagcgggagccgcagctgccaaggttcggccgaacctgggctggcccagcaagcctccagctttggcaagtcgctggcaagtgggtcccttaggcggttgtggtagttaaaagtcggtttccggcggttgcttctgatatgtgggccctccttatccatatgcttgcttaggagtgaggtctcttaacttttatctttattttatttgataaattcctgcaacatattattctccaagtacaaacggaaatatattattttggaaataaacatgcattgtaagcatagctaattctccattattttagttatattgatggtcgaaatttgtcggtaacgaccgtcaacaaccccaacacccatgtgatcgttctccccctcttaccaagaacaatggggttttgtttattagagttagcaacttgatacttgcattcagcgcgcgtgttggctaaattgtctgtctgtttgtcttcggaaccccaccatattgtgatttcttcatagtgaaactttcatattcatttagtgtttgttctacttgttcttcgattgcttgcaggaagagtgacctcgttgcctggttgttgtgcaccacaagctcgcgacaacagacgttgtattggttgctaaggcgcagcgtcattagatggttgtagtcgggtcgtgaacgtcttcttcatccaagtgagttatccccgcctcccatagaaagatcgggacacaaaccctcgcgggttcacatcatcactgctagagtgcctcttccaccgccaatccgaaccaccgccactgttgtagcatctggctgctcactgtcagcaattggcatcacgctaggctgcagtgcttccacctttcgctaaaatgcgcctagcagtagcttggccacccatccacaacctcaaatcggggcccaaacctgctttctcacactccctagtgagttccgctgcaaactcaatctccagctagcgtttctcgctgcgccgcgactcctctctctcccttaactccttcaccttcccgaggttgcggccatccccgtccggaggagcaccgccgtcggccaccttcccttctcccctacccgtcgcgtgcgaacggtgagaatcctctcctcgtctactcccgcgccacctctctcaccgccgctgaccgctgccggccacctcatgtgccgtgtcatcgtcttcttccctcggtaagcacaccgtcacactccttcccaccttcaccgcttcccatgtgcgccgtcgtgccagttggtcgtcactagtgatcatagggctacgcgccgccgctacccagccagccaattgtcgagccccactcccacttgcaccggtcatccgattcaactcgggggaatttgggccatccatgtggcctcccggtgccacctcactatgcccgcccaaagtaatagctcaagtaggctcaaatatgtgctaaatgaatagcaaatgctcaaatcagataatgtaaagttgaaaaatcattcaaagtcagtaccatgttggtcctaggctagaaaatactatacgcgcaagcctagatacaaacggtaccacaagatagcacttgtaggagatgacaataacaagcacacgatagcggcgatgacagtgttagtgaccctatcaaatgtaaaattgacagcgatccacttgtaggagattattaggtagttgtgagggcaataaggttaaaaaagagacgacggagacattctcaaagaatataagcatttctaacaatgaatctggacatatctatatcaagattcatagctagaagttgttatattttggaacgaaggtagtaaacacaaccattacttcatttgaaacgaaaataatctatatagcacatacaagggaaacattacggattaacaattgtcaaccttcctaatataggagaacagctgtattttgttaatcatatgtgtcggacatatatcgcatcagttagtatggctgttgtcggcatttagctttcttttgaacccttgacactaatgaactagagatccaagacttgttcatctcagcaatttcaccagagcgccaacaacacagacgaccatcttcgccacctgtccatccaaaaatgcccctgttttgcccagtatgagtgtttgcggctggatatacggttctaacaacgtctgtatggcctccttcaaggatagcttccgcggaacctattgccccttcaagaccagctcttacagggaagtaacctattgtccctgcagttgtgccgccaatcacccataacttgtcgtcgggcagagagtagtgacaatcaacaaaatagtccacctacaaaatatagtaaacagaattagacgttgagaataaattgtctaggtaatttgcctccctggactgctatattgcattgccaaccacgctaattaaacaatgaagcatcatgggcagccacatcgtgtagtttcacattgtggcagcaatccctctgtttcgccacatcaaccaatctagagagcaggaaaagctgagttgacgtttagactaagtaggtggacagcaatggaggcgtagtgagcatagttgaaaaaaccggaccggtggatgacccggtgaacacctcggttcaccggtccagcggtcgaaccgacgggttggacggttgaaccgcggtttaataaggtcatctagtttatatgttttgaacttttgatacttgcacataagggcacgtggtgggatggtcagcgcagccggcttacaacctggtgaccaaaggtcgaatctcctccgtgagcgatttggcattttttcaaaaaaaacaaaaaatcgtcttggtaggctgaagaactaaatgggccttcgtgtggcccatttacactctcgcatgtcttagcccggttcaaccgatagcagtttattgtccgtttcacctcaaaaccagccggttcaagcggttcaaaccggttcgattacatggccggtctttctattgaaccgaaccgagctaacctctggtttcggttatttccggttcaaacgctaggccggtccggtttttcactatggtagtgaggtcccgtaaacgggaatgtaacacttgcaacaacagtgacaaggcatctagaggagatagtcagttcagtaagctgtgaaaaataaagatcaagcaaattttgggttcatatgagaaaatgacaagagggtgcaacataaaatgatgcatgaggatattggattggctccatgattggagagaataggtttctgtagccagcaagaatggtgactggaatggagagttccctatagtgtctccacagtggaactgtgcaaggagtaaagaaagacggtcacgcactctatataccctaaacaagtgcattggagattatgtcaatgtcctaagcaacaagtaaaaaagaatagagggagtatatctaaaatttggctagttctggagttagttgatgaagacgattacagatataaggtgctacaatatcattcatttcgtgaagttctgtaatctttttgtaccatgagccaaatgaagaaagcaatgaactaatgaggtgtgattgtttgaatatcataactctctaatattaatataaaaaaaactgtcaattaccaaataccacactacatgccaacaaatgctgagtagctagaatgtataaaggcaaatattagaaactcacatggtcaaggttccacctatcagttgccaaggaacgagcatcatctatattcagttctctactcccatcattccagtcccaggtactgtgagaattcaacagcaaaaatcacaattagacttttgtccttatttatttatttgaactttgaaatataagtcagatgacatggcattgccaaaccagagaaagcaaaccgaataaactaccttaatgtttcaatgtggctcaagcaccagatcttctggtatgtgttgccgaaaaatcccacttttgcaacagaagtctccacattcataacctagggaagatcagatatcagagaactatcacccaaaattgacatcttcatacaaataacctcatgcagaaccattaaaattaaaaaaaaaatacttcaaaagggagatattgtaataccacaattgaatagtactaacaaccaagaaaagaataggcaaaactagaactgcatccgtaacatacaagaattgtaagctctattgtatgaagattaacaaagaactatggagattaacagtagcattgttataagaagcggtgaggaataaaattgtaagctctatcatgtacttcacgaacaaataacagcatattacacacatggccagttattgaagttacaaaaaggggaaaaaacatcatgcgcatttggcatcgtcatatgaaacaacaaaggaacataacttgaagtactaatgggatacttcagtaaacaacaaacatcaaagtatcaaaccataacctgacatagcaggatatgtaagacaaggcatttgggcacaggaaacaactaaaacatacagatagcaaatgattgtcctcgttcatgtcaccatcagtgtcaaaaacacatattaatccatcaactgctgcagaaatgagtttgctatgctgatgtggtgcaaattttacctgtccaaaaaaggtgacaacataaaaatttataatcacccagaatacagaaatagtatgagaggaacagtagcaaatacaagatattttcacaataaaatgcattcaagtgattcagtaagcacattatcaaaatgtttagagtaagtgatgaaagtagttgtctcctgtgatataaaaatagttgtctccatgaagagtagaaaacatacaaaaccatccaagcatcactttgtaaaatataatggtgcatatttgatatctagtccatcaatctaaatgctgataatgcatggtacggagacagcagatcattagatcatgatttttatataaaagtactgtttgcttctaggaccatttcgattggatatccgcatgctcacatattttgatagtatacacatgtagtctccagcattaatgccttcaaatatgccagcaggatgactcagttctcacttgattaaggctgtgttcgggaggaggttcccagcacgcaaaacaaagcttgtattattacatgattaattaagtattaaccttttttttgaaaaatggattaatatgatttttttaaaataactttcatatagaaagtttttgcataaatcccaccgtttagcagtttgaaaagcgtgcgcgcggaaaacgagagatgtgtttggaaaatggggggaagaacacagcctaagtgtttttatataaaggtgatgttatggaagggttccttcacaactgttcattggagagccaatgatcgtctacacaagattccgttggcatacagtttcatcgacatgggtcaccaaagacttcagccgtagttactgccacagcttgaggttgagatgccttgccacaacagatgtagtgcacgaacagtatcatgtactgtagcagtgtagcaatacaattaaggtttaggatttaccttccataataaatctattgcctcaaccaatcacatctattgtgtcaatatggcttagttatttggtattatatctattactccctctcccaaaatacaacttctagcattcaaaatttatcccaaaatagaacaacttcacctacaattccttttcaacaaaacacaaccttccaccattcaatttttttccacctacttcctcttcttaatcaatcattctcccatttaataccacctactttctttaatacccgtgcccaagtctacaactccttgtattttgggacggaggtagtagttaggaatgttcagttagaaattagaaatatggtgtgttaaggtagagatactattcatggtactgttcacgtaagtgcctccagtactgcagcaaaagaacctcccatataagggacccatgtaacccatgtaagtaagcaataaagaatcataaagtaggtgtagcttgatcagggtctactggcaatgaggacaagcctagtaccgatgagagtgatctcacttctatcccagtctttagacccttaacccatccatgaattagtgtccataacagatgaacacattcagtgtctgctccaaaagatgaagtcacaaggtgtaatgctcagttgctcacagcattaagccatcaagtcgagtcaactcacaaaaggtcagtttgggtaattagtcagatgactagtcggtgactaggcagcagcatgcatattagcatgacatcaaaattgcacaaatgatctttctgcacataagatataactattgatgcagccaggtgtccaatacctcttagattgtgaatactctccattcaccaggaccagagccctccaaattccacaaatgcagctaccaaatgaagcagctatgaaacagaacagcaagtaaacaagctttaacattgatcctgcttggtccatgattcctattcctccaattaggttaaacattacattcctttaacaggtgaaactgattcatgtacctagcctgaggctgcatcattcaagtcaacactaaacaagagctatctattgcaaggcgtcttttagttgagatagttatgctctaaacatgagcggttcaactgccggttcacatggttcgaatgttgaaccggaagtgctatattgtatgcatattctccatttgtcactgcgaaagttagctggacagtggatgcgtagagctttcaaccagctgacctgtgttcgaacccccattctctacctttttcttgctattttcaataagtacatgaaccgtgggccttgtgatctttgcatgcacaaggcccttgactggcccatcaaggctcatcctctcttggcatgattaaccggccggctcggtttgccttggttcaccggttcacatgaaaaccatccggtttagacggtttgttccacttcacatgcaggggcggtctttatagcaaaccaagccatccagacctctggttctggttttttcggtttaaccccctggcctgtccggttttttgtactatggctctaataatgcaatgagtcagctactttacataaatacacaataacataaaaatgtatgaccaattttatttgcggactacttgcacccacatattttcttgaacagattgttccattaatgtagagaaggaacaaacagtcctgagtaacaaaaagaatgcaaagtaaaatatatgacgtagaacaatacatacttgagtcacatcatccatgtgagattcctctaagcatgctagctgtttagaatttctccaatcccacaatagaacctacaaccaacaaattagaatgagacaacaagaatcaaaacgagtgtaacatcataagattcttttttctagaagtcacgtcacaaacatatggaagtaaaccatcctggtatgttaatcagatgaattttgagattgagatagttcatagttggaactggttttggagataattggtaaatatagctacaggggctggaatagagaggctattggagatgctccccttcccttgcaatggctggagacaccgatctacagctacaattgcctttcatgcaagagacggtgcacacaagcatcagaatggctgagcaaacaatagtccactattcagaaattgtacatctagccatcattctcaattctcagttactttgatgtttcatcttgatctatttgaacaccagattgaagcattcaacaaattagtttcatcaatttattatggttttagccagtttttgccaaacaaacagacttccgggattagaatttgtggcttataatccgaacagtggatggtgcagttcattacttttgctctagtgttttcagttaagtgagaatgtaaacagtcctaatatctgtgaaagaataaaactcaactcaattacctgggaattagaaccggcagcaagtaggttaccacttgatccaccaaaggagaagctgaacaattcttgagaaccccttagcaaagatatctatgcaaaacatttgaaccagtgatggttgaatttagaaatatatataattacttaaaccaattataatactaatgaaaacagctaacaaactggtcgtacaattaagccaatcgcactgcttaataatgttaaatcagtcctagtaatgttatattgaaaagatatggccaacaaatagagtatgaaaagcagtagtagatgcaaaattgtctgtataatttagcataagcacaaaaacaatatcatgacaatttataaccatatacaccgaatattgatgttagttccatgaaaaggcaacatcaattgtgatccaattatcagcagaacagagacaaacttaattgcacaagattgagtagactattagaatttaccagatataaaagttgcattcgggaaggtctttatgtgtaacaaaaggccatgcatttacattttaccatgtaaaagataaactcaaaaagatgatttcatggaaatactactgagcaagaagtgcataagctagcacagtggttgtgctttgggccgtatctcgaagagatataccaaaaaactggaacttaaaagaatcaaatttgattgtcctcaactcaacatgtataattcatatctgaccaaccatccaccagcacccaaaatatgtagacaggtctaagttgacccattaatagaagatcctttaggagaatgtgtcggggggttgcagaccacaacatcatcactaactccttttaagtaacagaactaagtatgtgatttgtcagcacattaacataatgaatagtgtggacagtctactgtacccatctcaagtactgcagttctctcatttccctccaactatcaagcaggacaaatagcactgccaactatcaatagcaggcatatctctaagactatccaaaggtggtttagctgattaggtgctaaaaatgcagtccaatcagcaaaacatggtgattcccacatgccagcctcaaattcttcatcaccctcctattaccacaggtccctgctgttggctgcccctaaacaatgaactgccatagtttctgaatgtgaggatccccatcgcccacacacagtgccatttgtgtagtcattgacacacttgatgactcctggccacagtaaaggttggcctgcttctcatgctaggccgaagctaattatggggtcctccaatacggcggcagctggcctgaccaacaagagcagggtgatgtggcgtcaaaccaggtggaattggaccaggggggagtttgtttggtattgatagttaaggggtgtcagttattccatagttagaagttgaaaattaatcaaatacatcagctggcaagagtaaagtatacttattcccttaattatgcatttgataaccagattaggaaaacagacctgcttaaagcttcttgtatcccaagctcttatagttccatctgaagaacaagaacagattacttgtggggatgatggggctgaaaaggaaatttcatggattgatccgctgtgtccagtgcattcacccaaaaattgcccagttgctggagaatataattttagtgcatttgttgacaaggaaaccgcgagcgtagagttctcctgacttgttaccagatatatgaaataagatgcagagggcataagtcctaaagcatgcataatatcagcagtacataccacatacataaaaaagatgaaaagagaaaaggatgagtatggataaataatttgtgatgaaaagagaaaagtgttattacggataaataataatgataatagagtaaatttcacaaaactacatgtttcatggttcaagttgcagaaaaccacacacattctgacacttgtcacttaagtacatatattttggtagtttagtttcacaaaaccacactatcgatggatggattcacccgtgagatgacgtggttgtttcat

SEQ ID NO: 79060 - DNA, 726 bp, Oryza sativa
cggccacaagattcatggtcggcgacaggggatcaatgtgccattgctggcgtccttctgttgtgttcttgcggggagggtattttggctatagacttatagtataactgtgttgaacaaaattgtgatattttctgtggtattaagggtgtgtttagttcacaccaaaattggaattttagttaaaattggaatgatgtgatggaaaagttagaagtttatgtgtgtaggaaagtttggatgtgatgaaaaaatcgaaagtttgaagaaaaagtttggaactaaactcggcctaaagtgtacactagccctttcacgtgtataacttttaggaaaaagtacgaattaccctcccgccccaaactatgacgacaatatgaattacccccctaaaccacaaaactagacattttataccctgaaaaccggacgaataacccccccctcaaccaaatccaaagcggcatcgtcctacgtggcattcgcgtggcaatccagtcagcaatttttttttaaaaaaggtggggtccgcctgtcatactctcacacatctctcttcccctcttctctcaatctctctctctcactgtctcggatgtcgttgggggcgacgaattagtggccggcgatgggcgcgcggccggcacaaccggcgcggcgggtgcggcggacggcgagcgcggctggtggcgggcgtggcgggggtgcggatggcggctagcgcgg

SEQ ID NO: 79061 - DNA, 7819 bp, Oryza sativa
tcgcaggttcgtccccgcgcccactgcggccgtattcagtctcccatctcccaaggcaagcggtccgccaggtccctctccttcgcgcgggcgcgctcttccagcgccgtggcgcgagcctcaagggcctcttcgcgccgccgggacgccgcctcgttctccgccgcccgccgttcccgggcagcggcggcgtcaaggaccccccgggcggcgtcgagcttcttccctagctccgccgcccggctcccgtattggaggcggaggtcgtcccgcgcctcgttcagcacggcggtggcgatgagggcagtctcccgctcctcctccacctccctggcgatctccgccagctccctccgacgggcctcgagctctgaggtgtgccggcggtgtgccttgcggcccgcctccaccatggcctccaccgagcgtcgcccctcttcgacgcgcgcccacgccgcgtcgagctccgcccgctctgcctgcaggacctccatctgggcacttaacccgtccaacaccgtggtgttcgcggcggccaaggcctgcagaaggggctccgcgctcagtggggcagcggaaggcatgggggagagctgcctcggtgagggtgccgcacggctcggcccaccgatcgacgtgccggactcggggacgtcccccgaagctggctcgtcctgagcgtcgcccgaggggtcgggcccgagcggtgcgcccgcggcctcgtcgtgggtggcctcggaagtcatcgtcgcctcgggcggagtcgggtcgggggcttggcaggccgcctggcgtgcgcgcgccgcctccgcctcccggacggactcctcggcccggcggagtctggcctcctcccgagcggcttcctcagcctggcgagcccggatggcctcctgggcagcttcctcggcttcccgaaggcggtccgcggcttctcgccggtcagcttcccgcctccgggcctccgcggtcgccgtctccccggcctcagactggccggacttggaatggcgagggggggcgcgacgggatctcgctgaggcagaagaaaaaccagaagacaaaaaacgggtgagtgaaaacttgccttgggagatgggagaatgaatacggccgtagtgggcgcgaggacgaacctgcgaggaggtcggttaaacgaccaccttggggggagatgaggtttccccggcatggttcggtccccccatcttgcggagccgcttcttctttcgctccccctcgggttgcgacgtcggcgcggtaccctccgggcgcctgctgctggcacgtaccgccccgccccctcggggaggagatggggaaggggtaccctcctgcttcctcttcccccgggcgtcagcagggcggctgctcccgtcgcggggcccagaagcatgaccccctcccggggtagattgttcccccctgcggctcacgcccgcgccatcgtggcctcgaggggcccgctcccctgacgccccgaccgcttgcatgacggtcaggatgttggcgcgctctggatcgctgcagagcgggaggacaccttgggggatgagggatgcctccacggagctgagattcagcacccgttggatcaccatcttgaagtcttcagggacccagtcccacttgaccccctggtgggtcctcatgtagtcctcggacccggtgtactcccaggcgccccgggcgcgccgctggagcggcgcgatccggcgacgaaggtagtcgccgtacaccatggcccccgtgagcccctgggatcgcagacccgccaggcggtcaagaacggcgtcgtagccgtctcccagatctaccggcgcccgccagctggaggcctgcgccgggggctggctcggaagtcggagacgcgcttcgtcggcgagaggggtgtagaaccagtcgctcttccagtcgtcccacttcttgcgaaggacgcagggaatgtagcggttcagcaccggcccctgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtagtgtggcgccgggcgtccctcacccagcgcgaccacctcccggccggtggcagattccggcatgaatcggcgcggcagcccggcctgcctctcgctcacgatgcgagaaggcggcagcacgctaccgtcgagcggtgcggagccccgtgccatgacgccggcggaggaggagcttgagagcgagcgagtgcggcgagggtagggcgcaggaaacgaggagttagagcgcaagcggcgaaggcaaggggaataatggcgagaggaaggaaacgaatctcttcctcggcgtctttatacccttaccaacgctatgcccggctcctcgcttcccgcgcccactatctcgccacctcgtttctcgcgcccacgcctccaccaatcccactcgcccgtttgcggcgcacgaggcggatgtgcggccgtagcagttgagatgggacagatcgagcgcgcgttaaccatgcgcgccaaacgcgaaaagcgccatcattacatctccaggcgaaacgaaccggctcgtcccgattcgcgcgctactcgagtaatgtagcggtcttgaagaaggccgctcattattatcggtcggttttcccttgccgatgcgcgcgatttgcgaccgctgggttcctgcccgcctgtagagaccggccccacctgtcaccaggcctaaggagtggcgtcacgcccgagcgcttccctcgaggggggcgatcgccctggcatgacgccgggggctactgtcggtgacatgggaccgagagtatcgtgactagaggcttgggcagccgcggtcacccacgtggcttgaccccctcgagggggtcgggcccgagggtgatgtcgaaactagatttcggcaataataaaagggggtggctatcaagctggaaaagtgtatgggtttggagacgaaggatttatacaggttcaggccttcttattcaagaagtaataccctactcctgtccggggatgaatccgccgagtgtattattgattgtatggtttggagaaaatcaacctctgcccctagaggcacccggaccccccttatatatgggaaggagtccgtgttacaaaagataatctatatccctaacggaatatgcagatataggtaaaatacagtcgtaaccgactaagtctcaaggtgtttccttgatgtacaagttaagaaacgaacccgagatacaaataagatattatatatatattcggtatcctatatccagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcaaatagatgcacctaattaggtgtagcccccaactatgtgattagttaacaaactaaacatatagttgagaacaaaataatagcacaatcgtgcatcatatgacaaaagcatatgcggcacctaaagaggcattctagccgactgctttttagccataataaaaagaatccgagtggttaacactctaaaaggttcacgaatgaacacacttgacaggcatccgaataaaaaactctaaagattacccaccaaatattataaaaattatggtaatgaataagtctaatagcctaagctatgactatccaccataattaaaacaggcatatgtggtgtagaatccgagtaaataaactcataaaggatttaccaaccgcctaaaaaaaatgactacaatatataatcagcctaagccataatattggtcaataaaaatgcacacttacgtggcaaaaagcaacgatattgtatccaatcaattgcttaaaaacccaaacaacaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctgagtccctaaaagaacatgacaggccacacctgaaaattcgcattgcaataattccgaagaattatatgaccgcgtaaaaaaggattttatcagcattgggcaacactattgtgcgcataagttgccaaagcaaaaaatgcctaagtccctaaggagcacaatgggccacgctgtcaaaagtattgggctgaggtactgttcaggcctaagcccattcgcacctccgatacccttaacaaaaaatcccgtgatccaagcgccacttcgtcttccccgccggaactctcgccattttccccactccctgctacagtacggagctgcgccggcaaactagggttcaccaatccactcaaatccacattcgaaaagttcatcaaaatctttcccgtaattcaccgccttaatccctcacctctccctagccatcccccgaatcaaatcagcgcattcgggtaaaatcaatggcggaagagaaagaaagctttgaaggccaatgggcgccatccgacgtgatggaggagaacctgaaggagatggtggcgcacggcgttctccctgccaaggagatcatcgggtggcggccagcgtgcggtgaggcttttccgtcccccgatacacacgaggttgtggtcttctctcatttcttttatggcggcttcgctcttctgacctcgaaatttttccgcgggatattaagcttctatggaatcagcttgcatcacctaaacccaaattccatagtccacatcgccaatttcatccatgtttgtgaagccttcttgggaattaaaccccacttcgctctgtttcgccgaatcttctttctcaaaccccaaccaaacaagagcaagccatgtgtagtcggaggggccggatttcagctgaggggaactctgagccagaagtacttctcaatgcccttcaagacttcaaacaaagggtggcatgcgaactggttttatgttcagaatcctgagcctgctcttcccgagtactcttgtcttcccccagtgtaccaagatacttggaactctcttccgattggggacgaagcagcccaagccttagagttgatggaccgcatgctaaaactcaaagaacaaggcttacaaggagagcagatcactcggcacttcatcaaatgccgactggcgccagttaaagaaagatctcgtacagcttttgagtttgacggcaagcatgatcctaatcgcgaagaaccagactccctggattttaaaatcatgaaggagagaatgtataaaatcttctcaaatgctattgtcgtcagctactcacatcagctgccagttgtgccatataatgcattcaatccgcccccgcaggtatgtatctgaaatcttcaacctatgaccaaaatagtatcttgtcttcatgttgagttaactaaccatggaggcatcttaatcaggaatatgtattgataaaatctgatcccccaatcactcagcgccggtctcctcgccagcacaccgttcagggaggtggagggccaacaatcagaccagattcgcaacctcaaacctccaatccaattggacagacaggttctcgcaagagaaaactggtgcttgacaacgatgaaggcgacgacgacaacaaatctggggacaagggctcgcctaataaactcccgaagcgtaccatgcccaggaaaaaactggctggccgtcaaatgccaaagattagaacatcttccaggtataaacctcttggtaccatttccctttgacatgcttctctcatagaaattatactaaatattgaaagaacactttgcaggaaaccatccgacatagatccaactggaaaagatcctgatcaagctgtgacagagccaaatttatccaaggatcctgagccaactgccgaaagccagccgactggcgcccatgcttcgggtgataaggccgatccgagtgaccagccgccgactggaaaccagtcgacagcagctgaaactgcaacaacccaagagcccccgactggaaaccagtcggatgcaggtcccgatcaagaaatccctgaagttggagcgcagacgacaacttcccaaggaccagagactggtaaagactcaatgattgggtctccaaataaagaacaagggtcacctcacgctcagctaggaacatcctcaggtaactcgtcttctcaagtgataccgatttaaataactccagtttatttgcctaatgtcttggaaatacatcaggaccaccgggcgatggcgaagaagaaattccccgcataaaggcggctgatgattctcgtcctcctatcttgctcaaatggtgggacgagaactcacaggttgccggcatcgtcataaaccgtcaaaaagaagatgaggaagtgtgccagctgaagaaggcgcttggggaagccactcgtattgtgaatgtaaatctttcaggcgactgcctttgatgactttgttttctttttagcagaactaaaccatgaaccatcatgcagagaatccatcttcgtaacgaagccaagaccgcaactttggagaagctggttcctcatttgggaactcttgaagcagttagggaccagctacacgaggccaaggagctcgccaaaaagacggaaaaagaattaagggagcgaattgctcagctccaggattcaaacttcgagctgagtggttcgtcaaaaggtaatcttctagatctgtcccattaatctatgctgtcataactgtatcctcaaccatttggatttcaaacagcgcaagccaccaagatggctcaaatggagaaacaaattgaagccttgaaaaaagacaaagtagaactggctgcgcaaagggactcggccttgaaggaggttgaaggtactgccagctagcaatctggacgtctctcttttaaatgcagcagattcttatcataaatgtgttttgtagatcgtaaaatcaaatctcaagctcagtttgacgtcctggttggtaagatcaagaggcttgaaggggcaagagatgaagtcgccaatgtcgctacaccactcgtccaagctatgttcctcaataacagtggtctgagtgcactcgacgcaaccgaaattttcgacaagctgaaagttgctccggatgtatatttcaagaacatcaagaaagctagaagtatgggagctagcatggcattggcgatgaccaagtccttgtacccgagaattgaaattgacgccattgatggctttgctgacgggacaagcgaagaggctgctcttgatcttatcagcaatgctcaaaacgcggctgacaagattgcaagtgacgttgtagagcaattccgcaacaacgaccttcagccgagcaacaataactctgatgatgaaaggactgattctgactgagtatgaatgtaacaaatggaggctcaatttgtacaatactggtgtatatatgctgtgcttgatagttctagccaaatctttgatttcttaaaagcttttat

SEQ ID NO: 79062 - DNA, 6254 bp, Oryza sativa
agcattggaagcatgaggtttttcagtcctcggccaaaaaaaaaagggtatcgaaactacaacttctgaatgactagtttggtacactcccaagaacactaatcactgtatctgtgcctcaccaatcagtgtggctttgtccatgtccaacttagtaatttcattgctgttgcgacccctatcctcaatttacttcacctgcagctattgccttccatttcgtacctttgcccgcaaaaggattttcaggtgatttcaagatttaggataacatattgttacctaatctggaatgctttcttattctctgtttgagacaagaaattagtgctttggggactgggcagtgctccttgtcctcttcagtagtgaggacttgtttttttttttttcctttcaggttctcattcttttgtatttgcctaataatttagagtgggacctttatcctgtttgagatactgagacataactatgggatatcgttactccgctatgcatttacttttaagtaaaaaattgatcctaagtaattttgtatatacctcaaattctcagtactggcggcatgcatgcttgtagtcctgtttattgacatatgaatgttcatttctccaattaacctacaatccttcttttgttaaggtgactaggaaacaaacttttcaccatcggagacatttccctgtcttattgcaatggaagccaagtttttccggtttctgaagcttgtcggggtcggcttcaaagcaaggacagagcgtgaaggccgtgagttgtttctgaaacttggttacagccacgaggtgcagttcactgctccacctgccgttcgtgtcttctgctttaaacccaacttaatatgctgtactggtatagacaagaatagggtacaccactttgctggcgctgttcgaaacagtaaaactccagaagtatacaaggggaaaggcatattgtacattgatgaagttataaagctaaagccagggaagaagcaaaagaagtaattaaatttgatttttagcctgctaagatgctctgtagcacatttttagtggcgcttatgttcttactgtttcattgtgttggatcatctttgtcccggtaccatacttaaaggcttaataattcgctgtatgcaatgtatgtgaatcatatgatgaaactgcatccaaaccattgggataatccaccatttccgatcataataactttcaattgtttttttgttgttactatactatccagcccaactgtcctagacattgaactcagtgtaaaacaagcttagatctttgcatttgagggcgttttttttttttactctgagctaatctgtacctttatatgtatgatgttatttgtgatagtgatgccactaaaggcaaaactcaaaactccgctcgcgaaatttccccatgaaagtaatatcttactctatttggtaaatggagtcatgtagttagacttgaaaaacatttagcgtctaatatgcacaaaaatatgaaaatttgtcttgtaaaactgaggtcaatagatttgggcaaatctattctcatatctatttgaaaagatgagcatttatattttttttagttgtttagacaatagatactacttttgaaaaactcaaaaacttgttcggcatcgagctacattgtagcatcacccaaaccactcttaatttgggccaagtttatagagtgtaagtgtttaataccttagtatttgacaatatctgaatttgaaattcatgatattttttttccaaactttaagtaaagcccagcactataaagcatactgtttccctgttttaatatatttttattaatttgttacatacttttttcctggttttaataactttaatgaacatatgagaagaaaaagtagccctatgtgtgtcctgaattcctgattgataaggaaaaatgaaggacgacagtaccgcctaattaagcaccggatggtgatttgacggaaatgtcaaaatagcctagatgaatgtacagggtagtaggtacaagtatcaaacagccggctgatcattttccataacatatttttgtcaaaattttgaaagtgaaacgcatgactaattggaacagataggtgagttgtccaatatacacgacgcttactccttgtctgcatttacacaattagctaacctgctatcaaggaaaagcatttgttcatcaagtcaatattactacgaatttctccacttaaaagtctatcaacaaataaaactgaaaaaaaagcaaaaatactagtactacaggacaaagctcatcatgaaattaaatggtgtacccctaattacaaacgaagcatagaatcgcacaaaattgtttcaaccaaccataattttttttgcgactttgtaatcgaagaagaataaagttttgtgactttatgtacacacaaattgccgccgaaaagagaagagaattaacggtgacgacaaggacgccttcctaatattagtggagtacttctaatactttgactaacaatcagcgggacacgtcatcatacatggtcaccaagtggacgtgggcacgcgccgccgccgccgccgtcgcagtgttgctccacggaggcggtgcagtcgccggcgaccttggcgccgtccttccccggagagtcggcttcggcgccgcgtcgagcggagccccacgccggcagcctggccgagaacgtgcgcatcagcgacgacacgttggaccacctcccggactggccgagccggacgctcctcccggcgcgggcgccgccgccggcggcggcggtggtgcggaacgattggaggctcgtcgtgcggcgtagcctcgccgaggtgacgatttcccggagcacgtgatcggggagcctcagcgtgtaccgctccgcggcgtcgtcggcggtggcgggcacggcggcggcggcggcgagcgagtgccccgtggtgtgcgaccgcgggaactgcggcggccggcggccggacttgctccgcagcgcgcgcttcacgcttccgatccgcatcagctcggccgcctcctccctcctgatcctctcctccgtctcctcggcatccgcgacgacgacgtccaccgtcacctgctctggcgccgccggctgcggcggcgcagccgcaacatcttgcccggtggtcaacgcatgcggcggcgccagcggcggcggcgggacgccggcgtcgaaggcgaggttggcgcggcagacggggcacgtgacgtgggacgccagccacgcgtcgatgcagtcggcgtggaacgcgtgggagcacctgggcagcagccggagcgtctcgtcgtcgtcgaactcgctgaggcacacggcgcactcgagcgcgcccttgccggccttgtgcgccttcacgtcggcgtacgccatggtcgggaacgcgcccagcacggcggggtcaagccccctcaccctcctcgaccgcgccgccgcaaacgtgaacccaccacccacacgtccaccgccgccgccgccgacgccataccccccgggcccacccaacggcccgccggcgcatcgccggatgtagatcgagaagaacccgaggaagaagaaggcggtgaccaagaccacgatcacgacggccatggacgggttgaagctcttggggttgaagtagttcgggccgggcccggacgtcgtcggctgcgccgcgccgccgccgaccagcgaggcaatgacgacggcggcggcggcgaggaggaggaggcggccattgtcgccgcggcggcgtcctcgcggcgaccccatcggagtcagtggctttctcctttgcccctttcgggtggggcgaattgatgggagcttagctaaggcgggagggagagagtggcacggcaagtgttgatacgtgagaggacggggataaaaagggcgggagttaacgaggtgcagtggcacgggcaagggtttgttaaaccaccctgaaggaaaaaacggaacgtaccccgccacccattttcctgcacaaaatgtagattttagagggcggctttagagggatggctgaggtgtaaaagatcggtggtggatggtagtgacacgtagatggtgctagagccgtgggatatgagggagggagggaggtgggacaacatcgaaggcgagagcatcaaatgtaaagtggttatcacacagaagcgacggtggcgtctcggcagaggtatcagagaagatgggtgcacctcaccactgctcggttataggaagagaagggttggaatgaaggaggccagtttggtgggccttgctagtactgtcgaggcagaagaaggctatgcacagggggtcattggtggtggtggactggtgggtgaccgggagggggatggggattgcgtcagcggcggtattggggtgaaggaaaggagaaaggaggcagtagagttggggggtatcacacaaatcttaaagtcatcctatccattaaaaaaaatcgactagtgctctcttccagttgaccgactaataataagccttgtaatgtttcattttgaattcccacgaaacactacggtggatattacttatgtgggcaccatgggtaatatgtcatcacgtgtccaaagtgaccaccacatgtattggatgagtgggatccatgcacgcataaatagccactcatcctcggtgtatctatgatcgtgattggcacctttcaatattattaactatgatgccaagtagtgagtacgagagatattcgacggaatagtttatcggtcaacttcaacccaagataggcccatgaaaccactcgaaaatgtcccaggggacttgaaccaagatgctacattccacgatcatcttaattattcaaaactcttactaatgctttgctaggccctaggaacaacgactagcctcgtactttctttacaagcaattgataatcatcgtaaatgtacaaatatggataagaggtttcaacatattacaacttgccctagaattttttaggaatccaaaaactttttttttaaaaaaaacatatatttcaaactgccctggcggtagctaacatctagtctgcatatgaaatagagattaacaaattgggcagaatctttccaaaccgtttccgtttcaaagaaacctaagcataggtgacgagtaagatggggagttctcactaaagtctcatcatcagctctaattcaaagcaatgtttctaatattaataagcgtctttggaaattaaagataccccttaaagttaagatttttttctttgatacttgcgtcgtggagtggtgttaacaaaggataatttgacaaaaagaaaatggcaaggataagaacgattgtttttgttgcaatgacgagacaattagacatcttttcttcgaatgtcgttttgtccattttgtttgttccatcatccaaatagcatatggacttcttccaccgcattgtgtagcacatatattggggagctggcttgctggaatccataataatctaaaagcacatgacctgttaggagcgtctgctactggtcgctttggctatgcaggaataatatgcctttttattaaaaaaagccacatcttcaccattgcaggttatatatcatcttatccattggcttcatacataggcttttctatagaaacctgtttcgcaggatatagtgcttgcggtatgtctacatttggagaagttggtcagggagttttttacctagggatatgggtggtgatctagtcttaagattggtggttcttaatactccgtgcttttgatggagatgataaatgaattgttcatgggtgacggttgagtcttggattgatggccctcaatactccatatcattttttttctttttaatatggatttgtatgttcgactgtgtgtatcttagttatgtagagaccgaaagtgttctcagaaaaattgtataaccttgttgtaattaattcagtaaaaacttccattattaaaaaaagaaaaggtgacgagcaaggtacgggttccatatgcacgcacgtggaacatgccaagtgcagtgcagagaccagcatcttttcttccttaattgtactcagccatgctgtgcctgtgcaacagagcaaaagcttctcctaagtcctaaatcttgttctcttctgcttgttttattgaggcttgcagctaaggctgaactgaatcgacgacgaccaaggatagcgacgacgctgacgacgaccaaaacaaaaaaacgatctttgcgtgaggag

SEQ ID NO: 79063 - DNA, 6532 bp, Oryza sativa
tctagccaggtatcccactgtccctgttcttctctttcttctcttactataacttagaacaatataaattaaaataattataacttttcaaatcatatattcaacttacgatctgtttgaactattatatttttagtgaaatcaatactttcatattcatattgactatatttaaatgccaacacaaaaattacatcccagacccacatccatcttgaggccaacactaaataaaaaagatattaaaattcatcattgaaaatcggaatatcccaccttaatttttaataaagccggtgcacccattagttatatctggttagacacctaaaaactttctatcaacttaattatattctctcaacatgtatatgggggctatttgcccatacaatttgatatttgagctttttatcaatagatgatcgacttaggagataaataaataatctttagataatcatagcatctaaattatatatatgatctatgaagtcactaataaattagagaaaaactttaaatgatattgtttttagtcataatgtgtaccccatctagtgttatttttttatagacaacataatgaaaataaaaacatgctaagttgaacatcatattgatcgtataagcatgaggtggccttaccaatataatgagtcacttccatataggaattaaaaatcatgtcatttatttcattttggtagaacatgctacgctacattgtaaactcctaacatttagtatagaacaatctagaaatgtgtatttattacatgacctctattttaatatttcttactctattgaagtgagataatttagaagagatgactttaccccatgtcaggttgtaggctcaacccacttatgttttcaacctaaattgcagagatcaaataatttcaaagatgcttcatagaatggaattctccaaaatttctttaaaaaatggacatgaaaacaaacaaaatttatctgttttttttaaaaaatggttttaaaacccattctaaatagaaatattcaaacttttagcagcgctattggaatgaaaatatgtaaaacttcaaatagcatctaacaaaaaaattggatattttgagcaaatgtttgggggtaagttatctctgtaggaaatcaaaatacccaaaattttctcataggaactacatatattatttcgacataatactttctcataaattgagaagtgtactgactcgagtaattttagtttagaatttatgtgctgcaagggtaatcagaagaaaattataactagcattcaaaacacattaaataagttcattttttgtttagatatagtaaaagaatattttaagacaaagtcatccacacatggatattcgtataaaattttacgtacattaaataagatgcacgcgcatacgcgcgggctatcttcctagtttatacaaatgattgtgggaccacctagaaatcattgacgatagaatttataaatattgacctattgttttcaaacaaataacaagctgtatctctctattgattcaacaagctcaatttgagatatttttatatttaggcaaatattcattatcatattcgatctgttccatatttgctctgtatttggattcgataatattttattttgtttctgtatgcggggttttcgattccgattccaattcagaaaagtatgaaaatgaatatgatagttatcattcgtttctgatccattttcatccctacctacggatatctgaaaaaaaaatcagatagtttaggacggttttcgattttcgcgggctactagcctgtttccctttttctttttaagaaactatccatgttcgttcccgaaaccagtgctattcaaaaaaaatccatccaagattatttgcttttgaaaatatatccgaattcaatctgatttcatccctcatcttcctcgagcatcaaattaactccatagttgagcagagaaaacagacattttctttgtcttgactgctcactcaaggcccatctctctggccaggagacatgaagggtcacgtaagccgcccaccgccggcgacgacgacggcgacagcggcgccggcggtccactgccagctcggccgcagaatcgttttcggagcatgattaggtaggcggtcaccgcgcctagcttgtctctagctaagctagctagctactctagctatgcctatgcgtgcctgcactactcacctggtccatgggccgtgggcccatgtccaccacctctacccgtctaaatttatttatgctacgcagtgacgacgacgacgtgcgtacagcgtactagtgcataagctataagctagattttgagcagaatttaagtagctaagctagattttgagcagaatttaagtatggttagccgttgcagtcagtcagtgatcagaaactcggactatatgtggtcgtgcgtgacgaacgtgctaattgtcgggtttggattagattccccggccctaattaagaattaacggtgccaattaacaatgacgggggagatcgaataatttgttggtcgcaaagtcaaaaggtgttcttggatgatgcggctctaaatagtccattactgcatatattctgtgctggctttgtttctttccagagcatggtttggttaattcgctaatccaaacacgccacgacaaagttagcagctttgcatcggctgagagacttactaattaattagttttctcttgttcattgtgaatgacccgcagagtgctagtattgtaaaatgcatattttggcctggcaaagtggcaatcgatggaccattggagcatgtatatatatacgtgcaatacatagttgatgaatagtagtagtactcatttcaaagtcctgctccagctgaattctgttctgttgcacagaggggcataggttcgcaatttcgcataccccaatgagcacgtactacgtactacatacacatacgatgctatcgcgaattggcaaatcatgcatgctgcagaatacttgcaggaacacgcacgaaaagaaacaaatgtggcagctagcgtgcatgcatgcagcgctcacgcaagcaaaaggaccaaaaacgcagcagggcgagctatagctagctaagctatggcgcagcacagcttcactgagaatctgtggcctcgccacggcaagcttatagccggccggacaaacgcgagagaatattttgctcgctagctcgccggccgcgcacggcgcgcgcacctgctgctcgctctggagcgcgcatgtgcgtctacctaaagctaagctagctgctgctacattggcacagaatgaaaaaaaaggaaaaaaaaactggcatgtcacgccgcgcgcgcctgatctgtgcatgcatgcgcgagcgcagccgcgcgggggcgcgggcggtgaacagtacgtacgttttgctgcgttcctgagaccgatcaccgatcacaactgtggccgcgcgcgccagccgtgtcgcgcgcacacgtcccataacattttttgggcggagctaggttgcacgtacacgtacgcgcgaatcgcgacggtgaggcggtggcggtgcacggtggagttcctcgccgttgctgatcatgtgggtggctgcagtggcggcgtcgtcgcacggtggctcctcgatgttgctgggtggtagtgctggtggaggcggcgacgtacgtacgtgggtggcggcgatgacgtgcctccaacaacgatgtgtgttaggtggaataatcctgcgcctgtcaaaaaatcatacgtggcactgtagcgtagcttgtcattttaatcatgcatggcactgtagcatatcttgtcattgttttggtttgttgcatgagcgcgccggcttgttcgcggcgtgagcgtcgtgtgtgagttcttggccatgatggtctggaacgcatctttagcgtgcataccgcgctagtgcttcaacgtgggatcgcgcacgtcattagggagtactggcgcgcatagcggaggccacttcggcacttcctttttcttctcgtttttcagttagcatgtaatcttctttatatatgaagtaaacagaaaacactgtaagttgttgcgcagcaccaaaaaacccgtatcgaacacttggcgatttcactattcatcgtcttcaacctccgatcacgagaggattctgcagtgtagtgagggttgccgctgacatttggtatcagagccatgtcggctcctgtgggtgatcggtcccgcccgccacactggcgtgggcgacggctctcgccgtcccctccgtgcaaccgcggccggcagctcgtcgtgcaacaggttgtcaaggaagggggctctgtcacctaccccacgctcactcgttccaattactctgattgggcggtgttgatgcgggtgaacctacaggctcagggcctatgggaagccgtcgataccggcgacgtgccctttcacgaagatcgtcaggcactttcggctattcttcgagccgtgccggctgagatgctccggccgcttgcggagaaggacaatgccaaggatgcctgggatgcgctcaagtccatgcgagtgggcgctgattgcgtgaaagaatctcgtgcgcagaaactacgccagacgtttgagtccatgcgattcaagcccggcgaatcggtggaggacttcagccttcgcctttagggggtcgttagcaacctccgtcttcacggtgacgacatgaccgaggaaaagatcgtccgcaagcttcttcgtgttgttccccgcaggtatcgtcagatggccttgtcaattgaaacattgattgatctcacgactttatccatcgaggacctgactggccggctcctcgccgttgacgaccatccggattccaacggggaagacgtgggccaggctctgctcggggaaaaggaggcacctgctcgcaacaccaagcagaccgggcagtcgtctcgtgacactggtatcgggggcgtcaacacagggtcacgccagcaagggcgcggcgggcgcgggcgcaacggcaacggtggcgacaccaagtctacgccatcacagacgggaagccgcaacgtctccaaagacaagtgccgctactgcggcaagctgggccactaggccaaagattgccacaaggcaaagcgtgatcgcgaaaagctggcccaggctaatctccttgttgcagaaccacagcaggcttgtggcgatgaggagcccacgttgctgatggcacaggtctgcgagctcgcttccgtcgacgaacctgagctgaccaatggtgaagtgcagctgaacgaggaacgcgcgctcgtttctctccgcgacgagggggagccggtcgaccccgactggatccttgacacgggcgcctccaaccacatgactggggcgcgggacgccttctccaacctcgacaccaccgtgcgcggcacggtcaagttcggcgacgcctcgcgcgtgcggatcgagggacgtggcaccgtgctgttcgcctgcaagaacggcgaccactgcgcgctcaccggtgtctactacatccccaagctccccaacaacatggtcagtcttggccaactcgacgaggtcgggtgcaagacggtgattgaggacggaatcctcaccctgcgcgaccaacggcggcgtccgctgtgtcgcgttcgtcgcggaacggggcgcctatatgtgctccaggtcaacatcgcccagccggtctccctcgcggcgaaaagcgtggaagacgcttggatctggcatgccaggttcgggcacctcaatttcgacgctctgcacacgctcgccaaccacgggatggcgcgtggcctccccgaaatggaacgcgttcgacaggtgtgcgacgtactgtgcggcgaagcggctcgatcttgtccacggcgacatctgcggccccatctcgccctcaacgcatggtggtaaaaaaatactttctcctgttaatcgatgatatgtcgcgttacatgtggctgtacctgctaacttcaaagagcaaggctcccgcgacaatcaagcgcttcaaggtaggagttgaggttgagactggcgccaagctccgtgttctccgcacggaccgcggcggggaattcacctccattgagttcgggctgtactgcgcgaacgagggcgtcgcgtgccagctcatagctccctactctccgcagcaaaatggcgtcgtggaacaccgcaaccaaactgtcgtggccatggcaaggtgcatgatgaaggcgaagtccatgcccggagaattctggggtgaggcggtcactacggccgtgttcatcctgaaccgatcgcccacgaagagcgtagctgacaagacaccctattaggcttggcacggacgaaccccttctgtgcattacttcaagacgttcggctgcgtcgcttacgtcaaagaggtaaggccacacctcaagaaactggatgaccgcagcaaagccatggtgtttcttggctatgaaccaggcacaaaggggtgcagggtgttcgatccagcggacaagcg

SEQ ID NO: 79064 - DNA, 964 bp, Oryza sativa
tattcgctctcatgcaaaacgatctatgcataaaatttcgttcttactcgcttctcttatttgagtcctttattgctttatttaaatttggatttgagcatgcattgatcctactcctttgtcttctctagatggccgaccacccacccaaccaccgcggagaaggcatgattgactttgtggcagagttggcacgtatgacgctggtggtgggctaccccaacgcgccagagtacacgactgttccacctctcagtggtgagcttcctcaccgtgtccgcctggaggtccatggctacgtgggtacctgcctagctaatatggtggttgaggcgtccggaggcatagcagatcacgcctgtcaggaggcagcatacctgatgatgcccagactacgggagcgccacaactacatcttccacgacacggcgtaccaatttcaccctcgtcgagccagcggtgatgatgtcagtaccttccgtccaacagccggtgagaacgacaccaccttcggccacatgtgcgccgtgatgaggggaatggataggatgcactcgaatctacacaaggcgtccaaggccttgaacgatgggaagctcgtgaggatcatagctctgaaggatgagatagcacgcctaaagagggagaatgctcaattgaagggtctcccagcgccaggaggagtccggatccgcaccacgccccgcaagtcgacgactgcacctgtgcgcattcagcttgcgcccaggaacccacctctgcccgcaattcccgcagctccagctccagccccagctccagttctagttccagtgccagctcccgcgtccgctctctccttcgctccagcatcggccgccaggggtccagctagtggcaacgggggttggttgcctgctactcccagtggcagtcgcgaccacagcagcagcagttccagtggtacatagccgggtagtggcga

SEQ ID NO: 79065 - DNA, 6903 bp, Oryza sativa
gccgcggattgatgatttgtttgatcagctgaaaggagctaaagtgttttctaagatagacctgcgatcaggctaccaccagttgagaattcgggaagaggatattccaaagacggccttcaccactcggtacgggctatatgagtgcacggttatgtctttcggacttaccaacgcacccgcattcttcatgaatctgatgaacaaagtgttcatggaatttctggacaagtttgttgtggtattcatcgatgacatacttatctattcaaagtccgaagaagaacatgagcaacatctccgtctggtactcgagaagttaaaggagcaccagttatacgctaagtccagcaagtgtgacttctggttgtctgaagtcaaatttctacgtcacgttattacagctcagggcgtggcagttgatccatcgaatgtggagtcaattaccaaatggaccccacctaaggccgtgtcgcagattcggagttttcttggacttgcgggttattaccgccgattcattgaaaacttctccaggatcgcccgacccatgactcagttgcttaagaaagatgagaagtttaaatggacagctgagtgcgacaaaagttttgaggagctcaaaaagaaattagtatccgcaccagttttgattctgcccgccagatgaaagacttccaagtctattgcgatgcatcccgccacgggcttggatgtgttctaatgcaggaaggtagagtggtctcatatgcctcgcggcagttgcgtccacatgaagggaattatccaactcatgatctagaattggcagcagtggttcatgctttgaagatctggaggcactatctgattggcaaccgctgcgaagtatatacggaccataagagtctgaaatacatcttcacccaaccggacctaaatctccgacaacgaagatggttagaactaatcaaagactatgacatgagcattcactaccacccgggtaaagccaatgtggtggcagatgcgctaagcaggaaaagctactgcaatgccctatgcatcgagggcatgtgtggagaattgcagcaggatcttgagcgtctcaacgtgggaattgttgaacacgggttcgtagccgctctggaagcacagcctacgctcgtggatcaagtcagagcagctcaagtaaatgaccccaaaatagctgaactgaaaaagaatatgagggtgggaaaagcccgggacttccttgaggatgaacatggcacaatctggatgggagaaagattgtgtgtacctgacgacaaggaactgaaggatctgatacttatcgaggctcatcagactcagtactcaattcatccaggcagcaccaaaatgtataaagacctcaaagaaaagttttggtgggtcagcatgagaagggaaatagcggaattcgtcgcactctgcgacgtttgccaacgagtgaaggcagagcaccaaaggccagcaggtttactccaacctcttcaaatcccggaatggaaatgggaggagattggaatggactttataataggactgccccggacatcatcgggtcacgattcaatctgggtagtcgtggatcgactcactaaggttgctcacttcataccagtacataccacgtatacgtgcaaaaggttggcagagctctacctctcgagaatcatgtgtctacatggagtacccaagaagattgtatctgatcgagggagccaattcacttcaaagttctagcagaaattgcaagaggaattgggaacccggttaaatttcagcacagcctaccatccgcagaccgatggtcagacagaagagtcaatcaaatattggaggacatgttaagggcttgcgcacttgattttggtggagcttgggacaaaagcttgccgtatgcggagttctcttacaacaacagttaccaggctagccttcaaatggcactgttcaaagcattatacggtcggaagtgccgcacacctctcttctgggatcagacaggcgaacgtcaactgttcggaacagaagtgttagcggaagcagaagagaaagtcaggactgtcagagagaggctgaggattgcccagtctcgacagaaaagctacgcggacaaccgccgacgagagctcacttttgaagcaggggattacgtgtatcttcgtgttactccactccggggagtgcaccgttttcaaacgaaaggcaagttggcaccacgcttcgtgggaccatacaaaatcttggaacaaagaggagaagttgcgtatcagctagaacttccatccaatatgatcggtatccatgacgtgttccacgcatcccaattaaagaagtgcttgagggtacccaaagaacaagccaattcggagcacatcgatatccaagaagatatgacgtatgtggagaggccagttcgtatccttgagaccagcgaaaggaggactagaaacaaggtcaccaggttttgccgggttcagtggagccaccattctgaggaagaagcaacctgggaaagggaagatgagttgaaggccacccatccgcacctcttcgccagctcctccaaatctcggggtcgagatttcatttaaggggggtaggtttgtcacatcccgaagttctttcccaagcctaaattggagttttaaatggtctcaagaaaatacctatgtcaagcaagagtaaaccttaataaattaatgcaaataataatcggaattggcatgtggaatttttcttgagttttacataccgaaatacgctaacaagatttttagtggaattttcagagttcttgaaataattttaaccaattaaaattgagcacatgcaattttaatcccatgaaaaatcctttttccttctttttcctttttctttcttttcttttctttttttttcctttgaatgggccgccggcccattcctcctttttctccccctcctcccgctggatccggccgaaggccgaggcccagctaagctgcgcgggcctgccgcccgcctcccctctctccccgggacgccgacaggtgggccccacctgtcggggtcgtccccttcctccagccgcccgtccccacgtcgccaccaccgccgaaaccgccgccgcgcccacatcccgccccctccgggccacgtcggccgccccggtcatgcgccgcgtctcccgcgcccacttccccctcactctcccgctcgcccgcgctcccgagacgaccgggattcgattttcgaatcccgcctctctctcctctcccactcacccacgtcggccggcgattcccgcctctcccggccacgtccggccccctctctccctatttaagctccgccgccaccctctctctctttttccccatttcgccgaactctcccgagctctccatcgctcccgcaccgtgcatccacccgccgccgcctttcccgctactccgggcgccgctagtgtattaatccccgtcccaggaaaagccggggtacaccatacaaacatgatataaaagacacatctttattatatcgataatatttacattattacaaaggcacttaaggcctgacaatcaaaaataaatagcagcggactagcgggcctacggctccatcttcacaggcgctcaactggggtataagccaggactccacctaagacttcttctccaaagcttctcttactgaagggggaaaagattgagcaagaatgagtacaaccacagtactcagcgagccacaccggcagatgcacgattaatgcaagggggtacaaggggtaatgatataggggttaagttttgcagaaaacatcatttaaaagtcacttagttgcccaaagccatttataaagacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctcggcttgcccataaccgagggcgcggctattcgaatagattatactctgatcagaggtgtacatctttacccacaagacacatcttcctcacgtgtaaccatgtgccacataccaccatggtatacggacggaagacgtgacatagtttccaacccatcctagccataaacaagagtaccgacccaaccccacctacggccggaacctccgggacaggtatgcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacaggttttaggggttttgaaagaggaagagaggtgtatgtccaattccaccataagccaaccattccatagtgtccaaatgatatgagaatttccaaagtctaaagttataaaaaccacctaatgttgtcctatttaatcagcgaagcatctacctaatttcatactagtggaaccatgaatagagtacccactagttggggttttgttttcctagggtgaacaaggtaataataacaatagcaataataaggtcttaacaaaggtaaataggcatggctaaataaaacagtgataacacgggaatttaaataaagcgataatgcattaatttaaatcaaaataattttataaactgggattcaatatgttcaaagatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttataacaaacattaggagacttgaacgggtcgattcagagttcgtatgaccaagatatgatcatccgaagtttaatgctgttatatggagatttgcggattattataattaggctttgcaaccataaaacatgtggaagcgctagcctgggaaaagacaggaaggctgcgctgttgacatgcggaccccacatgtcaacctaaaggaccgcggtagaccgagtacacagagacggtccacgggtcgacggaagcggaccccgtgtgtcaactgaggcgagtggccgacaaacggactccactagacaccacacgggttgcacacgtggagtccacgcggctactgagtgggtacactaacacggtcaccacacgcgcaagcgaacgactactgacaccggtacacgggtaccggggtcgacaaccgcacaacgggcacgggcgacaccgaaaggacgaggacggggcagcgagggagagggatccttaccaccacgcgacgaggcgtgggaacgacaacgacgaacgggcgcggcggagacagctcagggacgatggaggcgaacggcgagggaacgacttcggcggcgatccttggacgaaggcgagacgcggccggcacaaggcttgacgacgcggagccgaggacgaagacgacgacggggctgctgcacacttgacgaaacgcgggcggcggacgagaatggcttgacggagggacgaacgccacaacgagcgaaaccgggaacgacgagaggacgacgacgacgacgaccggagccggcgaggaggcgacgagggcagccggcagcggctgcacggagacgaggacggcgtgttccacgccgcagcaatgccgacgacggaggcggcgccgcgagatgacgagccggcgaggaggaacgatgacgacgacgacgaacaccggcggggttcggtcgaaggggaggcgaggccgagggcggcgtcgcggctgcgatgccgaaggtggtggaggtgcggccgaccggtgcacgggtgaggagggacgggcggccgaacaactccggcgaggcggatggagaggttcgcggcgatgtgcggcggcttccgggcgaaaccgaggggtggacgaggtggagggctacgtcaccgtgccgagggaggggacggcagcgccggctgacgcacgggcatggcgaaaggggttgccggaggagacgtcgacgaggaggaaggtgaggccggcgcgggcgacggtgttccggtgaaattcgggcgaggaggaggtgatgccggggatgagagcagcgtcgcggagccgagggaggtggtggcaacgtcgaccggcgctcaggcagggagacagaggcggctggaggcggccggcgcggaggaaagggaagggcgacggcgggaacgcagctccgggggtcaccgcgcgaaacggagggtaggccgtgggagaggaggcggctgcgacaccggggaaggcgacggcacggccggccggcgtggtgacgcggcggcaggggcggctggaggaaggccggcgccggagggagagaaggagaaggcggggagaggtggtgaggccacgggggggctcgggaggaggctaaaacggtagaacgcaaagagggggttccattttataggatgggggagggagccgggcatgggagagggcggaacggcgacgagaaacacggccggcggccatggttggtggccgggaaaggcgcggccgttcccgatgattgaaggcacgaatcaagggggaatttggggggaatga

SEQ ID NO: 79066 - DNA, 17225 bp, Oryza sativa
cgatggctggtaataggatgccatatcctcgtcctaggtgaaacagccacatcatctcgcgggtgaatctatacatcgatagtgtagttttgtgaaactacacaaccaaaatatatatactcaagtgccaagtgtcaaagtgtgtgtggttttctgtaacttggaccacaaaacatgtagttttgtgaaatttactcatgataatataacagcaacaacaaagacaggaataatgtggtcttgaaatctgaatggtcctttttgcatgtcatggaattcgtaataacataaaagcatacacctaatagcacaccacagttattaacatcccaaaccaaagctaaagtggtcgacaagtatcatctgaagctagtgaaatccatttaaacgggtaaagaatttgcagtctgaaatgaaccagggtgggggaagggcgcctaccaagaagctatctggaagacgtagtcgtcgccgaagttggtctggatgctgttcttgaggcccaaacgtctcgaggagatgccgctgttagggcttggagacgaggagttggacgtcgcgggcgaggatgtccccatgcataggacggcctctgcctctatctccacctccatcgccatggccgccgccgtatcctctccgcctccctccatcgcgccgcgcaatcccttccttcgccgcctgcgggtggctcgatggaaatgtctcagcgagaagggtggatgcgccttctttccgggcgactggcggcgaaggaagtagggaacggccggcggaggggccgaccacgcgacgcgagcctcgactcgcgaggaaagccgagaagcgacagcagctggcggcgtgctgtacgcgtgcgggtgttggactggtaccctgctagggtttattgatgggcgtagtgggcttggtttgatctaatttctggggtgaaactgaataagttgggcccgtcccggtagaccattggcgtggtccgaaatgaaaaagttcacccaggtccctcatctaagggttgaggttgaattgcgtctaacgtatccctcattagtacaaacaagatcctaaaacggtctggatggtggtttcagctgatgtgactggtttgagttagttctcaaactatgtgagcatggcattggaagcaaaattaaaaaaataaaaacaaaacatatggggtcatatgtcagtcaaaaaaaatagattaaaaaaaaaaggagaaatgagggaaggacggcgagctccctatgccatgcctcatcgatggtcggtagcagaggcactagcaagaagaagggagaagggggatggaggagccgtctgcaacattttcacaccctgattttcgtttcagagatttataaattatttaataaattatttctagaatttgtactaagtacacattaatttacttaatttacaagtaaagtgtgtaaactaaaatttcccaaataaacatggttggacttaatttttattaaattctttgtgataaattacagtctgaaattttatcggatttttcagagctcaatttttaattttattaatacaaagatcattttaacatttatttaaatgaaaaataattaaaatccatcatttctctctggggcgaacccggcccacttctcctcatctttccggtcacatgtttccctcttgccggcccgcttccttccctcgtctcttctctttttcttttgggcctcctccctcgctcctcccactgacatgtgggcccagacccaacaagtcagggtcatcttcaagctcggacgggagtcctagctccaccacgatgccaccctaaagccgcagccttcctccacccaattcggtcgaatccttagagattttacaaaattgtttgaggggtttttgtcccctagatctcctcttttcgtttcaccaataagggcttgttcggttggggcgggaatggccaggaccacggcccaactctcatggatcatctcggcgtggaaaggataccgactacagaaaattacgtgttcgattaagcccagtcggtattttaacccaacccatctcggtgtttcccctgcgccccagccctgaaaaaaaacatctagtccggagtgtgtggaaaataccctcgaggggaggaggcaacataacgagaggaggcgctgctgcggagcgcagcacgcggcgtgactcggacacgacggcgacggcacggtctctcctccggtggccaccttctccccggtgagttcctccccttcccctctcccctcctctcctagggttagggattctgcgagcgcgctactactgtggtggtaacaacacacggtgatggcaggtgtggcggaggacaccggcgtatcacatcctcttgccatggcagtggaagctctgccacaacggcaagggaagacaggaggacacgatttcttgatttattattgatttcttccactatttcttgatttgttcttcttcatcgcaaattgcttataattgattatgcgatatcttgtttgccagtcaagtagcttgctcttggatttgtctgagaacataggaagatttttgtttgttccttgatagatatggaatttttcatgctgacatgattaagaccactctcaattgatgtatttcacactttaactccatgaagtcaaggtttagaagaaaataccaagtttgagcaaaaagctacataagcttctattttaaacacttttcttcaaaaatgcaaacacacacaaatgagatggttttggtgagaaatgactatgaatgaatattatgcactcatttgagctagtatgatgcgtttatgcaaccccaacaatgagaactcatctaagtgctagtagtggccatttatggtctagataatattttggataagattgggatctaaatttattttgatcggttggcctttcagagaaactttgaataccataaatgtttgaattagccaaccctatcttttccgttttgaaaccatttccaaattccttttagaattaattgtacaaaaaaattgaagttaaaagctaaaacaagatacttagagctacatttttagttgaaattcatttttttaaaaaaattagctcttctttgaaatataaaagtattgagagatatttgaaacacacattgagatcatttccaattagatttttataggaaagccatagttttcaaaattttcatttttggctaaaaggtttattttgaaattaccaactagcacttagccaacttgaacacatatatgagatgtgatatacatggatatgaatgagcattaaacagtcatacatcacaacctatcttgcttaagaatgcataaatgatgactttcacatatgcaagaaatgttaattcttaaatgctatgagaatgcaatgtaacctacacaaggttaaatacaagataattcattgtagatacatgttaccgagatgacattggttctttacgtgaattttgcaatggttggctccaaattccgaacttggtgagatccaccatttcttgcatgagtcatacctatattctcattatagcacatttttgtccccaacaacattgggtccataaaggtaagtcacacaagacttaggcacccaaatgaattttgtgctagcatgtggtgaactagtcaccctagtagcacaaatgtcattttttgccttcctaagcaaatcataatcaaatgaggagtttagtttagaaatgttactcagaggacaatttttaccaatatgtccctttgcacggtaattgtagcaaagtcgattcttgtctttacatggtgtcttcttcaccacatcttgcatcttacttgctaccttgctattaagcttcttctttgatgacacagagtcatccttcatgtgggggcatgatgcaacttcatgacccttctcattgtatccatagcacttcctattgcttcttcttgttctcctctttggaagtgtggcttggtcatcaatcttgttgaaacacatcaaggcatagtgtcccactttcttagacatgaagcaagtaatgggagttttgatccaactttgaatttgtcccttaatcttgttgttggacttattgttttcttgatagaacttggtgcaagctactgttgatcccctctcaagctttttcaccatgttcccacgggtatcttgagaaggttgagcattgcccacaagtccatgatccatgtgcttctctctttttcctacacaatccaagtcacatgtagtgctcggggaaatgtttgtgttggagcaacaagtgttagcacaagtaaaatcaacttgaacatgtggctcataagattttaccgttgcaattatcacctcatgagctatctctaccatggcatgagaatctacaaggttctcatgagacacacaaaagttcatcgtgtgtttcttgtaaatccatatactttttagtgatctcctcaaattgagatttgagctcttaattttccttctccaaagatgctacacaagcaatagaattagtggcacaagcaaattcatttttccaattttttatacctcataattaatgaagaattagatcccttgagtttcttgtgtttatcggctagacccttgatttcttcatttttcttaatgaggcatgcttgttgcttctcaataaccctcatgagtttgatcaccattgttgtgtccttcttgttcaagtgatcaaccacgaagtcatcatcatcacccataaagcacatatgatcttcagcaatggaagatgaacaaattgatgatgtggattcttcaattaaccattgatgttcattcacttattccttcaaaaggttagtttcacaaatactttaggaagtagagcatccatccatatcatcctcatgcacacatttagtgctaggtgatatgcatgagtcaacaacactatgaaatatagcaatttcattatcggtgttatttgagtccaatgggagagttggaagatcatcaaccttactcaccaatttattaccttgctcatagtgtatgttgatgagatggatgatgaggtgagatcttcttggtcggaggagataatcacttgggacttgtcatgatgaggtaatgaagtagagcaattcccaaatgatgcttccacaagagtatcctctccatcacatttagacttgtcatatctttcctttagtgttatccaaatgagatgagcatctacaagtggcatgatggttttgaacacatattcactcaaagcactaaacaaaacattaatagcttgagcattgagatgtgtgcatttctcttcctcttcaaatgatagctctttatcattaggaggagaaatactcacatctacaactcgctctatatgaggacccatggccctaaacacattaagcacatgaatactccaagatatgtaatttgaaccatctaggaaaagaggttctaggaacatttcacctcttatcgacatcttctctcggggtagtaaagcccaaaatgagagaccttgctctgataccaattgaaaggaccttgatgtcacctagagaggggtgaataggcgtcacgcccagaaatttagcccaaatttccaagctattttgtgtattaaatccatgtccaggacaagacagggtacacaaaacaacaagtgataaacagatccaaacgtaaataaagcaaaaatacttacagaagaggcacttagtcctcgcaccaaaatgaaagtagcagcagcggaaaaaggcgatcctagcgaggcttcagctccactctacaggcaaaactcaactagggtctaagccttggtcctctaacttcgtcttcaactcagaagcactacacttttgaaaagggggaacaatagcaaggctgagtacaaccaccatacttagcaagccacaccaatgatgcagacgtgcaatgggatacaaggatggcttgtggctatttgcataaaggcagttgtaaaacattttattgagcaaaacagtaaaactattgattaattaaagtaatattaaatttccactaatcaacactacaccacgttgaataggcccaaccaacctacctgaactacaatgcattgggtcgatttattgagtgtgagactaatcacggtgaatctggtcgatcacccataaccgcgggcacgactattcgaatagttttactctagccagaggtgcacaactgtacccacaagacacaatccatcggcatgtcaccgtgctcggctagacatgtcaccatgtcgagtgattgtgacaagacccttcatataaccccctctgaccacagaaccggaagcgcccttgtttcaaagagaggaggacgggttattcacatttaatttgatggttataggcgaattgagaccctcgggggaaaatagggatgtctcctacgttacccataatatgtagaagtatcgacgtaatttcatagagtcattcgatctgaatgctacatgaagaacataagccagatgacggaacgtggagacctaggatgtagaagatcataacatgaacgatttggcatatttggattcctttcctatatatccactcatgtggtacttcatcatacgattcatataagatccatctgtctagagatcgtcatatacatctagaaagccgtatgctttggaagaagcttgtacagtttgggaaggggtttttttgagagaaaagaataatctatttcaaccgatatgcccttaggcatggccatacataacataggaatcacaagtggaaggggtgggcaattagctagagcagcaggtgctgtagcgaaactgattgcaaaagaaggtaaatcggccactttaagattaccatctggggaggtccgtttggtatcccaaaactgcttagcaacagtcggataagtgggtaatgttggggtgaaccaaaaaagtttgggtagagccgggtctaagtgttggctaggtaaacgccccatagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgttgtaagtaaatacgtaactaggaatatggaaaattgcatttttggaatttgcaataatgggatgggcgaacgacgggaattaaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaaggagtaatcagctgtgacacgaaaaaaaaagaattcttttgtagctcatcatttattggcaaaaatagaaaaggtcaatatgaaggaggagaaagaaacaatagtaacatggtcccgggcatctagcattctacccgcaatggttggccatacaatcacgattcataatggaaaggaacatatacctatttacataacaaatcttatgataggtcgcaaattgggggaattcgtaccaactcggcatttcacgagttatgaaagtgcaagaaaggatactaaatctcgtcgttaactgaattcagaatagaaagattcaaaataaaaaatacccagcaagatattgggtatttctagctttcctttcttcaaaaattgctatatgttagcagaaaagccttatccattaagagatggaacttcaagagcagctaggtctagagggaagttgtgagtattacgttcgtgtattactcccataccaagattagcacgattgatgatatcagcccaagtattaataacgcgaccttggctatcaactacagattagttgaaattgaatccgtttagattgaaagccatagtactaatacctaaagcagtgaaccaaatccctactacaggccaagcagccaagaagaagtgtaaagaacgagagttgttaaaactagcatattggaagattaatcggccaaaataaccatgagcggccacaatattataagtctcttcctcttgaccaaatctgtaaccctcattagcaaattcgttttcagtggtttccctgatcaaactagaggttaccaaggaaccatgcatagcactgaatagggaaccgccaaatacaccagctacacctaacatgtgaaatggatgcataaggatgttatgctctgcctggaatacaatcataaagttgaaagtaccagatattcctaaaggcataccatcagagaaacttccttgaccaatagggtaaatcaagaaaacagcagtagcagctgcaacaggagttgaatataaaacagcaatccaaggacgcatacccagacggaaactcagttcccactcacgacccatataacaagctacaccaagtaagaagtgtagaacaattagctcataaggaccgccattgtataaccactcatcaacagatgcagcttcccaaattgggtaaaagtgcaatccgatcgcagcagaagtaggaataatggtaccagagataatattgtttccgtaaagtaaagaaccagaaacatgctcacgaataccatcaatatctactggaggggcagcgatgaaggcgataataaatacagaagttgcggtcaataaggtagggatcatcaaaacaccaaaccatccaatgtaaagacggttttcggtgctagttatccagttgcagaagcgaccccacaggcttgtgctttcgcgtctctctaaaattgcaatcatggtaagatcttggtttattcaaattgcaaggactcccaagcacacgtattaactagaaagataatagaaggcttgttatttaacagtataatatagactatataccaatgtcaaccaagccagccccgacagttgtatatccatacaacaaaatttaccaaaccaaaaaaatttgtaaatgaattgagtgaaaaatcaaaactcagattgctcctttctagtttccatatgggttgcccgagactcgaacccggaactagtcggatggagtagataattattccttgttacaatagagaaaaaacctctccccaaatcgtgcttgcatttttcattgcacacgactttccctatgtagaaataggctatttctattccgaagaggaagtctactaatttttttagtagtaagttgattcacttactatttattatagtacaaagaacatttcagaatagaaactgtgaaagttttaccttgatcatttatcaatcatttctagtttattagttttgtttaatgattaattaagaggattcaccagatcattgatacggagaatattcaaataccaaatacgctcactgtgcgatccacagaaagaaaagtaagttgttttggtgaacatcaaagaaaaaacttgctcttcttccgtaaaaaaatattctaaaaataacgaacccaaccattgcataaaagctcgtaccgtgcttttatgtttacgagctaaagttctagcgcatgaaagtcgaagtatatactttagtcgatacaaagtcttcttttttgaagatccactgtgataatgaaaaagatttctacatatccgaccaaactgatcaagaatatcccaatccgataaatcggtccaaattggtttactaataggatgccccgatctagtacaaaattgggcttttgctaaagatccaatgagaggagtaacagggactttggtatcgaattttttcatttgagtatctattagaaatgaattctccagcatttgattccttactaacaaagaatttattggtacacttgaaaagtaccccagaaaatcgaagcaagagtttgctaattggtttagatggatcctttgtggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatcttcctagaaaagatgattcattccagaaaggttccggaagaagttaatcgcaagcaagaagattgtttacgaagaaacaacaagaaaaattcatattctgatacataagagttatataagaaccgaaatagtcttttattttcttttttcaaaataaaatcggatttcattgaagtaataaaactattccaattcgagtagtagttgagaaagaatcgcaataaatacaaggatggaacatcttggatccggtattgaaggagttgaagcaagatatccaaatggataggatatggtatttctatatgtgctagataatgtaagtgtaaaaatttgtcttctaaaaaaggaaatattgaatgaatagatcgtaaattctgaaactttggtatttctttttcttccggacaagactgttctcgtagcgagaatgggatttctacaacgatcgcaaacccctcaaatagaatctgagaataaaactcagaataaaaaaaaattgttgtaatccaataatcgatcttgtttaggatgattaaccaaattaatccaaaaattctgctgatacattcgaatcattaaccgtttcacaagtagtgaactaaatttcttgttattagaaccaataatttcgacaagttcagaaccatttaatccataatcatgggcaaacacataaatgtactcctgaaagagtagtgggtagacgaaatattgtctaggaaatttaagtttttctgaataaccctcgaatttttccatttttatttctacttgaatcagagagagagaaatatttctcggtttatcaaatggtgatacatagtacaatatggtcagaacaaggtgttgcattttttaatacaaacccctggggaagaaaaggagtctaatccacggatctttttccgcttcttttctatccaatttgtttatgtttgttcttattacaaaagagaacaaatcctttagttttgcaggccaattgctcttttgactttgggatacagtctctttatcaatatactgcttcttttacacattcaatccataacatccttttcaatccaaaatcaagaataattaggatttctaaaaaaaaaagaaaaaataaaggtctactaataggaaaaccagcttttccctacatcaggcactaatctatttttaacatctaattagatcagggagttcttccaattaagaagttaagctcgttgctttttgttttaccagaattggagccaggctctatccatttattcattagacccagaaaatcagaatttttttattccattccaaaattccaaaataagaaattgattttattatgacatgctattttttccattcattacccttgaggatcagtcgcggtcttatagactctaccaagagtctggacgaattttttgcttcatccaagtgtaaaagatcatagtcgcacttaaaagccgagtactctaccattgagttagcaacctagataaactaggatcttagatacgatcgaaatccaaaaatcaatggaattacaccgcacacccctgtcaaaatcttaaaatagcaagacattaaaagaaagattttatcaccattgaaaacactcagaacaccacacctcaggtttcacccctactttccacgggcagcgggcaattccctctcgtgcctaggtgaatctaaaagccgcataggccgtcgtagggcctatccgaactccatcacgctcacccttgcctggatgcgtcaaccagaggaaagctatacttcaagttaggcagttacccattcccgcttgtggcaagcgctgtatgtcttccagtgtatcccacgaaccggaccttaattgccatgggtgcgaccagcaaaaccatgcacccacagcccaccattcagtcgcattttaattggataattatgaccaaagaaacatggtcggatgtcccaagcacgcagctcgtcatgatattaaaaggtctaatactacaattatcccatcaactgtgctagtggtaattaagcatggctaagcaaatggttctagctaggtcaacataagtaacacaatctaggcgatttattcacccaaggttgacaaagaacatatatcaaataatacggcacaagcaagcaagtaggtaaaccctgatcccatgtaattagcaaaacatgcatatgtatttgcaaacgataaaacatttataaattgagatcaacatgctcaaggggaatgtgtgacttgccttgcttcttcacaacaaccttctgatctcttttccttgcgcctgcgatctttcaaaacgatggaaactacacgctggcacgcaaaacgaggaaaaactttagtaaaaaccaagcaaacagtacataaaaaagtaaacaaacctgtagatctcaattttagatgaattttacaagttgaatggctcaatttggagttcatatgaattagatatgaatgttagaagttttgagccatcaaataaatttctataattattaactgaatttattgcgcaatttaaagtcatttatgacgtcaccgaggggagaggggtagcaatgacaagcaggccccacctatcggtggctaaaaggggtgggcgcactgtggaccgagtccacgcacgcgtgtccgtgggcacaccacgtggcagccacgcggtggccacggtggaccgacgtgggagttggcaaggacgtggcgccgaggtggcaccagcgtgggacagcaccacgacagccacgttgacggcctcgggtgaatccaacggtgcttggcggctgccgggctcggcacggcttcaagccggccagccggcaggggagcggcggcgcatggcccgatggtcgccggcaacgaccactggcgcggcggcatgcacgggatgcagcagagtgaggctgggagggaagggggatgttcaccgagcggacgggatggtgaggcgaagacgggaaggcggcctgcgacgaggttaggcggcgtcgctcctcgggttggagtcggggatgacgctccgatgactcccggccgcggctgtaacatcctgaaaatgtatcattttctaatcttgcatcatgctgattcttatgttcttaataaccttctaaacctaggaaaatataattagcgggacctcctaaaactaacttgcataaaaacatctatggtatttaatcccttttgtgtttttcatttaaaaacatatttatttcttgttggaattctattttcgaatattaaaccttctttcgactaaaactcttttattcaaatttagtttgaaaaccatttttactattatgaattatggtccaagaaatcctccaattttgccttgaacctaaaccaaagcagttccaatctcattggaattaattgttagcccatcctttgatcttaaacccatcctttattctcgatccaaatatccaaattcctccttttgatctagccaccaatttaatttctgtggcttgatttcctcttcagcacaagaatagtattatttcaaatattgtgaataattgctcttgtgctaagaaaattccaacttatactcttcattcaccctttttagccacaaatatacataataccaattttagaatcggtatcctatttattgccttcaactaattcccttctatattctcaaaaatattttgaggaatattattaatttcccttcctatttgagtgcttccaaataaattccctccaactccatctctaaatattgcactcaaataaataaattaagaaatctcttttattaattctctccgaattcaaattcttcgcaaacctagttatccaatcaagtattcaaattagacttcctttctttttgtcatcgggacgaaactccattctttcttccttttggcccaatcccttttcttttctattttcctcctccttcttgggctgccggcccagctaagccgagccggcccaaaccagcccacaccccagcggagccgcctcctcctcccgtgcgcgtgttgcgcacggcgcacaccgccgccaacgccttccctcgctgcgaagttaccggccgccgtcattcttttcttcacgctaccgttgccgtgtcttcctcgacctcctcctccgaaccgcctctcacaaccgcccttccctcctataaatagccggcccttctctacacacaaaccgaactctctctcttctctctctcccatgccggccaccatcttgccatgcccaatctcctttaccggagcaacactaaccaaatcctcgcgccaccatacttgcccccctccgacgaacccatttttctagtttcccctctcctttagccatcctataagccaccatcaccacttcttttactcgccggagttgagctcttgtcgtcgccgtttcggccatctccctcgctctctctgccagccaccgccctccccgggtgcgtcgtgctcgggaacacgcatggacgccgacgtcaccgccctccagccaccgaagcgccgccgccccgattgccttctcctctctcttctcccagctctctctggaacagagaagaagaaaggaacgggaggaagaaggagaagaaaaagaaaaagaaagactgtcaggtgggcccctgcacagtgacttttcttattttctagatttaattcaaatcctattctttagaagcccatatctcctaaaccgcgtgcataaagcgcgcacgtgttctattacgtgcgagcgccagtcaaatttggacataaattcatctaaattcaaactcttcattttgatatcaaatttgctattttaagattttatttgaatttccttaatttattcaaataccatttgaataaatatttgatttaatcttataattgaatttacaatttaaacttatatttgctttccaaatattttcttttatttccaaaataccctttagccactaaaaagccgccggctttacgccttccatggggacgtttgcgcggtctacggacctcaacgtcaaaccgttggttgtaaagcccggcaaaaaccaaacctaaggtcgaagtgctgctcctggcaccccacgccttgatgcgtacagcggtcagagcttcactatccccttgacctccattgcacgccgcacagttagctcttgagctctgtgtgatcctagccgctccgccgctactcacggttgacggagtaacacttccaccccactaaaactgcacccacctcctattcttctagccgatatgttgtctatcaacacggctagaaatgataccaaacctagttgtcatgctgtccaactctagcgacgactagcgaacacccaaaaccctagccaatatttatcctacctcgatatcggcctaaacaactaaaccctagccactattctacaaaagctcaaccttcacccatattagccacatgcctatttaaccatatcaactatctagtatatttcctatcgtccaaaccacgagagcctccacaaaaaaatatagagcctagccgatatgctatcctactccacaaacgactcccatacaactaaaccctaggtattatactacctaaacctaccgctagcaaatactagccccataatccctataccctataaaagatataggttataccttaaaccctagcccttttagccgtttatcgttttcttaccattttatggcttttattgaaattagttcttcctctttctcagtagagtctattgtcttttggatggcaacatatggtatttcgagaatcggataatcaggttgcctatcttggattatttgcgttggagcaaggcaagttattattcctccctttgagcataattatcctatattctacattctattctatgcattagccatttatgattttgaatgcataatctgaacatatagcaaaccagttatatgctagcttttgcttagccctgcctagttagactgcataaaatataatgaacttagattgggacagtacgtaagatttggttgatttgcgggtggctagtactgtctcagtcgatataagtttaccaagtgcttatgtcaaacgaacgagtacgaccgcagcttctagaatggggacagacctagatattatgttaattaacaatgtggtacctctgtacagtggttcttatgtaagtcctcgcgaaggaggcaaatatatgctgagcagggcaaatgtgatatttaccgaggcgcacataaatatcttgattatcgcgcgatgtttgtgtgattttatggaaacctggttgagatgacgtggggtctctcctccagttctctctaaaaacctcgggaactccagaactcctctcgctgctgataacgttacgttcagagcgcatggggactagagttcatggaacaggtgccacaattgttaataacttaatactgggccatgactaagctaatgattattagcaagttatggactgcgggtaaagcgtacatctactgcagtatgaatatgtttaaaactattcgaatagccgtgctcacggatttgagcatcgggactgatatggtactttggttagaaatataattcaagattttcttaaatactgctgcatatcaagcatttcaggatttctacctctttattctcagcattctgcaagtaaatctagctctacacagatattacctctcatgcattcattgttgaataatataatagcttgctgagtacgttgtactcaaccttgcttcaacccctctttttcagagtctatttggagtttttgccgaagctgggagttcaatcatataagttagtttcattctaacttaattttcaagtatagactagatacatggtttaagtctatagcaaaacattagagttaagccattctatagcttctgctgaatagttagccacaaacttgtaaatatcctattattttatataaagatatctctttggagtctttaccaaatgtatgcgatgaagatccagattggttgaacctgtatcaatctactgatccaaggcttgatacaactaaaca

SEQ ID NO: 79067 - DNA, 825 bp, Oryza sativa
ccgacgaacttggtgatgttggggtggtcgatcttgtgccaggcttcggccacgcccctgagcgacgcgcgcaggtgggcgatctgctcgggcgtcgagaacccctccttcccccagtcgaggagcttcacggcgacgtcgcggccatcgtagtccgcgcggaacagcgagccgcggaagccgtgcttgacgggagcgccctggcggatacgcagcctcgagaggtcgatctcccacgccgccttgggctcgtcgccgccgccttcgcagccattgttgctgctgctgatgcccttgcccaatgccctagcagccatcttctcctcgagctccatatccaacagtgcgaggtcgaccggcacgcacgaacactgtaaaagtgcgtaagcgttctcacctcgtctcgaggccgcgtatgaatatttatatgttgttgagaagaaccctcaacgtggcttacaagattgaatcagtttggatccgattacaagagataaaacattgtttcatgtgagaaacaaactctagacttatctctaagcctatgcaaatctaaaccatactttatctctaacagcccccctcaatcataacttatctaagttaagattgtatacaaaattcttgaattgttgagctgaaagagacttagtaaatccatctgcaatctgatctccagaagcaataaacttaataaccaattgcttttgagccactctttctctaacaaaatgataatcaacttcaatgtgctttgtccttgcatgaaaaaccggattaactgaaagatacatggcttccaaattatcacaccacaaacatgct

SEQ ID NO: 79068 - DNA, 26600 bp, Oryza sativa
agccgaaggaggcgacggtgcaccgcgaggaggtcgggaacggcggggatcagcgaccggaggtggcaaacggcggcggtctcgggttgatggcgaaagtggtgcttcggaggtggactgggcaaactaagtggcagccggccttgcgcttgcgactgcgaagccaatggcgcaagcgatgagccgcagcgacgtttgaagcgtcggtggcgcgcggctggactcggtggcagcggtggaaagaggtggtgcgcgtggcggcggcgttacggaggcgaagaggggaaatagagtaggggccagggtagagcttggcacagcgatgccgacgacacaaacggcgcggcacggcggcccctaggatggtagtagcgggcggctggtggcggtgaatggcggtggtggttcgagttggcggtgggatggtggttccggcgatggaatggggaagcggagcagaggccggggtgcagcacggtgaggtgaagccgacggcacaaacggcgcggcacggcggtggctacggcgactgcagcatgcagctggagctcgccggtgggcggcggcgcgcggggtggcgtggggagagcgaggaagagtgagccggggctttggaaaaatggggaaaagagagagggagccccgaggagcatttttataggctcggggaggggagaacatggccggaatgggcggcaacgggcagtggcgtgggactccagcgacatgggtgagtggcggctcggcgtagggctggttcccgcggggagagagggggagtggggcgggatgtgggcgcaaggtggagaggactcgggtccacgccagttgggacgaggggaagcgcggatcggcgggaggggtgggcggcgtggccggaggttaggaatgagcccgacaggtgggacctacctgtcggcggctcaggggagaggaggtaggaggagacagctgggggaggcaaactagactcgagagagagaaccaagcgggctgagggaggggaagggagaatgggccggtggcccgaggggaagagggggaagagggtggcctggctgggaggggaaaggggagattgggccgagcccaaagacaaagaggggattttaatttcttttatttttatttaaatgagtttaataaactttgtgactttaaacttatttcttgagctccgaaaattcgcaggaaatttcagagagttcattagggcacaaagaatattacaaaatattctcggtcaatgatttttaaaggaaaattttaatttcccctataatttcacttgattaaattgctttaatttttatttaatttctagaaggtgcattatttaatgatttttaatcccgaacgaaaatcagggcgttacaataggcgttcctaaaaaattatcacacttcatagcatattggagagatgagaacttttggttcaaatcggaacttccagtataggattggaagttccggtctcaagcaaaaagttcggcggataacgaaataaaacactagctatgaactcgtagctcgaataaacaaaatgtatatgaatcaaatggtgacaaataaggtatctaagcaagatataaggtcaccaactatattaattaagcatgcaagtagatcaggtaaaaacaagatcaagatatgagagatggctagaacgagcaaaccaagagaggagacacgttgatttgtttcccgaagttcggatccaaggatcctacgtctccgttgagggaccataaggccgggtctatttcaacactttcttcacgaggttgcacaaatgcaatcatcggtttcactcttgatttcttcccttgcggaggcgaaatcgaagccttcacaaacttttcatggcacaccacaaccttgggtgctcaccggcaacacctagccgtctaggagaccatagtccccaagggtaaccaatacaatcaaagatttgcttgctatgaactcgagtgctcaaagtatggagtgaagctcactagctctcaacttcttaatctcttaatccaaatctctccccttctcaaatccctctcacaaagaggcaccacataaggtagggaaaacggggatggctctttggttttgaatttgtctaatgttgcccaagaacagcagccactcaaagaaagagtggaggagtttatatacccgagcccctcaaaaactaaccgttggaggccaacactgtaattttcggaatttctaaaatgcattttcggataagtccaaaaacttacagaagccaatctcagattcgcagccattttcaaaatttccgataattttcggatatttccgaaatattttcggaatttcttttagtttttcggaatttccgaaaagcacagagtaaaatgactattacttttcgctcgggagtccattttagatgatcttggactctatggaaagctcattcagaggactacccaactcaaccaaaaacaaggtctaaaaccactcaaaggataggttaaagcttgggtttctctcaaggtagcactacgataggtcactttgagcaccgagacatacacaaatacctcgacgttgcatccctcttaatagtacgacattcctaaactcaaatgtaaataggaagagaattataccaatagggatgccttctttacatctttctttcattgtcttaagggacgccaatgccgaaaccgtttcaccatatattctttaaatgattgatgcggttacttgtagcttcaaatggtctcgcacggtccatcatgacaaagccgtcactcttccgtcaccaccgatttggttcttcggtgccaagccccttgcttgcccttcaccgccgcatggtccatcgtgaccgaccatcgcttgcccttcaccgtcttgccatagtagccactttgtatcccacatcttcaatatcttcactttgtcattcttggtatcgttacgtgtaattatatcacttgagcatcaacacctttgcaatccttgggacctatttctttcattcaactcaataaaattattagtcccaatgatccggttgtcaacctccacatgttgaccaaccaatcgcatgtataaaatgatatgaataaatgatgagtatttatcaacaccacaagtgtcatatactcaaatatatgctcaaatgtaaagatcccaattaaatgaaagtgaataacttagatcgattacaagcataactaaactataggatttttccccctaaatgcatgcatacaaaatgtttgtgtgaagcaagagtatgcataaaagaatgaaacattaggagcttatcctatacaagaatcgaaggcatttatcaaatataggcattaaaataaaaacatacatttatcatcttcatgttctcaatgtaaagagaccaaacaagatatggctcaaacaaagcattagtctcacatgcttatgtaatcacatgaatatatatatatatgaatatagcaatatgtgcacggagagaaagagtgacatatatagcttgatctccatgcatttcatccttgtgatttaggtacatcatcaatgaacgtttctttctccactcatatgaagtccggatatcacctctcacatattccactttcatatccatatgagactagtagacaaagaaatgcttataacaatgttggtctcatgtaattggatttgtcattaatcaccaaaaccaaattaatggcacttgaactttcaaaagaaaaagagaaaggaaagatgctcatgtgattttgcaaaaggacccgtgtagtttttagaaattaagtgcatgttcctttgcataggaaattttgccttttaaaccctgatttttccataatttacacaattaaccctctttattgggatatttgtttgaatggcgtacgaaatttgcaaatatcaccgaaaatcatattctcgcatgaaaggggccacgagacattgaatttttacctcgactttgcatttcaggtacctttattgctgatatatatgattatgaaatttatttatcgcatttatgattattgattatttgtaatgctttattgcctttagttaatatctttgcagtaaaatgtatagaattgcatagaatacattgaaattatttgcgggaacttttgtgtatcattatttgcaacaattgtgcattcttacctgaatgtagttttgcgcatgttttgaatataggaaaatggctggcatcacgaattagaaaatttgctaaatctagaatatctccgacatatttattcaatgtcgaaattacgatagagcaggaagttctacggtaccgttaatccaatcgcgctatgtgcattgactcgataagtttgatccagcatttcaatatctcaccagtgcttctaagctactctcatgaatgagtatgctagacgactaggcgcgttagcatttagaaggttatggtgcacaccctacctcttgcagagcaagaactatcagcaagaatgggtattttcgactatgattgactaagaaaatgaccaagagagtacggtaattcggtgcaccgaacttgcaccaggtaccatggaaactctcaatgattctacccgagcgtcacaaaagtcgtacgcaagcatcactagtgcacatttataggtgacttatgatggttgtatggtggttaaacactcacaatagccattgggagccaaccaggaagccacgcgtggagggccaactaccacggcgaggatcttggcagcggcgctggatccgaccacaggctcgctgcccctccccacctcacgcagatcagaggagaccgatgccgccgttgctggagccgaagacgaagccggtggtgattcacgcgtgttcggcgtcgcctccctcagcaccagcatcatgtactcattcacccaggtccgtgcctcccctcctagtcccttgcctcgcccagcccgctgcacacggggatccccggggcggcgagtcggcaaacgggggcaccaccgcaaccagctgcattgcctgcacgtgtaacataccgaaaatttgctattttctacatatgcatcacgccgattcttatgtttttaataacttcctaaacttaagaaattataattagagggacctcctaaaactaacatgcataaaacccctctttggtatttaaaatctttcgtggttttattctaaaaattggtcttgttaaattgaggtattctctttgatttgattttgcatcttaaacgttctttcgaccaaaattttctttatttaattttagtttgaaaatcctttttacttttatgaatcatggtccaagaaatcctccaacaatacctttgaacctaaaccgaagcaattccaattttattagaattaattgtcgacccatcctttgatttcaaacctattcttatttatcgccaaatatccaagttccccattagcctcgaatacttctccaaatccttgctaaataatttgaggctaacatcctatttatttcccttccctctcaatcgagtgcatcaaataaattccgttatattctatctctcaaaagattgcactcaaataaattagaacatccttattttaaaatccctcaccatgtatcaatatctccgaattcaaatcctttttaaatctagccatccaaattcctctaaatcaattatttgaatctctagaaaaattagactttcttccttgtaattttgggccgaattcttcttcccactcaggcggcccaagtcggcccagctacccctcccagccacacagccgatcctcctccctgtcccgtgggcgccgccgccgtgtgccatgggcgcgcgtggcgcacgggtgcacacgcagccgctgccgtcgcctgcagctttgccgccgtctttccttcgccgctaagcaaccgccgcccgacgtcagcgccacctcacaccgctgacgccagccactgcaccaaaccgacatgatcggccaatcggatggaaggaccggtgccgtcgttctcttcttcacgacattgccgccgtgaccaagacgacgacctcctttgcgaaccgacctccaaagcctataaataccggcaagccgtccctttttctcccacatatccgaggtctctctctccctctctttctctctctttcttcctcatgaccggctgccgccaccgtcggccgatctccttcaccgtagctccacaacccaaaccctcgcgccatcgggcttgcctcgacgaggggaatccatttttctagtttcccctcttccctatccactccatcaagccaccacaaccacctcccttgcagccgaagagaagctcttctactcgccgttccggccaactcctcctctctctcggccagccaccgacttacccgggtgcgcgtcgctcgggaacacgcttggccgccgccgtcgaagccgttccaccatcggagcaccggcgccccttctctctctctctttctctctctctctctctgttgttacacgggaagaagaagagaaggaagaagatgacgggaggaaggaggaaaagaaaaagaaaaagaaagactgacaggtgggcccctacacagtacacttcatattttctagatttaattcaaatcctattttttagaagcccatatctcctaaaccgtagatccgattccaatgaaacttggacctaaattcatctaaattcaaaccctatcttttgacaccaaatttgctattttaatattttatttgaatttattcaaatattgtttgaatttatatttgccttttcaaatatttctttttaacccagaatactctttagccactaaaaagccgccggttggaactttacgccttccatggggacgttcgcggtttactatcctcgacgtcagactgttggttgtaaagcccggcaaaaccaaacctaaggttgaagtgctgctcctggcaccccacgcctcgatgcgtatagtgctcggagtttcactatttcctcgacctccacagaacgccgcacagttagctcttgagctctgtgtgatcctagccgctccgccgctactcacggttgtcagagtaacacttccgccccactaaacccacacaaacctcctatccctctagtcgttatgctgtctattgacaccggctagagaagataccaattctagtcgttatactgtccaactgtagcaacgactagcaaacaaccaaaccctagccgatgcctttctaattaaattccaactaccatccaaattccatacccacctatccaccatactattaactacctactcttctagaacctatacataaaatatagaacctagccgatatgttgccctactccacaatcggcttaaatataaccaaaccctaggtattatactacccaaacctaccaccagccaatactagccacatactcacttaaccagttatatatcccttactctccaagcaaccaaaacccacacataaaatataaacgacatgagttgcttgatcccctctccacctcaacctccaaccctctagaacctccacataaaatattaacccaataatccctataccctaaaggagatagattataccctaaaccctagctctctttagccgcttatcgatcttttgttattttatggcttttattgaatttggctcttcctcttcttcagtagagtttattttattttggatggcaacctgtggtattttaaggatcggataatcaggttgcctaccttggattattcgcgttggagcaaggtaagttattattccttcccttgagcataattaccctatattcttatatttctattctatgcattagtcattcatgattttgaatgcataacctgaacatagcaaaccagatatgctagctttgcttagccctgcctagtaagtctgcataaaaatataatgaacttagattgggacagtacgtaggaattggttgattttcgggtggctagtactgtctcagtcgatatagttattaccaagtacttatgtcaaacgaacgagtacgaccgcaattctagaatggggacagaccttgcaaagtaggttgtctagcaaaggtggtacctctgtacagtggttcttatttaagtcctcgcgcaggaggcaaacttatgccgcgaagggcaaatataacatttaccgaggcacaggtagatgatttgttgagctcaagtgtgtgtattgtgaaaacctggttgagatgacgggggtctctcaaccagttctctctctaaaaacctcgggaacgccagaacttctctcgctgctgataacgttacgttcagagtgcatgaggatgaaagttcatggaacaggtgccactgatgtcagtaaccgaaaagctttgccatgactaagctaatgaatattggtatgtcatagattgcgggtaaagcgtacatttactgcagtaaaataaacatgaatctatttgaatagccgtgctcacggaattgagtatcgggactcatatggtactttggttagaaacctaattcaagattttactaaatgctgctgcatttaaaacatcaggctttctatttctatattctctgccttctgcaagtaatcgtaatcctactcaaatattaccttttcatacattcattattgaatataatagcttgctaagtacgttgtactcacccttgcttcaaacccctttttccagagttaaattgaagttcttgccgaagccaggagttcaatcatataagttagtcttatttcaacctagttcacaaatctaaattagttagatggtttaagtctatagcaaaatattagagttgagacactctatagcttctgctgtaatagttagccacaatcttgtaaattcccctattaatttatgtaataacatctcctttggagccttgttcaaatgtacgcaatgaagatccagattgttgaagctgtatcagtctactgatccagggtttgatacagttaaacatgtcggtttccgaatcattagttttgagatccgacagcacgtccggctcgcttcccccgtttcgttttctgatgctgttttattttgggggattcttgaattgaggataaagggatgacatggaggtgctcgacgagccgctctacgctaatttcctgcaagtcactggcgtcgacaggccatatcacgcggagcttctttctaacatggtaaaccttgacaaaggtttgaccattactacttattgacggtcgttagtataacgccccgattttcgttcgggaataaaaatcaattaataatacatcttctagaaattaaataaaagttaaatcaatttaatcaagtgaaattatagaggaaattaaaatttcctttaaaaatcattggccgggaatattttgtaatattcttggtgccctaatgtactctccggaactttccgtgaattttcggagctcgagaaatagttttaaagtcacgaagatcatttaaccaattaaaataaaaagaaaacaaataaaatcctccctcctctctttgggcccctttcggcccaatttcccccccccttctctccctctcgggccggccttctccctcggcccgctcggctctctctctccctcaagtctgctttacctccctcgcccgttttcccctctctctctccccgacaggtgggacccgaggccccacctgtcagctcctcctcctacctctggctggccggctgcaaccgccagggcccgccgagccaccccacgacgccgccgtttccgacctcctccaccccgcgcgcgagcccgccggtcgtgggaccccgtcgccccacgtcctctacccttttccccactctccccacgaaaatcgccgccggttaacctctccaccacccccacgatgccccggccatctcgccagccggttgccacctctctcgagcacgatcccgtcgctccaagcccataaaaagcatccccggcctcccctattcattttccccaattcttccgagcttctcgcgccctgtactgctctcccctcgctgttcccatcgccgccgctcacccgcgactctccatccgctcgccaccgctgctacagccgtcgccgtgctgttccgccgccacctgcggcttcgccgtgccttgccgcacctcggccccgctccgttttccccattccatcgtcggaaccccctccccaccgcgctccctctctccaccactcaccgacgagctccagccgccgctcctcgccgctccagccaccactgcgccgtgccaccgccaccgccggcatcgccccgccgagctccaccccggtccctactccattttcccatttcgcctccggaacgccgccgccacacgcaccacctctctccctcaccatggccacctccagccgcgtcgcaacgccgcttcggtccttgccgacccgcgtcgtcgccttcctcggctccgcagggacggggagatccttggccactggccctcttcgccggaaatccgcccgagctccacctccctcgtcgccggtgagctcctcctcgtattgtcgtggtcggcagtcgtttccatttacctcgcaccagttctcacctccctagcccctccttgattttcctcagaccgaggccgagcccgtcccccccttcctgagcgacgcccgtcgccggagctccgtcgcgccgtcttcccgaggagccccgctgccaccgttccttgccgtcggccgcccgtttgccgtcgtgccgctcggtgagcactcccctccctctccccttcctccccttcgtcggccacctcctgtgcctgctcacaacgcgccgccgtcgccggtggccgtccgaccgggtcgccgccgccgcgctccgcgccgctgccggctgtgccgggcagtcggctgccgcctcaccttaccgcgccgcgccgccgctccctagcgtgcgccgccaccgcccgcatgcgctgccgctccccgcgtcgtcgtcggccgtcatcaccggtggccgcgctgccgtgcgccatcactcggctggccggctttgagccgtgaccgtgccccagccgcgcgccccgtggccgtccgatcggcttaggccaatccaggccgtcggttcccgtggaccggcggtggaccgcctcggtggtcccggtccacggtggaccggctcccttgtgccactgaccggtggggcccgcttgccggcgccgcccctcccctttgatgacgtcagcaaccctcttttcctttggaaaaataaataataattgcgtcataattcgttaataattctagaaattcatttaaatggctcaaaacttctaaaattcatatctaattcattcgaactccgaattgaaccgttcaacttgcaaaattcatctaaaattgagctctacatgtttgtttagtttttatgtactgtttccttggtttttattagagttgttcctcgttttgtgtgccagcatgtagaatccgtcgtttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgttctttgtcaaccttgggtaataaatcgcctagcttgtgttactttgatgacatagctagaactatatgcttagccatgcttaattaccactagctcagttgatggggtaattacagttttagaccttttagtatcagaatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttatcacaagccagcgtgggcaacggctgggcttgtagtgtagctttcctctagccgacgcatccaggcaagggtgggcgtgatggagtttcgatgggccctgcgatggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcgtcgcacggaaacgtgtcgtggggctgtgtcttgtgggtacagttgtacacctctgatcagagtaaaactattcgaatagccgtgcccgcggttatgggcagtcgaccagattcaccgtgattagtcccatcttaacaaatcgactcaatacacaaatcgactcaatacactgtagttcaggtgggttggttgggcctgttcaacgtggtgtagtgttgatcagtggagattcaatattactttaattactcaacagttttactgttttgctcaataaaatgttttacaactgcctttatgcaaatagccacaaacccctccttgtatccccttgcacgtctgcatcgttggtgtggcttactgagtacggtggttgtactcagtcttgctattattcccccttttcagaagtgtagtgcttctgagctgaagacgaagttagaagaccaaggctcagaccccagttgagttttgcctgtggaatggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctagacagggatttaatacacaaaatagtctggaaatttgggctaaatttctgggcgtgacagttagcgatcagtttcacccgtcaatattactaaaataaaggagaactagttatgcttacaatgcatattcatgttagaataagaaatattccactagcactaggttttctaaccttttgtatagaatgagaataaatggaggagaatcgatagcaaaatagacgatcaatcaatccgacgctgtcgtgaatcagacttagaggaagatgggccaagaactcagaaataacatactcacaagtctacggggagaacacacgaggagaccaccagccaaaacctgggctggttgggccgacccctggttcggccaaacctcgggtttggccaaacccctctcgtagccgtttgatccagggctttgcctggacgttgtagattagaccccaatgacggttggagggtatttctgaccattccaaccgtcacaaccgtcattgggaggctataaaaggggctctcatcctcacttcttccacacacctcaagcgggaagaatcaagctctctctctagtttagtactagaataggaatagaataggagtcttaattcgagaagtcttcagaaggattcgggtatggttctagtagctctgctctcttttgtaagacttatactttatttagaatattcttctttatactactctggtattgtattacttttcgagtatatgtataccaactttattatatattcaagttatattgattatgatgctagcttatctgggaaatgcaatggtgtgggtataatgatcgtgtatacgattgctctatgtcatgacgatgatattagagtagtatttggtaatttaagcgtagtgtttagattactggatatcattattttgggttatatgctgcgaatacgtcgaggtgggctgctgatgctgacagctcagtacgggtattccatcgcgcgtgtatatagtcctaggttactttcctggggaaggtactcctccgtatttagccccataatataccatgagtgtttctacgccattgctggaaattatatttctagtaatgtcgttaagaaataccaacactactccaatcacactactactatttccaatcacactactattattgctattggagaatgaaattttttgttgtgtgatctttgcggcatttagtaatggatgttattttgaagtagcggtcgtttggaattgaaccaaatcagctgtaatcatgctcttatgacatgattaaaagaatggggaggtggattcgtgaattacctttttctctttttttttcttctagcactttcatggctatttggacctttctgtcgaaatgttctcaatgtcttaattagactatttccattttaatatcgaaaataatacagtgcaccatattcgtgtgtgctattttaaaatagctctgctaagttaccataaatttctatactatcaatatgcatgcagcatggagccttctatataatagaatcactaaggaatacttctagtctgatcctgatggtaacaaagttatcagtgaagtcaccttttgggccagggaagagaatatattgttactacaaggtagatttttattttctaaaatgttgctcaatgatatataaatgatcccttaatcccttaatcttttgtttgtagcacattgcaaaacaacacaatatcagttgcatgtagctagaataaggttaatgtgctcttcttctcgattattccttttcgttccataaaatatgtatgattagtcacagtggcatctaacttcttccctttatgaaggaatgtagaaatatacttactcagatggagatatgatggctaactgcttactattgagctgatgtatttctgaagtagtaaagtcgtcggtaggatgtttcaaagaaactaatgatgtaccacgcaatgacataaatcaggaaaggattgttggcaactttttgtgacaagttggcaagcacgattgcagcacctaaagctttacggtgatcctaaatttgccaaccaccctaatctaccaagcgctaaatcaagatgagttttgataaactaaaccggcttgtggagccgatctagatggaacggtagataattacccgtctcgtgggcaaaacggaaggttttcaggacaaacctacaaagaggtgtcgcactctcgtagcagtggcggacaatttacagcacaaatcgacaaagatggacaaactaaactagaactagaagcaatatgaaaaaacgattctattgattgattgtatgattgtctttacaattgaaccggccttgtcccttatataggggttggtcttgccctctacaggccctcctccacgtccaactcgggataaaaaccaaaggaaacccgaaacatgccttcccaagcaaggaaatctcgagacccgacaaaacagactcgggctagaactttgccggtcagaccggccacacaccgtcggtctgaccggccaacacacggcggtctgaccggccttctcagaggaaaacgggcaaaacttccgaactttggcaatttccctatttcaatcctaggtaccaaatttaggtgtaaacaagaattagttggagttgcatgctatagtccttatttgtatggtattatttgttcaagttatgatatggacatacctctttctttttttaggaaaaagcaagagatgtgcatacaaagaaatgaagtaatagcattttcatatccatttgaatttatgcttcttggagttctaagctactatgtattttaaatagtactgctaaatcataactaaatacatgttttttgtatgatggattcactatatttaaagtccttaatttcatgatgatgctatgtcatcttggcatatggttaattaattgaaatatgatttacttggtgggttgtgggtacatgcatgatttcatttggtggtcgtgcccatgacaattaaggaccagttctcgagaatctctggaagatatactcatactaaccacaagccagatgggctctaggctgaatcttaagtataatcttttctagctgacacaccgttggcaaggtgttaacaatgaaatttggtaagcccctaagagaattatcacattaccaatagtcaaattcttgctatattcggttaaggaaattaatcgaataaaaggatgcatatccagaaatgaccgagttcaaggaggatgcggcatggcaagttatctattaattagaaatagtttgttagtttccttttatctttaggaaagtgtgtttagtgtcctataaggactttatgttttccttttatctttaggaaagtttctttcttgtcctacaaggactagtatctccccatgggtataaatatgtacacccggggtcatggtaattatctctcgatcaatactactctcggcgcatcgccatcctctctcctgaggtttttacttatcaaccggcggaatttggcacctgacgcggggctgcatcgggtcagttcgatctccagcgaaggggtaagtcctacgttccgccgccctagtgaatctattggctaaattggtgttgttcaaggctgcattgctttcgatctcttggatcgctctagtttggttgatatattttcttacctgatatctcaattctatccctaattgcattgtgtttagagacacatcggtttagttaggactgtctcggtaaggtatgatcttttgtcttagccgatataaagacacaactagctcggatataaccatgactaccttatgtattaatcaactaaaggtgcatatgttttatattagatttacttgttatatatttgaacaaacgttgctacacaatgagtttcatgtgtttttgtttgcagaggtactcgcttgggcgaaggaaaagagactgagcgtaacgaattcatggatgatcaaagaagttgattgggaccaaaccaagaccttcttcaagtccacttccatcttaacatgtcacttttggtccatagaagacaagagataaagttctacatgttttgaattcggattcgggcctcctgacagcatcaacttcaaacggatctagccgctaatctagaaggaatttcggggcccatgagtacttgttggaaagcttatggagtctactttcatatggatttggtcccacgtcaaaattcctaccgagctgtcgagaatttgcaaaacaagccacgtatctcatccagtccgaatctgatttgggttttgggccttgtaattatgtcgtgggcttagcccaagcgggtgtgcgccctaggccaaccctaggacgtccctaatcacatttattcagtagccgtcatcgtttagagtcaggttttgcttagattattcagtcaagaacagttttgccgctagatcggtttgtggaaccccaaattcgagcgcttaatcattcatatgcaattgtgttgcaatctatcttgttattgattgtgttcttcgattcgcatgcaaggattagccttctcggcgaggtcaaccgggtttcggcatggttgataactagaggagacgtggtgctgtgattgcagggctcagtagcgtgtttgttcagaagctggatcgagttgtgtcgcaactccgcccaaatcattgtttatcagaacctttcggaagatcgggacctgacatcccctcatcaatagatttgttatatccatcacattagacagatctatcagcttatcgaggattagattatcatatccaatctcgtgctgcatcggttagtttcgacctactagattgttgttgataatataaaccttgttaagctgacagattcatgctaatgttttatcggggtgctagccgataaattatctggacgttgcatcggcttacaaggattacatacaagttggcttatccaattgcagcaaaactttcactgtttatctaatcgtttggattttacgacatcggaccttcagccgatgtatgctttaaccttcggatctttacatgttctatcatatcattgttagccgattggtttctactggactatattattgttatattatattatcaacagtcgattgcctttatattgttatttatatcaagcgttagaatctacatcagaattatagccgatagctcaaaaccctatcccaatcggctagtatcggcatcggccggaattaatctatcggcttgttagctgatcggctatttgatccgttgtttacatatcttgtcagttgcagggtcaaactgactggcatgcccgcatctcatcaacctttggacctgtactaaagctaagcagatctctcaggccagtgtgtgtttttcgcatcaacacaagggtaggcgtgatggagtttggatggacctggattttggtctatgctgcttccgaatttacctaggcatgagcggggttgcccgcccctggattttggggtgggggtgaaaccgaaggtgggtgtgctagttagggtggttatatggagggttttgtcatgatttccccctttgcagtatcatggtggtacttcgggtatggtttcatgtgtagaatcgtgtcttgtggttaaagttgtacacctctgatcagagtaaaactattcgaatagccgtgcccgcagttattgggcggtcaaccagctcaccgtgatttttgctgggcctgtcgcaacgtggtttagcgttggacagtgatgatgttaatactacttaattatctactgttttactgctttcaacttatgatttacaaatgttgcttttactgcaaaaatatcctatgagccaatcctttaattatccttgcatcataccttccccttggtatgacttgttgagtacagtggttgtactcagtcttgctttattttttccaatcccccagaagtagaagttggttcaaatggtgagttctatgaagattaggcttgtgccagccgtcaagagtttgcctgtggagttttggaggaagcttcgctttgctgagaagattaagtttagttctctagtttttccgccgcatatgagttttatcttgttatttttgtaagacgtggaactgtatcaaattgtcatctatgtactctggttgatgcctggacagaggttaaatgcacagatagccggtgattcgggttgtcgaatccctgggcatgacagagaccaccatgcctcctcccactgcagccacagtcgccacagcagccgctgctgccgtattccaaccacctgctgtcgccggccagccgctaacgccaccgtcaccacgagctctgcgcctgctatcaccaccacgacgacctctcccgccgctagtgcccccgttgccacagcagccaacagtcgctgcacgtcggccagccactgctgccgccgccgtccagttgctgtcttcgcgccgttgcctccgtgccgtcagctgtcacgacaaaaaatttagcccaaatttccagactattttatgtattaaatccctatccaggaccaacaagggtacataaacgacaaattaatatatagatccaagcgtaaataaagcgtaaaatacttatagaagaggcacttagtcctcacatcgaaacaaaagcagcagcaatggaaaaaggcgatcctagcagggcttcagctccactccataggcagaactcaactggggtctgagccttggtcctctaacttcgtcttcagctcagaagcactatagttctgaaaaatggggaaatagcaagctgagtacaaccatcgtactcagcaagccacaccaatgatgcagacgtgcaaaaggagacaaagggaggtttgcggttgtttgcataaaggcggttgtaaatcattttattgagcaaaatagtaaaatagttgattaattaaggtaatattaaatctccactgatcaatgctacaccacattgaacaggcccaaccaaaccacctgaactacaccggttcattaaccaattattaaggatgggactaatcacggtgaatttggtcaatcgcccaaaaccgcgggcacggctattcgaatagttttactctggccagaggtgcacaactgtacacacaagacacaatccatcggcatgtcaccgcgtcatcatgtgcccatgatgagcatgtcaccatatcgagtgattgtgataagacccttcgcataactctcccctaaccatccacaccacgctaaagtttcacccccaccccctaccccggaggtgggcagtcccctcgtgcgccgtggtgaattcagcagctggacaaacgaacacccggccgacccaactccattacgcccagcctcgccaccggtgcctaggaaattgtcgagctataatatagatcaagtagttactcattccagcttgtggtaagcacagtaagtcttccagggtttcttgtgaaccggtccttaattgccatgggtgcaactagcaaaaccatgcacccacagcccaccatttggtcgcattttagttggataattacgaccaatgaaacatgttcggatgtctcgagcacgcaactcgtcaaggtactataggtctaataatgtaattatcccattatgtgagctagtggtaattaagcatggctaagcatatatgattttagctagatcaacataagtatcacgagctagataatttatcacctaaggttgacaaaggacgggtaacaagtaaacatggcaaaagcgagcaaataggttatacctgatcccatgtaattagcaaaacatgcatatttatttgcaaacagtaaaatatttataaattaggctcaatatgcttaaggggaatgtgtgacattccttgcttcttcacttggatcttctgaactctttccctcgcgaccgcgaacttccggaacgacggagtctacacgctggcacgcaaaatgaggaaaaactctaataaaaaccaagtaaatagtacataaaaagtaaacaaacatgtagagctcaattttagatgaattttacaagttgaatggaccaatatggagttcgtatgaattagatatgaattttagaagttttgagccatttaaatcaatttctagaattaaatacgatttattgcacaattattaattaatttctcataagaaaagggctgtcgctgacatcattaaggggagaggcgcgccaacaggcgggccccgcatgtcagtggcataaggggaggcacacggtggactcggttcaccgcggcgggggcggcaccgtggacctggaccataggaccgacggcctagattggcctgaagccgatccaacgggcacgggcggcgcgacaggacacgggcacggcacaaagccggcccggccgagccacggcgcgtggcggcgcggcaaccaacggcgatggccggcgacgcaagtagcggcggtgcatggcacgggaggtgggcaacgaagggggaaggaggaaaaagagagggggagtgctcaccgagcgccatggcggcaagggggcaacgggcagcggtgaggccttctcaggaagatgacgcggcggcgcctcagcgatgaccaacgaaggcggtggagcggctgaggttcagagaggggcggcggagccgatagggtggtggcgcgtcgcgacgaaggcccgcggaagtagcgggaattggcggctagtgacagggaaatggcggtgagggctcgggtgcacgctagaagtggtattttggtggagttccggcggcgatgaacggaggccggggtgtggtggggcgctgcgaacgctgtggaggcagtagcgtggccgagcgaggcgatgctcgccggcggggagcggctggaggcagtagaaacagtgatggcttagcctcgcggtgggagcggcgtttcggtggcttttggggaaaatggagcggtggacggggtggagttcggcacggcgatggcggtggcggcctagagcagaggtggctagggcaacggtggtgagtggctggagctcgccggaaagaggcggaagttggttgcgcggtgggagcgatgtttcggtggtggtggggaaaaacggagcggtggccgggcttgatctcgcagcggcgaagccggcagtggaggacccaggatttgaacccagggtaggcctagccaaagaaaatccaaatacaatacaatatgattcgatataaaatatggtaaacgatacgtatataactctaaatggttcgatacaattagaaaataacaaataagtttaacttttaggataaaagcttgtaagtctaactattttttttatcaaatgaggcaaatgaatcggacggattaaatgctgacatataaagaagcaactccatactaacttcatcaaaccgattctcaagctcttgacgaattctatcgatgacaccaatgtacacttctctcctatagtggtcatcaattgtttgttccaggtaaaaacggtgggatcttccatgaggcatatatttagcatccattgcgggaatatcaatggaatatttgatgcaaaatgatgtaacctttcctaagaaaccttcccaaccatgcaaaaatgtcatatgaagggggtagtatgctagtagtggtctactactactagaactctagattctagaagggggagagggactgagggactgaggaagtgaggaattgctcactggagaggcggactggtggagagccgaagaaggagtggccggtagagcactagcgctgggctcttgggcggctgccggctgggcgcgtgctgccaccgacgcacgtcgggcaggaccgcgggagccaggaggccgccggctggtcgcgccgacgcgggacagagagagtgtggccaggcggggcgcgccggcgaggggcggagagggcgcggccgcacgggctccgacgcggcacgaaaaggcagtaggaggagcggcgctgtgagtcgcggcctcgcgggagcgccggccaccggattcacgggctcgcgggagcgccgtggcctgtcgggagtgggaggccaggagagtaagtggagaggggagataagagagttagagttttcttttgttgggccaggctttcttatgggccaagaaaaataaatacctgttcttatctgggccaaattatagggtagtcctgggcctacctagactactctttggtcccgccactggaagccggtggtggcggtggcgtagcacggcaacgacaggagccgcggtggctcgtggttggaggacgccggtgggcggcggagctcaggccggcgtgggaagaacgggagagcgtggggaacggcgaggaggggaaacaagagaggatggccgggatgcgttttatagcgctcggcggccgggattgtggccgagagaggcggattcggggtggcaaccggtaggaggtggggcgccgacgtggaggaaatggcggccggatttcgcgggaaggggtgggggaagtgggcgcaaggtggaggaggaccacgtgcgcgcggttagatgcgggcggggagcgggatgatgcttggaatttcggtgatgtgggcggccatggcgactgaagctgggcgactggaggaaggaggaggagttgacaggtggagtcgctgagccctcctgttggcgagggagggacaaaggaggtcgggagagaggccaaatagactttaggggaggggggagagggccgagcggtgagctgggccgggaaaggaggggagggagggggaggctggcatgagagggggagggggagggtcgaaaggaggctcaaaggaaggaggagatcttaaattggtttttcaattaatttaattgattaaatgaactttgtgatgttaaaattagatgttgagctccaaaaattcacagaaaaatcaagagagtatattagggcatagagaatattataaaatatttctggccaatgatttttaaaggaaacttttaatttcctcaataattcacttgattaaattgctttaacttttatttaatttgtagaaaatgatttattaattgatttttaatcccgaacgaaaatcggagcgttacattagccaccgccgctgccaccacgggcgctgccgcggctgtctcaggccacatccgtagctgtctcagccgccgccgctgtcacccatcaccagccgcgtggtcggccaccattgtctccgcgacggcggcagggtgcagggagttaggaggtgcaatggaggtggaggaggcagaaagccatggatgaacggtgcggcgagctggtgaccctaacgtggagagcggcgcaagtggcagcactgatgatgtaagagcatttcgaagaaagggctaaacaggttcctaaaaattaatttttgggattttggttaaaactaggtctgttaatcacggttctaaattttatcccctcctataaaatcgataccaatctcatcagaatttgggaaatttgggaagcagaacgccgtcctaatcgcaggaatcacgccaattgttttactgtcggcgccaaaagttttttttccgtccgcttccttttcctcgtcgcgccgttttttttcgagaaattttttttccgcccgcttcctttcccttctcgcgcctttctcctctcgccgttttctttttcgcgagaaacaacagcgcccacgccggcacgccgccaggctagggttttggggctcctagcgccagctctgtcccgagcgcccgtccgtccagggctctgccggccgtccgtccagggctccgccggccgcctatccgggggaccgccggcctgccagccgtccgtccaggggcagcgccgcccgccgcccgtccagggcaccaccacctcgccatcgaccgtccatccaggtcaccccgacgacgacgtgtgctgctactgctgattcactttgaggtattttcagagaaactcatttctacctgtgctcgtatggtttatacgcactgtacaagtgcttgtgcctgtcaccaatcgttgctgctcgctgccgttgcctggttgcttatgccgccggcgctgacagaggaacagctctgcgtgcgtctgcagcactgtgtccttcgcaaggttgtctggatcgggatattaggtagtaatgttttgctccaagtattatcgtatcgtaatattggaatactatgagattttctttttttaagtttaattaatattcatattaattacatatatattatgcaaatatagacatttatcatgagaaaccacgttggttttgatatatttaactgatttctatatatacttgagcatattcatttacattatttccaaaccatcttattttaaataatattttgtagtaacgtagggatcgtagaatcgggataccacttaagatttcgtaggatcgtgtagtaatgaatagtaggatcgagatactatgaaaattaggatactaggtgggatcggtatcgtttcggcttggtaggatcgtagtatcataagatactagaatacgaatcaggatactgacaaccggacttcgttcgatatcatatcgctgcgccttatatagcctcacgaattcggacgtcaaagggtttttaagttgtatttggacgtcaaatattaaaacacgtttcttattgtataaggacgtcattttgagaaaatgaaggaagcatatactttacacactgtaattatatacataccacgttttgatattgtatttttaggttaaatgaaatgaagaacatttaatcaatgttagctaatttgtgttcaatgaaattttctacgtaaattatgtttgttttcgtggctgcgcacgccgcgctctcccttctagtaaaaataagattatatcatattggatataatgtgctcacattgtggaaaacttaatactaatatttgagtttgtttatattattgctgtgacatataatttgggaaacacacattacaggtgcacgatagctggtggaagggaaaggccaaaagggagaagaaaacgagaaaataaaagtttcaggcgccgcttcaaaatcccgcctcaaacggtcaaaagcccctgatccccctttcccctaccgggcctctccgctgccgcctcatcctccacccccctcactttcctgtcgcgatgccacggcggcggcggcggcggcgtgcggcacccggcggccaagttcccccagagctacgcctggcttatggcgcccgcgcgctcacgctcggccgcgcggttttctccctcctgccctcgcctcgacattgtgagtccccctgtcctgcgtgccggggaagagtggcctcggggtgcctcgcgtgccgccgctgggagcacctcctccgtgacggggaccccgtcgcttatcgccgcctcatcacacgagccgtctgcgccattgcggccgacgatctgtccgcgcccccgccgccccggtacactccgggcaactccgggcattcgcaggccagggtttgtcctgctgctctcctactctcgatcttgccttacttatgtgctgcttagggtgtgtacatttctcgtcttctattggttatctgaggctgccctttttttttgcctgcatggtgtttgactcacagctcgttcgggagatgatgaagtcgatcgttgcggatcagtctcatggaaccaagaacgtcctctgcaatggtttgcacg

SEQ ID NO: 79069 - DNA, 1729 bp, Oryza sativa
ttgattgtgaatgtgctgcagatatttaggtccattctttttttagtggatttatgttggttctaaagatacgctgaacctccctcttaacctggacctagtcctaagagcaaagttaatagtatagccaactactagctacaattcatctataactaatctaatagttaattcatacaatagttgcttactatactattagtatatagtcccactgtcatatacacattatgtcttggagtccgtgctgcagcgggctacagaagctgttcttctctctcatcttttatcttattaaaatatgtttgtagctggctaatagtatgctattgtacctgctctaagagcacccgcaatggtaaagtaaggtgctctctataaaacatgtatatctcagtaatagattagattaatagtaaaccacctcaatagtatttctacatgggtatctatagctctctcatccattgtcttgtttttctctatagactctccaggttagtagatagctttactctctctctccatttaatctcttacaagtaggaaaatacgattatcttttatagagagcatatagataaccattgcgggtgctctaataacactagctaagcgcaaactccgagttatccatttcgcagcatttaccttgacggagtggacctgaaacgctaaacgcatgagcaaacgtgtacggaactcctttggtcaatcgttggattatccatctgaaactccttttgttttcgccgggatacccgtatgaaactcctgcatccgtcgccttcattcgcaccggtgataccgtactcatttggccggcagaccaaacatagtggattagtggacacttatgtgttgagaataccgtgccggtcctttgcgaaagcacatgtaacgcctaggaaagcaaggagcagaagcaatctgcttgtcttgtgtgcgacaacgaggccagtgcgttgtcctcgcaccaagcgaccgcctcgccgccgattgttccgtgcgacgccacaccgaaaccgaaccgggacaacctatttaatctttcaacaaatttaaaccttcaaatcttgaaaagttttcaaccaatggatgcaattcattttaaataaaataattaaaaagcatatcaaaaataataaatctagatataaaaagagttgtataatctaattccactatacttacgtagataaaacactgttttacgtaaaacgatatggcattaatgtataattaatagagttttaattatcataaccttaaaaatttatttatagcaactttcatataaaaagttttttaatgaaatataccgtttagcagtttgaaaaacacgtgattatctaaatttttatccaatttttattacataaaaaagacctaaatttacaagaatattctctctctccgtcccataatataagttattttggagagatatttattttggagagatatgacacaatctaatactaccaatctagagtaccagattattatgatacattcctttaaaattaattatattttgatataaaatcctacgaacgaaaaatacaaagacagaaaaaacgaaccgaataaacccaagcaaagcaagcggaaatccccgcgtcgcgttaaccttctcgcccgcggtttcttcccttcctcgcggaagaagcccaccgttccttccgccacgcttcaagcaaccgctcacctcccctcccctcccctc

SEQ ID NO: 79070 - DNA, 5943 bp, Oryza sativa
taccaccttgcaagggtgtatcatccacaatttaccctctgtttctcggagatgcatcaaaagattagagaaactgcagcaatcgatcctgttggggattagacgttacacagtgctttggtatatatgaacggataggatattcagccctgcacatgcacagtgcatgcgaattccctgtagaagcctgtatatatacagtagctagaatcgctggatcgagtggcatcgaagtgcggctagctatagcttacgctagcttactactacctccgttctaaaataagtgtagccgcggtatccgtatccaacatttaaatatctgtcttatttaaaaaaattataaaaaattaaaaaaatgtcacacataaagtaaaatttatgttttatcatctaataacaataaaaatactaatcataaaaacattcaacgaagacgaacaatcaaatgttggatacaaacagtgcaaaactacacttatttagggacgagggaggactgtactatttcctccatttcataatgtaagtctttctaacattgtctatatttatatagatgttaatgaatctagatatatataaatataaataatgctaaaaattcttacatcatgaaacggagggagtatatacagtactattaccacaatagttatggctagctcatctgtacgcctgtgtaccagtgattctcagctcgtacgtacgtacactgcagcagccagagatgaccgaccgaccgatggcgacgacgcgtaaaatattcccggaaagtaaagttaccgcgcggccacactctgttaccattttacagtactttatttactgcgaggatgatgtattctctcgcttgtgtttttgcggccagagagagccagccggccattccctctggttggccatacacgaggaacgggttaggagaaggattttaatcacatgaatctacgtctactcattttcttgacatatattttgtaaaatgatatattttctctgttttatattataagttattttaatttttttttaagtttgattaagtttatagataaatttaacaacatttacaacaccaaattagtttcatttaaactaacatttaatatattttcataacatgtttgtcttatgtaaaaaatattgctatattttatatttaattgattcaacttaaaatgatttgatagaaaaaaagtcaaaacgacttatattacggaacgaagagagtatgacatattaatttatcttttaagttttttaaaaaggaatttataatcaattacttggcatatgtactactataaacgattagccgggtgtacgctccagaacgggctggtccgtgcgttgtccgtagcagcagcaacacgccgcgcgcgcggtcgcgtttcccaatggcccgcgcctacgtcgcgatcgatcgtctcatcgtcgcggaccctcttggagatgtgccacgcgccgtgccgccatcccgaccaaatcatggcctaatcacgcgaaaacccgcgctttcccacgccccccccccccccctgttcaccttgacctgtgtgtatataattactactagtcgcctccgaaagctacctctgcctttttcaccctcctccatccattcccagctgctccatgctgctgccgccctctcgtcctcttcccttcttcacgtgtagtctcaccttcctcgccatcgccatcatcggagctcggtctgcccatggagatgacctagctagctagctagctagctatagcctctctctagacatctctctcttgtgtgtgggtggtttggtttcttgattggagcatggcgttggaggcggtggtgttctcggaaggatactacttcggatgcggcggtgccatggcggcggaagcagctgcaggaggagcttggagctggagccacgggtatggcggtggcgttgatcaggggaagggggcgatggagttagtggtggacgacggggtggtgaacgccttctgggacggcggcggaggcggcgcaagctcttccccggtgatggccgccgtctcggggtttattgaggagccggacggcggtaattcctccgtcgcagacgcagcgccgccgccggagcacggaggtgcgtctgtcgtcggacgggatggctccgcggcggcgccggcggcggccgcagggaggaggaagcggcggagggcgaggaccgtcaagaacagggaggaggtggagagccagcgcatgacccacatcgccgtcgagcgcaaccgccggaagcagatgaacgagtacctcgccgtgctccgctccctcatgccggcctcctacgtgcaaagggtacgtctcctgccgacccatctagggctcacttcgcccaagaccgccattgatgatcttgttagaattatcaacaattcaagctataaataaattaaattctcatgtggatagggcgaccaggcgtccataattggcggagcaatcaactacgtcaaggagatggagcagcttctccaatccctggaggcgcacagacacgcccgccgcgcacgcaccgacgccgccgccgcgttgccattcgcgggcttcttcacgttcccgcagtactccatgagcgccgtgcccacgacaaccaccaccactgtagcagcagcagcaacggaaaacggcaatgccgtcgccggcgccggcgcgggcgacgacgcggacgcggacgtgtcggggtcgaagccgtcctcggtggcggacatcgaggtgacgatggtggagagccacgccaacctgaaggtgctgtcgcggcggcggccgaggcagctgctgaggatggtggcagggctgcaacaccaccgcctcgccgtgctccacctcaacgtcgccagcgccggccacatggctctctactcccttagccttaaggtatagtaaaaacacactacttcttcctttaaaaaaaaactaacctaaaagatagaacataatcataatctaatacaatgaatttagattcgatttttttaaggatgcagagagagtacgtgtatacgtgcatgcgtacacgtatcctctccccaaaatactctactccattttctccattttagcagctacgagtagctggctactgtagctagatagcctcgttttccgtgcagaaattgtcatgaacgacgcctacaaactcctcgtcattcggatcagtgtcatggctgcttcgcttcgctcattcacccctagagaaccgagcacccgaagcagaaggaaaacaacaaccgtttttttttttaatgacgctaacgcatgcatggctgctctgtggtcgctgcaggtgaaagaagactgccagctcacgtcggtggacgacatcgcggcggcggtacacgggatcgtcgagacgatcgagcaagagcagcagcagcagcagaagcagagctgtagctagatcagctagagtattttcttagaacatttagcaatggcaaaaatggtcaatattaatatgcgccaaccgtgtgtaatgtgtgcactttcgattcttctagacctctgtacgctggatgcacatgtaccgcagttactacacccacgtacatttctgtagttcatcttcacttcaattaatgcatcatggtctaccactctgtacttataaaagaagtcgtttagaataatatttaagtcaaaccttgagaatataaatcatgaataactctcaagttgttgagtttgaaaatgtaaaaattatataaatagatttgtcttgaaaaatactttcataaaagtatacatatatcacttttcaataaatatttttatagaaaaaagttaaagttgtgttttggaaatcgtatcactgtccaaaacgacttccttttttagtacggagggagtataccaatataatgcggcagtgagccagtgaagtgtttgaaatgggagctcctcgtcgtatgtagacacgaacatttcttagtggggtacatgttttcgatctgtagctaggatccaaacaacgcaattgataggcacagctgcggggtactctcgatctcgggacccctagcttgttccccgcatgaagcatacgtcgattattgcaatattcaaagccctagtttgaaatggtaggatttcaaagaagttctacatgaattgaactaaacagggtgaaaattaatctcgcggaaaaagaatatcatgagttctaaatagccccaaatatgagcttatgacaaggttccaacatttctgctctgccgcctatggccacccaccaatgccaaccagggttgaaaatggtcacagaaattttcaaccaacggacgctcgttttttatttctactgaccaagccatatggaaatggtaaacaacgaaaacaaaaaaaacaaaagcagaaaagatttccatgtttgattgtattatcgtggaaattacctttttggcaatggtatttaccatatttctaaatactccaatatctatggtccaagtctctatttgatctatatttgatctatagtttagatgctcatcaactcctaaaataaatcccagtaattagcatatttctaaatactccaatatctatggtccaagtcatcttttgatctatagtttagagtctcgtcaactcctaaactaaatccctaggttgaatgcatggctaagagagacaaaatttaacttatctagtgcaaacttgaatttaattggtcatattatatatagttatactaagttaaatatgtggtatttttagtttaatatttttaacatttattactggttttcgatcgataccgatatgattccgttcgtatagtttcgtttctgttttttcaatatctctgataccattttcgtttctagtagctttataattttcaatttttttttcgagaaaaatatagttatgggaaaagttaaggctgtttggaccattttcaaccattttcatccttaaattgtcagcggacaaggagccatattctagaattataagccacatggacacaatgaataaccatttggtggttaccaggcatcgtctatcaaaagatatgctactagagccgtttttcaagttacctctacacatgcatgtggttgtgatagtctgagtcgtcaaagtattcaaccagcatgagaaaaaaaaattcaaagactggtttatcagatttataagttatagacaaaagctattgaaaacagttcaaaattcatggtaatctaaattgtgctcatttttaattaatatggtggattggtggataattaaatccctggcctctgcatctaggatacacacacaaccccaggtccacaaagtttaagttaagaagatactctaacaaattatgataacctaaattttgctcatgcatgtttgttcctaaaacaagctttgcctttctcgcaaacatcaacagttcagattatattacagaattgaatatcatatatagttccgatttgtttgcttaagattggaggatggttaactttgaccagtgctagctgtcagctaggcatggctttgtctgacgagcctttttctctgaatgaagtataatcctactccagaaggagagttttgggtggaaaagcgcatatggccacatgggagatgaacaaggagagctatcagcaaagcattggagatgattagatgaacaaggagggaggagggagagcgatcgacgtacgtctactgaacgccggaaagtgaggtgacggcgagggctggaaatgataggaaaagacgcgctgctcgtgtcgtcccatgctgctatttgacccttggaaaaagattctaggacagcgcttgctttccttcactactcctacacacaacttttccctcttctgtctaggcatgattgatccaatgcatgaattgactgctgaaatgatccgtctctcccaaaatgtgtattttatcggcgatta

SEQ ID NO: 79071 - DNA, 15801 bp, Oryza sativa
cacataggacctcaccacgccctccaatctctgttttcatcacgcgatggcacatgggccatgggtccaaagtgcagagttagtaacagaaagatggttcaaagcaataagtgctggcaaaacctattcaagtactccaaaaaggaagtttactcgatacttcaaaatgtcaaaatacaaggacgggatcacgagattgtgggaggaactaccacacatggatgattttttttttttttttaaaaaatctgcacaagatagtgcaaaaatttatattgatatagtcaaataaattataagactgcaacactaaaagcctgtaaccagataaaagaatttttaaaaaacaaaccacctccacttgctagtagctcaccgcacaacccattagaaggcactagcactaagctggtcaccgctaagcgtgatcgaccgccgatatacctacttggggatcacaaacgctccacaaaacaccgaaacaacaaaagagatcaacgacgggctttcgatcatcctcacagggttgaggagagagagggcaagagagaagaatatccactcatctctcacaacaatctgatcacgaccatcgagaaaaccaaattgagaggagacagaaaaggtggggagcgaaaacttgctaggcaacgccactatgaaggtcgtgacaccttaggcaccacatggatggattttaaaatttccactaactgttttcacctaatttttgacaagttacctgtaccaggctaaaccgatatgcaagagttaatataccattttataactgcaatcgaatgaaaaatatgcagaaaaccacagagctatataatcgtttgatggtcctatagaatcatatgatatattgggaaataatggtactactacattggataagtatagagctaattgaagtgcaagagattaagccgtacgtacgtgcataatggttaagacggctaccgtctctacactactttaactagacatataaaaatactacatatacaaataacatgcatatataacagataatggtgtatcattaaagatcactggtcttacttagaggagaagcatggttactgcagtcggtctcgctcagttgaaaattacaccaattaagtaacaatcaactaggatagagagagaataatgacaccagtacatacgatatgttagtagaaaatgtaacgcatgcttcaaatataaaaggaagtagaggagctatattaaacccatgtccaaattaacttagtcacagctcagacagctagtagattttagaggtaacatggaaccttgggaaactacattcaccatatcaagacaaacatacaagttgcctgacagctttcgcaataaatcatcggatgtttccaaacttaggcacggtttagatgggattaaaacttttaagtccctatcacatcggatgtttggatactaattctaaatattaaacgtagactattaataaaatccatccataatcttggactaattcgcgagacgaatctattgagcctaattaatccatgattagcctatgtgatgctacagtaaacattctctaattatggattaattagggttaaaaaatttgtctcgcgaattaactttcatttatgtaattagttttgtaagtagtctatatttaatactctaaattagcatctaaagacacggactaaagttaagtctctggatccaaacaacacctttgactaataagttagccctacatgtctccagtaccctaattctattcagctgctgtccgaaaggaatcacttggactctcggagtaggccctgaaacatccaggaatatataacttcatcagaaaggaatattcctgtatctacacagtatgtcggactaagtatacttctcttaaagcactgggagaatagtagatcgatcatagaaacctgacatcagggtattagatacgctactgaagtctgtaagtcctacagggtattcatcatttggcatattgccagagaccagagcaacatgtgcacagatcagaaaatagatctgacttccctatcagacagcataaaacaacaagttagcttaacgtctccgcaatttgcgtagagtacatctatttttctaattaaaacaaatttccacgatgagagaaacttgagactagcattatacactcaaataggacagatagtctcaaccaatagctgaatttctccatgttttatcaagattcaagaggaaacaagatggttctggcaacatgtccgtataccaataatgccaatggtaaattccattattgattggatgtgatgtttaatcattttggctagttgctagaaaaaaatgacgaaatttccacattcataaaaggactttgaacacgggacgggcacacatactacaataccaaacaattgtactaaggaaggtagacataccacctaacaggaaagcagttcatgaacgtgtttcacactctaatagttagtaagaaaaggataattatgatagcaatacctattatgtctgaaaaagagtaaccaccttgcctttttccatgttaattggcataatgttgttttcttgggacctgctgcgtcattgtccataaccattcacaggttcatgatgtccatctgaagagaagacttatttggatgagataaacaatcgcaggtacaaggagaataactatctagcttccattacagtgaactatagtctgatgaaaagcagagacagagagctccgtctatttcaaaaggtagtagcatcaaatatgtagttatgcacaaactatctgctgaaatacttgaatacaagtataccacaagttccctcaaaatcaggaatatgccacaaactcacatcctcatcaacttgtaagatgaaatattcaggaacaagttcaaaatggttgtatggtattcccgaaaaatggttgtatggatcagtttaggaggatatgagaatatgacacacggatgcacgcaagtaatataatactccctccatttcgaaatgtttgacgccgttgactttttagcatatgtttgaccgttcgtcttattcaaaaaatttaagtaattattaattcttttcctatcatttaattcattgttaaatatatttttatgtaggcatataattttacatatttcacaaaagtttttgaataagacgaacggtcaaacatgtgctaaaaagtcaacggtgtcaaatatttcgaaacggagggagtatcaatctgcatgacataactagtttagtcacagcctatagtttcagcctaacccaacaggcaacagtgttaatttacatctaaaagccaagctaagaaaaatcagattgcatttacaatctactgagtctactgtagtatcaagtctatcacaaaataaatctgtacatggttgcataatttcttatccaaacaatgttaaataaaccactaaatttagtaaacgagacaataatatgtcagacatatccatctagctgcgatttcaacacaaagatccccaattagctggtttaggaagaacaatggccgcctccactcacctcccggcaactagcacctcgccattggtctcagcctccgcacccagcactgccgcgtgaccagttgaggaggaatgaacggcgacttcgcgaaaccccccgtcgccgtactgttccgccgccgttgcccgcggcggccatggcctccttctatccgaaggagccaggcgagcactcaacccggaggcgttccatcggacaactggcgcgcattccacccgccggccgccgctcggcgagcagccggcgaagcggcgcggtggtcgcagcggcggctagccggcggcgaatcgattggttcgcgaagaataaacgcgattagggaaagcagccgatgggcaccgttggatcgggactgtgcggtctggattgaatctaggaggaactttgcaaaagagaccttcatagcgtaatgttttagcaatggggtctctttctctgtgtcgcaatcaatgatagagcagccgttcgatcatctttcaacggctcagatcgtagcccggttaagcacgccatatcatccacacaagtaatcgatccgatcttctccgaatcgtctccccgtccccaatccattcgagcttctcttctccaatcgattcgcgatttccaatccatggcgactctcaccatgcagccgatcggtcccctaccgtctactaagcaagaaggcacaaggcaagtgaattccttggtccgctttgtactcactgagattgagagcaagaacaagatgggagaaactaggtttcggtgatttgtttgtgatttcttgtcctttgatcttgctgcagcaggggagagaagcctgcggagggtggtgccgatttgagtgacatcgactcggggtatgtggctctgcccaatttattgtattgtctcgcttggttcttggcttataattagttgatggatttgttgttgtggtggcgattctgggcagctgggttgttcttgggaagtcggatatcgtcccggcggatttggcagcccagagcctgcgctcatctccgaagacaattcctacatggtaggagaagcaagcatgcggttgtttcctttttctgtatgatgttttgactaaatttgtgtttgttttggtgttctttcagggctcggtgggtgattggaggtgtgctgcacacagtggtgccattctacgagagagcacggtatgttgaaggtatgtgcgcccaactccgataatcttccacctttacctatgagaaaatgactttgtaatgttgaatgggaggtaatcattattgattttatgaaatcactgtcaagtagtaatccagaaactgctgtgcagttcataaattgctgccaagtagttacaaagtatctgtgtttgcaatagttgggagaattttagggtgcgtttggatctcaagcaaggcctaatttatccttgctgtcaaggtttagtgttttgtagaagctaaaagaccttgctgtcaaggtttagtgttttgtagaagctaaaagaccttgcttttgatggcaccagtccataataacctgaaaaagcctgcctgatgaggagagccaaatcggttctcccccgacggcaaacggcgtgcgtgatgtctcgtgataatcaaccgctagattcggtaaaagctaagtaaacgaaatgatggtcgttgcttatataggctactgccaaaaggagctagataaatctagccgggctaggtaaagtaagcaaatgatccaaacacaccttagtgctgatgtttggttgttcacagatgagacggctcgaaatgtggagactgctgctgaggttgtggagcaaatagctgaggtcacagagaaactggcttctaacgtggctgatcaccttccagagaatggatgtctgcagaaagtagtggagaagattgaatacatagctgaggtagtggatgaagatgcagagaaggttgaggccattactgagaaggtgggctccatgtcactccctgttttgcctactatattttatataggatacataatgtcatttgaatttcagaatattttgaaagcaaattagcagttggatatgctgtatgagttgattggtagtgctaaagataagtgggtagagggcaactctaagtgccaactgtgaacaccagttttcaagtgccgttatatatttctgttggctccacctaaattgtagtattgtagtaaccacatgcatcaagaatatatctattcaactttcttttgtataatagtgttgtaccttcattgtgtgctacatacattttaccattatagtgtttatattgatgataattaactttgttagttgtttctgccaaggattgtttcgctatttctgttttccactacaaaaattctgacaattcaattgttaaaggattttgcttaattggtaaatctttgtaggtattgttgaagacttcaaggtcatagttccacttcaaaagtatattgttgacattaaatcaaaaaaaattaatgcaattttactgtgccacaatttgccaggacatctaggaataacgtcctattttcttttgtatttaaaaagagtctactactatgcagccttgtggcattgcactagttttagaaaatgtatctatatagcaagtagaagagtacaataacagtgaacaaaatgccggattgtaccaatacaaatcaactagtattgttttatcctaataaaactgaatcaggcaaagaaagaaaggattcctacaggtatagagtcattttgcgtaaaactgttgagatatctgcactgttttggaagtattgtgaaagacaaccaaagatgaagctattaacactttattgatcttctcgctaatacagattgagaatttcagcgacaagattgatgctaaagtagaacctatcttcacggagattgagaaggaattcgaagactcaacatcaaatgatggagtaaatgcaaatatataatcactagccctacgtagaaggaaatactctcagctccccattgtgtatagcatatgcttttttttttgaatgattcgttgtacatatgtgtacctttctgtatgagttataccatgcttattgtgacgcatggtggtgttgtggctggtgctcgaaactaaagtagagttagcattgactattgagactgttgagctgtgaaatttcatagactggtacaaaatagaatggttggtactggtaaatgctattatatcacaaaatgaacaatgcctttttggtacatagaactggaaccacgaacagtttcttatgaaatttttatgacatttatttaaagttgggttgtcatggactcgtggatatagtagttattgtgcacgtaatatgaagtgctaattcgtcaacttctaggttcctgttgaactgtccccccaggtcttgttcagtgctcagagtttcagaaatcagaactgctcgcttgtctacctttcatgcaaaatccacccgggttccagggccatcgccggcgagaagccagctcagcttatgatattttgcttgggatattctgctgtgttggatttatatcccccgaccacgaggcgcacgcgagccaagcccagctgccattgcttacactagtcactggatcaacgaacagcgacttggcgagaagcccggccgcgcgaaacgcattgctttggcgccggtcgcttcgggtggaagttggagaaccccgcgaccgcgactccgcgggacgccagccagcctattgctctattccgtactgcgacgaagaatccgacgcgatcacgtagcaaccgcgtgccacggctccgagtccgagtcgcgtacgttggtgccgccgtgccgggagcccgggacctcgatcgagtccgcgtcggggcgggggatcctgcctatatatgcacaagcacgtaggcgtacgaccacaccaaacacacccgtaccgtacgggcgtatcaccaagtcggcaagtcacaaactagttgagcaggagggacgacttgtgcgtggcgggtacgtagatggatcaggaggcctcgttgctgccggcggcgtcgtcgcacacggtggtgaggaggaagagagctctgcagcttaacgagacggtgtacgaggagccggagtacgtggcgaccaagggtggcacatacaacgtcgcggagatgcccgagaggttcaagtccccgaacaacgtcgacgggcaggatgcgtggacgaccgccatgttcgtgcgtggcatgatcctgttagacgcctccttccgagagctccaatcgaggattgcatccgagaaaatgccatccaatgtttgtgattgaagccttatttcaaaacgcgcattaatggaggcatatttattagtattgttttattttgtttttcttagtttattatggtggttatatgttaatttggcatgtacacatctcgtcggtgtttatcttcttttcctagctcatgtaaacaagtttcacgaggaacatttgcggaagcttaagaggccaccctaataagcagagattgccaggaaaacgttgctcaacaaaaagatcttagtaaccaactcgaaaaaggagaccaggcatgacaagtggcgatctctgtactagaatagaacccctgttagcagcgttagcaacttagcaattggatttttccatcccttgggagatgactttggtgctaatctaggaagaacaaaaattcacaaataagcgaacaggaagaagaacatcatcggactctaagcacaaaagatctgctggtgcggcaactggcatctcaccgtcttgcaaaatctgtgcaccgagatggtgcacctgctcctcgagcctctcgtaatctgcaatttgtagcaccaccataccgtggattccctcgatggtatcgtggtttggcctctgagagttcgtgcgcgctaaatcttcttctgtttgcaactggcgtagtagggcctgcacttgttccttcttattcagaacaccttgatgcattttttcgagccttctgttgtccgccgagagcagttgaggcgctggggctggtggggcttgggccggggtagcaacatcggcggcagccgcccgcgccatgtttctatcccgtctacgccgacgacggccgggaccctgtgacatcatgcacacgtaaaagaagtcgatgaagaactgaacatcatgcactcaacagttactgaaccgaacaaatgtagttagtgccttaattactggaccgagcaaatgttcagatgatgagatcaaacatagtaccaagcaaatgttgaagtgaaattacctctctcacaataggttgctgatggccgccgactaccgcaccagcccatccaccgcggggagcaacgccgccatcctgacggtccgcggccactcctccgccgcggcgagcgccgccgccgcccacacgatttgcgcgctgtcctccgccgcagggaacacgatcgccacctcgaccgccaccgcccactcgatctgcagctggtcctccgccgcagggaaaacgatcgcaacctcgaccgccaccgccatgacggactcctccgcggcgaggtccacccggagcatccctccatacctcatcgggaggatgcaaatggacggggaggaaatagcggtggtgtcctccccgctggtcgagcccgataccatcgccgaggtgcccgtcatctccatggacgacgacgatcacccgacctccccaacctctacgaagatcgcggtcgaggggcgcccccaaccaaaactgcgcatctgcagcgtggatgtagacctctccgggtcccccaacgggcacgttcccgaggccccgcagcgcactgcttgggaggcaaccggcgaacgatcccatggcttcaaggaagggaatccagaacgtaggaccgttggtgttggcgatgccgatgctgagtaccggagcccagacctgcaggcgcggagtccgagcatcgcgtcggagctcgcggccgtacgcctggtgttgctggtcaccggcgcttcgggcttggacgccgcgcgcgcccgccctgacgatcgcagaagattcccgatcccctcggccgcaagctggctcggtgttccagtcgcgcgcgcgcgcatgaccgcgctccggtgggtgaggagcagcacggcgctgcggggaaacagtagcgacgccgccgccgccgccgccgccgccgcggcgccctctccctcctccgcgtcgtccacgcccacgagctccaccttcctcgaggaaatggcgctccccttggccgcgcccatcatggccgcgtctgtcgtcacggcggcgagcaaggcgcgcgtgagcagctggtgcctgccggggatggccgcggcccctcattgctgtggccgcggcggcgacggcggggttagagggggcggttgcggtggtggtggtggtggtggtggtgacgtggatttgatcggaggacgacgcgatttataagagatcgccgtgttggaggggagaaggcggaatggcggattgggaagcgagaagagaagagaaaaggggagaagcggtggcgaggttgttgcgcgccgtgttccccacgccgtactaagccgagaaaggaatggcggcgacggtgggtcgggcccttgctggtaatttgtttctccggtaggtcgggcccacaaagcgcgcaccggcggacggcggttgatggagacggtgagagtgctgcgggatttaggctggaggcttgccatgggatggggagcgttgcagcagcagcagcatcatctcaggcgagcccgagaagagagatgagagagggaaccagcgcgcagaccgttgtgctttaaacaagggttccatgtacttggagtcatcttattacaattttactgttattcatctatttcgagtcatgtcattacaattttgctattatttgaaatataccactacttattccttcaatttaattcctaaaatttctaaaccaaaattcctaaaatttctaaaccaaattatccttcttcctcctttatttcctctctcttgttcgtcttctctgtgaactagatctcacggccactgagctgaaccttgaagcagcaggcagcatgcctactacagtggtgtttggatcagggactaaactttagtccgtgtcacattggatgttcggacactaatttggagtattaaatatagactacttacaaaactaattgtataaatgagagttaattcgtgagacaaatttttaagcctaattaatccacaattagcatatatttactgtaacatcacgtaggctaatcatgaattaattaggctcaatagattcgtctcgcgaattagtttagggttatggaatgagttctgtcattagtttatgtttaatgcttctaattagtgtcccaacatccgatgtgtcaaggactaaaatttaatccctggatccaaacaggacctacggtatgtagaagcggagtagctgttgtggacccaatcatgcaggcatatgcagcaacgatgggtcaaatcaacaactactcacaatcaccgggacatgatcccaaggtgaattagctgccatgttgctagtagagatgcaagcaggccaacccacgaacctgcttatatgaaaaattaatgggtaacctgtggattgacccgtgggttatctactaatttgctttgtaaatgagtttatggatcgatccacttgcgtctctaggtgcggcaagctaggctacgacgcgaaaacccatgagttaccacttatttgatatataagtaggttttcgggtcgtcctgcttgcatccctgctacaatgttgcatctaataatctctatccgatccaccaaagcacttgattccccacagaaggattaagatgcagcgtaatcaaacaggtggcctaagttgctgcttggtcgttagtcggtcctcaggcagcatggcttgcgacgggcacggtgacggaagggattcgagcaccagccgtagggcctcatacctaacctccgcctcctcgccaacgaggatatctcccgcagctccagtctgtcacccttcggaccaacggcccgacgtccgaaaacgcctcaccggaaggggctcgtgcgaagagcacgcatcggtgtatcagtaggtcaatatcactgaatgaagaaaggggatgcagatgttggagaagatgaacatgagatggagatggagaatcggaaaatcggcccacgaacagcctcatgcttgcctaggctgcaacacaccgccattcggctattcctatcaggtggagggggaaaatggcaccatccttgttagacggagggggaaaaaaggctctatcgcctgctattctgagggtggtgagacaatgaggactttcttcactttgatcatgagtctatgtcaactagcttcctctcttctaccctattcctcatgaatggtttcttagaatcgatcaaactccacatattaggttgcctttgagcaagcttctccctttctcatggaagaatcgtttgattgaagattcagttaaagtcttccccatcaaaataatgagatggaaggagctaggtttgtaatgcaactccaagctctgtcgagacactggatcacggaaaaattggagataggctggaaactattgttttccccacctatcttgaggatgaggtgaacttgaaatgcattcactaataaatggtgtggtataatggtataatgaattgtattctttgtgttgctatacaattggatcggcttatatagcccccgaaattacacatgaaattgcaatcttgccccaagggtgcactggaagttactataatacccccataaagttggaaaacctaaggatgtaactatacattcaagtggtctcccagagctactggcgtcagcttgcacgagtgattggagtgatccccacgacatcttctaagagaatattccatgctccatggtgtaatcatcaagctcctttctcccttgtcgaatactccctctatcctagtttgatcatcacataaggtttttaatgtcttcccaaaatgatcatcctctaacaagtgcatcttttttttatttgtgccatgagtaaatgagcatcattgaatgcattgcatgtaaccaaccaagattaatttctattggtccaactacatgcaatatttaaaatttgatacaatacatggaacacgaaatgacgtagcaccttaaccgatgagaattaattacataatgatgaatgttttattatcattggtctctgtgctctttgcttcggtgatgatcaaaatggaatggagggagtagtatttttgtcttgtaacgaattcgaatactactttccaagccggcattcgtgtcatgtccctcggtcatcttctacttgcttgtcacaaagggtcgaaaagtatttgccctaagtaaatatatcctcgattagtattgggataatgttttggtcaaataaggagatggtgtttgtctcttactgaaatacttgtgtgttatgttttttggtcatcaattgtatgcactaactttgttttatatatagggagagagagatgctactaccatgtttttgggtaccgcaagttggaattgaattgataagtttatatgaggttggatgttttggcatcgctatggatgtcaaaaaaaggttttgaggccaaaaaaaggtatacaaacaaaagagaatccaaggataaagttacaccatgtagatatgtttatggaaatgagggtcatcgaggaaaggataaaagagatcatctaataaagtatccttgagctaaaactagatctgattgtcaattacacatgggtgtagtaatggacagaaagacaagaaactatgaaatagctaagttaattttggaacacactcacccttttgtattttcctgaaaccttacacttgatggcattataaagaagaatttcagatttacaagtttttgaaattgaaatagccgatggtgcaggaattgggccaaaggcaacaaatgagttggcaagtcaccaagttggaaccaaatcattcgttgttttattataattagctttcttttgtcattttgcaagcaaacattttggaaccaaatttctttaaatgttcagccctcacatattgaattagcaacaacaacacattttgatgttttttttctgttctgatgtcacaatctcttttgccacactaaattggcacaataatcagtgtcaatctcttcgtatttttaaattgacacaatagtcagaatcttaaatttacaaggacgctcactctcatcacattcagtattgagtcacaatctcaattcaaatagatttacagtttcaaatcaatttacaatcacattcttgatctactgttgttgtcctcctcagaggtgctggtggtggccgccctgacggtccagactttgctagcaacaagctagggacccgctcccgtcctagtgttctcatctaggttggaacgaggtgctcgataaggacaccaccgtgaaagccatcgtcgtcgatgcgagcatatgggtggagcaggcccatgaggcgaggcgatggaagagagaggaggaaggaaaccagagtcgaagtgttaggagtgacgggctgtgcatccgtgggataatttttgttcgcttccgcgcttctcgctagtttttcgtgcgatgcggatcgaacggacgtgcgacgcgccacgtccgtcttgacgtcgcaagaccaacgtcagtcagacgatcgggttccagtccagcgaacccggaaccccatatgtttccccggccgtttgggatattttgccgtggttggtctggtggataaacctccccgcgaccgcgaggtttgcctactgctctctgtgtcagatatccacacgtgccccgtacgccgccatcgccatggctctccccctcgtccgcctccccccgctccccgccgcgcgccacccaccgttgctccgcctccccaagcactccgttccgcctcacggcggccgcgtctccttcgcctgttcgtccggtagccgcgccgccttcgctgcctgctgtgctagcgcctcggtggccccggcggcggaggcggaggcggtggtggaagagcccgaggggccgaggacgcggctcatcgcgcagaacatcccctgggactgcacggcggacgacatgcgcgcgctcttcgggaagcacggctctgtcgtcgatgtcgaggtaaattgttttccgtcgccttatccttgtccgcttcagagagaaggaatgtgcggcgaatttggagtggcagtaattcgctgtgaccgcgccgcagtacgaagcaggcagcagcggcaccccacggttgctgagagcctgagatcctagtgccaagaggatggcgtgaatttgcacaagaacacaaatgcgtttagcgcgtcgatctgaacaccaatacaccatggtccatttgcctgcaagaatgtccaatttagactttaaactattgttcatttcaaagttggttctgctcaagtaggagccaggtatttgaaagactccaatggttctactaacgtggatgatgtgttcccttgccagcctcttctcgaagggtgaactgaagaatctgagtcatttttgtacttaacaatctagcagaaattttgggcaaaagaatcgggactcagtagtccaatgcaaactgcactatttgcagcttcatttccatgttttaagccttacatgttaatatcaggaggttaaccagctgacctggctatgatgcattcaaaaatggatctttctccattatttactgataaatggcatcattagtgattagttttattgcttgatttgctagctctcgatgtacaattcgaccagaaacagaggattggcgtttgtaaccatgggttcagaagaggaggctctttcagcactcaaccatctaaattcgactgtaagatctagattgttctggaaggaatgtctatttgtatcagacatactcttatttattttttgagtaaaatgcaccagcggtccttaaacttgtcagcaggtttcacttaggtccacgaatttgcaaagcgcacatcgaggtccctaaacttggtttattgtatcatcccggtccaaagccgcgtttgaccgtggtcttgcctatgtggcacgccacgtggacgatgacatggatttttattttattttttctccctttttccttctttttttctctttcttccttgtcg

SEQ ID NO: 79072 - DNA, 42949 bp, Oryza sativa
  unsure (1)..(42949): unsure at all n locations
ccagctacagcccttccccagctccctctccctctcgctccccatctcgccccagctctcgcccgcccctcctcgccgccacctcctccccccgctcctcgcctccgcgtccgccgcccaggccgcgggccctgcccccgcgcgggcggcgggcggcggcggcggcggcgcgaagccggttcccctactcgtctccctcgccgtcggcctcgccgtccgcttcctcgcgccgcggccggccgaggtgaccccgcaggcgtggcagctcctctccatcttcctgaccaccatcgccgggctcgtcctcggcccgctccccgtcggcgcctgggcattcctcgggctcactgccaccgtcgccacgcggacgctcccgttcaccgcggcgttcggggcgttcaccaacgaggtcatctggctcatcgtcatatccttcttcttcgcccgggggttcgtgaagaccggactcggcgatcgtgtggccacctatttcgtcaagtggttggggcgcagcacgctgggcttgtcgtacgggctcgccatcagcgaggcatgcatcgcgccggcgatgcccagcaccacggcgagggccggtggggtgttccttccaatagtcaagtcgctatctctttcggctggcagcaagccgaacgacccatcggcgaggaagctgggctcctaccttgtgcagtctcagttacaggtaaaaagttacttgatatctgcagatgttaaaaatgctatgcgttttaattagtactccattcatgaatggttgtgaaatgggagatgcatttcgcctagatatttataatgttcagctgggaacatgcttctttttttggtggtctctatgacatgttattgaagaagtgctaagaatgagatcttcacttacttttgctttggactgggtgtctatactatttgactggagtactaatgtgcattgatcattctattatcccatccgtctcaaatactacttgatgtatgatgaaatgctcacgctgtattattaaggttgcgacttatctttgttagtgataatatataatgtttgttatacagtcatctgactagtttatatcacaacagcagaggtaaaaaaaaactgtttctaggtgcaccctttgcttctttgagaaactaaaactgaaaccaataaattgtagacgtggtacaattctgactctttctgtaaatagtaaatggtaggaagcccaaaattgaaagtttggttgaaattggaacgatgtgacggaaaagttggaagtttgtgtgtgtaggaaagttttgatgtgatggaaaagttggaagtttgaagaaaaggtttgaaactaaactcggcctaagtgaagtgtggtttaaaaatggttgcctggtcactttatcaggagctacatttaaaccaaactagcttgtactttatgaattgaacactttgttgaatcgattgaattcacaaacattttaattgtttggttaagtgcatgagtacatcatacatttacttttgaggttgtcagatcctactatatgctgaaagcaatacaaactcctggtactaggtttcttttgaaaaggcatgtttagtgaaaacttttcgatatattgcttctgggatgttaaaactgtatgcatgctctgtgctttgatattttacgttttcacacccataaggattgcatttgatcaatggcattgttgtgttggtttctgctgcttcacaggcatctggtaactcaagtgctctcttcctgactgctgcagcacaaaatctcttgtgtctgaagttagctgaggagattggtgttaagattgcaaacccatggatatcttggtttaaggttgctagtttgcctgccatcatttctctcttagcgacaccttatttgttatacaaaatattcccacctgaaataaaggacactcctgaggcccctgcaatagctgcacaaaaactgaagaacatgggaccagtaacaagaaatgaatggatcatggttgctacaatgattcttgctgtttcactgtggatttttgggtaagattgatctctctttttactaatttattttttccatgagttaatttgccatatatactttggtctatgattatgccacatttcctgttgcatttttcataagctgtatttagctactccttctaacgtgatagtgttctgtcgatggatacacatgatatacctggaacaactctttgttttaatgtttggggacagctttcttaggttctgtttggcattgcagtgttttatttttttataaacgtttatactttctgatataacagttagctgaatgcattttggataacaggaaatcttacttgaattagtaatgatttatttaactaactagattccatggaacagcacaaaacaaaaccacaaccacaatctggtcctttgtagctgtagacctgtagtgaattatcttcttccctttagcattttcctctgaacacgtttttgtcaatccggaatcaacccaggttttcaaattatgaatcatgattatggagatgtttcactttctgttggtaaaatgttcaacatgattgaaaattttcttttctttttttgtaaaataaatagcatattcttcttctgcattgctgacttttgcacaaggaaagatccattaccttatattggattaatattaacaaggaaagacaccctgcaacatttctctcttatggcaacatattcgtaattactgtaactagatgtcaaactgtgcattgcacggctattcttatggatatttaaaaatattaaagagttttttttctgatttaatagttttgaaattcgtatgtaataaatattgagttgtactccattttaattcttagttgtaactttttcatgttttaataaatctgaaattcgaaatcaataaaaaaaaccgagttgaattcactttacaatgttaaattatgatctatggtagtgataatatgatgcatttattcaacggttagatctttgtggttaacgttggagcttgtaggaagtgcctaattagtataggtataaatgcgtttttctaatgcttacttatttttgccagattgcttcctaaatctttatgcttggttttcacttcagtacttcacataatgtggatataatgcatgttatcttaccaagtgctacggcaacaagatagcaagagcattaacagaaaagataaagaatgctactagtccaatctaaattaggagttattcccatatcgttgcattttcggtccttttgagatattgtcagatattcagatgtgtgcttcatgttgtattagtcaaactacagcttatatatatctgttatacatttttttttgcagggatactatcggtgtgtcaagtgttgttgctgcgatgattggtctttcaattcttcttctgcttggggttctgaactgggaagattgcctgaatgaaaaatctgcatgggacacattagcttggtttgctattctagttggaatggcagggcagctcacgaaccttggaattgtatcatggatgtcaaattgtgttgcaaaagttctccagtctttctcattgagttggcctgcagcatttggtgttcttcaggcctcctatttctttattcactatctctttgcaagccaaacagcacatgttggagctttgtattcagcatttcttgcgatgcatttagcagctggcgttccagctatactgtcggcacttgctttgacatacaattcaaatctctttggtgcactgacacattatagtagtgggcagtctgcagtatactatggaggtaagtttttctgtgtgcacacttcattgaattcaatttgttttcatgttgacactttacgacacattattctttaatatttgcctcttcttgtttgtaaaagatctgttgttagagaaagagcataacaaatattttacttactacgtatggatagagtattcgaatacaagccttatttgatatcattatgtaggactacattgaaaatccaaatgtagcctaataaaggaataaaaccataagctaatggataccagcagacaatttaaaaaattccttggtttcttttactgttaggtttgtcatattttatctttaagcctttgtgtgtacttcttatattgagtacatgttttccttgtgcagcggggtatgttgatcttcctgatgtattcaaactgggttttacaacagcagcaatcaatgctgtgatatggggagtcgtcggtacattttggtggaagtttttagggctttattgagtcattgcaagtgttaagttgaccaaaagtgttccttactacacctgtaattcatggctccctttctggagtggtagtcattttttcttcagaggagtttgatgagtgcataataatggaacgatgttcctcattagaagtcttgaacatgatacacttgtacaacccagaagggttctcataggcgttttgtacaactcccatgcatttctcatgaacgaaattaactgcaggaatgagtcttgattccttgagcatattgttcatgtactctcggaactgtatggattgcttttgctatatgccgtgattgttaatttattatataggaccatgagtttcatcagacaacacaggattgctaagataaaaacatcaaaggccaaatgtgccatcttcctatccaacaaattggatggcagagtggcagactattttcggagcgtatttgtctacaatatttgccacatgtgaatctttgatgaacttgtgcaaaacccttcagcaggttagtgcatttgacttgaaggttttcgtttatatttgaccatgaaatgaagcatttgacaagtaatctgcaccaatacttgtccatttgtattccagtagtgctaccgattcatcgtgtttgtcactttgttgattgctattcgtcaggagaagtgctgagcaactgaagttagtgaagttttcgaagacattctattcaacttaaacttttgggttgaactgattagcacccgtaacacaatcactcttgtaagttgcaactgttgggaagaatttggttgtttaaacatgacgctaattttgatccgcttctccagagttcaggaccctaggccccctagccaagtctctccttttttccaattccataggagaaacatgaggccatgttcaatgcgtagccccaagtcgtgccttcacaaacggtgtcccgcttccgtcatcgggccgtgtccttggagagaggcgcggctcctggcagaggaacgcacgcctctagctccttttcttgagccaccgcttgggcctatgcgttggacgactgcgtagctcatggatacggcctcccgcaccacaaatttcctcttccacccttggcctcgtcgctgggagtaggcgggaggcacatagcaatgcggaggagtcggaggtagcgaggtggtggaggagccgacggatttgtgacatcgacgacctggggacggcggagggagagggacgggccccgcgaacccgtctgtcagccaccaacgccccagggatggggcaggcccactagatccgacgacgacctcgtgatggcgactgctcgccgtcagccatcagcagtgacgggcgaagggagaggggtggcgacgtgttgggacgaagtcggagcggtgccaccgccgctgttcccttcttgcctcgccgccacctccctcgccctccccagcgtcgccgcgtctcgccccagccgtcggtgaagggagcggtgggagctcgagctgcagccggatttggcgtgggagagtggacgatgagcggcgacggcgggagagagaggcgagcggtggcggcggcagctggggagggcgaggagggaggtggcagcggcatgagggagagggagagggagggggagggggagggggaggacggcgctgagcggagggagtgagacgaggcgaagaagaagaggcaggagcgaaggaaaaagagaagagagagagagaggaagagggagaagagaggggtggtataggaaaacacccattgtgggttttttggttgggacaaccattgtgggcttgagtacctttatccaattgcttcagattttaaagagaccacctagatgtagccttcatcagtttactggtaattgagtgtccctgatagtgtcctcggttagtgaggacttttaggtggggctttgatgatagatgccctgtataggttcagttctcagtctcaaggaccacagtatggcatttttttttccttccagcagccgaaccaatcactcagaaaattcagtatgcaatcactagccgtgggggctcgtcgctcgcctccacagtccacacacgtacgcggacgtggagccgagcgtgacgggacatggacacggacatggcccgtgccggcaaccacacgcgcgcatccagcgtcgtgggctcgtggcgtctcgtgcatgccacggcagcacaggcagtcgcgcgcgcgcgtgggggagagaggaggcttctcgccttccgctggatagcggccgagccgtcgtttctttgccgccgcgccgtgcgacagatggatggcggcatcgcgcggtggtggggagggggtgaatcggttttccggcatctttttccacggcgcgtcgtcctcgttcgtccacgccattttgtttggattcgcccgttgaaaagcgtaccaccggtagcagagctatacgccaaacgtcccggtgaacgataccggaagatgggttgcacacttgcacacctccatcttgcagtcatgaacttatcctctagtaggcctctagggtggagcagcagcaagccagcaatgctgccggaatatcggccattcggcagtcaggctccacgtttttttttttacgaaaagcatgaaatttaggggtttcgacgcggaacgaaagcaaaatctgagtgaaatttcaaataattttcaagaattcaaatttaaaacgataaatttgactaaaatttgattaaaatctgattgaaatttggtgaaaactgttataccactgagtatccggatcttgtattcatcggaaaggtgaaccctaaccaaagtctttctttttcctactccctccgtcctaaaatataagcttttttttatctcggcacggtctgcgagatgctattttgaccaacaatatttacaaaagtaaaatgttttaaataaagagagttgcatattatgatagtccatttaatgataaatatagtaacatgaaaattatattattaatatttttaatttttgtgctataaacattgaaaatttaaaaaatttgacttcgtactattaaaaaataattatattttgggacagacggaatacgtgaaggagacactgtgtcaacctgtactgtggacgtcagttccatttcatggtccatgcagatatgaatatacctatgcaatatttatgatgaaagcaatttgtgagcccccatctctcgtgccatgttccggcccggggttccttggcgctcaccgtgtttggtccctggtcttttctgcagaaaggctttaaaactgtgcgctcagaatagtgcacccagcagtgtggaggacaggaggaggcacaacaaatacctaactgcttcgagcaaggctgaccaccgtggtcctcgctctttaggttaaaatctcctgtcaatgtaatctaccgcagttaaaccttcgagcatttttatacacggataatttgttaagattttcacatgaatggagtcatttttgttaggaatcagaaacaaaactttgtgctccaaacaaaaaaaaagggcccaattattatggacgaagccaaatctagctcctgattctgtgcagtttaatcagtttttctactttgttgtgttcttacaaatccattgtttgtggcggttatagctttaaaatagataaaatggatattctcattaacataaattgtatttatattaccatcatctaaacaatataataatagatgaattaaggcacaaaagagcatccaagaacacccaagaatggaccctaccgtggtggtgctggatgccaggggcatgctggtgttgccgggttgggctagccctccgcctcactggccggtagcgctagatcaccgaacaaggtgccacgtagaggcgtagtcgcacgcccgcggccacggttccatacagggcacgatgtcggtgctgcaatcaccaccgcagtgaaggtaggggtgaaaacggtacaatttttttaaagatttccggattccgttttcagtttatcggaaatgaaaaaggaaatatcttccgaaaatagtatcggaaatgggataaagatttttttttttgactgttttgctgataaccgtattgtctagtaattttcgccaaatttttgaaagtttcaataatttccgtcagaattctgaaagttccctagcggctagtagggatgtcaaaaaaaaaaaaaaactcgaggctcgcaagctgttcaaggtcgactcgtcctagcctcgatttgagctcacctcgagctccaaacgagccgagtctaagcctctccgaaagctcgcgagcttcttcgagccaagctcgagcttcctacgagcctaataatatatgatttttattgttatttaataaattaggacatcaaatatattatttatatgccttgtattggcgtcatatatttattttgttttttttcttcttctatttgaagttgcatttatcctctagtgggttttggtgattaatgatgaataaggttaagggactaatgtgtttattgagatatacaggtaattagtcccaaggtgatcttaggtgatcaagagatgcttggagacccctacaactttcattcatgcggatttgaaactcgaaagtcaataggatagtttaatttttgaaatcgagtcttaggaaaaaccgtactattaagaggggtttcaagtgtggttctgagatataaaaatttcctcttagtgggttcatagtgatagaatatttttgggaaccatttttgcaaatgggtccagaccggacatagaaggctggccggaagttccggtccctggacccagaacttccggaccttgcattggatgaaatttgcgtaagtgttggctggaagttccgggggtcaggaacttccagacttcttccagttcaaaaatgtgagtaatggctagatgacgtcacctagccgttatatatatctagatcgcacccagctcactttttggccattccacttcagttctttcatcccctaggttgttctagcctctcccaagatccctttgcttcctccactcaaatctagagcctttcttatgaaattgtgagagtagatgagagtgtaggagtaatttggagaagctttgaagactaggtgtggttgagcactttgaatatcttgtgggttgtcactcggggcttattactcttggagatcttctcctagacggataggtgtcgcccgcgagcttccgaaatcttgtggatgtcccaggaaagtttgtgaaggttttcctcacctccgcaaggaaacgaggtaagtgattaaggattcttttgctaagttttcagaggttctcctaggtagagcaacttgcacttgtggtcttttctagaaggatttgtgagttggatcttggtggtcactcaaattctagaaaatgacctaggagtgttgagttgaaggccttggactttctctgggttctctgtacaagtgaggcaaggggttaatcgagacccggctctttggagcacctcaacggagagtaggattgcaagatccgaacttcggtaaaaaatcgcccttgtcttctttgtgatgattctgtgcatgttgttgtgattgtgtatctgctctgtcttcatgcagtttaattcgtgcaaattagtttaagtctttgctagatcttcaggtttttctgttgcccggaagtttcggtgtttagaacaccggaagttccggtctgtctgagtagactggaagttccggtgttcctcacccggaagttccggtcctgctgaattttaccgctatgatttgtttgtgaatttcaggatagcctattcaaaccccctctaggctacatctttgcgcgttcactattaatatgataaactagaaattaattatttttttatagattttccttaaaatatacattgtgctacttaaaaatcaagctcggtagtcgagctcaagcttgatcgagctcgaaccgagtctgtctgaaagctcgaacattttataggctcagatcaagcttggctagagcttgtatcgagctcgagtctaggcaggcgagcttgctcgagctcggctcgttgacagccctagcggccggccagcccaacccatggcagacttgtagcctattaggaaggggaagtggccaggaaaaacgttgttaaccctaggacgtggcatgtgaattttgctgaactttggtctactcaaccgatcgatgttgaagtatcgccaaaatttgtttatattgttcgtcaaacttatcatatcattaatcatcatataacgatattgtgtggagtgtgatgatgtaagaatgaagtaataaagtcattttcatatatagttaaatgtgttattatgccacgctccgctgttttcgacatgaattttcaacttccgaccaatattggcagattccattctgacggtcccgtttccaatatcaccgataaaacacgaacatagatagcgcacacttacatttttaatctaccaaaattgatagtgtacacttccaaggtttttaatcttttccaaaattaatttaattaagaaaagattaattcaatcagatcatatatagtgcagtggaaatgggtgtgtggttccaaccccaaggtcatgtgttcaattcttaacacgctcacaaattcttcttagagcatgtataatagcagagtgtaagccggctaaatgctgaggtggaggagagaagagaggagcgagaggagaagcgggctgtaaacttacagccagcttggacacaagaaccaagaaattatgtgagagagacaagtgggctctgtatttatttattgtaaatagctaactattacacgtgtgggctaagagaaggctgcaaagaatcttatagctaacaagtcagctatattattaggcttgctcttaaaaaaatgtttggaggatgtctccctctaaatattgttttttttaatcagcccatagatgctagcgagctgtgattggaaaaacaggaaaatgctgcagaaagttgcaaccgtggcataaaacttgcgtgtaatttcccccttcatattccctgagggcaagtcccatctactttgctgaagaatcccctccacaactcaagagtctctgatgagataccttctgtcttctctggtgattacctcgttgtctcaagccccacacacgttacatcgagcaaacatttgtcatgcaactgtacgtgtacatgacaaaccaaaccgctacgctctcctccttatattggagaaaaagaaagaaaacacggaagaagaacattctaatgctttcaaaatataatactactagagagtggaaacattgtggtattatatagtcttgattttgtacaagaacaaatatctcaaaagaagattcctaccatagactgatagacattagacaaagatcacccttttttggagttccattttctttaatgtaatctcattctaggactcgtcgttttcgtggcagctttgtgtaatcacagaggtattagggcacatacaaaggtagagaccggtgtggtctctacgttaattagatactatcacgttacaatagttaagataatacggtctctaaccattaatgtaccaaaatactttcttactagtcatctttcctttattagactcaatgcaacgaaaaattttcttaataaatggctaagaatcgactctatgccattgtcatgtgtagcaaccatctttctctttccttcttcatctctcttccacgtcacaaaatatacttacatgccaataaaaagagaccgctaataaagacccttgtacatacccttacaacaacaaaaaaaaagaaaacggattcgattggattttgtcagcttaaacaaaggattgtgccgccaaagaacgtctcaaaagccgcgattactttctccatgacagcagccgagaggagtaaaaaagaaaagaaaaaaaaaagatctcggccgccgccgccgcgcggcgtcttcccctggccgcgcttgccacggcgccatgccgccatcggccccatcccgctcgacccatttcgcatctcccaacgccgacgacgacgacgtgctgccgcgctacctccgcgttttcgttacggatggaacatgaaagcgaaacgcagggcacttggccacttgttacctcgcgaatttgcacttaggccgagtttagggtgtatttaagttcacgtcaaaattagaaatttagttaaaattaaaacgatgtgaagtaaaagttagaagtttgtgtgtgcaggaaaattttgacgtgaagtttcaaactttttctttaaacttctaactttttcatcacatcaaaacttttatacacacgtaaacttccaacttttccgtcacatcgttccaatttcaaccaaatctttcaattttgacgtgaactaaacacacctttaggacatttttagttgaggactaatattaacacatatttttaattaaggtaactaagcttagtcatgtcatatttttctgtaaacaaaatagtaacaaactaaacttaagcaaagttaggtaagaaaataaagtgtatgatatgtgctatgcagctaagggttaaacaaaagtagatttatgcatgaactgaatattacctgataaaactgtggcttgattaagataaggtgtgataaatttagttaccaaacaaaaatgcccttagactttgctactcccgtactccggtattatggattttggctcattttttacacagcttctgagcacgtctcgtccggtgcaaagccaaaacagtaacagcaggtaaaagaaaaatgtgcaggagttacacgagccaaagcaaatcacacgaagcaaaggcgaaaaaaggaagcgttggctcccacaacttccccccgcggaacaaaagctgctttcctaccttcccgtatagattggcgcgtagcgtcgcctcgtcgccccccggtgatccggctctctctccccagtccccaccaccaaaccagccaatggaagcgcgtcgccttttgggctaatttgcccccacaagctcaaaagcccgctcccttttgccatgtccgattgccagtcggggtccccccaactctaccaccgccaccacaccggcagcccatgcctactcctacagtcctactcctctgtccgtcgtgctcaccactctcactcccacgcagacgcagggtggaggtccggaacaaacagaacgctgtgcaactatgagcaattcgtcatgttcaaatgtaggcactggaagcagggaaatagggggaaatagggttcacaatcctgataatggatcgagattcgctcatgagttgtttcatcggattacactgaatccataaaaaaaccgatgaaaaagacaaaaaccaatgaaatttggataaattttttcaaaaatttttaaaatagtttgaaatttttttattaactaaaaagccgagtggtttatgttttcaacccggttcaaaaagttcggatttcgcggaatccaaacaggattccactggaactgtgaaccctgagagaaatttatagtgctttccagttgaacacttcaaatgcaggtagggaacttggtaaaaactagaaagaaacacgcgctacgctgcgtgcacggaatatatggttaatggcacatagtagatatgatgtccggtatgtaaacatcgatatggtagtcaacactacgtgaggaaataatttatgttgcaaccaatatccaataatttccagtctatttgtataataatgtgcacttagacaaaagtagtagccacacgtggaaacatatatatcgtgcctgcatactgtagaatagattagaaaaaaactcaaggatcctaggattcatctctttcggggagccaagaagcactcttcctcccttttctgaatcttcggagaggcaaaagaaccacagaaacattgacttcaagggaaacattctacatttccgtatagctatgctcttcgtgacacctgcaatacaaagatgtcttgtctttttaagcttgataataaatagtacatcattatatgtattcgcaataatatatataaaagatgacaggtacttcctttgcaaagtggcattgaataatgagccatgctgtacattatgtctaaagctccattttgcatgactgttcattcacaagtatattctcatgttccattgaggggcaataaacatggcataaaaaaaaatcaaataatctaatgaaaattccttgcaaaaaaaaaaggcttagcaaagtcattctgtgaaatccaacctaggacaaaaaaaatcataagcatgtttaccaagggaaaaattcaatctgaaaggatggaccggtaacaaattccaaaactatcatgtgcaaggtgcttgctagaaaatgataacagtactctcacatatggcatatatatattgtgcaaaattgattaaatttgaggcagagatttgaaagaacttttcacatgccaaaatatcttgaggtagaccaagcacaaaatagaattagacaaataggtggacataaatgacaatttataattgagtaaaggaacactacggtggaaggccgccgctccaaatcttgacatatcttgcaaaagaaaaaggcttttcccttgtaagaatccaacaacttttactatgcttcttttgaaaagaccggacagaaatcatatacacagcagcaacgtgtgcaaatagtcaaaaaagaagctacaaaaattttgtgtagacaacttgtgagcgttacaataaatatgataatgcattcagaaacagcacataaaagtttataccatgcataaaatttttgacacagaagacactttgttgctctgtttttagttctactggtttgaaacagtagcgatcaacaaactataaagtggcagaatcaataccaggatccatgaaaatatagaccacctcaacacttttgaaccaacattctcatgtgaatatttttattgtatatgcaatagcattaaagatttttaaggttagaaaataaggtaatgatctcacctcgttgctcaaagaagaaatctcctcgactgtagatcaactgacttggatagaagataagcacacgcatcattcagagaaatagtctcaagtttatatctattattggacctgcaaggaaaactgaagaagtattattccacattgggatctagacaacaaccaataacttattaaacacattagcattggaaaagtaacagttttttttcttttttggtttcacatgttgcatttagcaatacatatgagctagtattatggatggttcatacaaataaagtttagaagtaagaaacattggggcaatatttcaatattagcatgaccaatatcaccaccagtaatttccaaaatgcttgaatcacttaacattagatgggtaatactgcataaatattataatccttgttaaaaagaaatagccaatcatgctaggggaattggtagtctatggacctggaataagtttgcacatcaagcataagtaaaaaaaaaaaagaaaaaaagaggtatgattgaaactctaggaagccaaattcaaagatttgacgtagtaagtaccccaggattattgttaaagcatctaaattgcacatctaagatgttccataaagaacatgatcaatgcatacatcagtcattctatcaacaaagaaaaatgacttgttagaaagggatggaagagagcacttgctcatagcgtaaacaccatacctaccagtaactacaattaaataacagaatgagtaatcccatgtcacatatatcactgggagaagacaaaaaaacagaattagtaccttcaaatagaagccacagtagtttgcacgtgagctgatgccattgcttttccgtgggtgattctgcaaccgaatgagcaggagatcaataatagggataaggatagggaaggatccagatcaggtatgtatgcatataacagtagaaaatttattatatagcttagtggtttaagcatgggaaaacagtatataccgaattagaggatcattccatggattcaccgaaggtttagggtcatgctgcagagtgagcaccagtccggactggataaattggatctatgagcttcaggatgaacaggtaaagctaaggattaggagggttaaagggaaaaaaaagggaggcaaaagggctgcataccttaccagggcatggtcgaggcggagatgccgttgaaggctggaccttggtgtgcccaaagccctaatccatgcggatgccgaggcaagagcaggccatagaggccaattcctctagctgcaacggagaggacaataggggcagcggcaacgacgacgatcgacggcggcggcggcggcagtggcagtgcggtggcaggtgaggagattgcatacaccatctgagagagatagtgagacggcgagccaccaaataggaagggggtgaggaagagggaggcagtggtggggaagagataaaagaggataagagggtggcggtggctcatgttcctcacctccgtgtgggcacatcaaccggcgagtaggacgggggccatcacgctgatgcgatgcgatggccttgctaggaaagagtggcggcgacgatggatgcaggagggcgaggcggcgacggcgacgatcggaggaggagggtgaggtggcgaagcgacgcggcgggcgacgaccggcaggagagaaggccgcacgacggcgcgaggttgaggggctgagggcgaggaacacgaaacggctagggttttggtgtggcctggcgaaatcggtgccgtccgttcccaatccgacgatctcacagctgtgtaaggggcgccacagctgggacacgtggacggtcagatcgatgccagtgcgaaatcggacggaggattgtacggggattgacacgtaattaacaaaaaaacgtgaggacttttttgcaaaatcaggatgacgtggcgcgctaattctccagcactcccgcgacgtttagagagattaatatgatagcgtctggaacagctagctgtgtggctacaacacaacaggactcaacaagcaaacttctgctaggagtgctactccatccgtccctaaatataagagattttatttggatatgatacatactagtatagtgaatctgacatgaagattgtctagatttgttgtactaggatgtgtcatatccaaccaaaatctcttatatttagggacgaagggagtatatcgttgcggctgcacaaccacagccagccgaacaaccccaacatgtttaaaatgtcatttattatagttttaaccgtataactagtcgcttgagtagctagctggacctaaatattttctaaatgtggctcaagaaaagccttcccgggcaaaagaaactgaaatgatgattttgaggtttgtaactacttactctgttttacaatgtaagtcattatagcattttcctatttatattgatgttaatgaatctagatagatatatgtctagattcattagcatcaatatgaatgtggaaaatgctataatgacttacattgtgaaacggagcgagtacaagtttataaaaatcacataagaacaaaacatgacagattcttcattctagcaaaaaaaaaaaaaacagttcattctcctgttcatgtagcacgatcatgtctattagagttcacaattttattccgaggttaaaatgtgaggcctaacaagatgataagtttgcaaaatgcctagcttaaagtttgaaaagggtacacgtagaaaataaaaaggtagaatttttttcgagaaaaaaaataaaaagtagatgttagaaaagtgtcctaacaaacacaacaaccatggtcactctttaaccctcagtccctcacctactcagcagtcagcaccacgtttgactctgcttaatagatttagtgaacgtgcttaaaactaaaaagtcattaacatataattaattaagttttaattatatacaaaattagaaattaaaattatttaatatgttaaaacaacttctacataaaaagtttttcatacaaaatactctctccatcccaatttaatcatcctataaggtggtgtttagatccagggacttaactttagtccctgtctttagacactaatttagaatattaaatatagactacttacaaaactaattacataaataaaagctaattcacgagacaaattttttaagcctaattaatctataattagagaatgtttactgtagcatcacatatgctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctaaggctatcctcaaccctccatgtcatctagtttacatagcatttaatatattgtcacataagaaaaatgtgatatggtaagagagttaataaggagagagataaaaagataaagaaaccatttctcatgcaagaaatcatcaatacacaagaaccaataatgaaaacaaggggataggtaaagaaaaggagagagatataaggcgattagatgagaatttaattcgaagacaccatccattggatatatagtttatatacatagtgtctatatgacatagcaagtatgaaaactatttaatagtttttctgggtttgatggcctaagcaaatgataccaagaccaaaaacaacaagatatctatcattctgaaattattcatcatcgatcaaggtgctccatcacttcttgttcaacaaaaattaattcacactttaaatgttacatggatttgaactaatagggattaattgattagtcgcatgtttgcatacatgacattccagataaacaaagagacactttgttcgatgatgatcattttgagaaaacctcaaaaatcatagggacgattaaactgggatgaaggaaatatacttagtattgtttagcaattttaaaaatatgctaataaaaattgaaataaaatctgtagcgtagcatcaggcggccgtttacccctaaactctcctccctcccccctgccttcttttatagcgcacacagttctcgcaaggaaccgaaaacagagaggcaagaaaaagaaaacggaaaaccccccgcccagcccaaccacttcactcctcccactccagtactcgactccaccacactccagtccagtccagtacactccgcacacgcgtgccacagggatcatgcgaagcctcaagaacgtcgcctcctcctcctctagcggcgtctctcggttgtaggagacgctcgtcgtctttggacggatcggagcttgggggaggaaggcgacaaccatggtgccgatggtcctgggtcacaagacgggcggccacaccgacgacgccaagtgccatcaccggaggcacagcaccgagcaaccccacctctccccattacccttcccccggccacccctctcctcctgatcatcacgcctttctctgcttcttccatttgatctttgtgacaacgtcgtcctcctcccgctactcttcgaatcttttgtgaatttcacgtcgtgagacagtagggattgaagcatgagaagtccagcagcgcttctcccggtggttgcagatggtaagttttttttggttggtggttttgtgtggtgattggagatcttggttgagatgggagtgtgtgtttggttgtgaaaggtggtggtggtgttggggtggaggaggagatggatgtggacgaggacatggcgatgtgcggcggccgcggcggcggcggcggggagaagaagcggcggctgagcgtggagcaggtgcgcgcgctggagcggagcttcgagacggagaacaagctggagccggagcggaaggcgcggctggcgcgcgacctcgggctgcagccgcgccaggtcgccgtctggttccagaaccgccgcgcgcggtggaagaccaagcagctcgagcgcgactacgccgcgctccgccaatcctacgacgcgctccgcgccgaccacgacgcgcttcgccgcgacaaggacgccctcctcgccgaggtacgcacgccaagaaacggttctgatcacggacgagtgcaatgtttgtgacctttggccatggcacgcagatcaaggagctgaaggggaagctcggcgacgaggacgccgcggcgagcttctcgtcggtgaaggaggaggaggacccggcggcgtccgacgccgaccccccggccaccggcgcgccgcagggctcgtccgagagcgactcgagcgcggtgctgaacgacgcggagatccttccacacaagccagcgccggcggccgccgccgacgccgcggcctcggaggagacggaggcggtggtgaccggcgccgcgctgctccaccacgccgaggtgttcttccacgggcagcttctcaaggtggacgacgacgaggcggcgttcctaggcgacgacggcgcggcgtgcggcggcttcttcgccgacgagcatctcccgtcgctgccgtggtgggccgagcccaccgagcaatggacgacctagctagccgcgaaaactttgcttacttggctggggcgaataaacaattccgtagggggttttctgcaaatttttgtaaaatgaaattgtacctagtccttttttgtcaaaatcctccccctctagtacgtgggccacgtggccggtgagctagaaatggcactcctggctttctctggctcaagcagcgaacgatgcagaaaggggagccaagggagattcgtgggaaacgcaggggaaattccgcaaaagtagcgggagagaaaaaagtgacagtagtgtactccgtagtgtggaggaaggcaacggcggcagcgctggagggaacagtgtcgctgtcggtgggcccggcgccacgtgaaaagcagacttgtcgctgacagcgattcctggcgtctgcctagtgtgtctacgcaaaaagccttgccacacttgccctcctttcctggccacaagagtgtagttcctctcacaagttcttttgtttgtgaatttttttttgcaaaaccatctaaaatatcaataaaaaaaatccgatttggcacaaacaaaatttttttttttgcagaatattggatggaaaaaacaaaggtgatgggtttgattttagtttagaaagaggcttatatcatcatgtgagtatcttttaattgattgactagtcctgttcgtttccactgtaagaagtggattaaattttgaattttcgtggcacgcttttcaaacagctaaacagtgtgtttcgtacgaaaactttttatataaaagttgttctaaaatatcagattaatccattttcgagtttataataattaaaactcgattaatcacacgttattaccacctcgttttacgtgaaatacttaatcttcatcttcagaagattcaaacactacctaaggaagtgttagtttagtccctcgacttattttttggagagatctcccaaacacctcctaattctttttttgcagtttacactgagttttgatttacccttgaagaactctcgattttcgtggacacgctacctgaaatatctttcgtgcaaaaactttttatatatgaaagtttttaaaaagataaaataaattccccaaataaatttacttttcatctttttattttaaaaaattataatagctaataattaattaatcgtttgctaatgatctttttattttccgtggctggaaaatctcgtctaaatgcatgggcccttatactctgcatacataggcaatgaaaaaatattttagaataaggtttttatataatttagtggtcctatagtgttgatggaaaacacggtggcatgggagattagctaaaggcataaaaatacaaacccacaacaaaatactaatccaatctagaattaacagttaaattcaagtttggttgcatcttatataagctaaagaagtgaagaactgcaaagcaaaacaagagcatcaccgactgtggaaggagcgttggattttctttggacggacaatgatgtgtttctaggagcttggctccactgtggggagcacgatggttaatttttggatggcacgaataattacggccagagtaaaaggttttggtactacctcgagccaattttcagcagtacggctgcactttctccgatcctttttggctcgtcctctgcatgtgcttttcagtgtggatttccattcatgagctgatgatgagggtgacgattctttccattaacttttgttccctttggtcctgcagaaccataaacaaacctgcagtttgttttaaacgcaatggacattcgattagccgcttgttggaacaatacaagtttcagtccatcgtttgacgtatactaaaatatattaacttttggtccagattcataactaaaatacttatattttgggacggatggattactaattgcgtataagtttataactcataacatcttattaacgattaaaaaaagttatatgtattcatattaacaatttaaaacctaacgttgaaaataaaccacgatgaaaaaaaaacaataaaatcagcactaaaatcaagttttaacatttaaattttgacagtggcatatgaatctttaatgtagtactactattataaaaaaaaattatagcatatttgagtccctaattgaaatgcgagctttgttcttatgtgattgagctgtcccatatgaaattcgattgttctagaaatccctaaagttattttgtaaagctaggctgttttgcatcaaattaatcgaactgtgcacaagaaggtgattgaaattgtaaaatgcaattgtacgggttacaataggagttagcaattgaataagcccatccattagccaagcaagacaagtcagtacatttcgccacctttttgttgatatccaaacggggccatctcgaatagaccaatcaccaattgactttctttgtttcttttgtccactagttttctgatctattgttgtcgtgttgcaatttggtttagtatgtgttgccattagaaagtgacggggaggaggacggagaaagatgtgcattgatcgagtgatggagtgtaagggtgacacaattgctgcaaacaaaggacccaaattggccatgtctgaaacgaattaatctcaaatataagtcatttttagtagtttcattaatacttttgtaaataaagtcattatataacttttagtcacattttcatcttcgttaaatgtaaatcgctgcagaactttctgtcacattttcatctttaattacacaaatgtctttgtcagatacttgacaactctctaaaaagtaaattaaaatagataaatcagatttttctagtgatttagtaaaataaagggtaacaaaataatttgagctgtaattttacttttgtttcacaggtccaaaatgaactgtgtcggttaccgaagaagacaattaattactagtacaagagatgaacggtatgtgcaatagcctccttgagaacaaaagagccttgtacttctagtagagcatgtcatgtgtattgtgtactggcatctaaacctacaaaatcttcaatgttgcagaaaaacatactttaaggaagactgaaagagaatggagtcgttatgagcacgtcaaataagaatatatcatgatcaatcatactccctcatgtttttaatatataataccgttgatatttaacatatgttttgctattcatgttattaaaaagaactactccctcctattttacaatttttgatgttttggacaatggtacgatctacaataatatatctttgactatatatttctattataatatataacaaataagtaaacatttaagtttattaaaattaccttttaaggctaatgtataaatcatatctagtgtccttaatagttattgatagtaaaaaaacgtaaatattagggaatgacctaatatcaaataatcatttaagtttattaaaattatattttaaggctaatctataaatcatattctagtgtcctcaaactaaatatttaatagttattgatagtaaaagacgtgaatattagggaatgacctaatatcaaataattagaagggatgagactttgaacccaggtcgtttattccatcaccttgtggagctagccagaagacccatcagcgtttctcaatagttattgatagttaaattctagtaaatgatttgtatcaatcttattcaaaacgtcagaattatggaactgagggacgtacacaattattatttatattactgtgatttactttattagtgagtttgatttcttttttgctaatcagccatttataatttgtataagccaaatgtgaagagctttttttttaaaaaaaaaacatagccacttatttacgaaatcaactaacattgctacaatcaacatggctacaaccaatatggcaatcaactaaatccatagtaatcacagccttaaagcgatggagttaatcgggacaccttcaaagatcatgaactacaagaagtgttagatatttgaatggctctttcgttaggctcgttatcccggttcaaacacgaaataattcctactgtagaaacagagaaaaaggagccctgaataaaagggacaggggaagtggaacgcgactcaccaaacaaaggatgggccccaaataaaaaggcgctttgtattcaacgctcgaatttcgtgggccccaccacagggaaaacaatcgacgcaggcttccgcgaccgtggccacgcgtacccacgctcacgggaggcagggccacgtggacgtggggccgcgttgtcatcgacgtcgcgcgacacgggggggtcgtgtgcggcgcgcgcgcgcgcgttcgatgccgtgcctggtggtgcgctgcgccggtggtggtggtgctggtccctcgccgctgtcccgactcgcgtccgatgacgtgggcctgtaaccatcgtatgggggcccgtggtgggccatcgtccggaaaggcgaaagcttcatcgtggcgcgggacgggtggggcccagtctctccctcgaggtgtaaatcttgcacagttgcacacttgtgctgagcttatcggttctctcgtctcaaattgtcatacataaactttgtgcttattacaacctcccataacattttaaaattgttctaaaatggttgttacataaatcattttcgtttcaatttttttttcattttatccttaatcaccatcccaccaccaactatatatggatctattcggctgcacatgccacttatatagccgttacaaccaacaacttgccgaacgctccctataaagaattatggcttgtttaatgtttatatagttatagacatttttaccaaaaaaaactgagcctctactttcttgttctcataatataactatttttaaactttttataaagattaagaggaaatataaaaaagattagattgtccatcgctatggtcagtgggtagggttgtaaaatcgagtgtatctttatatttcatcgctacaaatatttaaaggtagctattttttatataaattctaaacgtcaaaagttttaaataggaaaagtaggataggaatttgaacttccaagcaagacaaagacaacgatgctttgttttgttctgagctggtctgaaatattgtactactttatttatcttaaaatatatttccttcgttttaaataaaccaacctacgattaagtaagatactatacaatatacaatatagtaaatctggatagacttctaagtgtaccatataatgtttcattcagttttaaaatgaaaggaatactcctactaagtgttgtggagagcggaggagaggcaggcgagagcatagcagttctataccgggacacaacttgataaaccatcactgggctctatgtctgagatgggtcggctagcccataacaggcctgctttatggattcatgattcatgacccacctatacatttgtcgacaaattttcttctaaaaatttgacagatgtaattatagtacaatcatagtgtaattacactgtaacttatatgtaattacactgtaacttacatgtaactacaatgtaacttgtatgtaactttcacgtaattttgaatcgttagatctattacaagatttgttctagtgacgaacaaaaagatcacagtacacacatatgtgaaaagatttgttcccacgacctcgattttaccgaaataacatgttacggagagatttttgaaagttacatacaagttacattatagttacagtgtaattacatgcaagttacagtgtaattacactgcgattgtactgtaattacatctgtcaaatttttgggagaaaatttatcgacaaatatatagcaaaattgctaaagtatcgtatctgtggttctggatattcctaaagcatcaggatcgagtaacaaatgttgttaagatgaaacaatgaatttgttttgcgagaaatatctcatagagcaatcgaactcgaaatatgtagaaactgttttaagctatcaaggattgtatatttgatccatgtacatatgtgagcctgatacggattaggaggcgaatgtgatgtccctaaaatcccgtggatatggattatctgacaattccaccagaattatgtttgccagataatccaaaaatgttaacttacgctaccactctatctattgtatacaacataacgtgtccattcaataacccaatttatctgttaatctaggctctcggtccttcccctcccacctcctaatttctgacgtaggctctagcctcgtgatgacgttatcctcaacgcggcgacaacccaccacacgacggcgagcaacttattgtcttatcgattgcatatacacataacatctgacaatattaatttgctttcgagatgagtccgcaccaactatgcaacgtttccaacatcccgaaactatccgctcctcacccgcacatgctctaaatctgcttaaaacaaagaaattactatgtatttggcccatgtgtagagcttacatccgactagtacatgtgcaaagcacgactcttgtttgtctgggctcgcatggtaagaagaaaagcttagagattggtggatatgacacgattagatgagagttgtacgatagagtcgtacatatagcaaggtaaaaaaaaattggtgtaggatatgatatgactatcctaaatccgctttggtttcacccctacgatctataaatctctactattataaaaattaaagatgttttcgccggtattctgttacgttatccgtgtttgagttggtttttaagtttgtttgcttttggaaataccgattcgtgtttgagacggattttaagttcgtttgctttttgaaaatatggatctgtacttgagtcagattttaagtttgtttgtttttggaaatacaaaaggagtagtataagaaatctttttaaaaaactcgcatgctaacttgagatgaatgtcggactcctaattgcatctcatgattttctaaaataaaatatttaatagtgaatttctcctgagctgaactgtataacaataataaaataaaaattgcattcacccgttgcaacgcacgggcatcttttctagtaaagaaaaaaacaaatcatactatgaaaagagtagccacattttctgtttggatttgttacttgttattctatgaatgaagtttggtaagtgaaatgataggtggtaaaataatttatgttgtgaatttttcatgactatttgggttgcatgtataagacaagggcaaccctggatgacttaaaaatcaacttccccatgataccaaaatcctacatgtatatgcatctcattttgttcttttattctcatcacgtttaattatagcatgatggttcatatttcaaacatgctccacatagcatcttccatttttaagttcctgaacgccaaaaataaacaagaagggaattcccaatccatcgaggtcctcagcttccctcctccgcttttcttccagtctttctcctccgtctctcatcctctcgaattttctttccccccgtctctcatgcgccattgatcggatcgcttgatgccgnnnnnnnnnnnnnnnnnnnnngctgccgccgtcgccgggcgactccgacccgtcggggtctcgcgacatggacgacgaggacctcgtcgaggatctcctcgtcaccgtcaactcggcgcgggccttcgtcgagttccgccgcacgcagcgcaaggagtgcgccaacctcctccgctggctggagctcgtcctcccgctcctcgaggagctccgcgactcggcgccgccgctcaccgaggacgcctaccaccgcctcgccctgctcggacgcgccttctccgccgcgcgccgcctcctccggtcgtgccacgacggcagcaagatctacctggtccgatatatcctgcattcctcatcttcctccgtcatcgtctccaattataaaagttaatcgatataacagaacgtgttctcgatcgcttcagttgttaataaactaaaacacgttagacgatgacagacacgaacacacaacatttgttaacaagattcagccgaaagctatgatctcaaagctctgcttacgaacgctactccctattcaatatagcacctagccgctaagagtgtatggtctcgtcgccatcgatcttaacgatcttgcattgcttcgtcttgtctcaggcgctggagagcgaggcggtgcaggggagattccgcgccgtgtacgagaagatgaactccgctctcgacgggatgccctactcggagctcgccatctccgatgaagtcaaggagcaggtaagcctgcctgcatgcatgtttctgcctgcatgacacatgcacaggtcagacatgatcatcatcatcgatcgccatggtttctttcaggtggagctgatgaacgctcagctgacgcgatgtaagaagcgggcggacacgcaggacatcgagctgtccatggatctgatggtgatcctcgacaacaaggagggggagaggaacgcggacagggcgatcctggagaggctggccaagaagctggagctgcagacgctggcggacctgagggcggagacgatggccatcaagaagctcatcagcgagaggaacgggcagagcggcgatagcaccaagcagatcatcgagctcctcaacaagttcaaggaggtcgccggcgtcgacgagaagaacgtcctcggcgaggtctccgtgacgaaatccctcgacaagtgcccctcgttgatgatccccaacgacttcctctgcccgatcacgctcgccatcatgagggatcctgtcatcgttgccactggacaggtataccaaaattctccaagaacaacacggtgagattcgaacgagtttgacgaatttgaatacctttggtttttgtagacgtacgagaggaggagcatccagaaatggctggacagcggggagaggacgtgcccgaagacgcggcagcggctgtcgcacatgtcgctggcgcccaactacgcgctcaagaacctgatcctggaatggtgcgacaagaacaaggtggagctgcagaagagggagccggagcccgtggcggagcaggacgacgagcatcagcgcggcgccgaggacatcccgtcgctggtggaaggcatgtcgtcgatccacctcgacgtgcagcggaaggctgtgaagaggatccggatgctgtccaaggagtgcccggagaacaggacgctcatcgccgacagcggcggcatcccggcgctcatcgggctcctcgcctgcccggacaagaaggtgcaggagaacacggtcacgtcgctgctgaacctgtccatcgacgagagcaacaagcgccacatcaccaaggggggagcactcccgctcatcatcgagatcctccgcaacggcagcgcggaggcgcaggagaactccgccgcgacgctgttcagcctgtccatgatcgacgagaacaagctcaccatcgggaggctgggcggcatcgcgccgctcgtcgagctcctccagaacggcagcatcagggggaagaaggacgccgccacggccatcttcaacctggtgctcaaccagcagaacaaggtgagggccacccaggccggcatcgtgccggcgcttctcaagatcatcgacgacaaggcgctcaacatggtggacgaggcgctgtccatcttcctcctgctctcctccaacgccgcctgctgcggcgagatcgggacgacgccgttcatcgagaagctcgtgcgtctcatcaaggacggcacgcccaagaacaaggagtgcgcgctgtccgtgctgctggagctggggtccaagaacaagccgctgctggtgcacgcgctcaggttcggactccatgaggatctctccaagatcgccaagaacggcaccagtagagcgcagaggaaggcgacctctctcattcagctggcgcgcaagtgctactgaagatgaggaccccgtttgtaattgtaactcattttctttccccctctttctcagtagaaaaaattctgttgcttgccctgttctagctgaatgcatatgtggtgtatcgccagaatggggaattggtggtggaattgctgaaaaaaaacaccctaaatgtatttgtgccgatttcagtcaaactagttgatattcctataccattataagctgagttagattttaatgctaggatatacgatattagtttatacaagatcgatatattccgttataagtagaaaccgggtagtaagcagtattaaatagcaccttattatctggtagtaaatattgtgcaggtggtaaagaacaactaattgtgtgtgcgtgtgtgtggggtgggggggtgtttagtttttttgtgtaaattttttaaactatacggacacacatttaaagtattaaacatagactagtaataaaacaaattacagattctacctgtaaactgcgcgatgaatttattaaacctaattaatccatctttagcaaatatttactataacatcacattatcaaatcacggcgtaattaggctcaaaagattcgtctcgcaatttacatgcaaattgtgtaattaattttttttccacatttaatgccctatgcatgtgtctaaacatttaatgtgacatttttggtcaaaattttttggatctaaacaaggcttaggtaacaatgctagtgccgaatggaaggaaataaacaatcttatgtgtataatttatctgacacaccagtcacattgctaccagcaatggatgatttttttttctcaagtgaccccaaccttattcatcacccatacgcataagcattgtaaatgtagtaaagaactactacccactactgtttggactcacactaataccgagtttggtaagatacattgaggaagctctagcttaaaccatcatggttgaaaagacacaatatgttttcttcatttttttcgattaacatgttaatttctactagtccttgagagcaaacagatggctccttttcatcctctcacttaatataaacaaacttgagtaaaatgtacagtcgatcgttaaagttgggctatgtgtaatctagatccatgaacttataaatttagatatgtatttcttatcttgatttaatatagtactccctctgttctaaaatataagagattttgaagggatgtgatgtccatattcatattcgcagtcctagaaagtgttacatctctccaaaatcccttaaattatgggatggagggagtatcacctaaggtcaaaaatgcaaatgacttagcttgggtgctgatatggtgtcctcgccatggtggtgagaattttgcatgtaagcctctatgttatcatattgctaaaattgactcccaccactgctaaaatcgaccaccacagtgtccatggtaaaggagctgaagagatggcgactagaacggctattgagagtttccaaagccgaaatagataacatgatagggagagggtgattctgcaagcttggtacagtgtggggttgtcgttgtgaaggctgatgatggacctcatattacgagaggattacggcaacaatagcgggacaattcaaaattcaaaagttttgataaaagctacagagaagagtagtgcacgttagagttttgggatcgaactgcataggactcactgaaatagactaatttcagaagttttgcataaatataactagctgggtggcccacgcaattgcacggctagcatccaaacaaaatcatatatttttaagtatgattttacttagaatttattaaatagctatctcattgtcttaagagtttgaaagaccaaaccttatcatccccgtgtttctaattatatagttttttaaaagtcacaccagttgctaccctttatgtcatcatcttctttatttgcttgctcgttctaccactatttctattcattctctttggaacctttaaaaattggatcttataatttttagagtttattatcacgttgggttttgtttttataatttctaacatcccgtcaaacgttgccattatactcctctatggcccatccaccatctcttcttctttttgtcattgagattttaaaaatcgaacataattatcgtttgggatcatttttactttttagaagtcccgccaaaccgtcagcgactttgccattgtacttctctatggctcacgcgctgcctcccttctttattgccattgtacttctctacggctcgcccgctgcctcccttctttattgttattgagatttaaaaatcgaacatgattatcattgttttttttaccttttataagttctgaacctttaattgtcttgttgggttttttttttataatttatagaagtctcgtcaaacgatgccactatgctcctctacggcccgtccgcccccctattgtcattgtgattgtaaaaatcaaacatgactatcattggaattcattttttattttctagaagttccatcaatcgtcagcggctatactcctatacaccccgccagctgcttctcttttttattatcattgagattttaaacatatatgattatcaatggggtttattttttttactttttagaagtcccggcaagcctttgctcgtttgcttcacggcctgcctatcatacctccttttaatcgtcattaggattcaatctgttgctttattaacagtttttatatgtcatatcaaccaccaccactctactcatttataggcctgttacttaatttatctcgtcatgtgttttacatggtcttttattgaatctttcaatagtctttatttttatcacaaattttaattatttataaattgtattcctaattgaaatcttattttcctttttctaatttcagaatttattttttttctaattttaattaatatcgtattgtgttcttttaatattttttattttttattttcaacttaagtttgtcggtgacatgggaccgagagtatcgtgactagaggcttgggcagccgcggtcacccacgtggcttgaccccctcgagggggtcgggcctgagggtgacatggcctccccgccctctgtctccccgaggggtcgggccgctcccgtttcggccccgagggctggggcgccccgaccccttgtggttttggcgccacgtgtgtgggttaggtgagcacagcggcgcccacctaaccgcatttatagcgggttggacgagcgcgccacgccgcatttaatgcggcgctacgcgctcgcttatccggtccgtgactggtcgcagtgtgtgaccggtcacagaacggtcagatcacgggttaggaggcaacaggcggcctttcacacgcctcgccccgtcccgtcggaatgatgagagactctaggcactcgtccctagccggagccggcgtgctaactcctggagttagcacgtcagttccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcagcaaacaaccgtgctcccacgttgcacctgcttccggcagagtggaggttggtatgacccatcccatcggagggtcattcggacagtagccattgcaaatctccgcccattaatgaaggaaggacatggttatcccagtgtcaggcgaaggcacgagccaagttttggtcaaagtagggtgggtccccacccaaaagaaggataggtagaaatggtgcatgtggtatccccttgagatataaaaggaggaccatgcctaccaaggggggacgggagctgagagaggagagaggagagaaagagaaagaggaagagggtttctagagcttgaactctcttactcttcagctctttgtaactccttcacacacagatccaccagaacacaggagtagggtattacgcttctcagcggcccgaacctgtctacatcgcccgtgtcttgtgcatttgctctcttgcgaaacattccacagatcgagggcttagaacctcacctagcgcccccggccgaaccggcaaaggggggcctgcgcggtctcccggtgaggagacccacgctccgtcatctggcgcgccaggtagggggcgcgtgtgtttttctaagccctcatcctctttcgtgtgcgccaagcttctcccgctcagcccaatggccgaacgggcagtggcgcacaacctctctccgagcgctagcggtgacgacggggagtagaacctgcgccgtcgagctcgtactccaccgcccccctcgcaccgaagtcttgggcgggaggaggcgctcgagggggtcgaaagatccgcgactttgccgcccacgggcgatggagaaggacggcgagacggggagcgtcgcctcctcgtctatggcgatggcagcacgccccagggcgcgctccaggctgcgggcgcgctcctgcgtcacccgtccgtcgtccccgatctagagactccagcccgacgttggccggatgacgtggctgacttggtcatgacggcgcagcagcgcctaggcgccggcgggcggtcctccgccaccaaggcctctggcactgctaccgccggctctgtgtcatcgaggcggagggcgcggcgagcggcggccgttgcccgccgttcgtccgccattccctcgtcaatgcctccgacccaagaagatgtgcgtggggggccagatgcccgcctcgatatcgagcgccggcgcaatggtcgtcgtgctgcccacgcaacggagggcgcttcctcgtccggagcgccactccgatccgggcatgggggccagcctcccgtgtccccggttggtggtgccggctgtcgagcctttgtggcgagccttcggaacgtccgttggcccccaaggttccggcccaccatcaccgaaaaatacgacggaagtgtcaaccccgccgagtttctccagatctacacgaccgggatcgaggccgccgggggtgacgacagggtcatggcgaatttctttcccatggccctgaagggacaggcgcggggttggctaatgaacttgccacccgcgtcggtccactcttgggaggatttgtggcagcagttcaccacgaacttccagggcacatatccgcgcccaggcgaagaagcggacttgcatgcggtacagcgaagggacgatgagtctcttcgctcgtacattcagcggttctgtcaagtccgcaacaccataccgtgcatccccgctcacgcggtgatctacgcgttcagagggggtgtgcggcacaaccgcatgctcgagaagatcgcctccaaggagccccagaccaccgcggagctttttcagctcgcggactgtgtggctcgcaaggaggaggcctggacctggaactcctccggttccggtgtggcagctccggccgcccccgggtccgccgctcggtcagggcggcgggacaggaggaggaagaagaggtcggcccattccgacgacgagggtcacgtcctcgccgtcgagggtgcttcgcaggccacccgaaatgggaggcctgcgagcgacaaaaagaaggaggccggcgctcccagcagggaacgcccgaccggcaagtggtgttccgtgcacaacacctccctccacaacctcgcggactgccgcgcagtcaaaagtttggctgagcgaacgaggaagtgggaggaggagaggaggcaggagcgccgtgagggcaaggccccggcggctcccgccggcaaccggcgaagtgaggccaagcagaaggccccagccgaggacatcgacgatggcgacgatgacctggggttccaggagcctggggccaccatcgccaccgtcgatgggggagcgtgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtacgttgcccggggaggacagatcgcgatggtggtttcccccaccgtttgcaatgtgaagttggggcgtgtcctcatagacgggggtgcagccctcaacatcctttcccccacagcctttgacgccatcaaggccccggggatggtgctccggccgtcccagccgatcatcggtgtgacgccggggcacacttggccgctaggtcatatcgacctcccggtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgaagatgccgggccctgatggccccatctctgtccatggcgacctcaaagtcgcgcttgcttgtatggagcagcgcgcggaccacctcgccgtggcgtccaagcccgagggtggcgacgagaggctcagcacctccgtcccagccgccccgaggcagcggatgatcacgtgcgacgaggtcccggtcaaggaggttgccctgggcgacggcccgtccaagaccacacgaatcggtggtcttctagacggcaaataggaagacgcgctcgtctccttcctgcgggcaaacgccgacgtcttcgcctggagaccggcggacatgcccggggtccccagggaggtgattaagcaccgtctcgccgtgcggccgggcgcaaggccggtccggcagaaagtgcggcggcaggccccggaacgtcaagccttcatccgcgaggaggtggcgcgacttctggaggccggattcatccgagaggttatccatccggagtggctggcgaacccggtcgtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttatcatcagattcgcatggctagggaggatgaggaaaaaactgcattcataacccccataggaacttattgttatacgacaatgcctttcgggctaaacaatgcaggtcctacttttcaacgtactactcaaatttctttgggtagccaaataggacgtaatgttgaggcctatgttgatgacttggttgtgaaaacgcgcaaccaagagaccttactctcggatctagcggaaactttcgaaagtctccgctccgcccgcataaagctgaaccccgaaaagtgtgtgttcggtgtgcctgcgggcaagcttctcgggttcttggtctgtgcccgaggcatcgaggccaaccccgagaagatacgagctatagagcggatgcgccccccaagtaagcttagggatgtgcaatgcgtcaccggctgcatggccgccttaagtcgattcatatcgaggctgggagagaaggcactacccctatttaggctcctcaaacgccccgggccgttcatctggacggaggaggctgagcgggccttcactcagctgaaggcatacctcagttctcccccagtcctggtcgccccagagccagatgagccgttgctactctacctggcggcaaccccgcaagtggccagcgcggcgttggtcgtggagcgcgacgaggacaaccctcactccgcgcatccccaccctatgtcgactcgacccgggagagagcagggacgtgaggcccccgagccgaacggtggcccaaggcccccgacggccggagctggccctctgcccgcttgtccgacggtgccaggcgcccccgacccccaggacggcctcggggccactgcgggaaggccgcgcctatcgccctctgaccccgaggtcgtcggcacagaagccgagtgcgccccgcgcggcctctcggacgaagagcgccctggagatgcggcccctagcgaagaggatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttaccccctcggccaaatcttgcataaccgagagggtactggatgggtggtgaaatgggcaatcgaactctctgaattcgatttgcactttgaaccatgccacgcgatcaagagccaggccctcgccgactttgtggcagagtggacaccagctcctgagcccgtctccgaccccgaggccagttcgggcccctcgcagctgcctcacaccgcctactaggtgatgcagttcgacggctccctgtctcttcagggcgccggtgcgggggtcacgttgacctcgccgagcggagacgtcctcagatacctggttcgcctcgactttcgggcgaccaataatatggcggagtacgagggactccttgcgggactcagggtggcagctggactggggatccgccgcctcctggtgttaggcgactcccagctggttgttaaccaggtctgtaaggagtaccggtgctctgacccgcagatggacgcttacgtgcgccaagtgcggcgtatggagcgccattttgacgggatagagcttcggcacgtgcccagacgggataacgcggtcgccgacgaactctcgaggctcgcttcctcgcgagcccagaccccaccgggcgcctttgaagaaaggcttgcccagccgtcggcgcggcccgatcccctaggggagacggacgcgcctgaacggcccccgaggtctgtcggagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcgcgcggctaacggagtcctcctgaagtgcattcttcgggaacaaggcgtcgagcttcttgccgatatccatgaaggcgagtgcggagcccactccgcctcacgcaccttggttggcaaggcctttcgctagggtttctattggccgacggctctcaacgatgcggttgacctggtccggcggtgcagggcgtgccagttccacgccaagcaaacccatcagtcggcccaggccctgcagaccatacctctttcatggccgtttgctgtctgggggctcgatatcctgggtccgtttaggcgggccccgggcgggttcgagtatctgtatgtcgctgtcgacaagttcactaagtggcccgaggcttacccggtcatcaagatcgataagcactccgcgcttaaattcatcaggggcatcactgctcggtttggggtgcctaatcgtatcattacggataacggcacccagttcactagtgaactcttcggtgactactgcgaagatatgggcatcaagctctgcttcgcctcccccgcccaccctagaagcaatggccaagtggagcgcgccaacgcagaaatcctcaagggcctcaaaaccaagaccttcaacatcctcaagaagcacggcgactcgtggatcgaggagttgccagcggtgctctgggcgaaccgaaccacgccaagccgagcaaccggggaaacgcctttcttcctcgtctacggcgcggaggcgattctcccatccgagctcaccctgaggtcccctcgggcaaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcgctctgcgtcgacgacctcgtcctacgccgcgtccaaacgcgtgctggactgagcaagctctcaccaatgtgagagggtccgtatcgagtgatcggcgtcccccggccgggctccgttcggctggccacgggcgacggcacagagctgcctaacccgtggaacatcgaacaccttcgtcgcttctacccctagtgggggtcgagtgtcaggtctcgggctcgggccaacaccgcacccccccgggcgtgcagggttggccgggggctaccacatgcataagcttatattttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaattgccaaaaggggcccagaaccgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagcccttgtttaagctaagacacagaaggaccgtggcacagaccatcctcgtctcatacacacaacaaatgaaattgacacaaaaatttcctctttatttgattgcagattaaattagtctatacaagaaaggggcccgaaggcctcggaagaagaagaaaaagctatttaagattggcgggggcctggggctcacttcgacgcgcccgggccgcaggcctcgtcgtcgctgtcgtccgcaccaccgtcaccgccctcctcgtcggagtcgagggcgaacgcgagccgaggggccataccctcgaagctgtggacaatgtggtcggcggcgtcccggacctgcgcgcgcgcgccgtcctcggtcccaggagggaactcgtccagcgctacccacggggagaagtcggggtccctggtctggtagcttgccagtacgagctccactgccccccgggcgaggtctctcgaggatgacttgatcgtctcctcgagctcctcggggagccgctggagggtcccggccatctctgagaggcgctgggcaaggcccccctggttggcggcgtacttcgcggtccgcccgccccagaggcccgcctgccgcccggcgcggtctagacgggagacggcgtcccgaagcatgccgggccctacctcgcctgccaagcggagggcctcgacctccccggtggacgagtccagcgcgccctgcagctcggcgatggtgtgctcggcagctgcgaggcgggcgactaggtcgccgtcgcccgcggccgccccgccgctgcgcgccctcgcgtccagctcctttgcccgcgcctcgagctcagcggcccgctgatccagtgcggccctctcggcgcgggcgccttccagattgcggcgcgcctgctcctcccgcgctgtctcgcggagggacaggctgtccgccagcctttgcgccgcggcctcggcctcctcgagagctcgctcccgctcggtgagcgcatcctcgcggaggcggagtgcgaactcctcttcggcacaggcggcctcgtgcgccgccagtattgcctcccggatggcgacggcggcctcgcggtccgccaggtccctctccttcgcgcgggcgcgctcttccagcgccgtggcgcgagcctcaagggcctcttcgcgccgccgggacgccgcctcgttctccgccgcccgccgttcccgggcagcggcggcgtcaaggaccccccgtgcggcgtcgagcttcttccctagctccgctgcctggctcccgtattggaggcggaggtcgtcccgcgcctcggaagacttcaa

SEQ ID NO: 79073 - DNA, 5670 bp, Oryza sativa
ttctctaagtcaaacttctttaattttgatcaaatttatataacaatatagcaatattttcaacataaaaaactatcaaaatatattcaatgttaaatttaatgaaactaatttagtgctataaatgttgctatgtttttttataaatttggtcaaactttttagaaaattgattttgcaaaagtcaaagcgtaaaatatgaaacggagggagtattatcttctgaacatatgtttgaccattggattaattaaaaaattatataattatcgttatttcattatagcttggttaattttcaaaatatatgttttgtatgacttatatttttatatatttatataaaattttgaataagtcaaatagttaaacatacgtcgaaaagtcgacggcgccatttattaaaaatccaggagtattcatcaactgacaattctcttaattttttttgtcgtaaaataaaattttatttcgtatacacatgtggctataatttataatgtttggttgcacgttctgtacatggacatctatttaacaagcagcgcaatgcttgttttggcagcaatagtgtgagagagagagatgtggcgttgctgcagcagcaacagagcctctgggcttctcgtgtggctggtgcttgtgtgctcatggcagattgcagctgctcagcctcaacaagcagcaaaaactgatccaaccgaaggtaagaacgtaaccatgttccccgcaaaaaaaaagaacgtaaccatgttcttgggttttcttggcttaatttgtccgtggacactacatgattaatttagaggaatttgtgttgattcatcgcctaattctgcttacacatagtattaattaatgttgactttgttgagttaaccgtgcagtggcagccctgaacacgattttgggaagatggagcaagaaggcatcgtcggagtggaacatcagtggcgagccctgcagcggtgtggcctcggatccgagcaactgggataacttccccaacatcaaccccctcatcaagtgcgcttgcacttactacaacaacaccgtttgccacattaccaaactgtatgcacagtagcaattttgtgtctgacattttgctattgaagttaattagaacctgtacaaatcaattacaaattaaacaccaaaattacaaaatatttggctaaatttgaataaacttatgctaaattagaaaggaatgaaaattttgtcctgaagaacatcctagcagggaccgagtgacaaactgacaatcccaaaattctgaaactcttcccaaatatggaactgttagacacctcttctctcaacaaataacagcatatctaatacaagctcgacaagtacaaccagctgtttgaggtgaaactgaggaagaaaagggatagaggatacaagctctaaaaggtctagaagctaggaagagcaagtggagctaggaggagaggtagtggaaagatcgccgaggttccagcccggaaccaggacactgccatcgccgagccaccatggccaagtcaccgttttctgctctgttccatcgttgaagtcctcctgtttcggccttttctattcctctacattgcttgtttgagcctcggcatggattagcaattgagtaggccctacagcccaacgggttcctaataggaggcaactattttttgcacctgaagatccttaatagaaaaccccttatattttcagggcttcaggctggaaggcagaggcatttggtgtttcttccaatcagtaacttgggattcacatcgactaaccattacttctctcaaatgtttttagttggccatagaggaaatgttggtatgtcctttacaaaaaccgatggtgtattcagtcctccaggtcaagtggcatggttttgcatgcccttgcaggaaaatcaaacggtttataagttaggggtgaaaatttaactgtccctatagaagttgagagcagatgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttccccccccttcctctcttgggccggctcggcccaactctccctccctctctctcctctccccccccccgcggcccatcggtctcccccgcgcacgcgccgctgacaggcgggcccgcccgccgccctcgctgacgggtggggcccacctgtcatcgccttcctcctgccgctcccgccgctcgcccgtgccctagcgccgccgccaccgccgaatccgccgcatcccgccgtccccgcacgccataatgaggggggaatcattccccgcgattccctctcccgattcccccgctttttccctctctctctccctcggtttcgttcggagttaatcccgcaagtttcgccggcgtcttcaagggcggccgagatctccgcgcccgtttcctccctctccggccgcgctctccccctccagacgctatataagagttccccgtgctctcctcctccgtttccgccactcgccgcctctcctccccgtcggaatcgagcccgcaccgtcgcaccttctctccgccgtcgccgccgagctccggttcgccgccgtcgtcgctccggacctcctccccactcggcgtcacctccatcggcttcgccgcgtccccgtcgacctcggccacccctccgcttcgctcgccgaccgccggagcaccgtcgccctcgccgtcccgaaccgcgccgccgccttcctccgcttcggccgccgttcccgtcgtcgccgtcgactcggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccggccgccgccagccgcgtgctcccggtccaccgtggaccgagaggctgacgcgtgggccccactcccgtggacccggtccgcgcgccctctctcccggctgacgcaataaatgggtttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagagtaaaagccttttcttttccgtcggtcgtgtagacgctgcagcttcggaagatccgctcttcgtggaagttgaagccggtgtttgggaaagcgagcaaggcaagtcacatcatccttgaacatattgaatcccagtttgtaaaattatgttgatttaaattattgcattatcgctttatttaaattcccgcgttatcactgttttatctagccatacctatttacctttgttatgaccttattattattgttattgttattatttccttgttcaccctagagtaaacaaaaccccaactagtggacactctactcatggcaccactagtttaattttaggtagatgcttcgcaatttaattaggtaacattaggtggttttacaactctagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccgggggtcccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctatattattatccccttgtacccccttgcattaatcatgcatccgccggtgtggcttgctgagtactgtggttgtactcattcttgctcaatctttccccccttcagtaagagaagctttggagaagatgtcttaggtggagtcctggcttataccccagttgagcgcctgtgaagatggagccgtaggccgctagtccgctgctgtttatttttgtttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcgattttcccggtcgcgacagcagaaatgggggattttactgttaattcaatgatttggcctgaatggcatataaaagtctacaataatcacatatgaatattacttgtagttcttaaaataaaaagaatattactggtttgtttgggcaggaaggtatataagttggacgtggttggtcaaataccagcggagctgcagaatctcacctacctagaggacctgtacagtatctaagacttatcatcttatttcttgacaatgaaatgttaaaccgcccatctatgttgtgccaaaaaaaaatgctatctctggtttttaacagatgccaacatttactttttaatacatgtttgatcaatcatcttattaaaaaaattacataattataatttattttgttgcaacatggtttatcattaaaggtctattaagctgacttacatatttgcataaaactttttaatacgacatgatcaaacgtgtgtcaaaagtcaaaggcattgttcattttttaaaccagatgagggctgcagga

SEQ ID NO: 79074 - DNA, 5973 bp, Oryza sativa
cagaacatccatatagctagctatctaactgatttggcagacttaacttattattactcacttcaatagtcttttcatgtactctcttctttccgagcatatgacattaggacccatacaccagcctctagtactaccccttcttcctactcctctttctcccctcttcctcctctcccggccttttaacggcggcgatgacaacgtcagccgcaacccagaactcagcttggggagacggaggcggtgaaggccacgaagctgcaaatccaacccgctagtcgaatttgcgctagagcgggtgtcgtgtagccctcgaatccacaccgtgttgcccgaatccgacacaagccctcgcgaatccgcgccacgccagtcgaatccagtaggggcacaggtggcggaggcttccagactatggcgaatacaacagcgacaacggatagtaacctcgaggtggatggcaacggctagtgatggcacaaacgacagtggcggtggctggcgatagtcatggttggaaatttcggactgaaatttccgaaatttcgatcatttcggtcccctccgatacgatattacttcggccgaaatttttcattttttcatgaattttggtaatatttgttcaaattcaactaaattttgttcaaaatttcggaccgaaatttcggcattttggtgaggcccgatcaaatcagcataaccgataggattaaccctggcgacagtgacctcggtagcaacaacggatgatgatggcgaccttgatgacgatggtggccggcagcgctcctctgcatgggtgcgggaaaagagagagaaggggagaagggtatctgacgactggatcccctggttggcaacatggcttggcccgctaggtaggatgcccatgtttagctagctagagagttaattttgtgagccagatggcttggagggtttgttggcaggtctattggaggatattttttcatcgaacttacctaattttagtttggagaatgcattggaaaggctgttttttataggttcgttgcaatgatatacctcaaatttaaatatttaaagtaaaacacatgttcagctgtgaaaaagggagtactatgttagttttctctagagtttttattctttcgtggagtttgggatgcaaataaaaatcccacatagtacataaaaaacaatagaaattagaattttccaaattcaaacattgctaaggcatccacgttaaattgaaataaccaactacggaatcatttttaatcaaatttaataccaggctaattataaggattgaacacaagtttttactttttttctataaagtgtgtgaaattcaacaacgccttcaaaatgaaaacacgatcatgaaatttgtgtacatggataacaaatgtaaaatttttgagacctactatatttcaagtaaattgagggtaaatcagctggttatatttttttttaaccaacacaaattcaactcaaaaacttgacatggcagcactcgtacgtacgattaattattattccagtgataagcgaggtacctgtctatagcatagcacctttgatgattttatcaatcttgatataccgtctcactctctcgaagtttttgttggggaagggtatgctgtgtttataggatgagtgtacttgcgtgtatgaaccactgtgtttcttttttttttaaaaaaaaaaggtcctcgatacttgtttacaggaccaagaaagtctctttcaaagcttgttttatgtcacaaataatatggtcaatccaatcaattatgatcaaaatgtgaaaatcttacaccaggcaccaaaggctacctatccatgagcccactctaaaaatgataggtcaatccaaatagtctactccctacatcttagaatatagcaacctaaaaccaccggatgtgatatatcctagtactacgaatctagacagaggtatgtccagattcatagtacatccaatccggttttaggttaatatattctggaacgaagggagtagctatcttgtcttggaaattcggaaacatttactgatcaaagaacgattttgctatatctcactcgaaagattttttcttatctcttactcgattttctcactcaaatttacagtgtgttttcttgtaagttacaatataatttatgaaatttgcactgtaacttttgtaagttacagtgtaatttttgaatcttcgcatataagttttgaaatttatattggatttggtcttttttttctgaagatatggtaatatagtatccattatggtgtttcttagttgttttttgtattttactgtgtctattggattttaatccaagaattaaaaatctgtgtgatatgattataaaaatctttcgaaagatgcatagatatccaaatcggccctgaccacatcatggacccacacacaccgcgcagcctaggagggccgaagcacaggcctcattttccatttggaataagttaacttttggtctcttaaattttcgacgaatccgaattccgtcgttgaaccggaaaaccagatacggctgtcaaaaccggtacaatatagatcccatggtaagacaacagttttagctgacgtggcacctacatggctgatttaactcggtctttatcccacgtggaattgacgtgacgcttacgtggcaattttatctagaaaaaaataaaaaccatgggcccacacatcagttacagtaaaataataaaaattaaaaatggtggggcccacatgggcccccacatgtcattctcactcctggacatttttcttcctccagcggtttcttctgcggcgacttcggcgcccactactaggaaaagcatttttgtaagtggccaaaacctattttcgcaggcggaggggaggaccgcctgcagacgaacgacggtgaaaatcatccattttcgcaagcgggcaaatggcccgcgtgcgaaaatccaataaaaaacaaaaaaaaaatcgcctccacgccgccgctgccgcagcaccgggagccgccgccgccgccctcccccggcctccctccggccgaatctaggaggggaggccggggtagccgccgccgctgccgcagcaacaggagccgctgccgctgccctcccccggcctctctccggccgaatctgggaggggaggccggggtagccgcagccgccgcgtccgcgcaccgccgccgccaccgtgtccgcgcgcgccgccgctgccctcccccggcctccctccggccggatcttggaggggaggccggggaaccacgtcgccgccgtcctcccccggcctccctccgaccggatctgggaggggaggccggggagccgccgtcgccgcaccgggtcgccgcagcgtccgtgcgccgccgcctccgcgtccgcgcgcgccgccgctgccctcccccggcctccctccggtcggatctgggaggggaggccggggaaccacgtcgccgccgccgccgcaacgggtcgctgccgtgtccgtgcgctgccgctgccaccgcgtccgcgcgccgccgccgccacggtgtccgcgcgcaccgccgctgccctcccccggcatccctctggccggatctgggaggggaggtcggggagccgccgccgccgccgcagcgcgctccgccgccggtggaccacataagatgcgcctcgcaggggaggggaggggatggtagaggaggggatgggggagctaagaagccggtggtggagggagagagagagttgagaagatagaaatgagtggtagggaggggttggagtactggataaggattgaagttttttttttggtagatacgatttttgcaggtggaccacataagatgcgcctcgcaggcgtggcttaggtggtccgcctgcgaaaatgattttcacaggcgccgcttaagtagtccgcctgcggaaatcttttcgcaggcggacaacgaacttcacctcgatttatatttttgtaggcggtcatttgactcccaagcttatgtccgcctgcgaaaataagacacctacattgggaaaaatgatttttctagtacctgcacgtcgaccggtggcgaatgccggtgcgtcaaagggttcaagctgtcggacacgtacgaaggagtggggcggctcggctactttgtcaccggctgctcgaggtctctcccactgagctgcgagcctgcgacgccaacggccagaacgagcacggcgactccttcgctattcttgacaatctcgaagggctcccttacaacgctcaggacgaaccaggtgacaccgatgaagattgcagagaagcttgcctgaacaaatgctactgcattgcatactcaagtgaatatggatgcaagctctggtattacgacctgtacaatctgagctcacctaataaacctccatacagcaagatctatgtccgagcaccgccgcgtcctccagcgtgtcaccgtcgccccttctccggatactagcacggaagtcgtgcaggcgctgaatcgatgagcttgatgggatgcttcaatttttgcttgagatttcatatgtactgttgatcacattcaactctgatcagttttgggtgcagcgactaatagccggacttgtagccgggggaagaagatcgcccgagagagaggaagcagaagaggagggactgagaatgacatgtgggccctaatatttttaattatttttattttaactgacatgtaggcccacgatttttattcatttttccagatcaaattgcaacataatcgccacgtcaatgccacgtgagataaagaccgagtcaaactagccaccacatcaactaaaaccgccgtccaaaccgtcatgggatctatattgtattggttttgagtccaaaccatcatgggatctatattgcattaattttgatagttgagggttcaaggatgaaatcggattcgttgataagttaagggaccttaagtgaactttttcctttccattttcaccccgtgcttgcgcctctggacctctgcttcgcaacgcggcctagcaggtccgagacaacgacgagccagctgggtcgctcactcgttctgccctgctctagattctagaaccgtagactacccgctggattcttaaaagatatcaatcttttcatatttttcgtggctgaaagttgatggattacctagggaaaaatattgatgtattgttaactttattcggtatttatgtataattttaaacattttttattaaatataataatgatatccaacaaaattataatattgtaaaagtacataaaaaaatctattcaaaagtacataaaaaaatctattcaaaatattttcatgttttgaaattaaatcattgatggtcaattttaaaatttttgactgaataaagtcgacaatattatttatttaaatagagtgtgtatatatgatagtaaaacactagattacaaatactttgtataagtggtctgcaatgtggtagacctttttttcataaattgtatatttagatataaatacgagcaattctcaacaaaaatctaatgaataagctgaaaaagggacaactagcaacaatttaacttccatatatataagtggcgaccttaatagtaaaccataacgcaatgccacttttgcacttgcggaagtggtgagctacacataaactgatccgaactactacaagctaagataaccatgtgtataagttgggggcacgagttatccctaaaatctatcactggtggagaaaccatctttcgtcggtcggccgatttccacaatagtcccggatacaataaaaaccggggctaaagatgatctttagtcccggttcaaaagggtaacgggcatatttgatctttagtcccggtttgtgtaccaaccgggactaaagatcatctttagtcccggttcgaatgctgtcagggcctgtcaggcccccccggg

SEQ ID NO: 79075 - DNA, 6575 bp, Oryza sativa
cacccgtcggatagactcgaagcaaaagtgcaaaacagaccaaaccagacgatcagctactttattacatatccaggataacccgatagcatatcatctgaaaaattatactagtaccaatttaccattcctggcatcgacaacgaatgcacgcacgtaataaaggtacatgggctccctaaaaacagacacaatttatgaaagtatagaagaagtatggaaattaaaataaaggaaaattcacggcatgaactttgctatagtttggatattctcaaagatagatacaacaagaattcaaaaaaaaaagaattcacaattcatgacaataaacaacagtgtcaagttattacataaagagtaaattaggatttattatgtaaaagtactaatattaatagatttatcatgaaaaatgctttcatatatagttatatgttagtaactttttatacaacataaagttagaaaaagtaataagggaacatgtgtttttggagactgtgtttgtgtctaaaatgtaagtaaaagagaatggagataataacattcagttccatctactttgtaaatttcggcggtgccagccagcattaattaatgaacccatagcattgaattggcacaacaagaaaaaggagaagtctttcaatggtcaagatgcttttgggcggagataccacacatctaataatgattaaagattgaagggctaacctcatgtagcactggtacatgcttaatttaccgctaaatatacccacgtgtgcatgttctacactactatagatcctgctattgttggtggcctatttattattggtggcctatttgttatggatcaatacaacacatcacagaaacctttatctctaacatgtagaacattagcccgcttaagattatattgtccggaacaacctgccacaaatcgaggttatatgtgatatagtaattgtagcccgtcacggatcatttatgataggtcataacgacaacccgttatggatgatcccacacctttaacagtctattaacccatcactgataagagtgacgggtacccgatagaaataacaaatcatccctaacgagtttgttttttaacccatcaccaatgtggaaaaaccgattgagcggtcaattgcatgtcatccacacataaaagatcttcaagatatctctcttgctagctagtcagcctctcccttcttgttgctatctcccaccttcaccgtcagcaccaactccaactccaccagccatgccggcaccagctcgatctcgaccggccactgcagcctctagatctgagagttcaggccgctagcctcctcctagggtcaaatatgaagaacaccgtttaagcgtaatagcagatcaaccaacaaaactaatgttggactataataatggattaaatgttattgtggttactaagaacgctatgtggtaaaaaaaaaggggggacacatttaagtatttgccacttcacaaatacgacgtttaacaattgatcactcatgttgtgtctatgaatatggacctaagctagagccctcgtatcttaaacacgtaatgtgaaaaattattaaataccacgttaaaattgataaatacttaaatatcccctgtttggcacccgtcggatagactcgaagcaaaagtgcaaaacagaccaaaccagacgatcagctactttattacatatccaggataacccgatagcatatcatctgaaaaattatactagtaccaatttaccattcctggcatcgacaacgaatgcacgcatgaaataaaggtacatgggctccctaaaaacagacacaatttatggcgattttgacgatacgaagtatctagatttattcggtcggatcacacactgtacgcccctaatcaacgccgaattttcgccatgtcctatattatttcgatgtcgggcaagctgccaatcccaaaccaagattatgctctctccatacaattaactcgatctacaactactctgccgctgcacatgcctgcaaattcgccagtgcgtgtttgatctcgcatcagcaacttgtcctcttccagagcacagatctatctgtcaaatcgcatgtcacccctgcattgctgctgccacttgaccctacacaacaaattatacaattattcatcaaatgatgattcatccatctcatgagtttttttcccttaaacaattgttagcataatcccttgcagaatatatgcgagataatgacgtatcttgttggagcaataaaaaaaattatggccattgttgggtgaagcaaaggttatagcagaacgtgcagccacactagccatgatccatccatgaaccatgatccacaatatatatacgtgtgtgtgatggtggctttgccattgtcatcgtggacactgcaatttgcagctacctctcctaatctctctttgatcaaatcactatcgtgtaattaacgcatagttagctatgaggaaggtgtgccctaaccttgaccgggaggacggcctcgacaccgtgctggaggtgccggtgccggagctccaccgccaggcaccgcggcggcgagggcggcgcggcggcggcggcacggtgaagtcgtgggtgcgggcgaggatggagcacgggcggaggcgcgacggcgcggcgccgtcgcgcgccgaggtgcagctgatgctcggcgtggtcggcgcgccgctggtgccgcaggccgtggaggcgaggaaggccatggtggccgggcggggcgtcgggggggagggggaggagcccctggacctggaggcgtccaaggcgaggtacatcgtcgagcagtacgtcgcggcggccggcggcgaggccgcgctgggcgccgcgacgagcatgtacgcgatggggaaggtgcggatgaggacgacgacgacgagcaaggcgaacaagggcaaggtgatgggcgtggccgccggcggcgaggtggccggcgggttcgtggtgtggcagaagaagccggatctgtggtgcgtggagatggtcgtcgccggtggcgtcaagatgagcgccggcagcgacggcaaggtcgcatggcgccagacgccatggcaggaagcccacgcctcccgtggcccgccacggccgctccgccgatgtattcaggtactgaactgttctttcgtctctgcgtttttacccaaaagaaaatcaaatttgactaaaacttgtaataattgagcaaatcacaattgcatgcaagaacatggtgtaccgtacccggacaatccggccggacgaacgtgctcccatgtgcttgtaaatgtatgattatttaattttgatttaattactgtattaatcaattttgattatgtgtgatgcagggcttggacccgaagtcgacggccgacctgttctcgagcgcggcgtgggtgggcgagaggtgcgtcgacggcgacgactgcttcgtgctccgcgtcgacgccgaccacgccgcgctgcgcgcccggagcagcggcgacgtcgaggtggtccggcacgccgtgctcggctacttcagccagaggacggggctgctcgtccgcctcgaggacagccacctgctgcgcatcggcctcgcccacgccgccgccgagagcgcctactgggagaccaccatggagtcctccatcggcgactaccgcgccgtcgacggcatcaacatcgcgcacgccggccgcaccgccgtgtcgctgtcccggttcgagagcgccgacgacgccgccgccgccgcgcgcggtagtaataagcggtcgtggggcaccaccaccatggaggagacgtggagcatcgaggaggtggacttcaacgtcgtggggctctccatggattgcttcctgcctccccgggacctagtgctcaacgactgcagcaagcagcagcagaaagaggacgccgccgccgccgtcgtcgtcaaggacgccgccgccgccgtcgacgtcaaggacgccgccggtgccgccgcgaacgccaagggcggtagtgacgacggcaagaccaacggcggtgacgtcggccgcggcgtggtggtgaagaaggcgcttgttccggcggtgaccggactgggttggttcggtccggccaaggtggttgccgtcgacgacacggtggacgacggcgtcgccgccgcagccgacgacgacaagtaaatgtagatatctctcggctactcgctagatcaggtggtgctcgcttctgcgcccctcaagagtaaatattaattcgtatagtttaagttaatttctactacttaggaacatgcaagcttgatcatgttatatgttagatctagcaactgcattccattgtagatgttgggggaggagactaagtttatgttcttctccattcgagtttgaggacattttgcgtagtgtccggccggtgcttcattcatgatgtaatttaatactttggaaacaaacatccaaaggaaactttgtgtatccattttgttaagaacgacatgggggcttcagttccaggtccattcatcagaaactaaagttattaccgccaacgacgaaaagcatccaaaattttgacaaattgacttgtttataaaaaattattttaaaaataaaacgtaaaaaaataatttcagaaatagatcatgacctcaacgacaattttgtgctgagctaaatgtctcaactccaccactattgatgttgagatctcatgatcttgtccgacgtgacataaatctgcaaggacacgggagctcagcataagtgtgctggcggcatcgatcgatgtatggttcagcatcctccactatcctccgaatgcatatttacattttttgagttgatattaagatgcaagaaataatttgaaccacgtcaaaatgtgatcaccatcatggatctcaaaaggtacaatctggaacacatacacatacgcacacatccccctccaaacaaaaatatttacgtaccagattaaatcttagcctctacatctaaattagatgaatacaacaccaacccaaaaaatataaactatttcttagcttccaatgttccaatacaaacaacaagatatattacttcgctcaaccatgcgcaatcataagagtggagtgcattttccgtacaataaaataaattgagtgcctaaacttcaggcaccatttttcttgttctagctaggtgacaatccaataattctcaacacttctctattgctaatttaaaaaagtctattcgatttaaataaaaggtcaaaacaataaattattatgacataaaatgcaaagttatatgaaatgaacttacaattaataaaaataaaaaatacattaaaataggcttagataaagaaaaaattaaaccatatatttcaaaaaatgctaaaaaattatacattttaggtgcattaagtgtgaatcttttttggatgggtcaactagggtgtgtttggttgcctgtatgaggcctggcccacatctgtagatgcaattttcggtttttggttacctgcgtggccttcccagcctcgccccgctcatgcaaaaaggcctccgtagccaggctgagtggaaacagtcaattcgagcttcacaactcagcttggcccgatggatgtaactggctgtatccgcgcgtgcaactggtaaagatggggtcagtttgcccctcctcatttctccccccaaatccaaaagctagggtttggtgccagcgtgccaccctcctccttgacactactcgtggacacatggcctagaaaagagagacgtacatgggctgatacaagtgcatatagatgtattttgtcgttctccatcatccgcacgatatataaaagttagagtaaaatgcttggagagggtcatctaacttatttagacgtgtcacataggtcactcttctaattttaaattgcacatctgaatcacgttagtgagtcaactgagtcatttagtcaactaactatccacatgaggacgccttgtatatatgacatgtcacctagaattgacaaaaatacatcatccgcagccgctgcctcttaggaattcgactccatttctgtttacatccatagtttatcattgccgtcgggtttgatggcaagtgagagaggactgagaactagcagaaaaactcatcaaaacagacacaagtgaaatgatttggttcctttcatttcttgttagtgttgtgacaaaaggggaaaagaacacacatgtggtttcctgcatgtccaaaagcaatttttccaataagggcacccacaatggttatctataggctctctacaagagatccatgtcagcatattttcctacttggaaggtattaaatgaagagagagagcaaagctatctactaacttagagataatctatagagaaaaacgaggcaatgcatgagagagttatagataccaatgtagacatactattaaggtggtttactattaatcgagtctattgctgagatatacaagttttatagatagcaccttacttaccattgcgggtgctctaataggtggcatgccatgcgtataagatatcgtgtggatacattaattagat

SEQ ID NO: 79076 - DNA, 5926 bp, Oryza sativa
aattcaatgagaagggaggatgaatctggagaaacgattgatctaccaaaaatggatcagccatcacgagccccaattgagctaaagcccttaccttcaggcctacgctatgcctttctgaatggtgatgcggagtctccagtcattataagtgacgaactctctgagagggagacgacccgacttatcgccgttttagaaaaacattgtgctgcttttggctattccctccaagatttaaaaggcatcagtccgaccctttgcacccatcgcattcccttagatccatcttgcacaccatctagggaacctcagaggaggctaaacaatgcgatgaggaggtcgtcaaaaaggaagtcttgaaactcctacatgccgggattatttatcccgtgccatatagtgagcgggttagccatgtccaagtagtgcctaagaagggaggcatgacggtcgttgaaaactcaaaaaacgagttgatcccacaacgaaccattacgggatggaggatgtgcattgactataggaaactcaacaaggctacgaagaaggatcactttccgctgcctttcattgatgaaatgcttgagcggctagcgaaccattccttcttttgtttccttaatgggtattctggttatcaccaaatccccattcatcccgatgatcaaattaagactacattcacgtgcccataccgaaaaatgtcgtttgggttgtgtaatgcaccagcgtcatttcaaagatgcatgacgtctatttcatttttcaagcaaacgaagagctttttccagtaaatgccgtgtgtacttttttagaaaatggattaaaatccggcctctacatccataatggatgtacacagcccaaaatgccgtgtgtacttgtgtacgtagatactgtgtacattctgtacagtaaatagaaaaatcagaacaagatttcaaggaacagtgtggatgccttgacaagacaggacgagcatgctgagaacaagaaaggcagccgccgccgttcgaaagaaccccatggccatcgtgtatctctcgatcgatcggctcaatgtgcgtcgacgtttagtaacctgtacgtatgaaccttctgaagatcggcctttgtttgtcgacccgcacggcgattcaatcgcaccctctggtatatatattgcacaatcggggtacaagataaggtaatttcagaagtatatttatagaatttctcgataaacagatgaatccaaaattgatatctattgagccatcattaaaaataaaaaatagtattctttgtatgcatcgtatttgaatcttaaccttccataagccatgtgcactaagtgtagttgccattgatataaaacttaactagcaaatatgcccgtgacttgcaacgggatatgtatattatatatatattattcctatttattgcatgatttgttttttttctatacttatacgatagtggtgagacagatgattcacatgggatttggagagatttgtttttaaaatgtttggcgtgggtctagtacacgtgatagatgaaacatatgatagagatctaaaggtcaatttacgtattgttgctagatctaatgattcgtattcaccacaaggaattggctgaaatcactccatggacctgataagcctgggatggtgaatcaagcccacgcttgttggttttaataaaaagatgtgtaagtattttattatctaaattttaataaaatttattacatacacaaccagtgaatcagtgaaaaacaatcaattaatagctaaaagtgcttcaggaaaagaaagcacaacacaaaatttatataaaaaatgcacgattcgataaattttataaaatctacttatacatcatgtagaatatctcattaaatttatttttaccatgataaatcagtaaaaccagagtatagaaaagaaagaaaagtaaaaacaaacaatgtagcatcgcctcggctagcttctcataccacttcgctgagccactcaccttgccttgttactcgcctcgtggcttaccggcgctaggtggttggatccgatggcctggtgactaagaatttagagtcaaccttgatgatagggagaatcagcaccactggtggacaaacccgttttaatcccggttcacaactcccctatagtcccggttatgcaaccgggactacgaatccaggactaaaaatacctatttttagtcccggttcaaataaccgggactaaaaaaggatctttagtcccggttggagttccgaaccgggactaatgctcttttttcttttttttttgtttcctgctacttgcatgatttcgagccccacgaatctccacaaatcattcgaacaccacgtatcattcaaaaaatccccaaatatttctatccccaaatacatcacaaatcattcacaaaatcataaaatcatctccacaaattcattcacacatcacatatcacacagatcagaaaaagaaatccacatcgcacagatcggccgcacagattagaaaaagaaaccacatcgcacagatcgaccacacacatcacatagatcaggaaaaaaccacatcgcagagatcgggcgccggccgtccgccgcctcgccggcatcccgcccgggcctcaggctccgccgccgcctggggagcgtcgccgcccgccgccagccgcctatgcggccggtgcgtgcctgctgccacctcgagctccgccgcctcgccggcctcgctgacctcgctggccgcctggtgggccgcccgccgccggcctcgcaagccgcctgcccggccgccggcctcgcctacctcgcaagccgctgcctcggccgcccgctgctccgcgccctccctgccaccgcgcgccgcccggcctcacgtggtaggaggaggaggaggaagagaatagaagggagaggaatgggagaggagaagggatgaggatggaggaggatggatgaggctgaggatggagaagggataagggctgtttaattaatgagaggggaggagagaggaaaggggagagaccgaggcggccgggcgaggcagtggcgccagctcggttgattttttagtcccggttggtataaacaaccgggactaaaaaagaattggggtctaactcggtccgataaccttttgaaccgggactaaaaatgatctttagtcctggttggtgttaccaaccggggctaaagatcaaaaggtttttaaccgggactaaaaataatctttagtcccggttcctattcgaatcgggactattgtggattttgggcgaccgagcaaagatggtttctccaccagtgcactatgctcagaaaagagccaattttcatatggtccgagatgttgggtgaaaatatttatattaaattatgaaaaaaataaaaatagaaagagtatagaataattttatttttgaaatcatcaaatgaatatcatttcaccgtgttcacgcatgtgcatgcactgataatcgcgtcatgcacaagctttgtgatggcaagggcagtttggctcggggccgctaatgggcgggtgatcgccccccatccccctatacactactctcttatacactactctcttgcttcctcatctccttcttctcttcctactacaccataaaattttaaaaaataaaaaacacaaagttgaaaaaacttatgtatagaaatactatatataaaaaatttgaattcaaatataaatttaaaacgggtatgtaaacttttgacttacaaactttgggtctataaattaatatttgaattcaaattcaaatttgaatcggatatgtaaacttttgacttataaattttggatctgtaaactttaggtgtataaactttagatgtataaaaatactatatataaaaaatatttgaatcaaattcaaatttgaatcggatataatttaaattcaaatttgaatcgagtatgtaaacttttgacttataaactttgggtctataaactttaggtgtacaaactttagatgtatagaaatactatatataaaaaatatttgaattcaaattcaaatttgaatcggatatacaaacttttgatttataaactttggttctttaaactttagatttgtaaacttaaggtgcacaaaatttaggtgcataaatttactaaaattaaaaagtaatacagtgccaaaaaagaaaaccacgtgaaggagaggggggcgccctagggtcgatcgatcgctccttagcaatggctcaggttggtgccggttgaggacgtgtgttagacttgcagttggggcctgtgggcaaatggcccagctggtccagataaaagatcagcagcgacgctgggtgcagaggaaacgcgtaacgcgggcccaactccgagcgagcgcgtgcgtgcgtgaacggatgattttttttttttggaattaaatgcgttttggaattaaatgcgtgcgtgcgtgcgtgcccatctgtgttgaaatataatgatttttggaggtgtgtatgggtattaatgaagtggaattaaatagggacgtttgtgattgttttagataagaaagtactcgctcggtcctaaaataaacaaaccaaccaatcaatcgatgcgaggtgcctatgatgacttcgacaatctaatgatatatatgctaccctagtctcttgaggtagaatgtgcgtttgtatatccatagggataagtgtgtgcacatgtatgtgtatttattgttttttgtttgtgaaaagaaaatgacgatgaaaagagttaaaccctgcattttaaatcagcaggtagggtttgtgtgcgtgccttcataggggtaagtgtgtatgtgttatgagtgcttgcgttgtactgtataattctcaaaaaaaaatcagtagtgttttatctttgtgaaacattttattaacttggttgaaacaattttctataagtggtgaaacaacctatgaggccatgactagttatgacatatataattaatataattgtatgatatcatattataaatatttaattgtaatgaatataactgtataattggattatagattgaataaacaatataggagggaaaatgattaaaagttaataaaaagattatgcaagcacgtacatatgctggcatgctgctaattataagagggagagagagggatgccatcctgatgttcagaggcacagaaagagggggcagggagtacgtacacaagcattaccgtgagatctgatttttcattcccgtcggacgtctaatgtgtagctctctccaagttgtaccgatatattagagatagctactaatgtgtctgtactaacgttacggcgaaatttagtaatacaaacaaaacaacatgaagatgacaatttaattttaaaattcatgtaaagaaagaaggatgaatagctaatctagtccttcaactcatatagatcctcatatgagttgcatcttatcatatatatagatcctctaagtattcatttttggctcaaaatttttcatggactcacttgatgtgccacatggttaatccaattcaacatttatattacaaaatgtccattatacgctcacaacaattagaatacaacaatcagatcagcatcataaaatgcaatattttcatagaaacggtatacaatagtcaataaagataacatgcttgtagttatggaggatacttgacgttgattcttacaaggacacctttattggcaaaattggttatatagcattgaatgttcacgtttttggttttatagcaccgaaaaataccggttcactttaatagcacccaaagtttaccatgttcccatttttagcacttccgtcaacttttccgtccgtcttgatcgttattgacccagctacgcatacgatatgacgtttctacccctcattgacatgc

SEQ ID NO: 79077 - DNA, 49515 bp, Oryza sativa
gcgcgcacaagttcgtggatctaagtgaaacctgcagacaactctaaggaccgctggtgcattttactctttatttttttgtcatctaactgtctttctactcattttctcttgtagactctaaatgatagaacaattaaggtagactttactagatcgagaaagaagcagtatgttgtgccatcagctcccatgccgaagcacagcgtttttgtgggtaatctgacgtggagagtgagatctcgccatcttcgtgaattatttgcatcaaccccaggtgttcaatcagttgaagttgtcttccataccacaagtccgaggcgatctgctggttatggatttgtttccttttcctcaaaagaggcagcagaggctgccatatctaccttcaatggcacggtaagtattctgaaatgtagcttagaaataaaatatagtacaagttttggtttgtgtacggcccaaattctaatacatgattgtgttttgatgctatttctgacctatgaaatatatcacagaaattgatgggaagatccattaacgtgatgttcaaagatgacaatgccaaaaagaataaatctgctgcaccaacggaagaggatctgaaggcagaatcatctgagcagattgttagctaagcatcaattgtcatgggaacacaccgagaacttaaatgattgaggattgcttaactgacattttcccagtaattactctaactcagtccttaatcttattttttttctaagtacattttcagccatcataacaaaagaaaagggcatcttccgaaaaaaataataatgatgaagcaacattttttctggttgtcatttctgatgacatgtctgtttatttatttgaatgctgaaaattatgtgtttttgccaagttgcattgctcactggttaggttttgtaaacataaaaactactatcatttcatattttcattacattatctctcctgaattattagtttagattttagcaagtgcttgtgccaatttgagcattttaaggtaccagttagttatacattactgtcactttgattgttgatatgatggaatgttgagttatagtttgggcgtcgttgacttaactatggttgtgtgttcctcctgaagatactgaattattggccaccactctctgctaatggtgaaagattctttttctcacaaggtctcccagctgctggtcagttttgctcattcaacgcctcgtgagttctatattacagcgttgtttatgctgtccacttgatatggatgacatatgacatttggaggtcagctttatgccatgagcacaaaatatatgtaagcttttcttgacacccaggttaattaattgtagatagagataagtctcaaggatctcagccgtaacccgatggatttagcgataatttgtttattgtgaaatatttggctgaaatgtataaatcaccgggataactttaaaggctaaaagctactactggtattgttttcagtctgtacttgtcttcgtttttatgtgaccggaagattgtagaggccgggtttaatctaatccattatctaaaataaatgtgaccggaagaactgtgacaactgtcaaattaatatatagccttcacatcagttccaaattgcacgcttggtgtgctatccttaaaggttgccgtgcagtacagacccaaggttcttcagtaaccaaacgggctagtacatctgcgtcacgagcggtccgacgaaacatctgtgagcaatactgaactgtgctgaatcaattattgtccagtcttccgtccccatctgtctattcttagctcagaaagtatcctctttaataatctgataatcttgtagtactaagcttgttgattgtgaatgtgctgcagatatttaggtccattctttttttagtggatttatgttggttctaaagatacgctgaacctccctcttaacctggacctagtcctaagagcaaagttaatagtatagccaactactagctacaattcatctataactaatctaatagttaattcatacaatagttgcttactatactattagtatatagtcccactgtcatatacacattatgtcttggagtccgtgctgcagcgggctacagaagctgttcttctctctcatcttttatcttattaaaatatgtttgtagctggctaatagtatgctattgtacctgctctaagagcacccgcaatggtaaagtaaggtgctctctataaaacatgtatatctcagtaatagattagattaatagtaaaccacctcaatagtatttctacatgggtatctatagctctctcatccattgtcttgtttttctctatagactctccaggttagtagatagctttactctctctctccatttaatctcttacaagtaggaaaatacgattatcttttatagagagcatatagataaccattgcgggtgctctaataacactagctaagcgcaaactccgagttatccatttcgcagcatttaccttgacggagtggacctgaaacgctaaacgcatgagcaaacgtgtacggaactcctttggtcaatcgttggattatccatctgaaactccttttgttttcgccgggatacccgtatgaaactcctgcatccgtcgccttcattcgcaccggtgataccgtactcatttggccggcagaccaaacatagtggattagtggacacttatgtgttgagaataccgtgccggtcctttgcgaaagcacatgtaacgcctaggaaagcaaggagcagaagcaatctgcttgtcttgtgtgcgacaacgaggccagtgcgttgtcctcgcaccaagcgaccgcctcgccgccgattgttccgtgcgacgccacaccgaaaccgaaccgggacaacctatttaatctttcaacaaatttaaaccttcaaatcttgaaaagttttcaaccaatggatgcaattcattttaaataaaataattaaaaagcatatcaaaaataataaatctagatataaaaagagttgtataatctaattccactatacttacgtagataaaacactgttttacgtaaaacgatatggcattaatgtataattaatagagttttaattatcataaccttaaaaatttatttatagcaactttcatataaaaagttttttaatgaaatataccgtttagcagtttgaaaaacacgtgattatctaaatttttatccaatttttattacataaaaaagacctaaatttacaagaatattctctctctccgtcccataatataagttattttggagagatatttattttggagagatatgacacaatctaatactaccaatctagagtaccagattattatgatacattcctttaaaattaattatattttgatataaaatcctacgaacgaaaaatacaaagacagaaaaaacgaaccgaataaacccaagcaaagcaagcggaaatccccgcgtcgcgttaaccttctcgcccgcggtttcttcccttcctcgcggaagaagcccaccgttccttccgccacgcttcaagcaaccgctcacctcccctccccttccctcccctcccccaccactctcaccaaccacacccccccaaaccaggcgccttctggtgctctgacgcgcgtggatgccgcggcggacggcgagcagcgcggccgcggcgcccggccgcggcgggatggagtgggagctggagcgggagatggtgctgatggcggcggccggcggcgaacaccagaagaagcagaggcagcagcagccggcgcggcgggcgttcgccaccgacctgctccagaactgcgacctgcctcctcccgcgaagctcttcggcccgctccccactctgcaaaggtaggcgccgccgcgttcccatctccctctctcacacgatcgatgccgtggaattcgcgagtgtggcattgcttagagcggcgcggtgtttttttttttgttttttttaccctttttgttgatgtggaggttggagaacgcggcggcgtggacgagcacgagcccggatcggaagggcggggacggcgaaggcggtggtggtgacggcggcgaccgcctgatgcgtgcgctgcggctgtcgcagtcgcgggcgcgggaggcggaggagaagctggcggccgccggggcgagcaacggcgagctctcggcgctgctggtgcgggactcggtggtgctgtcggcgcaccgccggtgggtcatgatgctggaggccgagaactccgggctcagaggagcagcaggagccgccggctcggccaaggaaggcgtcggcgaggacgaggacgaggacgacgacggcggcgcccggcgcggggccgctgcgtggtggctcgcgctcgccgtctgcgtcggcattgccggcatcggcctcgccatgggcaagctcctctgaaaactaaccgtttcttcacctttttgttaaggggaaactgcacattggaggatcagatcagacatcatgaaaatccatcgttctacgaaaaaattctgcacaaaaaaaaatgttgctagcatctggaacatttcgatgattaggaatcacttgtaaatgatgaacatgatgaacagagaggggtgatgactgatgagaactgtagaaacttaggaatcactgttttcagaaggaagttgggttgtgactggtttggttgtgaagtttgtgtagataggattatcatcacgcaaaattggcatcatttctattcccaaagagaagcttggatgatggggaatgggctggaagatgccgtatctattgctgcacgctaccacattcatgactgcgtctgcgtgtaggataaacttttaaaagagagtagtaataccttgtttggataatccgtcccaagataagtgtaggataatccgtcctaaaataaatgtagttttgcatcgttcgtgtctagcggttgaccgtttattttatttatttttttattgttattagatgataaaatatgaatagtattttatgtgtgaatattttatttaaatttttgtcaaataagacgaacggtcaaatgttaggcacggatatccaaagctacacttattttgggatggatatagtatattgtttggataatccgaagaattctatagaatattcattgctccctccattccacaacttagtacaaattctatcttaactatatacttataaaatatggtatttacagctaaagagcatgtctaatggttgttaatactgatctctcagtgttgattaggaatattcgttgacatggaaaaaaaaggagacaaaacatagttgctatgggtaataacggttcaacaaccattcttagtctctataatatggaaacacgattgggtgagagtaaaaaaaagaaagaatagtaaaaggagaatatttttagttaatttagagcctttttgcctttcaactattattataaaaacacgaaaataattttgtattatctcagagattatactcgtctctgccgattgactagctcttggttttattaccaagttaactaatccaggttcacacctcacccacacaaattttgacaatttgatcctttgaaaaagctaattttacaaatgaaccgccgccaaaacttatttaaaaaatgactttttttcagcgccaaatcatatggcactgaatttagacatctcagtgccacgtcaactggcgctgaatgccttgccaccacggatggaaggctaagtcagcgtgccaacgtacattcagcgccgtactatttagcgctgaggtatctaagttcagcgccatacgatttgacgttgaacaaaagggtcatttttgaaataagttttggcggtggtttatttgtaaaaatagtttttgcaaagagttaaattgtcaaaatttgtgcctcaaccactggtggaggcaaaataagtatttccaccctttttaatagctttgtttatgtagaatgttcttttattttattttaggatagggaaagcagctcagccgagtatcgttgctttgattctcttgatggttgtatctctgctgctcatacggcgcaagtatttctacaaaagaaaaacaattgagaatatatctatttgtttaataatttatgtttatatatctacacgggaagaaatgtcacaaatatacgagctccgcagattgaatacataggagcaatcacaaatcgcgttgcgggaatgcgggagcgccaaccagggtgttcccgctgaacgagcaagcagaaccgctagtccgccacggtccggtgggctgaacttgcgggaccatgacggtcctgcggaccaggagtgcggcagcgtggcttcattgcgtggaaccaactctgtgaacagtggcaaacaatgttagacggtactcaatagtgtttttgaacaatattaaaaacgcatgtacgtgttcagatgccggtgccgcggtgccgtgagaccaatccacaggaccacgtcggtcccgcgcaattgccccacgacactacccctcttgtcggtttcgcgccttcgagttgcagtgatggcgcgggccgcgtatgtggaccgcgggaaatgtatatttctataaaattttcatacgcatgtatatatatgcaaaatcaagaaaattacttcttccgtcctaaaataaatacagttttacactgttcatattcaacgtttgaccgttcgtctttttttatttttttatgactgtacttttattgttattagataataaaacatgaataatactttatgtgtgtctaaatttttgttagctttttcatattttttttcaaataagacggacggtcaaacgttggacacgggtaccaacgattacacttattttggaacggagataataatttatattttaaaatttaatttgtatttctactacttaaacatggagtcatcgatcctttccccacctcgtgcaaagcatggaacatccaatggggattttctgcggtaccgctagtgcggtagcagtggctgatgtgtgggtccggacccacatgtcagcctttgctactgcatcagcagtactgcaaaggatctgtatcctggactatcaccctaataaactagaaaaaaaatcaaacgacaaaaaaaagagagcaaagtatatatctacactcacaacccatcctcaagtcatgggtctagttcgttataattcacggatatattactaatgggagataataggatgggcctatacaaagaaatatatccgaaagacttggtggatattttgagtaattgctatctcgatgattaggaatcacctataaatgaaacatagagttgtgagggtgaaatatgtagaaagatactaggaagcgcaattggatttgtggggatccatgccattataaatttatctgtttggaaatataccactataattcgtgaaattaaaactataccattacaatttaacatgtatttaaggggtagcactgcttaccccttcaatgcaatttctaagtttttctgaccaaattaccctcctttctcaatcatcttcttccttccatgtgctctcgtcgtctgctggtcatcgcctcagcccctggcgagctcgtgcagccaaccgcagcgctgccctgacgagctcatgcagcaggcgtccacgacgcacgaagagctgctgctggaagggaccggcaggaactccaacgcatatccagcgaccttggtccaaagcagcatgggcgagttcttgttgcagttggacacgagctcgatggctcccgccgtccctggatgtgctccatggccgctgcccacaccagcaccgacgcccccgccgttgccacccccaccccccacccctcggctgccagatctgagtcctaacagcgacgtgcgtccaggcgtcgctggcgtccgctggtcctcctcgcatcactggcatcatccggccaaccaactcgcgtcgtcgccgccgtccggtctgccatcctcacgccgtcgtccgctcgtcctcttcgcatcgccgccgctgtcctgttgtcctcctcgcgtcgtcgccgccgtccgtaaccattctcacgctgtcggtgtctgcccatcttcctcgagtcaccggcaccatctagccatcctcattgtgtcgccgccaccgtacgctcgccatcctcacgccaccatgttcttctcttcctcctcgcgtcgtgtcctctgctcgtcctcctcggcaggcgggcggggcgcgaaggagcgcctagaggcatggtttaggccggaggaggaggagcttcggtggaggcccaggcctcactaggcgtgagggagagaggagagagaagaggggagaaggaagaaagggaggagggagcaaaaagacgagggtaaaatggtcaaaataatttttataaatacactgaagaggtaagtagtggtatatcttaaactgttgtaaaattataatatcatcgttacaaatatatgaattataacggcatattttcaaactgaagaatttataatgtcatggatccaattaaccctcgcataaagggagtttggttgtggttggtggtaacgtttgtgtagctaggatcatcatcaggcaaaattggcatcatttctatccctgaaccaatcgctgattcgctgcacggtgcacgctacgacgactgcgtgtagccgtgtaggatacactttgaagtcgcatcctgtttggatccataatcggaaattcggaagtctcaacggaacattcaataggttatatctttatgagcctcagttttcaacggaacattcaaacgtttaatatgatagggtgtaaaatttttacgtgggaagtaaacatagcctcagtttgtacgagggaggtcagacactgctaattgtacatggtcccacaagatcgatgtaagtgccgaaccaaagtaaaggtttgctttcgtgcacggccggtaggcctatagggacgatccactgatttggtcatcgacatcttgaggaataagttcatctgaggtcccttaacttgtcaacgaattcgacttttgtccctcaaccgaaaaaccagacacaacgggtccctcaactatcaaaaccggtgtaaattaagtccctcgatggtttgagggtggttttggctgacatggcgcctacgtggctaatttgacttggtcttcatctgacgtggtgcttacgtggcaattcgatctagaaaaaaataataaaacccatgggacccacatgtcagtttcacacacaaattaataaaaaatggtgggggcccacgtgggacccacatgtcatcctcgcccctcctcttcttcttcctctctccccgactccccttcatctctctcccctctcctttgtcctctctctagacgcgagtgaggaggggcggcgcgcggcggacgacgggtgaggagggagcgacgcgcggcgccggcgggagacggaagagttggcagcggcgcgcggcaccagtgggagaggagggagtgactcgcggtggtcgacgagatacgggaaagaagggagtggctagaatgagcgagctcctcgccctctccactgcgccggtgctccacgcgcagctccagcaggcggaggctgcggcacaggcgaggggcaaggcggtggaggacgacgacaacccacgccggcgccgcggacgacgtcgagcaaccggcggccagcccacaaacgacgacacctccttctcccttttcccctctcctctcgtcgccgtggatccaaagggaggagacggcagcctcgctccccagatcagcgtcggcgactcggcggagctcggcctaggcgtcgatgacgccgcgtggccacgatcctagcatttgggatggcatccgctgagaaaggatcgtgtccgcgtaagttgggtcatcgtgcccacgttctgtaatcgcgtatggataaaagggaaagaaacagaaaatgtcgcaagcaagtaatatgcagcgccaaaaagactttcccaattggtttgttcttctcgcgtccaagcgtgtgtgtgtgttgcaggtttcactgcagttgccggagtttagctaacatcgtcccccacctcttcattgacggcggcggggattaagacgacgacgacaatggcgacggccgtgaggcggtgccgtggcgcgaggagaagcacccgaagacggccaatacccatatctacaccaccattgacgcaatcccggtgctgttcaatggtttccctctcctcaagggtgtggacaagccgtactggttcgaggacaccgacgatgacggcggcgtcctttcagcctcatcccgtcgccatctccaggagctcgcctgccactcgccccctctctgcccaccgcccctctgctgtgcccgccacctctcggcgctgcggtgccgccgccccttgcccgtcgcttgtgccagcttgctccagccgccgccgcttagctccgccggccggccactccgctcagacctgctccgcccaggtgagagagagagaggatggagagaagagggatgacatgtggggccaaatgggtcccaccatttattattattttgtatgtagctgacatgtgggtcccatgttttttattttttaaaattaaattgccacataagcgccacgtcaatgccacgtgggacgaagacctagtcaaaggagccacgcaagcgccacgtcagccaaacccgagcataatactgccgagggacctcttttgcacggttttgtaagttaaaggatgtgttgtacctggttttgcacttaagggatgaatttcaaactcggcgacaaattgagggacctagaatgaacttattccacatcttgattggtatgttgggccgggcccgtcaggccatgggccaagccgatgccaggtcgtaccatcccggcctgacgcggcctagtcacctgggctagcacaatgggagggctgggctttctgtgccgtgtaaacggcccattcttctcgtctcttcggccttgagctctcgaggttcccttaattattttccgtttgccttttcagttcccttattctacatttggtcaattggctgctttatatattttgagaagaaagtgaggaattgcttcgttcgtgctattatagttctcttgatccttcttaatatataaatccggaccaccagaaaaaaaataaaaaagaaaataaaaagtgaggaattggattctgcatcgaccaatctcctttgatcattttctatatacgaagggcaggcagtggtaggtggcacccttgctttggcagcttgggggcaccttggcagtcaagcgatgccatggccaagactaatagctcgattccagactttcagtagctgcattgcatatcaggttctttgatttttttttcttccttttcttctaaagctgcggtgttttaaccttattctcggcattgctgcattctttataggaaccgaatcccgtgcacattaagtttgacaaatttatactctaaaaattgtcttatattattgtatggctaaaatataatgaatgtgaagctaagacttaacaaatactcctatatacatatatagtacattttgagttcatgtacattatttttttcttgaattttcaataatatttgctagttaggtgtgcacatacatacgtacatttggttttgtgaaaatacactcactgaaggttgatatggatctagaagatgtgtgaatcatgtgtggttcttgtaaagtaaatatatttggattatgtatcagcgtatcactatcaaccatgtatgtcgaatatacttatatatgtacataaacaatggaggagcaatttgcgctcccatgaactgttaataatctgactgaagagtacttataaaaacagcccatattagttcatggcttacgtatgccagacgacgtgcaactgcaattcttacattgacctgcacatttcctcccttcccaagcttcaaggacggtcaacaagagggtatcataaaaaaaaatgaagctaaaaatattattggcaatttggcatgcaactaacatgtgttctagcacagtagcagggaccttatacaaattcaactgggtaaaattattgccaagcaactatcatgtgagtggcactgtagcagaggccttatacaaaataattcgacagtatgcctttttttcccccttcaaattcacagtgctaagcgtgtgcaagaaatggttctttcaggggtgggaaaagggaaatagggtgtacggtacagccagtgaacaatccaaaattttcttctctgaaactagtatttttaaaaacatattcttctcgatcttgaatcatttcatgaaccttccaaaattattcgtctcctgattgaagagactgacataaacctaatctgctgatctctatacagagatgcgttggcactgtttacatacaccctgccggccatgatgttatcccatacggcagatccttcctttcggtcaatgcattaggtgaaaaccgagtcgtcttacatgcatgctatcacatatatagattgcaggagcagatcgaacaaaatgattaggtcaacatgccgtgtgtccatgtggatcggagtacgctagaaatttttaacctggaagctagagttaactgtgccattagcaaaagatcactttattaaccttgcaaacggcaaggtcaaaagctctttccaaaaaacgagaaatatacttttgacattttgacagatgagtgagctagcactagtgttcttcctgcttcgactactaccatatatgttgccttccatttgttgctcatgccactacaggcggctaaagaaacaattcacatgcattatgttattttttttcgcaaattgcatcagttacctaaccactcctcgttctgccatagtttcattagtttaatctctagtttaattgagctttctgtgcgttcattaagtaaagtacaaggacaggcaggccagaagtattctcgttggaccatgcatgtattaataagcagcagtgccggtatgcgtagtatagagtaattcgtctgaacctttctcttttgtgcaatgtgcgcggagaaaagaaatgcatggctgtgcttgatgtcgaccattgacgatgacccacctaccgtgtatgaacaatcgcggaaatagaggataattagagataagggtagacaaacttggatggaccatgatcccgaacaacacttggcattttggcaatgatattagggcccacatgttaatgagcagtattgtagtatgtattgtagtatatctctgtttccctattttgccaattccttttatctttgtcggttatgtttctataaaccggttgagtagataagggaggtttcgtgtctatatgtactccgcaccgatatcaatccaattttgtgttgagtctattccgcttttatggtatcagatttttttcgatctaccgctctaagcctaactccaccaacaccgccatgtcgacggctacctcccccctcttgccagagtccctcgtcaacgttgtttccacgtccgttgccgacgccgtccgcgcgtcttaccaagccctgcccggctcgacaattgatgacgccatggccaagacggtcaccgactccgccgctgatcgacagggcatccgccgccgacccgccgtacatgctgccctcaaacagcacctgccggcgctctccatagcgcccaccgccacctcgtctctccccaccatggacatcgctccttaattatctctctcggttctgtttctataaaccggttgagtggataatggaggtttcatatgtactccgcgccaatatcaatccaattttgtgttgagtctattccactttcagtttggttcatgagatgcattaagtctgaaaagtaatatttcttgaatataatataagggttggccttatctttaaaaaaaactagtggatcaatccagcccatttttctctatcactaacatgtgaaccgtcacttaaaaagtaggtcattttatctctcataccaaacggataaatgcgatcttcctattttcgaaatatggatgagttcaaccaatctcatctcgttctgaaatcaaatacctctgtgtaaaaaaaaaagcggccgctgtattttttcagtagatgaaggagaaaaagaaattcggaattctgaacgttcgtgtgtgatttgactgatttatcatctgaaatatctgaatgaataatgattaggatttctggaggaaacgaagaaacgagcgagcagaaaatgagtgaaaaggaacgaacacaaacgctgaccatcctctgctgcgtgtgtaaaactgcagccctgtccaacaaagcggccggccgcgtcgtccaaaagactgatcgctcatcgatccgtcacatgcaagttgccaaccatgcggtgaaatggtgatggttctctataaaaagagacccttccaacctcaccctgtcaattgtgcagcgagacaccgatagctagctaactaatcttccccttcgtctccggcattattccacttggacgaacactagctcaccggccggccatggcgtcttcttccgttctgatcaagctgctcgtcgtcgtcggctgcgccgccgcggcctccgcggcgacgctcaccgtgggtggtagctccgggtggacgcttggccagaactacgatacttgggcaagtggccaaaccttcgcggttggagacaagctcggtgagtccttgttttcttttggcttaatttggtagtagtgatcagaatgtttggaatttcaggctggaatttagtcatatttttgttacaatttcttgtttcatgcttttctatacatcaaaagagaaacaaaagggtagaaatttattggagggagtagcacataagtgtacttcttttgccgggtcggccgaccaaattccattaagatagagggtatgcaaatttataaacctgtgaatttcgacaaaaaaaaaagctatcaaaaccgaatggagattggtacacaaacaacctcccgaaaacagaaaaatgtgctacggcttggctgttcctctcccaaatcctttaaaacttcagcttccttccagattatgatttcctctttgacgattctagaacacgcgtgcattcctttccttccaaataagtggagtactaattaatactcgtgactaatcaagcataattggtaatttcccttttcagtgttcagcttcgttggggcgcacacggtgacggaggtgaacaagaacgattacgacaactgcgccgtcgcaagcaactcgatcagctcgaccagcaccagcccagccaccctcgacctcgccgccgccggcatgcactactacatctgcaccatcagcggccactgcgccggcggcatgaagctggccatcaacgtcggcagcggctccggctccggctccggctccgggacgccacccagcaccaccccaggaagcagcggcacgccgccggccaccccttcttccccctccaagccgaccggcggcgcgtccgccggcctgcaggccagcgccgccgtcgccgccgccgccggcgtcctcgtcaagctcgccctcttctgatcgggcccacctgccaggatagaggcagtgcatatgattcttgtttcttgatcatttcgtctgacggccggcatgcatgtgtgtgagagagatgagtggtttgctagctagctagatgatgatggtgatgatgatatggggttgttgttccgttccatcgtgtacttagtactgtaattacgagctgtcatgtgatttgttttctcatctccatggatttgtataattttcctctgaattttatcatctgcatattgatcggacactctatatcactctatatcaatcttgcaaaaagaaaaaccggtggttaaagtgatggttaacggattggtcatgctgagcaatgcatgatctaagcttgcctaggccgatcactgtagtaagaatgggaccagaccgacctgaaagaagagcaatgagacgactactaactactaggacactagcctagaggaaaagaatcgaataatagatcgaagggcaggtagtgcgtcgttttcagagaagggaatacctcacatttctgcttctgttagaacaaaagtttcctgcttcaacacctgctccgggggtaagagtcagacggttagcttaggtaccaaagttctctgatgctaattagccgtgcttacctttgaaatgagcaactgaatctgtcatgtcagtgtctgaaatgagacgacgacgacagtggacacggcggattcaacttcttgatttctttagtgatggtgggagtaggttgggtttggtgaggaggaatacacctttcaatctcaaagcatcaaggcggtgtgtatagatgactagatgagtgtgtgccagccgcctcagactccttgaacacaaggaaagaattaaactccttaaagaaagaaaagggttgagacaatgagaccgtccgtgatttggagtatatcaccgttccagagtatcagtcattgtcatacaatttgggatattaatttgttagcgagaagatcacaacatgttcgttgcaatttttcaggtctctttaccagactttggtagaccgcagtgagagctccaatccaaatgacagtaggctgagaggtaaagagaaaaaaaaaccctcaaaactaagttgacttgtgtaaaactagtttcgactactcttgagtataatgagttgagtttgattttgaacttttgcttcgtttgccaatatgtgttcactatttcggaacctataaatatttcaacgacaagagaggaggggttgctatatcagagactttgaataataattaaactcaaaatttgaacactttactttaataaaattttttgttaagttgcatagtttcaagctgaaaaaaaaatcctattggaactttatttcaaacctgaattttgaaactctagatctcaaattgtgagacctacaaggttgcacaacacaaccattacgagtgtaaacacgactggtcactggtagatctatgattcaaaattatcattttaacctctactcaatctgctctatattatagttcatttttaagtttgtcataagtcaatatttttaatttagtgaagcttactgagaaatataccaacatttttaacacgaaacaaatatactttaaaaatatatttaataaactaattttttattataaatattatcatgtttttctataaacttaattaaattgaaaaaaaataaattaggataaattggacggaatatatcgatcggatgaaaagaaaattgagatgaaaataaatcaaataaaacagtagtgagtagtagcactagcagcttgctttctactccctgaattgataagtggtggatatcctcgcgtttcattggtgcgcgctggaattgtgcgtgaatattataattccgttgaaccggtcttcgcgtgctggaaattgtgcggctactggcgttgggaatccctggcgttggcgtttctttgcggttttgacaacgaccagtcgactattcacgacgacccggccccctaccatgctgtccatgcatgatttttttcgccggactggcgtgaagagtgtccatgcatgatgaactcgatcaacccaaattccaaatttgccatcccaaattcccaatccctgaacacacggcctgccccacacacattggctgcattttgccatgcaaaataatgtgcttctgattttctgaacctcgcgcgtgcgctttatccaaaatgagaagaatacgcgttgacagacaactgcgccagcttgtccatcttggcggccgataatggagtaatggtggtcatgaggctctttttttttttttttttgagaattacatattacaacgcagacactcacaacgcacgcgcactcaaccctctgtcgatgggtacgtcgcctaccactgaaagcacaacgccgttaaatcctagaaaattcgctcccacggggagtcgaacactgaggctcttgtaaccactaggctacatgccctttcgcatgaggctctttctttgatcgacttaggaacgtcctaaggctgtattcgggaactccacctcacctatgaaaaacgcagtccattaacacatgattaattaagtagaagctatttttttaaaaaaggatcaatatgattttttaaagcaactttcttgtaaatttttttttgcaaaacacacaccatttagcagtttgaaaagtatacacgcgaaaaacttttttttttaattttgagaatttaaatcctaaatcgtgaaccatgcaatagaatatttatacctcgatttaaaaagtgagctataaatattctatttaatttaaaagtaaattgcatcgtcggtacacaaacttgtcagatggatacaaacttataaaatactcgttttggtgcacaaacttgtgcggtgcatgcggggaagtaaaaaggacattacatgactaatcttgttgatttaggggtcgattaggatactatgggagcgttcattctggtgacatagggtgagaaaggacatcgtattctgggcgtacgcttcccaaactactaaacggtgtgttttttgcaaaaactttctatagtaaagttgctttcaaaattcatattaatccatttttgaaatttaaaatagttaatacgtaattaattatgcgctaatggctcacctcgttttgcgtatcttcccaatcttctcaatcccctcctcctcaaactcaccctatgtaaacatatatatgagaaggttaccattatacatacacctattcaataaaatatagaatataatttagtgatagtagaaaaagattaaaaaaattgaacactgatataagggttagaaatatatgaaattcatcatttcaatgataaaggataaagtagagataaaatttataaatattacatgtcttatgcatattaactatgcgtatacacgccacatcctaatcaacatcaactttataaaattaacattgtcaagttattttggtcctcgttcgcatgaactagacaagtttgtgtactgaaaacgagcattttataagtttatatactaaattgcacccacctaacaagtttgtataccaccaatacaatttactcttaatttaacaacagtaatctcctccttatacaaagaatctgccagacaaacgtaagagttgaatcattttttgaaaggactttactaccaggacttagcctagtaatgtattttcgtaaaataaaagacttatttacaaagttcgaagcagatacaggaattagaaagtttgtaaccatgaaaaaactatatgcttaagatgtcattcattttgcacgtatgcaaaagaataagagttgaatcaatatttaataacgatcaatttacaattatatcacacaatcaagtgagttgtattggatttggatcctactacatatgccttgtttagttccaaaaattttttacctaaaaacgccacatcaaatctttggacacatgcatagaacattaaatatagataaaaaactaattgtacaatttgcataaaaattgcaagacgaatcttttaagtctaattaatccatgattagtcataaagtgttacagtaatctacatgtgctaatgacagtttaattaggcttaataaattcatctcgaggtttccaggcgagttatgaaattagtttttttatttgtgtctgaaattcccttccgatatctagtcaaacgtctgatatgacaacaaaaaattttctttttgcgaactaaacgcacccttagctcaaatttcaaaacgagatgatttttggttgatacgagagcagcgtgcatgatatccttgcgtttcattcgtgcgttggaatgctgtgtgtgaatcaatataattccgttgaacggtcttgcttgtgctttggataagataacgacctttgacgacgacccaccaaaccatgcatgcatgaacatgagcacttgctcccacacgcatgggctgcatttcgcctcttaaattaatcaaaacagtcgacttctcaaccttgcgcgtatgctttatccaaaaatgcgagaagagaatgcgcgttgactggacaggctcctgctcctgtccaacttagcggccagtagtccccagctgcagctagtactcatggagtggtcgtcatgaaactctcagtataaaaggaccctgcagcctgatcccctgtcaatacaaccagctgcacgcccattcgtctcaaacacacattctttgattcttccttcaatttccccttttcaactctgtcatcaacttaattgttagaagcgacctaaagattttgcggccgatcgagcatggcgtccccttcggctctgatcgcaatgctcctcgtcatggtcgtcggctgcgccgccgtggcctcggcgatggagctgagtttcattgtcggagatgcgcagggttggaacaccggcgtcgactacaccgcttgggcgaagggcaaaaccttcgaggctaacgacacgcttggtgagtctttctcgataatcaatcacttcattcgcacaatgctgctaaatgctaatgctatccagtttgccaattggcatttgaaatcgaacgctgattttatttggtgtaattaactgttttttgccttttttgtttcttcagtattcagatacgccaggaagcagcacacggtgacagaggtgaccaagagcgactacgacgcctgcaccgtcagcggcaaaccgatcagtgatttcgaaggaggcgcgcttgtgacattcatagcgctcagccccggcgagcactacttcatctgcaaaatcggcaaccattgcgccagcggcatgaagctcgccgtcaccgtctccaactccagcgacaccccgaggccgcaaccttggattgggccttactccacgccagccagcgcgtccgcacacctgcacgccggtggcgccgtcgtcgcggcggccgttgggatcctcctcaatctcgccctcttctgagatcgcattgacgcgtcgagcggcatggacgttggcagggtggaggcaatgcatgattctttgtagcgtttctgatgaaatttgtttgattattttgtttacgttcgatcgtgtatacgtgcgtaataatgatttattggtcttgtgatttattttctccttatattcatttgtatatcctctgatataattttctgtacatctcagcattctgtatgccattcagtgatgtaggttagagtaacaaagaactttgctgtgatgtctttatactaacttaaaagtgaactcgttatccttccatccctttcttctcccaccgtgcttcagtgcttgcacgcagagcgtagtaggtgtgtcaaatactcctagtaaatgccaaggaaatatgcctccagtccggtcgcacccgcacaaacccgttccaacccatctcgagaaaggcccattccatctgcttcgccacggcaaaaggcccgcctcttaacggcccaaataggcccttctcacgggggactacgtccgcgcgggccgttggggcccaggtaaacccccgcctgggaagcccagcttggatcgggaaaccctagccgccggccgccatcgcccatcgccactatacatcacgcggcgaagagagggagagtgattggccgcggccgccgagaataactggagattcgccgtcgagcgaatgcagcaggctatagcggcgtagcggcgacgaccgccgacggggatggcccctgtggcgacggtcttgacggccgccatgtcctcgtaggccgcctctgcgcagtaggcgccggcggtgccgtcgcttcgactacggaggttcgtagctcgcgctctacgccttctagatccggaatgattctaggggatctgcttgtattctgcatcttgcgcgtaccacgttttttatgaaattattgacgaatattttaggtctcttcagtttctgcgtgcttacttcaagtttcggcatggagatgtatttgggttttcgcgttgatgttctttgtattgcttttaggtctattgctgatggactgacatctgattgtttaaagtagctagtgcgtatttattcatcctcaatgatgagagatgcattactgaagattttttcctaaaaaaaactgaatgtatatgtggcaaaggcatatccaagtgggcttttaattgtaaatatgttcattgcacttctggtccgcattagtgtgacagcaaacaacacaataagcatattacttttgatctgattgatagaccagacagctgtctgatgcttctattgcctatctcatgcttgattatagcatatttgcattgtggtcttgattgtaaggctgtggttgggattcactagtttcacatacttggaaagaattcttggagctacctttctgggaaaaccctttaataaagcaattctaactcttatccattaacaaaaatgccttcagttgggtgtaaaaatttatgtattttctgcttatctgactataacgtgttatgttttcttggacgtttttatgattggtgccccaattttcaccatcatattttctgaaaacatctgtggtgttttgatgaaatgcaggttgtcagttgtgttaattcttcagtcatccgaattgttgagattccatattgtttggtcataacataaccagtatttttatttctgtcattcaaaactctattgtgctctttattgcttatttatatctaatcaacacttgatatagtgccagcctaaaagtaaactagaaacctactaacctagtgatggcacattgttgtcttgtggccacaaaaggatttccttttttgtcttagcaggtgtgcttgtggcaggaagtattttgacgaatttgttgagttttttcttttggggtttacattgtaaacttatatgtgatttgcaggtttctggaccaaggtccttattgtggattagatttggatgattttaaaactctttaaacacaggatgcagaacagctcaataacagaagcgctggaccctggaggtattcctatttccatgttgatattaatgcagcttgatttttagtgtcatcattttttcattgaaaccaattggctcggtagggctatctccaatgctggtggaatatgaagtccggagcatattgcttagtttaaatttgttgtggtgaatagcgaggaaatcagctctttatgagtttgctcaagattgattgaagccagaccttttggtgaatattatcaaggacagttcatatggctagaggaataaacgcagccacacataaattatctacctgtaggaggataacccctgaggattgacaaggaatcaaggtgatattttgctacctaatgctcttcaaatagttagttgaattttcttccgcctattaagaaaatgcattgcatcatattttgtggtctcctcctccctagtccctaatgctgtatgcgtgtggattgtgattagtgttatggcaatgaggagaaatgaaaggccggtcttacggctgcctcccattcccttcccgattcaattagtctctggtatgggacgggatggtagtagcatgatgtgcagttcggcgaaaggttctctgagccattctttctttacctccacttatgttcagtacactttatttcgtgttctttttagggtaaaaatattgcaggttattagggtcctcattcagtgtgcagatatacaacaatgcacgcacgttggaatttgcatagtcttgcgattttgttcttgcatactcttccagaagcattgatagcttttgtcgaactcctgattttgttcatagtttcagttatttgctggttatgggcccttccagccagccttcctctggattcttgttcttcgttactatcatcactgggcatcataggcgccatattggggcttattgtttgttgatttgagccgtctgtgccttttttgcttatttgttgtgtcgagagctgttgctttacttggaagtagtagatgtgctgatatgaaacaattacggtgtaatactccgtagtccgcaaatgactaacttatttgactgtccatgtcatctgttttgtattattgagctggttagagcatgtttaatagtagataaccggctataagcttatattagagctaacttgtatatacatcgttctatgggctgcttttcgatgacgcggctgtggcctttccctatccagatttctggaggaccagaaaagtagaaacggcccgtgctagccactcgcccgaacaatattacggagtatttttacccctggttttagaatatggcgaagatcgacgtgacgattatctaagaaacgtgaatctcgaatactatcgtacattcatagattccagaatgccacattgtaccgtgatgattcgtctaagaaatgtgaatataccgtgttgccatcgcgggattgtttgcctgttccacacgtacccggccacctcacccatacgcgcagccacattacaagtggtacaagcaagagcccgacggcacagcttgcaagagctccaccgtctcaacctcggggctaccaccgacggctcacacgacgacttcttggcagcagtggtgacactggcgatgcaagtgcaacaacaacaacacgacctcgtcaacattgataacacctcactcgagcacagcaccggctccaactccgtgtacaatagggacggcggctacatgatgctgatgagcaccgcatcggccacgacacgcggtggcgagaaaccacgagtagcaggtggttcaagacggccgagggatcacggcggcgacatacaaaatgtcttcgcatcgtgccgttagaggccaatggctggaggataggggcaaagataacataattgccctgcattgttcgctcgatgtaaagtcctaccccctctgttttttaatacatgacaccgttaacttttaaacatattttttactatgtcttattcaaaaaaaattgtataagatataaatcatgcttaaagcattttaagtgataaaacaactcgcaacaaaataaattataattacataatttttttaataagacgaatggtcaaacgcgtgataaaaaatcaacggcgtcgtctattaaaaaacgaaagtaatacattttttttttacttattctgatttaacttgtggcgtgtagtcaggatggaacgaggaggctttcctgactttgtgtagtcgtcatataaatcaggatggaaggataaggctttcctaacttgcgtgtaccgtgtagtcacaaaatggaaggatgagaggatggaaggataaggcttacctaatttacgtagtcagaatggaaggatgaggcttttctaacttcctgtacttcagtttacagttgagtcatgaagtcggagaattcacttctgggatggagccaaactaatcaaacgtgtgccaccaccactggtttcatcccaaaagtgtcatcgctaccggccaaacccgccccgcccgcgcacgcactaaccgcaccgaaaaaccgcctacgcgagcgtgtcggccgcgggcacgttaccaacgcgcgcagcccaaacgccacgcgccctcccctcgccgcatgtcttgccgtgctcacccaccccccaccaccaccacctccagcaccggacgcctctcccatctcccatcacacgcgagatgctgtgctccccagctggccaccaacgtgacaacatcatcacgcaacgaaagccacagcggtagaatcgaaacaaagcaaacaggagtagaatgctacagtaatacagcagagggggaaaaatctgagcagatctgaggagctagatcagaacagatcaagcaggcaggagcaatcggatgacaaaatctctactaataatgtccgaaagtagattaaagaaaagaatccggtgggggaggattatacaatggcaagcacagtctctctctcactcacaaaagctagatctagattaaaacgcaatgggattagcaaccccagagcgaaggggggaaatagctaataataacaataataaattaacggcagtaatggcggtgatgatatcggcggcggcgaggaactcatctccgggagccggatctcagtagaacgccgcgacggctgccacggcggcccaggcggcgacgacggcggcggcggagggggagactccggacgcggcgctcggtggcggcggagacgtcggggcctccgtcggggactgggagatcgaccccggagccggcgcgggcggcgagaggacggggggctccgcggtcggcgccgaggcctggggtgacggtgtcgcggcggcgctcggggcgggcacgggcgcgggcgcggaaaccgggggaggcgtcgtcactggcggctgggcggcgggaggagacaccggcgccacggccggcggccgagtcggcggggtcgccaccggtggctgcgccttcggagccggcgtcggggaggcgctcgggccctgcgccaccgccgcggcggcgaagagcgcggccatggccacgaccacgaggtggaggcgcgccatgggatggcggcgaggagagctagggtttgggtttttgaggttggtgggcttcgctttgcaacttccaagtgggggaggcggcgaggcgggcgatggatgatggccttcaggtatgggggctataaaaaagggggcttttaactatttgccacggttagttttagcaaataactatttgccacccctatctcaatgacatgtgggtctacatatgtctatgacatatgggtccaatggcaaaaagttaattgtcacatctaaatgtggcaaatggttaaatatctcaaaaggggggaactgactacgcggtagaaacgaaaaaggaagagttatagatagcgattaaaaattggagattggtttatttggaggatttatttaattcgagattttggacggtgattacgccatcctttttaagtcggttcggccgtcggatggaggatggccgttggattggctgccagggtgcagatgatatgggtacagaatgttgaggctacttataatgaaagcaaattctgcaaaacaaacgaacggtgcaatatcttcatgtcaaagcaaaagatattttccattcacgtatttaaaacagttgacttgtccgaaattttaaaccaggtagatatatttggaacttttacatatatctcatattcgaactaaagcctagggatgtcgatccaattccgggctttttggattataggactaaaaaaaagtcaaaataggaaaagaaaagataagagcatatgcaaaacaaacatatgaattctaaatagaattgtaaaacatgcgtcaaacaaagcaaaagcaaagaaaaaaacgtaagaaatgaaataaagacatgtcagagtgcatgaatttttttttctttgtttctagtagaatccacatgatttttcttgggtttctgtaagagatcaattcctttgaaccgaacggtgttacagtcacgaatccatatgaatccaaaactctcttttttttttcctttgttttttctcatatcagaatgggtatttttgtcaccatgggcaagtgaagtaattttttctcatcatattctctttcatcatgttaaatgttatttttattcctaattaagatttaagaccagctctgaagttttggccacaagtcaaggtcggttgccttttctatttgtgataatgcgcgtccgcctataacaatgccgcgtcaatcttaatgtcagtttaaaattgccagagaagtggatatactagaatagacaggctatttccttacttaaaatgacactagatgagtagtaggagtatgtttttggttcttttatctaaaaaattgttttgtttggttaattgataaatattagctttgagaaatctttggtcaatttaaaaaaaatcctttaatcggaagaaaatggacatgacaccttttggaaccatggatcgagtcttatggagctgtgctcaattattgtattcacatccgtttacttattcagattttaagtctagagtagtcgccgctgaactttttgacagtgactgtttctcccccgtaattttgataaattgaccctttgaaaaaacttattttgatattgagccgtgtcaaaaactaattttaaaaatagaccattttctcacggcatcttacttggcgctgagataaggtccgacgtgtcccgcaaatcacacgtcatgcgatatcagggccaaattctttggcgctaacttacatggtctggattgtataaatagcatgcatgtacacccttactgtatggaaggtgtatcctggtggtggagggctgcctctcataagtcaagggttcgaatcccgtaacttcccatttttctttttttttcctttgaggaacaatactgcatacataattatgtagcaaaatagagggtgaaaaaaaactgaaatatgtaaatttataccgactattaatctataaataccacatacataattttgttccttccatatttaaaaataaaataaatttaaaaaactaagctataaatactgcatacataattttgttccttccatatttaaaaataaaataaatttaaaaaaacatccatatttaaaaataaaatgaatttgaaaaacatgtgagatttttaaatagaacatcaaaagatgcttgtacttagatggaaaaacttgcgtggctaaggattgaacccattacttcacaagttctcccccaagctatcttgtctttgtgtgcaatggaagcttgtagataactaatatttgtaaattgaacagagatctttggtgctgacctcggatgacgtgtaaaatccgtgacacctcggatgacatctcagcgccaataatagtggcgccgagatgttatatctcagcgccaatctctatggcgctgagaaaacggtctatttttgaaattagtttttggcatagttcaatttcgaaataagttttttaaaagaatcaatttatcaaaattacgggtttctccccgtattttattatagcttagccaagtctttagtggaacatgtaaacgatgaaagggtattatagtggcatcacacatcaggtgattaaggatcgtgctatcaagaagtcaacattaactggacgtctggaataccagagtgcatggcacgctaggcgtatttacgagctgatgcatccagagaccaaagaccttggctgtggtcttaccccaagttttccaactatctcccttgtttttcaggcacacacttttcaaactactaaacggtgtgttttttataaaaaaaattatacgaaagttgcttaaaaatcatattgatttatttttgaaaaaaaatagctaatactccatccgtcctataatataagataagaagttttagaattggacacggttattaagaaagtactatatccgtttcacaatgtaagactttctaacattgcttatatttatttagatgttaataaatctggacatatatatttgtttagatttattaacatatatatatatatatatatatatatatatatatatatatatatatatatatatgaacaatgttataaagtcttacattgtgaaatggatggaataggtagaagtgagtgatggagggttgtgattggatgagtagtgaagataggtggaaaaagtgaatagttgagggttgtgattggtttggaagagaatgttggtgaagaagtggttatattttaggacaaatcctaagggctaaaagttattatatttttgaacgaagggaatacttaattaatcacgcgctaatgaaccgttccatttttcgtgtgcactgctctggttgtgacaaccttgctccagcgaacacttcagtgcaaatttgcagccgtatgaacagctcagaaatcagcgtatttactactcgatccgtctacgtatccagatatagctacatatccgacaaatatgtccagatttataggtgaaagatgttatatttttataatggagataatccaagataatgatacgtaaatgaaaggggaagacgaccaggcaatgtagaccggacagtagagtagactacaagagcacaaaagtctttacgtgctattggatgtagcagtgcgccaccagcatcaatcttttgctgctgaattgcccataagctgacagcagagtcgtgcatcactgcatgacctaggatcacggaccgataagccaccactcaggcctgtctctttacatttggagagttgatacaccaatctcagctagatatacaaatcatcagccaaatatctaccctacagacattatccaagaggaactttggataaccttcttctatgttgaatgggcacacggcgcccttgtacactatgaagtatgaaaacaatcttccaaagtgcaacttctgaaggatcttccttcaacgaacacagttgcaatgtttggtaaaactccagttttttcctttatgttcacttctatcagcatgtcactgaaagaatcttctataaacgaaatgaaaccatcttctgtcttgttccaaaacactgcagaaaggttaaaaacattaataaaataattgcacaacacaaagatgcaaaacacacccttgtagaatctttattgttctaaaatactacagagttcagaggaaacaagaatgtatgcaaacgttatgataggaacataaatacagtaactcagcagtcacggatgaaatgattacttacagaagtatacttgtttccgtctgtacatggtttgcctatttcacttggtcacctctcgaacttacagcctctaccatttcttcactactaccttcagcaactcccatttccttcactttttcaagttgcctgaggagatctaacctctctggagcataggtggatgggatctacaaaataccagatgcacaatgtacataattaaatcatgccacaggggaaataatgaggggtcatacaaagttacgaaccatggaaggcacatatctctggatgaaagccaaaatagcagcatgcccaacagcagttacctgggaacattatgaacttgtttacaatgctgtatccatgaagatatttgcactgaacattaaagttcactaactaaaaaacatgactggttatctttagtcaatgtggatgaagtaaagaagacaggcttctgaaaccaaaattgaaataaacaacagtctgggcctagaaggctttatgcttgttcaggaggggtaaatcgaagtacaacaaatacttactggcagaagcatgagtattcctataggaacaacagaggctaaatctgtcagggttctttgaagagcctgcttttccttatgagttagttcatccccaataagagctcttcttaacaaacccatagcagctcctgtgtcaattgctaagagctgtgtcccttgcacaacagtctgtgtagggaaaaaaatagagaaaaaggaaataagttgcaggtctgcattctagacattttttttccctcaaatatggaggagagctgcattctggatttcagtaatggaagcattcaaatatgatgatgcgccctggtggcacaaaggcttcatggcaactaattaaattatgtagggccaataccaaatatattttcaagaaaatgtaaatggccttaccgtcgtggtttccttaaccttctctactgatttggtaataacattttctttcttgctagctggaccagaaggcattgatacaggagatgatgacacggaagaatccaatgtttcatttgcgacatatgtctcctggaaaatgacaaaacaataaataattcttcaaaattgaaaacggatgtgcatttatggtcaaaagcaatagtgagaatatcatatgaaacacataactcagaataaagtactctgtccagcattgttgcttaagtgctaactcaaataccaggtgcattcatgtcaacatttagaaagcatatattaagaagcatacctccttttgagcattatctgcgctcttttgaactcttttctctaactcaatcagctcacgtcttaactgttcaaaccggaggatatcatttgattgtgtgtctttgttatccacattagcgacagaaacctttatgagaaaaaaaaagaggtaaaatctgttaagtaagaacatggtgcaacaagatatctttgcatcaatggtgttgttctcaagaacagaatacatgcttccgcaactattatatactatacagagagactgttagtaagaataaatcactaatcattgatgatttttgtgatccccatcattgttaaatacaacacctaaaaaatttgctcgaaatataattgctaaaaggacagctcaaatattcattgcaagatggcagcttctattgttttaccctattgttgtttgaaaattattaaatgcacagtaatgcatgctacagaacgcatacattttgatctgaagtttgttggacaagctgaactctccttccagaaggcctaccaaagaggtcccaaattggacgacgtttgttctccactctggtgaaaaaaacaatagcggttattatccaccctgaaatcacagaaactacagcagaatgttacctgtttgctggtttttgtggtgttgagctctcattagcattgctagctgtctttccacggccttcctcgacagcaggagataatggtctgctactagcatcagcctaattgaccatcagaaaactttaggatagccatcatagtagtaatgaacagttgtaccaagtagaacatatggaacctctattatgttgactcacaaacatattaccaaaaaaaaatcattatcaaatattgggtgggaatcttagaaatatggtggttctacatggaatcaactaacttcgttgtgtaaaatgtcaaccatgttaatcagtggaaggagaactgacacacctttaaagtttaaacacagtaaacaaaacttaaacagtccacccaatgaaactactctcgggggagtagaagaacctaaattatatcaacagaatgtccctaaagaaataatatctcggttttaaatatctaaaatgtgcaacatatctacgtgaatgcatggccaactggagcgtcaggaggctgacgttgaaggagatgataccactttccacttgtgttatctttagttgttatcagtttatttgaagcggatgttatctttaggtaactagttggtacccacgctttgttgcgggataagtggataaatgcatgttattcattatagaaattatagattatagatgtacatgtttaaataatgtgaaaatgatgtggagataatgatttgacattacttgcatattgagttctaaaaatacaacaaaattgtaaatgatatgtcatgtttgcatgatatttaaaatactctagataataactgctagtgggtccacttgcatgtgatttaaaatactctggatgataattgctagtatgcgatgatgtggcacacttgcatgttgagctttaggagttagtgggcatcaactttatagtaaagataggattagttagtgaagctgttaggaatgtaactgttatactgtattagttagcacatgttaggaggtggtctaaataagccaagccatcattaaggactaaggagaaatatatttcaagacttcctactctcgtatatccctgcccttgtggtgatgttgtcagtcatcagctggttgcactgcttgggtccagggccatataatcagggcatgtgataatttggtgttggcgtcaaccaccacagctggtgcagaaagagtcagccctaccaggcaacaccaaagatcaacaaaaccaccatcagaacggctgcaactatcattcactttatcgctagcacaactactggctttgccatcaacttgcaagccccatggacgccaaaaaggcagccctgatgtggtttcaacacttcaccatccagcgacttccatgctgacaacatcaatgacttgaaaagcgctagccccatggggcatgccaatgaagactttttggcatgactgcaccacctgttgatcttgtgactgtagctggtagaggtgcagcaaccggccatggtagatacattgacaaccttcagaagcacagtctgtgtgatcttgacagcttggtgctctcacatgacaggatgcccacactgcaacctcttcaccgtggagatttcaaggggtgcaactggtcaccaccctgcaggttgaggacaaacagctagaaaggaagggtgaagttccatgatacacccattattggagatgtgatcaaggcaagaggccttacagccaatggaatgtcatgaacagcccaacaggagcttaggaagcatgaggcagctggatgcagaacatgtatagttggttaagataaggagataagatatgtggctcgttgcgtggttaatgctgccctatttaaaaatatatctggattttaatcagattaagcaagaaataatcataagtgtttggactaggtaatcatccatagcccatgtagtgtggcccctggtcatcagcatggttgtgttgcttgggtctagggccatctaatctatacatgtgacaattgttatttcagtcattgaggatgttgtttctattattgagaaatagctggcccttaatagccattgcagttattggaatgcactctcctgagtcctatgatggagaaattaaagtgtccacatacttgtagtaattccttttccagatgaaatgcaggctagtaaaaggttgtatgataattaagctcacctcaagaaattctgtttttgctcgaaaggaagcctcaagaaactcagcctctttcttcagccttctaatcatttcaagatcagaacatgcagcccttagatcctccttaccagagttggaactggagagatgcaattcttggagcaaatcttctaacttaaccaaagcttcctcaacactttcaagtgactgcaattattgagactaacttcataaattttcaccactacaatatatattcagaagtaattaaattagcatttgttcaaattgccattgtaaactgaaaacaagcatacacaactaagcacaaacataagtaagactgaccataagctttttggcaaatggcaagtctaattgagaacataaaaatgcatataacttaacagtccgaaaaatattttttttaaaaaaaaaacacatctaacatatgatcttgtacagttattaattgtaaacagatatacattaaatggatcaatccttcatctcttgcatatctcagaatacatctaatacatgtcacgctttgaatgtgtaagcatatcaaaaggagacggtggcatctccctgcatgtgcagccttgcatcgtaatgaatttgatgtctgagcttatagtgttatggccgggagttactatcagcatgaggcctgcaatgatgtttcgcatagtgccagcagtgcatcaagttgcttggagcttctttcacagtttacccttatccaacaaggctatttttcaccaaatattatatattctcattaggggctactcatgaaagcaatcttaacatcttattgtttgcttacagagaaataacataagtccactagtcatatttcttgtccacaccaatattctggcaacagccatgagaatataaggcctctcaccatccatcccaccctccaccccctcccaccacaccaaaacaaaaccccaaaacacacacatgcaccaccgcttccctctgaaactggcatataggttccatgaagaaactataatataattagcagtttagcactgatatcagcaacatcatcttggaacatgtcaaatgcacaataatttaactaactcctcacaaaaaataataatttaactaacagtactgagaattactattgttgggatgtgtgagaaccagaagaaatactagtaacgttaaagtgcatcatgtaacagataccttgtcaaaagaggctagctctgtcctagcaaccaagtgttctttggcttctggaaaggtttggtcttttggcatatcatacctgcatcagaatgagcagataaataataatattcttacaattgtacaaacatatacccaagtaacataacaaataacaatataaacatcagaattatatgtttactttgttaagtccagttccttcatgcaatcactcaacatggaatgcctacaaaaatttgaccatatattagaaacgttggttcgcatccatatctgcggcaaaatgtgagagagcatgactgaatttggatgtaccccttggacagaaatctggctgcctttacatttgaagggttctcaagccatgagctgtactttataaaactagtcatccaataagagcacacatttagcactcttgatattatttctcctttatgcacatcctctctaccttcaattgttgcagctggcacatcaccactgtaaaatggaagccactcgagctcttcgcaaactacctggaaggtgaaaaggtcataaaaacacaaaaaaggtgcatagcattgagagctcggtgtattgcctgcatactaacctccacatacagctgataagaactaatcgaagacaactgtggataatataacacactcccaccaataagatacctggatgattgtaagcttgttaaggtgagagctacatcataattacgcaagaaaacagttatactgtagcttatgtacagaaacataatttcatcgagcaaatggcaattcaaaattcgcatcattcacaccttacaatatcattgattgaatcatccagattggtaagatgattggaagacaaatatgtttgcgtacttctgcctaaagcaatgaaaaacccaaaaattgctaaatccttttccaaaacctgcagtaaggaaaatagttattttggaaggagaattcataaagctagacgaaatatcttttgttccaacctcaatactttcacttgttgtcaatcttgaccatatcttttcacgatcaagagcccgtagcaactgtttctgaaccagatcaatccaaaacgatatctcaacttcacgatcactggaaaacttagggtcagcagcacgaggaccaaaattgcaaaggaattctctctgaagaccaatatcttttgtcaaggtatatgctttacttagagggacaaattcaagaagcatatccatgaatcgaccaatgatatcagggaccatggaaaagaactgctgacaagaaacttttgttgatccaagctttgtgatagcagcaagacatgtcaaacctagcataagtagagaaaggtcactttcactagtattcatttgctggcgttcatggcatctgcaagcaacaaaagaaaaggtatccgttaatgtattagttcatttatcaaatgaagcccaacagaagtaaacaacttacattgctgttgcagagttaaaccgtggatcgttttcaaaagagttaacaaatgttctcacaaccaaaggattttgatcagatgagtaccactggtacaatgtaggttcccttttcgacagctcattttggatagcaccctctagagaactaagtaggcgggataaactgcaacagaaaattaaatatgattaaataggagaccaagaggcatgttctataatcacaaattgaactgttatgtacaacatagaggttagatctgatttggcttcatcatgctgtcaatactatgttcatgtaagcttgactattgaatccagtagaaggctcattctgggtcaacaaaaatgcaaatacagcagaaacctgtagactctagcagtaacttttttttcccatgaatcaagtggatcaattaatttgcatgctcttctgacagcatatgttttattgacattaaaacttaagaaatctaccagtcaagaaatggaggaatatatttctctaataattaggctatagatggaaagcaacttatgagacaggaattagctccaagaaaacttaatatacagaggaagctacataaaatgtacattacacaccatttgctctctaaggtattaaaaagcaaaattggctccaagatgatagatagttgtagtcttaaaaacacaccaggagaaaaaggataatgtcagcaattaggcatgataatcaaggcaagtgctagagggcagacctcctctgaacaaatacattgatatctctatctctgccatttcccctagatgaaacatcaataactgcttgcaacaatgaaccgacagcagcctgcaaacagattattttagataccagacaataaaaagtttgcatgccaccaaaattcagaacgcaacagctaatatttgttttactgaagatttatgtgtgagaactaataaacatcaactcaaagaaggttcaattgccgcgattggctctaagttgattaaaagactctgcatcttcatatatgaaaataatactccagacaccagagcagaacacttcctctggtggcagagtagcactactaatatcctaaaaggggtgaacaaaagctaaccaattaatagtttaccaagttcaacatacatattcatctatacaggcatccatatttcataagacctctatggatgatatcctgactacatcatcttttctttttctaaacaaaaaaagggaaacagtagggtgcatgcaataaaatctggcttacaaaatttcaatactagttttctgcgtggaaggccaaaagggaaaagtcaagagaaactatttaatcaatgacatgaataatggtcactatcattttatgggcagatatatgcctgaagaaagttcagtcctgtacctggtaagagagtggttttatccattcattgttatccacaccaagccattcctttggaaaccaagagttttttgatgatttgctgtgatctaagaaagccaattcaatagatcttgcagcatcatgtattgattggacaaggccagtgcttatatcctcgctttgtagtgctttaaccaatttcacccttatatcatccatctcgcttgccgaatcaacttgtggggatccgttaacagataaaccactgctatcatcttgagaagccaaaggaataagatggattgtccttctagttctctgaaatgctaccctctgtctcctaaattctagccatctagcactgtgaatgatcttctcacattctgatgctgaactcctgaaatagctctttctcttataaacacgtgtatgaaatttttgactcctcagatcaaccacacttctgcatactaatctgaatccatatactttctccagagtgtaaatcttcgatgtgctgcaaacacgttcaaccatttgatccattataataagaaacagcaagaaaaatattattaacttcactgtacaatgaaacctattccataatcaaaaccagtagcaaacaatttaagaaacgctggcaagctactgttttaggaataagcatccgccgtcaaattgccactgaaagcacaatacgggaaacacaccgtgtgcataactgcaagcctcaacagaacagaagaggaaactactagtagtaaagtatcccagttcaattggccatgtcaaagctccggccgtcaaaaccgcaatgctatcgccatcaccaaaacggcaacctacaacaccaaatttgacgaaatccctcggcggcgcacgcccccgaaccgaaatcgcacagataacttagtgagccagtgacgaattcaacgaccctactacctctacccctcccctccacaatccaagctcgcaaccagcgcattccaccgcaacccatccacccacgagctaaacggcaacgactaaaccagcgaatcggcccgcagcaccgcggccagaaggagagagaggagatgggggtgggggggggacccaacctggcaccgcacatggccgcgcgcggctgcgacccaaccgccgtcgccatcagcctccgcccccgccgccgccgccgccgccgttactgctcgccctcgccggcggtgggatcgatgcgcgcgcgtcgcgacaaagcgatgggccggaggcggagagggatagggtttataccgggagggaagtagcggtggggaagcgagcggccgcgaggacggaggaggaggaggaggaggaggtggaggagggcccccggaaacgataggctccgggagaggccaccggtgctcgtcacggggaccagaccatctctctctctccccaactttctctcgtctcggtttttcctcgcgcgtttttctttttttctttctttttttttcctccttcctcgtcgactggagtactggacatttcgcatttttctttttcttttttttttttgcctcgcaccactgctgtcgtgataaggccatttacggcgttgaaggaagaaaaagaacaacacgtcataccgttgagctgcattcaaacctgactagctttgacatttttgttttatgtttagtttaaaattaactctttgaatcaagccggtagaatattaccttagtcaaatttgaacaactaacaagcttgttttttgctgggtctactcaagagagtgttaaagtcaaaaaaaaaattactcaagagtgtgctctgtgtttgtgtgaactagttcacatgctaaaattttagcacagaaaagaactgcagatataatggcatggcagattggcaggcatcacaatttgctgaaagaacactacattgtcactttgtacaccacgctcaaatagatgtccccacaaccgaaaatgaaacttatgcccaaataaaagaatcaaaactaagagaaagcatatccgttctttcaagagaactgattgaacatggtaggtacgtattcaggccacgtaatagagtgggcattatcatcaaacgacgatatgaaaccattagtaagttagtaagatgtttgcatatggtacatgtatgcattaagtgctaatagcattgcactttgtagctacagatacactaaacctatagagaaccatcttaaacacatatattccacctcaaacacataaatacacacacatacatataaaacaaaatatatgcatccctcaaaaaacattacaaacatcaaacatattacatactttaggcgtaaatgcttgggagaggtgcataaacatgcatcatatattttggataacggaagatcaaggagcgtaaaaacttttggcaggatgacaagtgcaaaaaactggagatacataaaaccaaaactggagcacgacgagtgcgcttaaaatcaaattcgtggattatattccaccgccttaagaaaaatgaatatagttaatctcctggagtttactcttgctcgctagcactgtcaatctgatcttgctccttttttatgccgccatcagccaaggtgcttgtattaccactaggccgggttccataaacatgccccatctttaatctctttgtttccatgtaacgccgattctcattggttattggtgtcaacagtggcactctgcccaagacactcaaaccatagcccttcagtccagtatatttcgcaggattgttagtcataagcctcatggttcggacaccaagatctcgtagtatctgcagagagaaaaacagcaatgagcggaatctggaacagcgtgaacaggaacgctatgtcacaggttcattttcaatagttcaggagtacagacaatttatatatacctgtgcaccaataccgtactctcgtgaatcaaccggcagacctagatcctcattagcctcaacagtatcccgcccatcgtcctgcaaattgtatgcacgaagcttgtgacccaaaccaatgcccctaccttcatgtccacgaaggtaaactactacacccctgccagtcttctcaatcatggtcattgccagggcaagttgattcccacaatcacacctggctgatccaaatatatctccagttaggcactccgaatgcactcgcactaagatatcctggccatcaccaacatcaccctgcatacaagggaaaaatatatattctaggttcaacttcttcctggatgagaaagtctggtagagcttataacttaaatacaataaaagaaaccgttgcttcactactttctaacaatcattgcagatgaaccatgtcctgggtatcactgaatcattagttgcgatccagtctgactaatgtaacaggcaaagatatcttgttatactgtaatttgttcaggattttgtacatgtgattctacttttctatataatgcataagggcatggattttacttttttttatttaaaaaaagtaaacgctctcctaaaagtagacattgtatcaaagtacttaacatagtctttgttgagggatgcttaccttgaccatagcaatgtgctccatcccatcaataagagatcggtagcaataagattgaaatgatccccattgtaattgtaaaggtgtaacacaaacacgttctaccaatctgtctctcttcctcctatacctgcataagaaaattattagtagctgatatatatagtagccggaaagttccacaaaacaataatccatgtattataatttataattcatatcttccacaaatatagttttacatgtatatatatcaactgtgctttgcattcctgtaagaaaacatttgcttgaaatgtggttatgaagtacaatagaaaaaatgacctgttctcccgttactacttatcatgaaaccattagcccttctgtaaataataattactcttaaattttgtacttcaatgcagcatgtatgattcttatggaaaaaaggattgacacttgaatatattaaataaagcaaacctaatcaagtccgcaattgaaattatcttcaggttctcccttcttgcaaaatcttggagttttggcaataaagccatggatccatcgtcatcatcaacaatttcacaaagaacagcagcaggaggtaacccagccaacatggcaaggtcaactgatgcttcagtatgcccagcccttttcagcacacctccttctctatatttaagaggaaaaatatgtcctggcctgttgaagtcttcaggcttagaattaggagatgcaagtgctaagactgtatttgcccgatccttagctgaaacccctgttgttgtgccttctttagcatcctacaatacaaatatttagcacagacagattagaaaaacagggcataagcaatatgctctcatagaaggcaaaaactggggaaaaaaagtacatccatacacaacaagcaaaggagataggaatgataagacactcgattatgtccatcttttgcacaaaatagtcatggacataacatagttttttaaaaggaatacatacacgcatcaaagtgatttcaatcaaaaggtgacccttttagctcattctaaccaaagtggttaacagaccccaatggttctctttcttgttaacacaagttaccatatatgtaaaatgatcttgtgctacaaaaagcaataacagcgaatgaaaatacataccactgaaacagtgaaggcagtccgcagcttctcttcattttcctttgttgtcaccataagaggaagttctagtctttccaggtcatcttctttcatgctgacacatacaatgcctgtcccatgcctcactatgaaagccatagcctcaggtgtcacctttgatgctgccattataagatctccttcattctctctatcttcatcgtccacaacaatcacatactgcaatataaacactgtcaacagatgaaggaactacttcaaaaacctaattaatgctagaaaacatgatattttttaataagatccatacttttccttggcgaatatcctcaatagcttcaggaatggatgagaaaccctcagttgggctgtctaggtcaagctcgtcatcatcagcagaaaaaccatcaacaacaggtgccatatcagcagctatggtcccaagtgcagcagcatctgcttgaaccactttagaaggactagcctgtccatttataataacatgttctgaagaatcacccacagcatgagatatatgaaaatttctggcccgatggttatacggcaagtgaacagaactgattgtcctcaaactgtttgatgtagaatttggcataattgaacgatcagaccgcaatccagaagtcctgtgttggctgtaaatgctgctcagccgtgacatgagatttgcagtacaggaatccatctgaggaaaaaaatcagaactatgaaacaagttaggaataaaaatattcaaataatatacccaaaggatgtgatggaaaaaggaattcaaattatttcagtaacgttacagagattttctatgttactaccgcagtaccgccttgtgcaggggagaatctcactttcctcaaaaggaaatttagaataagtatctagtgcctattgattaccagaaatgcggaataaacccttgaaaacaacaatccatctcctaaataaaccaagtcatctagaatctagagtaaagctaaacacagcaaaatcgcataacaaacaccctcaaaaactccaggggcggacctaaagtaccgcatgagattcagctgaaccctcgaattcttttggaaacaaattgctatctattattactgcacctcgcacgcgtccaagtaatagaatggggaagaaaccggatgggtttgattgaacggaaacgaatcgaacaatcaactaaatccggacgagctctacaccaagccggctcatgacgtggcgctgagagagagaagaacgatttaccttcgattccgttctaactcagatggatggccggccgcgtctacccctggcctttacctgatcacccggctgtgcgcgcgcgcagccaggtaaggcggccgcgcacgccgtgcctccggagtccggacctgttcgccgggagcgggaggaggctggccgtgcctccgccgggaggaaggagagtgacagagcggtggcgtttggataaagagggtggtggaaggtggaacagggaagatacgagagtggttcgggtgctttgttcgttcgggagaagacgagacgagacgagccgcgcgggtggggatggcactatagggcaagtctgcaacgtcgacaggtaggtggcggcgtggcacagtgtaccgatgtaaggaaaagaaaaactaatggaaaggtgcaccggaggtcctgatcttgtcaccgagatacgaaaacgtcatcgaaccgcaaaaccagatatacggggttccttagctatatgaaaccggtcacccgaggtccttcgatggtttgaccccggttttagtgtacgtggcggctgagtcagcgtgggccccacatgttagcatgccacgtaaacaccatctctctccctctcttttctccacattttttttcactgacgtggcaaatgtctaggcccactcgtcaggtatggtgcgtgcaagaggtgcctccgccgccgtcgggagtaggaggttggccgtcgccagtctcagactcacagccctcaccatgctcgcgcgtggagacgccggagatctcagtggaggcggtgaagatgaagactcgttgtttccccaacctcatcgccgccgccgacagaggcacgggtctagaaaggggcggcctacctcagcgaatcagtcgcgcgcgttgctggtgaggccgacatggacccttggcgcatgctgccgcccgcgacgagctcgccgagatgccgcccgatccgtcgcctatcacgctcgtcaacagcgccgagcggatctggaggaagagagatgggagagggcaggatgtgacttcaccgccgcccatctcttatccttctctctccgccgccagctgctgctccagccgcatcttggaggcagaaacagctggtccttgagcacggtgcgcgcgggaggccggtgccgcagcggggagctcggcgtcggcgtcggcgttagcttgtcggtggcggcgaggcgcggggttactgcgtcggcgtcggcttgtcggtggcgacgaggcgcggggttactgcgtcggcgtcggcttgtcggtggcgacgaggcgcggggttactgcgtcggcgtcggcttgtcggtggcgacgaggcgcggggttactgcgtcggcgtcggcttgtcggtggcaacgaggcgcagggaggccggcctcggcgtcgccctgtcggaggcggaggcggcaggtccttgagcacggcgcgtggcgaccagcattttctcgacctgcgccgtcctcctctccacatcccccaccgccgcagccttggccggtgcaagaatctgacccggcctgctcccgtgtcgcagccgccgccaccgccacctcgtcgccccggcgatctcctccccaaccgccggccggcttgcaggagaaaaagtgaagagagagaaagagaggagaaagggagaggaggggagagagagagagggagtgatgacatggcatgctgacatgtgggtcccatgctgactcagccgccacgtataccaaaaccggggttaaaactaccaaaggacctcgggtgactggttttgtatagttaggagactctgtatatctggttttgcggtttgaggacgttttcgtatctcggtgacaagtgcaaggacctccggtgcactttttccaaaactaatacactattatgtccatcaacccatcggacgtgggctccaagcccagaacagagagctagtttgtccagtggaagcccaaatgtattgaccttaggcctaataagagttcataatgacactgaaggtgtgttcactttgttgcaaaatgaaacttgccaatgttttgtaatgctgaagcaaaggttagatggtggtagcagtgaaatattctaaatcaacaaaatttggtagggttgtgttgttgattgtcttgccaaaattttttatgaggttaaaaatgacaaaaagtgaacacatcttgaattttagagtgaattttagaaaaccccatgttttaggaccaatgtaacacataaccacaggttctatttattttctcacataacccaatgcattctatccaattaacacaacaccacagatttaaatatgggaaagtaccacaatgacaagtgacatggcagacctgctccacatcagctggccccacctgccagatcaatgcgtgagctatttagggctgggaagcacccatcctctgttcccgcgcacgcgacgacgcacccctcgtcttcctcgtgctcgctgcggcagttttcctcctgttacaagttcagaggggcagctcgtcgtgcacatgcaaaggcaagcatcgcctgttctgttttgcatcaactgatcaaactgtacatatacttcctatcttctaattatacaaagcttgtgtgtgtgtttgattaaacatggccaggacctgacaatgtttctgctcgagttttttgtaagtaggtcgatcaccaaggtgcctgacactgtgttcctatgaaaaaaaaatgaaaggaaaaaaactgacaatttctatgcattaagcagaacaatggagcaaacgttataaaaacattccatgtctgaataaaagcaccatagcaacagttaatatgtgacccattgcaggtccaaggcataagaaatttgcaaaacgaatccatatctgaaatatatacattgtgaagcagagaaaaatacaacctatttgccgagaaaaaaaaaagaggaagccatgtctgctcttttgtgaagcagaaaaaaatgttgcaggcctttaaatgttaattatggttagttttatatctgactgcaatataatagttgtaatagaatagtcttatacacggtccaatctacatgctttttttatttgaaaaattatggtccaatgatgaaaagcaattttgcaatgacaaacagaagaacgattgcaaagttgtaatgccctaacaataatgggttcccctaaattacattttactagccctaatttcttgacaagccaaacatgatcaaatggctggatttaattcctcgtcaaagaaccatgaagcagagtgtccttgcaaatcaccaaccaacatgctttggagtcaattcatatgatcatcacaagaaaagagatgaatgttacctgctaggaatgatacctaacgagttctcttcctccagctaggtcaacatcaccatcatcaccggaggccatcatgcaagagatggttggggaacgtcgccaccgcctgcgtacgcaagaaagacggaggtgccgcgttgtgtgcgtaggaacagggaacacacgcttctgttctcccgcgtgatcccaccataataggccacatattgacctggcaggtggggccagctgatgtggagcaagtttgccatgtcacttgcccttgtggcactttctctcactaaaacctatggtattatgttaattggattgaatgcacggggttatgtgagaaaataaacgaaacctgtggttatgtgttacattagcctcaaaacgtggggttttctgaaattcactctggattttaatatcctagagaaaatttggaggtaaaagttacctaatattagagactagtagttgctaaaatatcaaggatttcttaatagaacacctaaaatatcaaggagctcccaagtgaagcaagaaaactctaaagtttttttatgctttgtttggcataaacctatatccattcatcccaaggatgggttaggattgcagtcaatttgccagcccatcccgagagataggctcatactataattgaagattatctgggtgagtgaattaaggataaattacttactctaccattgttacgcaagcgtaactgcgcacgactgcaatttttaaagtaggagcgacaataacgatcatctggagtgtcagccacacaatccttatcagacgacagagctactgccacggcacatcacgccatatcctcgcacacggtcatccccaactcacgactatgactcactgccatccggtcccacgccgatcccgaagcaacaaaaccgtggcctgtgaacagaaaagcatcatatcccaccaaaaaaagaaaaatacacgcaaaaaaacatcgaccactgtcaccgccaactgtacacagagaagatgacaatacggccctacctttacacgcgagcaatgggccccacctgtcagtagaaccctggtgacctacgtctccccggatataaacaaacaaaataaatcctacccgtagctctctctccgcacgcagcaaccaccactcccc

SEQ ID NO: 79078 - DNA, 10026 bp, Oryza sativa
actaaagatttagtcccggttgttctcaacaaccgggagtaaacatctgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccacctcctccgctgccgccgcatctctggggtgagagccgccgccgccagatctcccttcatgcatctcgatctctccgatctcgatctctctccgtcgcgccgcccgccacgagacgccgcgccacgacgacgacgcgccacgacgacgacgcgccacgccgccgccttcgccgccgccgcatgccaacgccacgccgccgccgccgtcgccacgccgccgccgccttcgccgccgcgcgcgcaatgccgccgccgccacgccacgccgccgccgccacgccacgccacgccgccgccgccacggccccgcaacgccacgccgccgccgccgtcgccacgctgccgccgccgccgccacgccgccgcgccaaccgccgccccgatgccgccacaccgccgttaacgaacgagaacgatcgaacgaacgagagcgagaacgaacacgtcaacgtacattgccgcgagaacgtgaacgagaacgagaacgatcgaacgaacgagagcgagaacgagaacgatcgatcgaagacaagcgagaacgagggaacgaacgtgaatgagaacaagcgaacgaacgtgaatgagaacgagcgaacgaacgaggacgaacgttaacgtgaaatgcaatatatatatatatatatatatatatatatatatatatatatatatatatatatatatatatatatatatatatatgttacttcgcatttatcctaatacatctttttgtatcttgcagaaaagacgtgttgtcggagtcgtccgtcaagcctgagtggaagagctagccctagaaggaattggagcatgcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaattggtgcgacaagtagcaattgactattgtagtcttaattagacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgctgtcgcgtcccaaaacgactctaaaatacatcctcaaaattatgcatagaataattaaaatccatgtgaaagcctccaacaattaaaatgtgcaaatttaaaagtcaaataaggcttggaggatttttgtatatttcctaaaagcctaaaatgcgtaaataaattttagtggaattttcagagcacaaataataattaagaagaaataaacaaagttaaaaaggtttcaaaaaagtcctttccccccctttccctcttgggccggctcggcccacctccctccctctctctcctctcccccgcggcccatcggcctcctccccgcgcgcgcgccgctgacgggcgggcccgcccgccaccctcgctgacgggtggggcccacccgtcatcccctacctcgcgccgcacccgccgcctcgcccgtgccctagcgccgccgccgccgcggattccgccgcatcccgccgcccccgcacgcaataaagagggggaaatcactccccgtgattccctctccctttccccccacttttctctctctctctgtcacatcctgattttcgtttcaggatttataaattatttaataaatcattaatagaatttatattaaatgatctttaatttacaagtgaagttaaatgtgggaaataaaatttcctaaatataaagcatggatggatttaattttttattaaattctccatgattaagtcaactctctgaaattttctcggatttttcagagctcaattcctaaatgatacaaagaacagtttagcaattatttaaaaaataaattaatcattaaatgatctggatattattatattaaatactttgagtgtccaagtatgttcaagatttttcttggaattatttgagcattggaagtatttttaacaattgaaagatcatctcattggttaatttatttggaaaagtaataaaaatcctccttcctagtcttgggccgaatccagcccattccctcctctcctctctcccttcctgtcagcccagccaaagtctgtttaacctccctggtgctacagtactccatcttcctcctccagtcagagccgagccagccgtgctcgtgcacagtgccgccgattcccttccaaaatccgacctccccgttgctcctctttccaaattggttgcgggaatggaatcctctcaatctcctcttccttttccccaagaaatccccaaaagtttctatggaaatcctttccaatttcgcggatcaaatcctttcctttttccggcgaagataaactttcccgagtttttcccgtcgatgtgggctcgatcccggcctcccatggctatatatagagcccccagcctctcctctttcggccgccacctcctccttcttctgccgccgcccgaaaccctctccccacgctctccctttctctccacctccggccgccgctccagcagccccgcgccgtcgctgtggtcgtcgccttcggtcgccgctgccgccgttgggttcgcgaggaggagaagaagaccggcctccacttccccgtcgtcgaagaccccgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgcccctcggttgttgcctctcgtcgccggaaagccgtcgccatcgtcaacccaaggtcgccgcctttggagctcgtcgcctgccatctccctcgccgtctgtcgtcgcataagtggtggtaagggtcactttgatcccctctcgctcccggtgccctccgtttgcgtttgtgccgtggttcgccggcaaccgccgctcctttgccgttcacctgtgaggttttccctagggccttaatccgatctaatctaatcttgtttggccctagcgtcatcatcgtctccgtgtgtgtcgtcgtcgttgtgtcgtagctgcttgccgtgccgctgctgcgcgtgtgccggctgagccgcttagctgcagctgcttgccgctttgccacagccgcagccgtgccggttgcgtttttgctcgcagccctgctgctctagccgtgcatggtcgctactggctgtgccgtcaccctaaccctagctgcgtgtttccgcctagccgccacctagccgagtcaagttgtcttagtgccgccgtgtcgcagctgtgtgccgtttaaacctagccgccgctttagccgttgctcggtagccaagttgtctagccgtaggtgcatccctaggttcctaccggcctatcgtttgtcgtaccagggctttaccgtgaatcgtgtctagccgaccggtttaaccacaaccgttgttgagtcgttcgctcgttcgttcgaacgaggtgttccccgtgcttcgttcattcgtccgtgttgagtcgtcctttagtttagagccgtacagagccgccggttctgttcgccggtttcggttgatcatttaggtgatctcatgtcacgtggagttgactcgttgagtcggtatctcgtgaggcttgcttgccagatcaatccaagccatccgatcttagtcgactcggtcaaggttaatctcagccgtccaaaatcaatataaattcgttctatcttttcaatggcatattagtcctttttctttttatcatatgtcatctaccaatataatctaatcttttccggaggttgctttaatcttttctctccgttataaatcatttgtaaatgatttaattaattgggaatagtcttcgtttaataggtttaattggaattaaatcttgtaaaattcataataaattcatatgaaatcagaatgaggccgttcaagtctcataattcatctaaaattatgatctacatgtttgtttactttttatgtattgtttatttggtttttattagtctttttcctcgttttgcgtgttagcttgtcgtttccgtcgttgcgaaggttcgcgagtgcgccggaagtattcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataatttgactagttgagctttatatatattggttcaactagatattagatattattgcttagctatgcttagaaacattagcacacaattgggataactaatgtttcactatcacttaaggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcactgtggtgagttgtattatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcacaataattatggatgttataactggtaataatttgcttagctcctggtttggaatggataattcctggtttggagattagatctgtacagccgggtatggttgttcaggatggtcgggcctgtgcagcatgggtgtgctgttcagtgttgattaaaattcctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaatgatccagaaggagaagacgtttggcttataccccagttgagctgcctgtgggagtggagctggagcttcgctagattttattttccgctgcagttttcttcttgatgaggactaagtgcctcataagtaagtatttatcgttttagttaatttgatgaatctgtatattaaattgtcagtttgtgtacctcggctgattcctggacgaggattttatgcacaaataagttcggaaattacttgtgaattttcgggcgtgacactctccctcggattcgtttggaaacactcccgcaaacttcgccggcgcatcaatggcggccggatcttccgcggccgattccccctcatccggccgctctctccccctcccaacgctatttaaacactccccgtgcctccctcctccttttccgccactcgccgctctctctccccgtcggaatcgagctcgcgccgtcgtcctccctctccgccgtcgccgccgagctccggttcgccgccgtcgtcgccccggaccttctcccgcttcggcatcgccttcttcgggttcgccgcgacctcgccgacctcgtccacccctccgtttcgctcaccgaccgccggaacgccgccgtcctcgtctacccgagccgcgccgccgccttcctccactccggtcgccgtttccgtcgtcgccgtcgacccggggtgagccgtggaccgccgtttcacttcccccttccctcccctctctcgggcgccgctccgccgcgctggtggtcgccgccggcgaccatcggggcgcgggcgcgccgcctccccgtcggccgtgccggcgaggccgccttcgggcgcgccccgcggctgccatgtggggcccggccgtcagccggccgcgccctcgggtacggctgacgcgtgggacccacggcgccggccggcgtaagccgcgtgcacccggtccaccgtggaccgagaggctgccgagtgggccccactcccgtggacccggtccgcgcgctcctctctcccggctgacacaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttataaaattatgttgattcaaattattgcattatcgctttatttaaattcccgcgttatcactgttttatttagccatgcccatttacctttgttatgaccttattattgttattgttattatttccttgttcaccctagcataaacaaaaccccaactagtggacactctactcatggtcccactagtatgattttaggtagatgcttcgcttttaattaggtaacattaggcggttttacaactctagactttgggaatattcatatcacctggacaccatggaatggtttggttattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggtgttccggccgtaggtgggattgggttggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgcgtttacaaaatagctttgagcaactaatgtctttaaatgctgtttactgcaaccctaaccctttatagtgtaactcctttgtactcccttgcatttatcctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctctgtgtgtgctcggccttcgctgcccatgtaataaattaactatttacgcttccgcttgttaaactctgaattgtatcaacttttggtgtaccttgcctcctgggacaaggattaatgcacgcacgtaaggaacgcccgttgggtgatttccggtcgtgacagatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtgcaagaagatggacgtcctagtgccccggccgaagccgccaagaactatgtacgtcacagcggttgggttgtgcgggataacgtgcctgtcagtagggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagttttagagcttcaagggagatctgtaccagaagtatatactgaaggggcagacaccgaacttcgacacattcccaaagctaagggatcactgggacgagttcgttgcatataagacaggtgaacaagggcaggcgatgatgaaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccg

SEQ ID NO: 79079 - DNA, 15490 bp, Oryza sativa
ttcctggaatgatccggtaggggtatttttatttcccttggcctccccacacactagtagggaaacaattaaacggtagggaacatggagatttttagtagtgtacaaaatcagtgatgatagtgtcaataacaatctcatctcgcagcatcttctcaatgcacagaggagcctatcagacttggtaccatagtatatatattttggaggcccagtgcgagcccgcactgccccagggccggctctggtaacatactcagcatacacagcatacagctagcactactacagtcctcgagatcgagatggatcatcatcgtcgaataattaatcaaatcatgagatattctcgcaatctggttcggttgacctgatcttgcccaatcacaaagtttattattgagcacatcacgacaagtgagttgactcaaaaactatattttacatacatacacgcgattatcaaaagaacaagtatttttgcaactagttgcttgtcctccttttcttaattattcatattaattatgtccatccaaacaaggtatcatactcatatatatcttatatattcttcttagaagaataattaaggagcatctttaattttcaatttgtagttgacctcgtactaatgtgtacacctggactgttaggggtgtgtatacgtacaaccaactcaaagtagtccatttgaagtctaccgatcgaggaagatgtgtgtacaaaaagtcgtgtcaatttgtgcatatcaagctacaccttcgagtttaagccactataattaagctaattatttagttactttttgttaagcgagacagctaaatgattattcgatctctagcaacaagtggcacagttcctgatattttatatggacactttcaaagaactagcaacaggggactcgcatacatcgatgttgtactatatagctcggagcataatcgaaaaaaaaaacatatagaaggatatatatcactattccattttttgcttgaataaatttcaataaaaaagaacacttttagtagcgaaccatttgagaaatcaggaaatatacttagtaacaaatatgagttaccggacatgcatatggataaaatggtttagaaagttctggacgtattttcggaaatgaaaagtgtcggttggatttttttcaaaaagttttaaaaacgaaaacgaatttggatttttttttcttggaatcggaaataaattgtttttttatatatatagctgattagtttcagctttctctgctttagatgttcagacttatactaaatattgaggtggttagttgaatgaagatattttttaatagttcaatgctttagatctgtttttctttttcctaccgactatttttgttttagttcaatgctttagttcaatgcttttattagaccacatcatactacttacaattatagatgaatatagtttttgcttattggagttctcacaaaaagtaaagtgtaaaactagttgtattattattaattgataaaataatagaaatatcaatttattgttttagaaatatcgatttattgtttgaaaagctcatttagagttgttttcatatttcgataaatatttgttatcttattcgctacgtatttgtctagtcaatatattcaatgccatcttcataactgggtttttccaatttcgattctgattccaataaaaatatatggaaatggaaatagttgagatggtttccgcatgttttcaagctgttttcatcgcaagacctgcaaacgttttacattacaaataaggtttttgtttttcctatttaattgtatataaacccatgttctaagaaacaaactagtagaattaaacaaaatgtttctcaataaaaaaaaactaaaagcaaagtatgcacaatgaattaaattatgtatagagcttgattttaaaatgatctatatattcttgtcattttctttctcggttcttcaccatcactcgttttagctttcttggaggatgtatatacgcacagagagtcgacggctattacattagaaagatgatatacttctaattttctcttttcactctgcaacacatatatatgcagaaatacacatcaataagcactaataatatgacgtctacaatcacccgttactctcgcattataccgtcactagacatcgatctgtacccatcattatgaagccgaagctgcattattctaactatatatccacttgcatatatattattcctttaaattcctctccccctctctccttttgagtttttgcccccaaaccaccacagtacaagtattgatctcttgtgattgggttggcaaattgcaaccccactagctagccatatagccaaaagccaacccttttttaattattggctcaactaattggcttgtgcactacacacacatgctgctgctgtccatatgcatgtatacaacgtgcctaaatgtgataaaccaatggtcctagctgcagcatatgcaacttgatatatatgatgctggtcggccgattcagattgttggcatgcatcaattagcacatagatcgaccaaagcctaactgtaaattaaaaattctagatgcttcttaatttcgttggttgctttcttggatccacgtcaacttgatcgatcgatcgatatcatctactccctcaatcataaaatccgatatgctatttgatcaacaatatctataaaagtaaaatatttaaataaaaagagttgctcattatgatagtttgtttaacaataaatctagtaatatcaattatacattattaatcttttttatttttttatatgtcactatttaaatatgcttatattttggtacgtacggagggagtatgtatgcatatgcatgtgctgtttggactagctatgtttgatacggacttttagggctttaaattgtggccggcggcggcgcgtggttttggtgatgatggccggtggccgccgacgtatacgccgccgccggcagcaggccggccggacggacgtttgaacatgtgcatccaacaatgttagtcctggtgtgtctatcacctctctctgccattttttttcttatgtgataactaatgtgcggttagtactctccctccatttaaaagtttaaaacattttcttaaaaaaaatcatcaaaaccaaagagaaattaattcatcccgcgtgtaacgaagaccgagaaatattatatatgcatgcaaccaacaaatattaaaatggttgataggttttctatcaacacaatttaatctagcattgtgaaacaaaaagacaatctcttcgtaagtcttcgatgcgtgaagactacaaatatgatcatcttatttggagaaatcagaaaaataacatatgctcaaagatttctggatgaaaagattatattaaaaatgttattgttgtgattactagctattcggtacgtataaatttttaatggaatctttttaagtactctatatttgttttgagccgttcattagccgttgatccaatggtcgatgttaatttctagagcctcactactgtctctacgaaaacaatctgaacgcgttgatatcatttaatcaaagggttcaaatctatttatactaccaccccagttagcggtagtagaaacatggaggggcattattgtaaaaaaaaaggcgcggaagggtataatcatcactttgcagtgattaaacttttccctctcttttttggctttccgatgaaatatgagcgatgccagcgcaatgaatgatcatagattcctttcaaaaaaatgaatgatcgtagatcgatttagccgagaaaacaaacataaataacaaaataactcctaatcatgtaatagtaaattgctaattttccaataataatattggtagtataatactaccagtagaaagcaccggagcatcgctctaatttctatatactaccatgttaacttgatcatctatctatgtagtgtcatgcatgtaccatatgcatcgatttgcatgctgttggagtagataagtttataaaataaataaggtttttaagttttctggtagtaaccgccggagcacacactactatcgaaatgattttagcagacgagccctcctccaactttcaggcagacagtaacatctccacctgcggtaatattgatcctaaaagaagacaagacccatatgcgaaatcaattttcacagcattttcacaaatgggcctgttaagagacgcacatgtcaccaggtcaactaccctttcccttggatgaaaattacgtaagacttccgtccttcacaatctggaaagaccccaccttctcaattgtcacgtgtccagctgttcgcacggatcttgaaacacccatcttctaccagtgcccaaaatttccccttatctttcctctccactccccatctttcccttcctttcttctccttagctggagccccatctctagcacgaacacatgctccaccgctgcatcctcttgctcctcggatggagcatatctgacacgagaacgcgctccctcgcctcctcctcttcctctttcctgttgcagcgcgggatgcaatgtggtgctagtcgagactatgttcctgacaagggagtgtggtaagtttgccatccggtgccctgcagttagacgagtttgtcgtcacgtgacatagacttcagctaaaatttggacctcgagctatgaagaaaaagaggaagggaggtagtgagagtggacatgagagaggggaaatagttgggtgagctctccatcccctgcgcgtggaacgtattccaagctagagatagtgctcccctgccctagtcgatgagaagcagagaaagtatgggggagaggggaggggaaaataattaagcacttgagctagaggcagaagatgggtgctttaagattcgtgcggacacgtggtagtaaataagtgaagtctttccaaacgtgggaaggacagagttcctgtataattttcttcccttccctaaaaaatctaagtgctattctcgtctcctcatcctcttctcaactcatcctctcctctcctctaaaccccccactccacctcccaccacttcacagcctaggcagcgacattacttcgagcgggcgctccaagaggtggtgaaggcggcagctgcgttaggcgctctgggaggtggcgaaggggtggccggatccggtaactatgccctcatgcgggcactggagcggtggcaaaggtttagttgaggctcgcagtggcccgatttatttatctggcatataaatttaaccttctatatcacctgatttatttatcatatttaacctttacccattatactgtgcacattaccattgatatagcataatagaaatatgactaaccatagatcaaaagtaatggatgacatacatgtttatcatacactaagacatctgtgcatattgtaaaaaagaaatattgtttgagattctttttgcaataaattgcagctggcagctgagcaatcaaatctgctattttcctctactatatatttgatgataaacccattattcaagttctaatcatgcatactagcatgtgtgtttttggaagtccctatcaatgtaaaggacggatcatttaccttagtttatccttcatatatgtttcttacaggtagattagtttgaaatgcacatttaaaattgattagatttttttcagttaacacgtccctcaatcatacttttaaaattagaagcccaaaatgaattggttttgcgctctttatgtgaaagttaagataacttcatctttcgtagaatattatctgaagtggaattgcaaccaaagatagtcctcttacatatatgaggatcttatggataggaagaatagatcatagaggatctgatcacaatataaaaatattttgctgccaattggttattgtttggccatctggtattactccttccgtctcttaatataaaaaattttagaggaatataacacatcctagtactataaacatggatagaaatttgtccagattcatagtatgtgtcagatctctttaaaatcccttatattttgaaatttagaacggagtgagtatatatatactccatccgtcccaaaatatatcggattttgggtgaatgtgacatgtccggattcatagtcctgaatatgtcacatccacctaaaatcccttatattttggaacagaaggagtagatccttcattgcaaagctagtacttctagctactaactatattaagaaatgtcacgtctggttaatttatttgtggttatgcgtgcaactaatcacaactagcctgtgatgaaaggaaagttgatgtgcaatgtgatggatgcttctgaacgaagaaatatgatgatttgcaacctcatatatattttatagcttgcagcaagacacttgtaagattcatgaaggagcacacaattttctttatacaaaaatgaacctcaatcatggtgattaccaaagaaaacatcctgcaaattttctttattaattgggccaactatagcctgtgggttttgattggattttggaattatagggatataataagtgggatatataggggactcgaaaataaacagatactttgagagaagcagaaaaaagagcaaattaaccttccatcttatcctagtagggtatcttcccccattctaataagcaaaactcatggtttgtcatctctttaaagtggcatttcgatattgtccacccccacgtctaaatgatatgtagatcccatatatcatacatatataagtggttaattatttcatttaatttggaatcttggatgaactacgagcaggatgtatatggacgcgaggtgggcgattacatgcctaaattttactgtttaacccaacccaatgtattctagcatgttttaggatctccttatttcttttttttttcaacattctttcattccccatcattgatttagctagaacatgattgttttctcgacaccaacaagtgttctatgttaatcactaccatctcaaagaactactcactagtggagaagtgctttttagtcccgattcgtaacccctatatagttccggttttcaaaccaggactaccaatcaccaaccgggactaaagagagggatctttagtcccggttgttgttattaaccgggactaaagagagggtagcggcagtccagctggtcctttttttttcttttttattttctcacgaatcaagtggtatgcatatcgtgaaatcaaaccccaaatccacatcacaaatccacagcacgattcacagattcatcacaaatacatcacaaattcattcacaatatctattcacatattcattcataacatcacaaatatattcacaatattggttcacaggttcattgacaacatgacagactcattcaaaacatcacagattcattcacaatatcgattcatagattcattcacaaatcaaaacattcaaaccacaaatcataaaaaaactcaaaaaaattgtctcaccagccggcctcccatcccgccgcaggccggccacccatcctgtcgcttcccctccggccggatctgggggaggggagggcgaggccgccggcgaccagcctccgtcccgttggcccgcgccgggccgccaccggccggcctccatcccgctggcccacgcccggcctccatcccgccgccagcccgcgcccggcctccatcccgccgctggctgcctctgcaagggaaggaaggggaggggaggaggaaagggggtgagagaagagcaaggggaggatggaaggagaaggatggagaggatggagataaggaaggagaagaaaaagagataaggatgggagatggagagagagagaggttgcgcgtgcatgcacaggatggagagagagagaagcatgcgcggtggacgtttttcttcccaaccggaactagaaatagatctttagtttcagttggtgttaccaaccaggactagaaatagatctttagtcccggttgagaacaccaaccgggactaaagataaaaaagtagctctaaccttttgaaccaggactttagtcccgatttttattgcaatcgagactattgtggattttggccgaccgaccaaagatggtttctccaccagtgactgtaagtcatgagaatatgagaatgatgggaacgtgtgttccatgcattgaagatttcatcgttccacttactaagaaaatttaaatgactacatcaagacataattattcttcctagtttttacatagaaatgtttgtgtctttgggagacctcatctaatgccaatacactttgtaagattttagggatgatgataaattatggtgtatggtgggggctaagcgtcttattagcttttggctataaattaagtctatttggtcctaatcgtacactgctggagaaactatctttggtcggtcgaccaaattccacaatagtcctggttctattaaaaaccagggctaaaaacgatttttagtcccggttaaaaaaaattggactaaagatgatctttagtcccggttcatcccctgtcaaaggcatatcagggggccaaggatctttagtcccgattgatactaccaaccgggactaaagactaccactttagtcccggttgaaagtaccaaccggaagtaaagatcatctagatctttagtaaaattgaacgcgtagtataaaatccctatcactcatcctctcaactcacacagatcgaatctcttccccttctcctccttccctctcacacagatctcaatcccccttctcctcctctcctcatccccttcttctcctctcctcatcccctctcctccccctcctccccttcccatcaggtgggccgacggccggcggggccacgcccggcggcagtcggcggcgtagtgcgcggcggcgggcagcggcggccgtggcgggcggtggcgccgggcggctgcgagcggctttgtgtttttttttataatttgtgattccctgatatgtataaatttgtgatttattgtatggatctgtgatgtatttgatttgtgtgtaattttttagatctatgatgtatttgatttgtgtgtaactttaagatttgtgatgcggatttggtgatatgaatttgggatgttactctgatttgggatttatggtttgatttggggatttgcatgccacttgattcgggagaaaataaaaaggaaaaaaaaaaagaaaaaagaaccatctggtactgccgctattctctatttactcccgattagtaacaacaaccgggactaaagatccctctctttagtcccggttggtgttaccagttatttcatccgggactaaagataacgatttttagtcccggattgctactcccggttgaaaaaccgggattaaagggggttaccaactgggagaaaagatggtttctccaccggtggtagtttccttttcttctagtttgttgtgtttaaccatggcccttaaaggtttgtacgagtctttctagacttctctcttcttcttaattaatatattgatgtacaacattcttgcgcatttgagaaaacttagacatatcaccaccaccatcatcaactagtgagcttagttgatatagctctagttatcattggtcatgcaaaattcttgcatgtttggtagtatggtatagctaataagctaaatatatgtctcagcatatgcatgctactgatctttgttgatcaatggatcaaattgatgcttcaaataattgattggagtgcttatcattggtttaacagttaaaagagcaatatggagggaaatggagtaaagaaaggtcactcccttttatatggttttttcagatgcactacttctcaagtagttatagtcatgaaactaattaattcgcatgattaggatggtgaaaaaatattccctgaaaaggtcttaatctatacttgtgtgcccagcaagcatgcttgtatatgcttatcgatgattagcagagaagcatctacaaatcggacctggccccatgggaatttctagaaagtgatgcagatcactagccgcctcctaacaacatgatttgtcagctttcctgaagatactataagaccagcgtgccggttggcacgcctgcaatttatagcccgtgtgtattatcatgtgttgtactgttaaattattaatttctacctagcaataggttgcaattttctaaaatactccttctgtcattttagatagatgtgttatatctcagtacaatgaatccgaataaatattatggtatggagggagtataagaaatgacatagtaatgttatttgtcttaactttatttatctagatatttttcagcatagtaggaaaattatcggcgttacttgcttatgtactggtaattacacttattttgccttaattttcaattaagtttgtagaatattgtacttgtttgaatattagacccgcaacttatttggtgcttttaatttcactattaaacggttttattttctttgtcttaactgtatttatgtagatgtttttcgacattgtacgaaaattttcggtattacttgcttccgtacttccgcttatgtactttatattacgcttattttgtattatttttcaattaaatctgtagtagattgtatttgtttgaatattaaacccgtaacttatttggtgcttttaatttcactgttaaacggtttattttctagacaaataggatgttactatcatggagttacttgcctatgttttatttaacatgcagtaattgcttatagggaaaaatatcataggttagaaattataatattttttcacgtttctctcccttccttttttatttactcagtttattattcctccatccagtcataaatatttggccaccaatatcttacgtagcttatatagcatagtttatcaaacaaaaaaaaatatgtacaaggttatatgaaaaggttaactggaaataatgatcaaagttcataaaaataatttttttaaaagattttaagaatcaaataattttttaccggtgggagtattgtttttcctttgttcttttttttcccggaactttcgtatagttctatcttcagatatagattcttgatggtactagtgcacaaaacgtgagaaacgatgtgcttcagttttttaaattcctttcatgctaagacgtatgctttgtgtgcaaggcccaacaatgccaggcccttccatgacgcaagttagcgttcctccgttacttttttttttaaaaaaaaaaacaaactatcgatctatccagatgcaaagcaagtacgcctgctgttattgtgcgtgaagattgattccggtgattaaggacgtgctatgtggcttatctccacggcaattaatttgcatggaattcgtgttataagatatgatatatgcattagcatccattaatccctttgacactcggagctcataggttacccgttaccctagcaagccaaagctaaggttaaatttaaattttaaaacataattttggaatcaattttaaaatattttagcgtagtttcttttttatattggcttttgagggcctgttcactttaatatcattttcaactataccatttttggtaaagttgctaaaaagtctacgtttagttcgttaccaaatttggtcaatacataagaaatcctgctaaaattttggtaatataccatcttgccaaaattttggcattactaaaacttgataaggtttattttaggtacaatctgaataggccctaagtcactaagaacacatataaaattttacctgcaaattaatttttattttttaataggttgttttgttttagtagggaatatgggcaaccgatgagaacctcggttaattaactccaaatagtacgctcaggcgtgtgttaattaatttgtcaattacttttgtcgtcttctctagcatgataggatccaatgtgatcttaactttaatcacatatctaccatgctaatttctttgatttccaatcaatgaagtgaatattgtcaacacatgcactttagtaaagaaacacctaggttgcacttttatttacactacaattacttaagcctctttaagaaaacaaattagaccaaccgtacgtgtgttgctttggtggcttgataggattaacttcccaagaagtatctgatatattgggaccaaccaggagataggattgtccaactgtacaccagcaatgccataaaaaagttgttattatcttttttaaaaaaaaactatattatgattttaggaagagtgaatatataatcagtctaagagcttgaattttttttatcatatataatgtattttcttgtagaacaattttccatctatgatacttttttcatggtttaccttaattgtaagtagctttgctgggaccgcacttcttaataatcttgaggatggaatcaagagggaagtatatatatccatcataatcaactgcagcatcatataataaattcctcagagaatctaaagtagttgcacatatctttctttaaactcttctctttttgcaattaaatatagacaattctgagactaaaacccctagttttttggctcagggacaaagttaggtacattagttgggggtggcaaaaaattaagctataaatttatcaacaagttgcttggagataaagatgagtaggtgcatgttgaggctgagcagttttcatgaaaagtacagcattttttatttattgtttgcagacaactttggatagtgaccctgcaaattagtaccacgaacttgatcactttaagcccatcgaaagaaattatttggactattctttgtgagtttgtaggcctagccgtgtataatttgtctacttttggtccaactgtggcccaatccctatttgattttaaggagatttttttttctgttttcatttagatactatttgataggtttgggcagtttgtgcaaccagaatatggaatatgatacactcttccacatcaattttattatgtctatgtggtgttacttttagcttggtaataaaaggttgagtatgtggattcagcattctcattttggtagttttttcccaagctgttttcccattttcagtttattcagttctcaagctttgagaaccttgtgaaacttgtaataatttagcgggtttctactagaaaaacaggtcgtacaagacataaataggattgaagaaaaaacaggttttataactaaatcagaacaatagatcgcttatcttggcatgatcagcccagctgcctgtcagaaaggctcgcgtctttgtgagataactgtaacctgtaactttgttaactcaccaagaagctgaagtcattttatccgaaccaaacgagctgcagtagtaactacatcttgtaaaagtgaattcatgagcacttaaaatcttgcattattttcacacagatagccttcattgtaatgacagtatggaagtcccttatgatgcagggtttcattgtaacgatcgaactctacggcagcaacagaaataaactaatgtgcagcatgcaggccaacctgaaaatttcaatcaagaaaagtctccaccacactggttgaaaccagatggacaggtcaacctgaatatttcaagaaaaatatccaccacaatggctgaaatctttcggtaaaatcaagaaagaatgccagttttcttgccagtcgaatctcgcgacaaagcctacgaaaacattcctgatactttttccactactaaattatggcagcttatacaaagtcaagtaaggctacaaagagagagaatccttaggcaaagaaagatatcagcacatatgcttgctaagggtggaaggcggaggggatgataaattacatatcggatgtcatctgacatggaaaaaaagggagggaaaacttcttttccgggtaaggagtaacaccgtaccatcaaggatggtggcagatgcaaggcaaggctctaatccttttaactctatctttcagtaagacaactgaagcaggcagcaaaatgccatagttgcacaatacacaagcagctaaacgaacagttacaacatacagttgacagggctcagatgctttgctgtcgcgaatgattcctttttccatgacagcattattgcaaagaccaaatgctttgacacagttcgaggtgtcggcactgttacttgtgctccataagcaatgaacccagtgagagcagccacgtcgtcatatcaaacttgtaatgttctatctttattgagatggtttccagtcatactgaaggttattgaagctgtttgctgctctaagtccactcaacagttggtttcctaagtcatgttgctgctgctgctgctgctgctgttgctgttgatgttgatgttgatgttgatgttgatgttgctgttgctgctgtagttggcccaactgtgataggtcatgtgcactgtgattcattcccatcctaccactaattgccatcgcattgttcgctattgcagttctcaatccactagctgcatgatttggaccaagcccacccatggccccaaaccccattcctcccattcctgagttatttgtaacagcattaccaactaaacaattaactccgttaacactagatgtaagtccgttcggtcttttcatgtcattcccaagctggccaacaccattcatctgcggtgacatcatcaaatcttgcaatattctctgaaccgagctttgggactcatttggatcaggctcctgaggtcgagtagcaggtggctgcattggcggtaggtttgatgatgcggttggggagctgagttggtttgtgttctgaggggcaggcatcatgttgttattggatgttgttggcactggtgaaggaaaagaggtagatggagttgactgcagtgaggttgtcgagttcaccttgggaattgcagcactgtttccactggtatatggaccattagcactgctcattggatgatcttgtctagagttcattgaaccttggaggagcccaacaacggacggtgaaggtgcagacgttgagggtgcacagctgagagaattatttgatgtcacatctgcatttgcagaggcagaagcctgcacaccagtcatgggagcagcattttgaccactctggtttgaactctgcgggatagattgctgttcttcaggctgttgctgctgtgactgttgagggtttacccctcctgatgaagtcctccgaggaaagctatgcaaactagctgaaacaattaatagtagtagatgttaaatatgcacaaaacaagtggtaacattaataaggctgtaaaatacagttaacactatagcaacagactaccatgttctttggctaggagtaaaaatcagcaaggg

SEQ ID NO: 79080 - DNA, 8195 bp, Oryza sativa
acttttattgattttgttttgctgtttgattctttttttgagagaaacgacatttgagttctgcaaattgtacttatatttcaatcttttaccattaggtttgttgcatgtgcccgccaattggctaaagcactggaggtgccattggttaatgatctgggatacacaaaacgatatgtgcgctgccttcaggtacacttttacatgaatctgtttctatcatctgttctggatttctacatccaacaaatttagattattatcatatgcaaaagtcggcattttgtacataggactattattattctttgttgtgggcttgtggcacctgttgccatcctctacttcgttgaaactgttttatctgacctattattttgtcatctgaaacattggtacttccagattgcagaggtggtaaactgtatgaaagatttaattgattacagcagacaaaatggatctggaccaattggtacgtcgtttttatcttctgtttactgtgcagtctcatctgatctcatgtcatcttgtttagcattaagtaatcttcacatattatatgatcagttgtacttctacaactcctccgtttgttttcttttgattgtacgttctattcactattttttatgaagacaagtttccaggctgtacaatttttatccatttcccaaattcagtagtgtagttaacaaggaagtagagcatgcaatacatgctcagatgagtaacatgctgttattgatctgtcacaacttccaaccagcgactaataacatgtgtttcaattgagactgttggtagagggctggtttcctgcattttctagttgctttttcgccagatatttgtttcatttgtttttgtttattcaaccttcataacatacttggaatgaacttattctgagatacccttgctgatttttgtctctagccaaagaacatggtagtctgttgctagtgttaatttaacaccacactgctattatttgtttcagctagtttgcatagctttcctcggaggacttcatcaggggtcagccctcaccagtcacagcagcaacagcctgaagagcagcaatctataccgcagagttcaaaccaaagcggtcaaaatgctgctcccatgaccggtgtgcaggcttctgcctctgcaaatgcagatgtgacatcaaataattctctcagctgtgcaccctcaacgtctgcaccttcaccatccgttgttgggctcctccaaggttcaatgaactctagacaagatcatccaatgagcagtgctaatggtccatataccagtggaaacagtgctgcaattcccaaggtgaactcgacaacctcactgcagtcaaatccatctacctcttttccttcacccatgccaacaacatccaataacaacatgatgcctgcccctcagagcacaaaccaactcagctccccaaccacatcatcaaacctaccgccaatgcagccacctgctactcggcctcaggagcctgagccaaatgagtcccaaagctcggttcagagaatattgcaagatttgatgatgtcaccgcagatgaatggtattggccagcttgggaatgacatgaaaagaccgaacggacttacatctagtgttaacggagttaattgtttagttggtaatgctgttacaaataactcaggaatgggaggaatggggtttggggccatgggtgggctaggtccaaatcatgcagctagtggattgagaactgcaatggtgaacaatgcgatggcaatcagtggtaggatgggaatgaatcacagtgcacatgacctatcacagttgggccaactacagcagcaacagcaacatcaacagcagcagcagcagcagcaacatgacttaggaaaccaactgttgaatggacttagagcagcaaacagcttcaataaccttcagtatgactggaaaccatctcaataaagatagaacattacaagttcgacaacacggctgctctcattggcctcattgcttatgaagcatcagtaagagtgccaacacctcgaactgtgtcaaagcatttggcctttgcaataatgctgtcatggaaaaaggtcattcgcgacagcaagcatctgagcctgtcaactgtatgttgtaattgttcgtttagctgcttgtgtgttgtgcaactatggcattttgctgcttgcttcagttgtcttaccgaaagatagagttaaaaggattagagccttgcctgcacctgttgctatcctttgatggtacggtgttacttcttacccggaaaagaagttttacctccctttttttccatgtcagatgacatccgatatgtaatttatcgtcccctccaccttccgcccttagcaagcatatgttctgatatctttctttgcctggggattctctctttgtagccttacttgactttgtataagctgccataatttagtagtggaaaaaagtatcaggaatgttttcgtaggcttgtcgcgagatctgactggcaagaaaactggcattctttctttttgaaagatttcaaccattgtggtggagatttttcttgaaatattcaggttgacctgcatatgttgtccatcttgtttctgttgcagccatagagttgctcgttacaatgaaaccctgcataaggcaagggacttccatactgtcattacaatgaagattatctgtgtgtaaaatgcaagattggccaggccatgatgtatcttggctgatgggtttcaagtgctgatgaattttgctgacatgtagttgttgcacctcgtttggttaagataaaatgttgtcaagtacgtagtgaattaacaaagttataggcaacagtatcatcatgatcacagttataaaaaccgtgtttttgttgggggtttggacctgtgaatcctgcttatatatttatgacactggctgtacggccaatttttctagtagaaaacccactaaatcaataataaacaagagtttggtgggtttaagctacccagttttgctgatactattgatggtgtatcagcattcaagatacatcaagagctttcagaagagtttggtggatgtatgaccagttttgcaaatacccggttttaaagtttgatggtgtattttagacaaagcgaagagttaagggtcgtaaattgaaattatccctcaccacccaccacctcactggctaggcggaataagttcacttcatgaccctcaactgtgatcgaaatctaatccatgaccataaaccacaaaaccggatatcttgacccttaaactcctaaaaccggtgcaatttgactccctggacagttttgggaggcggttttgctgacatggcgccacgtggcacctacgtggcaatattgaccgagtcttcgttccacatggcgttgacgtggcatctacgtggcggtggaaataaaaaatatgcgtgggcccattagtcattcacacaaaaagaaatgtgggcccactgacatgtggggcccacatgtcagcccttcttcctccagcctctctctcccttctctctttctctccccttcttccccttcagcggacggcgggctgcgagaacgagcggtggcggcgcgcaattgagggccgtagcgacgacgacaggacgggcgagggcaggagcagcgagccgtgcagccaccgccaccttgacacatctccccgccgtcgcgccgccggcgctcgcggcgcccatccaccgtccacctgctgccgccgccgccgcatgcgccagagggaggcctagcacgctcgcggatccctcctcctcctcctcgcctcgcccgacgacgacgcggcttgcagcgatgcatcgcacgatacggccacgctgcctcgacccgacagcgtggccctccgcctctcatccgcctccttctccggtgacggcgcagcgcggcgctgaggctgggcggcgacgccctggaggcggcctgggcggcgttgggtggcccggccaggtggcgcacgacggaaggggaagaggcgacacggggaggtggccggctcggccgtgcacggaggcggcgcccgcgcagcagacttggctgtgcgtggcggcggcggttcagcgacgagctcgagctgggctcgggtgtggtgatgacgatggcttgggcggatgaagacggcggcgacggcggcttcgatggtggacgacgccaaggcaccgacattggcgaggtggagtcggggctccatgtcgccggcgtgaggagagaaagagagagaagggagagagggatgaggaaaaagggaaaagagaggatcacacgtgggccccacattccagtgggtcccacatttttttttgtgtgaatgataaatgggtcccacacatatttttaaaatttgagtgccacctaaccgccacgtcagcgccacgtggaaggaataccgggtcaataccgccatgtaggtgccacgtcaacgccacgtggaacaaagactcggtcaatattgccacgtatgtgccacgtggcgccatgtcagcaaaaccgcctcccaaaacctcccagggagtcagattgcaccggttttagaagtttgggggtcgagatatccggttttgtggtttagggtcatggattagatttcgatcacagttaagggtcacgaagtgaacttattccctggctaggctagctgcgaggatttgttgggccaggtcagcgaaacataggcccatcgatctggtagttgggccgtgtgcatattcagcatgctggcccacactgcacgcccaagcttggtaggtcaaagtagaagctggacctagagcttaggtcaacttattgttagtattgtatttataaggcatattttattttagttttacaaagtcaaaatattcttcaagacctcaacttggtaacccgtctgtgttgaaaggaataagaccaattcgtatgaacgatgccgaaaacttaggatgaaaatggtccaaaacggtattgcttttttattatttctacggaaacggttgattttttttcatatttataaacttaactcttcagtatcagctttaatattgtgacgttgacagaaattagaaaactaaaattttaaaagataatagtcgatagagatattatcattatattacttttctgtaaacaatatccgtacagtcgataaagaaattatccgtatggttggaaaatttctataccattttcacccccacccaaaagggtagagaactgggattttgcaagcacaatcatctggttcatgttcatacatattaaacaaattctgcctatcttaatcaacgccttttttttgcccaaatgaattgtccctgtcaactaaaatctggtaaattaataagtgctctgaaatattgcagcttactattcatcatttatagaaaagaagtaggactagcatttagtctcgtcatgcgggtcaatgaatttgggcttaatttgatctttgaacacatgggaccgagttgaatcttcagagaaagagaaacaagaatatatagcagttggaaaaatacggaggactaattcgtcagtcaagatcgttcttctgaacatggacttttttttaattaatatgctgttagttaatttggtagcagccggcgttgatcctctgaacaaattaacaaactgaacttcttaggattcctggaaaggagaaacgaaaaaaaaaaaagaaaaggcaaaagcaccatgcggtttcagttgatctgtcgctgttcttgaggtacacgtttgcatatatgttgtggtgtcagattattttattaaattaagaggaccacaaaagttaagaacccttactaactgctgctctctccatctaaaatactgttagctcgaagcttgttccacaaagaagctctctctaagatgggtttcactactttctaataatatttcaatttattttattattttagttatcgaatcaaaaggtatttcacccttctctttgttttcttctcctctactccatccattaaaaaaataactaacctcgtattagaaactatatccagatgtcacattctagtacgagattaattttttttctatggggagtacgtttcttctccgcattaacgaaagtcatgatagtcttttagtctcttatgtaatttaccttataactagctaaaacaacggtattttagagacggagagaatttagataacaaccttctcttttttttcttttgcttccatttgcttaccaggattgttgctgttgattattagctagctctctcctatttttgtgtgtttcgtagcaaacaatgcttgcctgatatgtgtgcatcagtacatgtgtggagcacatcattttcacttaattaatcatagatgtatgctatacttacagtatatattggtgcatgatgcatgtgcgtgtttactgtatttaagacaatcaatgaataatagctagatcataattgtgtgactgttgctcgaataactttcgtcctcgatcgactcatctaaaagaggcaagccttttgcaagacaccatagcccatttgtttcggttcatcttaatttttaacttcctccttcctataatatagcaatctaaaatcagatagtacgtatcttgctgctaagaatctggcttgattcgtaatactagattacgtcatatccaatcctatgttgctatattatgggaagtagggagtacttctttataattatatatgtacattttggtcagtctaatttccgttccttagtacatacaattagttcaaaatcgactattatgtttcagaaaaaaaaaatctatggtgtatttggcaaaactgaaagtaactatctctttgtgtggaaatgtatcaacctttttgaaccaaatcttcaaccttttgcaatcaaactatacaaaatacaaccgatgcttcacgttggggcttttctattggcccaagttctcaagatactttgcaactttacttggttagcaagggacaatagagttggcatgtggttttttattagctcacaattagagctaatgatctactccaacattagttttgtacctgtgtactactctacctaccaaccaacatatggccttaatttgcttttggcacaattgactcatgctactcatatatattctaaactatattattattaaggttgaaatcagcaatgacctttgttggtcgctagccatcaaatgaatggaaccttccaatgaagatcaaactggggattctgaatatatccaatgaaaaggatagcaatccatccattgatgcaatgaaggaagaggttagttggtgattatttaactagaggcttaagttaatctatgtacgagtaatccagattaattggtgacagtaacatagaggcttagcatccaaccaactctgattattattaaattacgattcataataatacaacaagagtacgtggtacacctgtaaggcttaggatggatggaatatcatgatctcagcttgcctgttccatgtgagcataattcctccacccaactacattcatgcacatattatatgtgtgcttgagaaatacttcaaaaaaatattagctagggctcataaacatggagctcacttgatccttttttctacagagaagaacattaatcagctacaggatggctcgatctggtggcagatcctatagttgtggacccataaaaattctagagcacaagcaaacttaactatatatagtatatttgctataaagtttttattttattttctttaactacatagaattttaatgaattattcgtcgacgagcctggatggccacccaggttcaccgggtgggtgtcgatggaagagccacctcctgagcaccatggttagctgctaaaaaccgctatggaaaattgtacatagcaagtaaaactttcatgcaatactcaatctttgagtaatttttagaaaaactacagacattttgactaaactatcacaaaaatatagaattcaagacggtgtatcatagaacggtagatttagcatcaaaattatcatgaaactacatatttaagtgaagcatcacaaaactataaacttaatactaaatttatcattaaactatatatttaagtggagcatggcaaaattataggatcaatttatcataaaaaatgcaatgtttataaaa

SEQ ID NO: 79081 - DNA, 6058 bp, Oryza sativa
aattactgttatgatgccaatatctacgatcatatcgaaagcttaattacggagtttcttaggacattattactgatcaacagaaggagatctcgcataattggagttgacaacactcaagagataaattaagagaaacctcagaaagagagaatatatataacagagagaaaagctcaacaatttgtatcatgagcagctaattaattaatcgattcacctcatataggaaattgaattttttaaaaaaacttatttggcaaagttgtaaggggggtttcattcatcctctccttaatcactagtggccatgcatgcatgtccctagctacccttttttcctgatctagtgcatgcatgcaattaagatgcgacgcctaattaattacgattgatcattaattaacaacaaatattaatctcagcttcttctctaacaacatatccattggataacactatcgatccatctccggctcgccgccgccggcgacggcggctacacgccgacgccgaggaagtcgaagtacggcacgcccttccgcttgtcgccgccgccgtcgacgtcgccgtggttctcatggccgccggcatccatcagttccagcgtctctctcatgggagtggaggagaaggtgatggtggacacaggctgcgccgccgccgccatggacgtcgtcgccggcagcagcgtaccatagctcgtaccgttaaacgacttgatcaagaacggcgccgccgccggagaagaagaagacgacgacgacctgttgatcatgccgaagccgaagcatagcgagctattgcgcgcgcctgatgacgcaccgccgccgctgaagtcgagctggctggcgtaggaggagaacggcggcgggtgggcggcggcggcggcggcgcgggcgaggaggcgggagcgctcgcgggagcggcgggcgcggacgacgtgccagtggttcttgacggcgttgtcggtgcggccggggaagtggcgggcgatgagggcccacttgttgccgtggtggcggtgcgccgccagcagccgctcctcctcctcctccgtgaagggccgcttgttgatccgcgggtccagctggttgaaccaccggagacgacagctcttccctgcagccaaatatatttattacaatttattattattattctccaattaaattcagcacagttattagtatttattattactgctattactagtagtttttttaatatataacgctgatgattttttatatgtgtgatcatttgttttattaaaaagttaaacttgatttattattataggttctttaagcatttagtccgaaaatgtttgtttaagcgcgagttatgatttttcatgtttgtataaaaattacattgtttttcattttaatcgagcacaattatttattattatactacctcccttcgttttttaatatatagcgctagtgatatttttatatgtttgatcatttgtgtttatcagtttttttattataactcattaaaggtcctttgagcattcagtcggaaaaaaattaaagtttgtttaagcatgcgatatgctttttaatatgtttgtataaaagttttgaataaaacgaatgattaaacatctattaaaaggtgaatagcgtcttatattaaaaaagataataactaattggtcaataataataataataataataataataataataataataataataataataataataatttgtttttacaataattaacaggtgataaagaaataaatatgttgactctgcttggagaatcacatagcaatgtttgcaaatgataaatatatggtcaacttggcttatattctgatggcatggtggagattaattagggaaaagcatgtgtacgtgtaggtgatcaactcttgacacacacatgcatgcatggttgggtcgtatgaactaccgagcgcatgctcatgctcatgcatgcaagcgtgttcatttcttctttttattatgttgttttttgttatttaattttttactactatgtatttaattaactgttgttaattttcaaatcaataaattaatagtatagttaaaaaaaatctctgaaagacgttttgggttaactaatttgattttgaagatggaaatgaaacaaacggacatcataattccaaacgtgacgaagtttgttctagtatccctggacatgcataaccagtttgataataacattacttataaatcgatgaaagaggatcccaaaacaaggaaagaggaatcacaacaaagataagtaataagcttgatcggaaaattgaaacagctagaatacatgcaaaacttccaacattaattagtaattcagattagacagacgatcaaattaaatggccagctggcctttagtaattactggaaaatattatccttttgataaaatatggttgcggtcttttttgggagtagtataaatggaagaaattaaccctcagctctaattaaccagacaactgtattcctctatctccaagataaatacgaaaaataattaattagaaaaactgaagcgctcgctcataaatatatacaagattaatacaaagaaccgtatggggagcatggctaatttctttcaaaaggttagattaaagtatatgcatcacagaaattttgcttacaaactaacacacaagcatgattggaggcaaatcaagaaaactatttttttgcacaactctctccgattaaatgaacaaattaacaacaattaatacacccacaaaaaataacatatgccaaccatagcatccaagatttcgatccgattcaaaccaaacaggcatgtacatatgcccccaaaattttgaacacaaaattaaatataatccccatctaccaatttctagacaaaagaaatataaatcctcatcttctctccatgagaaagaaccaaagaacaacgaaccaaataaatctaggtagatgaactagacctatagcattaatttctttgcaactatatatctagcaccagaaatgaaacaaactaatcaacaccatcaaagaaaaattaaccatcaccaaattaagagataaaaaaaatcaaaatcaatcaacacacaactatagtttaaccaacaacaccaacctgatctgccctccagcttctcggcgatggagttccagttctgagggccgtacttctccaccagctgccggagcttctcgtcttccccgggccgccagtggcctctcgggcacgccgacgacgacgacgacgccggcttcccggcgccgtccgacgtgttcgtcgtcgacgacgacgccatgatccttcacctagctagagatcgaatcgatcgagtagaaatcaagcaaaacttgactataacttgctagctagctatcttgcatatctatctttgtttttcagatcccaaaatgattttctcttgataagtgagaggagaggaggagagaggggatttttcttgggctaattattagctagcttaagtaagtagaattagaggggaaatgggagattgagtgagggagaaggggtatgggtagtgttaggatacccatacccatatatatatacaagagagagacacacacatgtttggggtagctagttagggtttggatgataggtccctctttagtttagtttagcatgacaagaaggtttgggcagcttaattgcaccctaatcaaaataactagcatataattgtatggcactacctatatctctttctttctaatctacattctatatataagtgtatgtatgtgtgtgtgtgttgttaattaagtatatctatatatatcgctctcaccaacttggattacctgtttggctattcgctgaagaccactgctctcacagctcccatcaaacacaaaccaatcccttgattacttctgccttgtacttcctctctaacttctccaacaatattctctctctatgcatgcagcaggagacatcatcatcgaaatattgttaattaacaacaaattaattaaagatgttatctaaccatgctcgtgtgttgtttacgtctttgtgcatatagggagaaaacgaaatcgtctctccgtggacatgtataagtaatgatcattggtaatatgtctgaaagaaacatttctacgcatcagattttcttattttatatatatatatatatatatatatatatatatatatatatatatatatatatatatatatatatatatataagatgaaatgtatggtcagtgatcaacatatatatatggcacgcaaatttaaaatattcatctgttgataaaattttacactacaaatgtatgcatatatataaatctatatatcacattacaaacagaaggacacaaggaggtgtatattaattgcaattattatttcaatgcaaatgtactttgatcttacctctgtgcaactgcgtgggaaattctattagattagttaaatattactcaaaactatacctccaaatgaacctaagtctatatatataaatctgcgtaactgcacaggaaattcaacaagattaattaattaattgttgatcagatttgtaaagttttttttacctcgctgcagcttttgttttttcctttttctacctcctggcataggcttgtctggacgagtgccttgcataacaaaaaaaactcttttccttctaatatattggcatgcaatcattttgcgtgttcgcggaaagattttcaatttttttagatcattcttaccctgtgtactttcaaatacaatcagtctcttcatttgcaaagatatatcaaatagaaacaagacctatatactttcaaatgaacttcaattagctctccacgattaaattgtgcgggacggattgcgacaacctatgttcgattaattgttggtactctcacacaacttgtaaagctctaaatacatgcttattgtccatgtcaaaaaaaaacatgcttattgcattgtatatatactgcaaatgcaaatcgatgatcatctcttgaattcgtcgcaaaagtttgttatggtcaacatctatgagcccatacattcccacaggaggtaaaccgttcgagctctgccattacagccacccaacagaagcagaaaccctagtaatggccaatgaggcagcgtacacagaggggtggttggcttggctgcatatacatatcctgatcgatcgaaaagcccaaatttgcagtcttttcagcatgggatgcaccgcagaaacaagggatgcattcaatcttccatgctgctctgttcattgtgtttgggagatttggagcaacacatgcatgtacaagggatgtgatcagagagcagttagttggcagtgtgatatatgtgtatatttatgcactggctgcattgtaattgatgagcttgatgtacacatgtaactacatgtgtgtgtctatatatatatatcgtgtatatataccctttctcgtggtttcataaaatctctctataatttttttaaaaaataagtatataataacatatgtactgcacaaaagatataccatttaatttcatttttatgagcttaatatagggtcattttgaggttatttaattgcttgagcatgccctctttgtataatttgcatttaatttgtctgcagctgttctcaacattgtcatccaaggtggtaactgattgatctatatcatgggattccatacttgattcccaaacagatgtcctcataataattcttgtcactttgtttagttttagagaggcatgcacatgtttatatgcaaccaaaaacaggaagctgtttaggctaagtaatgagccacaaccaaaagtctgttccaaaaggacaagtagggcccaggaacaatggacaaaatctacaagacaaaagcaaatggaggaaatttgatgcaaccaatattcaaaaaatacaagaaatctaaatttgcagtatgtatacataatccgtgtttcttcattttcattctgtaaaaagtaattttgctagctcttgctaaatagaccttcgaaggaaat

SEQ ID NO: 79082 - DNA, 11569 bp, Oryza sativa
ctcatgcccccgcccgccgccagcctcgcgcccacccgccgcccgtcgccgcgttcgcccccacccgccaccgccgacccacccgtgagatagagaggaaaagtgaggcatagattgagagagagaagagagagaggaagagtatgacatgtggatcccgcaaatttttttataaataaaatgttgactggactgccacgcgtacgacacgtagaccaaaaccaccatggattgaaccgagggggtaattcgtccggtttgcatagttgggggtaaagaatgtctggttttgtggttcaggggggtaattcggacgaccgcgatagttcgggggtgtaattcgtactttttcctttattatatccggaagaattggagagagaaacagctgtgtaagtacagatttaccctttgaatttttttctttttctttttcttttttcttccttatccttttctccctctctcgttctttctctctttctctctctgctctcaaccgtcgccttcaacctcgcccgcggccgccgccgctcctcctatgctcgcccaccgtcgccgctccgccctccgcgctcacttgctgtcaccgctcctcccaggctcgcctgccgttgccgctcctccttcgctcgcccactgtcgccggtgctactgctccatggcttcatgtccttcatgcccagcacggtgacgtagacatgaacgcgctcagccactcatcagtagccgacggcgaccattggcgcgaacgcggtgccgaacgagcagtcagcggcggcctgcgatgttagctaaataatgcaatcttgtgcatctagtttctgtagttgcattgcatatgattggctgtgttagaatctgtcagcagccgttttactttcagttagcatgtagctgttttctagctagtttttcggttggactgaattggatcgtgggatggcacggtcagtagtggatccagatcaatcgggtgttttttctgttatgcatgtaacaaactctgtaattgaggagaataattagaaaaccagaaaagcagcaaggtacttcgctgtgccaaaactctgctcgttctactctgttcttcagttaactattcatatattcgacaaaaggttcagagattgtgagagtgagagtttgatcctgtaaaaatgagaccgtgtgcttcacatccaccatcgtttcttctcctctcttgctctttgcttggtgatgagaatgtaagatgtgtttaagcccgtgattagtgaagactaactaaagaaaatgtttagcggcccacgttggattaacttgagccaaaggcaaactagtttttaatgattgtttctctctcctatttctctaaaaataatcccgccggtgtccaatagctaattaccagtttttacgatgccctacagcaaatacacgttcttacgatgtcccctagctaattacacgtttttcagatgtcctgtagcaaattttgccaaatataatttcatcggcctttcgtagtcaataaaaattcatggtcacataagtgtatttcggagaccaattaagttatcgtccaaagcaacaagtatttgtcaccaaagatagcattacttaatgaatcatagcatgtccttttgcgaagaacatatatacgtacctaaagcttattaacaaaagcaaaagtcatgcattcgatgagtccgtttatagataaaaggaaagacgagaataaatcccatttttccacaacatgtacttttttaagaaaattaaatatgatagcaaaattgagactaatccgcatctagtcatctaccccataaaaggagagatctccctgtcatatacagcactgctatacatacgattgtttttatacgacgtttgtacgatgaaacgtttctctcctaacttctaacgtttttttagcgatgaaacggatcgctcccctgttgagcccatatccaaagcccaagctctgacgtgctggtctgctctctcgttggcatgcttgcgtagccaaccaaagcaatcttctttctagttatatattaagcaattttcgttctaattatatcttatatagtaattgtacttagcgctcatttgttatgtggcaggtgaagcaaattactcatacatatatgttccttacaccttggacagggatagcatcaggggttgctagctggcgcgcgcgcgccagttgctcccggcccatcagccctatttttctttttttcgcgattttttttcgtttttcttttgcgatttttttcgcttttttttccctttttttattactttttttaatctttagcacacttatttttttaaaaaaatgttttgagttgaaagttttcaaatctcgatttgaaagtttttaaatatgagttgaaagttttcaaatcttgagtcgaaagttttcgaatcggagtcgaaagttttcaaatctgggatgaaagtttttaaatcttgagtcgaaagttttcatatttttttcaaatcttaacttaaaaaatttcaaatctgtacttgaaagttttcaaatcttgagttgaaagttttcaaatctcgagttgaaagtttttgaatctcgagttgaaaatttttaaatctgagttgaaagttttcaaatatgagttgaaagttttcaagtcgaagttgaaagttttcaaatcggagttgaaagttttcaagtcggagttgaaagtattcaaatctaggttgaaagtttacacatatatggaaaaattcggaaaaaagaaaaactaaccgtgtcttgccgcccattgggccgtgtgggctggcgcgtgcgcgccgccggtgcgtacgcgccaattaggattcatggatagcatcaaccatagttggaagtagaatctaatggccacaatcagaattggatgcagaaaaagtttatatatatatatatatatatatgaaccaatgttaaacaaggtttgcatatgtttagatacagagagactgtatagtgctgctcagcatattaattgatgtcacatggtaacgaagcagaacttctttcaaacatattccactcttttagtcatgagatagaaggacaaaaatatcttcttttcccttcagattagacagtaaatttagttagattgaatactacctggtagattattttaatataatctcaagtataatataatctcaagtcagatgctgcaaagaggttaattgggctttcgggcccataagcgctcctgccacgtgtgcgtgcgccgtgcgctcgcgttaggttcccctgccatccgcgtcgttatgtttgatcgtacaaaaatcggaagaaaaaaatcgtatgcgtagcattttccatgtcatatatatgtgcctagactcaagtggatagattcatgcccctattgcaagtcttttggagcacatatataacccagctcaataagttgatttttggcaggttcaaataagtccatgcgaatgggataacaacatcatgtggcccaccgaagtgagctttgcacgaacctgaagtccagagtatgacttcagcttttctatccaacaacaatatacatgggtgtactgtgtacaacgccatgcaggcttcacattctccttttgatttcagatttatccaatctcactagctacctcctatgtacttgtttccactttatatcgcagaaattgcttggttcttacaaacggaggaggactatatagaaataaaacatggtacgagaaacaaataacaaaaataaaagaaataaacatggtacgccaaagagaagtatccactatgcaatataaaatctactgaaatttgttagttttgaatcaatcaccaacatctatactatacgttggacattgcagaaaatagtccaatcctataatttgaactattgataagaaaaagataagcaaatgcgagattacatgagtaatagttgggtctttgaacggtccatgtttgataagaaaaatataagcaaattgaggttacataaatgctagttgggtcaaaaggaaatcctaagcttagcaaaagcaacctagaaaagaacaagaagaaaaatgaaaggactagaaagtgcaataagattcttgattaataaaaataaatcaaacttgaagattacgtggacaaattatccctaccaagttctccacataaacaattttgtcaaatttgaattggtcctagttgttgactagcatttaagtagctttaaacataaataattccaaaaagatagttcaaattcccgccaaaacaaagataataattcacattaaaaacacgtcgacggagaaaaaaattcctactatcctattaaataaacaaactgtttaaccccaacaaaaatgatctaatcacagaaccgcaaaatagctacttctgaatcattatcatcctcgtcagcatcagtgagctagagctgctaagaggaacatgaggacatgcatgaactcatacgcattggccaccccatagcatggagcacgcactcgttttgacttattttttaattaatttattattaatcaatcaattaaaacttcataccacacacaaacagaaaacattaccccaaaaaacccataaaaattaaaccgaaaaacgcccaaaccaaaaagataaaaaaaaaacccaacgccccctctctaatcaacccctcccctaaccttaccaccacccaaagccctacccgccccactcacacccacgtgggccccaccacccctggccccacgtgtcagcgagtggcagcgcccgtcacccccgcgttcgctgtgccttcccccttaatcaaatccagcggatatttttgacgtccgcaaggacaaagtctcgccattttctcctccgttttgttttttttttcgttttcttttttcttcctcgctttctctctctctctctcctcctctccctcttcttcttcttctctgccaaatcccatcgcgaaggcgagagagagagagagagagaagaaaaagtgaggggattaacaaactcgcgagtttttcttttttttttttgtttattgtgtgaatttggcccacgtcggcggcggcggcggaggagctaaaccctagccggaggtgaggtggtggtggtggtggtcgggaagtggcggcgccggtggtggggcgggggggcgatttggcgcgcgcggccgagctccggatcgccggatttgtgcgtgagcgcgtggagtttgtggcggtgtgctcgtgttgctgttggtggtgaggtgtgaggtgaggtggggtggtgtggcttctgctgctgctgctactgctgctgctggtgcttaattttgctcgggttcgtggggttgggaagcgagggatgcgatctgggaggtgttcgggagctcggtgttgcttaattccggtgctggtttgcggtggtgcgcgcgcggcttcttctcggggtggatttggtggtggttttttttgttgccctcgttgttgcgggtggatttcggggggagggagagtttgagggatgactgctcgttcttgctcaattccggtggatcttacggtggaaggatggcgagctgagtaaaggcgcgcgatatcttgctgcggtttgtgcggagcttcggagcactttgtcattgctggcaaggatgatgccgtcggggccgctcaacccgatgggtcccgggcagccggtgggcgccgccgcctcgctgctccggacgagctcaagcctgcttagtggtggtcagcaggggatgggcagtggcggaggcatgattccttcgcagtcgcccttctcatcccttgtgtcgccgcgcacgcagtttggtgctaatggcctgctgggaggtggctccaatgtttcctccctgctcaaccggccgtttgggaatggtggacatatgctcggtccggggttgatgccaggtggtggtgggattccaatgaataccctccagcagcagagaggagggcttgatggtgctggcgatttggttggcgtgggaggttctgatcctctctcgtttccttcatcgtcgcaagttagtttgggcaatcagctgggttcagataatctgcatcaaccaccgcaacatcagcaacaacaacagcagctggatgctatgcacgacttgcagcagcagcagcatcatcagcaactgccaatgtcttacaaccaacaacatttgccaccgcaaccaccacagcagccacaggctacagtgaagttggagaatggtggcagcacaggtggggtcaaattggaaccgcagatggggcagcctgaccagaacagctcagcccagatgatgcgccatgctagcaatgttaaaattgagcctcagcagttgcaagctctaagaagtttgagtgcggtgaagatggagcagccgacttcagacccatcagcattcctgcaacagcaacagcagcagcaacatttgctgcagctgacaaagcagaaccctcaagctgctgcggctgctcaactgaaccttttgcaacagcaacggatattgcaaatgcagcagcaacagcagcaacaacaacaacagattctaaagaatctgcctttgcagagaaaccaattacaacagcagcagctacttcgccaacagagtctaaacatgagaactccaggaaagtcggccccttatgagcccggaacctgcgcaaagagattgacccattacatgtatcatcaacagaacaggccacaggcaagtttttgggttattcctaacaagtaatttagtgttatgtgaaggccatgcgcttacagtttagtgtctctatttgttccttttggtgcaggataacaatattgagtactggagaaattttgtcaatgagtatttttctccaaatgctaaaaagaggtggtgtgtatctctctatggaagtggtcgccaaactactggagttttccctcaggtttgatgtgctgtttccgacttgccattttttaatctagaatatagattatcttgttcatatattttcttatgcaaggaagttctgttctattatttaattggcaggtgcagagtagtgacagtgcctcacattttaaatttcctttcaaattgttagttgaagttctctatatttgcccttgtaggatgtatggcattgtgagatatgcaatcggaagcctgggcgaggctttggtaagcattattttaatttgcacatgtttctttgtcaattctgtttttacatccacttatgccactacacctttacagagaccacagttgaggtgttaccacggttgtgccaaatcaaatatgccagtggtacattggaagaattactatatgtggacatgccacgtgaatcgcagaatgcctctggccagattgttttggactataccaaagctatccaggaaagtgtattcgagcaattgcgtgtggtacgcgaaggacatctaaggatagtttttaatccagatctcaaggtattatatttttaatttattatttgtctttttttttggttactggtgggcctttaaaattagttgtataataaatggtgccttttgaactaaagcatgtttccttttcttgaagatcgcgtcttgggagttttgtgctaggcgacacgaggaacttattccacggagatcaataataccacaggtatttagccctatagctatatagagatttttattcaagacaaatgtcttatttcaatattctgatttttgggcaaaatgggaaagggttcaatatattttgtgacgcttggtgtttctaagcaggttagtcaactgggcgcagttgtgcaaaaataccaaagcgctgttcaaaattcgacaaatctgtcaactcaagacatgcagaataattgcaactcgtaaggagattttctctgatgccctcaatactttccatgttcagtttattgcaaaatcattaatgctttatccaccttgctccgatatgcatatttttgtgttcttttgaaatttatcttatttgcaattgcaaagaagccgtgtctactagtgtaaatacttttattaactctatgctagcgtgagctgtcttccaaaatgggacgtagcctctgtctcattcttcgagttcagggccaagctgtacaaatagttaaatactagtattccgtagcctaaccatttagattttgtgtcatagcactagatagatttgcactatataatggatgtacatgaattttcagttagaagtcaaatggtagtgtgagggcatacacaatgtggaagaactccgatctggctcctctttgtatcctgccagttaccttatcttttgcattctggttcgatgtctatatcccccgtaagaaaattgacattatgccgttgtcaaagtgggtttcactggaatgccatcctgcaaatgggtttcgttaaaatgtcattctcaaatagggcaacacaccacaatgccatttcttccatttattctcaatcaaatgaattttgccctgtttttcttgatgagctgaccaaaatacgtcacgctcgttctctctctctgtctcgctgggctgtggctgccgtcagcaatgcggcgccattactgagctctggccaccccgcatcaggaaggatgggaccaacgccgttgtgcacccaccgcacgccaccgcactctcccgatgaggacagctggcggcagagctccatgaggatattcgcgcacgagcatgatgaggttggtggcgtgcaatggagctggaggaggccactgctgcttgaggaggctgcggtggcgctgaaggaggccgctggtgcgagagcttggggaggacaccggcatggaagctggaaaaggccggtggtacgggcggcgatgcaggagcttgagttgttctcctctgtttctgcctcaatccatggcaggtgcaatttcatcaattgaagttgcaaaagagggcaaaattaaacaaatgaattaaaaagggatgaaatggcattctagcaagtagctaccatttgagagtggcattttagcgaatcccacttaagagatggcatttcagtgaaacccacttttgaggatggcatgtattcaattttctcattgcctgcagacttgtctgttggcttgatgctgccaccagtaagcttgagaaagcggagcagcagcagcagcatgtgaagaggtgtcgagagtctgagaaatacataggatcatgagatcaggactttaggagaagatgaggcgaagaggatgatctcctgggttcacttgagagaagagatggctgttgatctggtttgggggcatgatttagggaaggagggagagggtggagatatgggcttgtagattgtgtgtctgagtggttactagtagtaggctgccctgagtaggtgcgaaaataattctccgagaccaagtctctgtttacaccgtcctcaaaacatgacaggtagacataactgccatctacaagtagttaattctagagtacgttagtgctttgagtagggtctaaacagagacctggtctaggattattgttgtagcgggacttttttcctttaacctgttctttttactggctataattggtatatgatggattttcactgaatataactactgctaattgctggctaggcacctgcctagtgtccaagtgcccccaaagtgccaaaacacagtgctgtgcaaatggcgtgaggcatatgtggttttctggtccactggttgagttcctcatggcacggtagttttgtactgtactctgtgatgtatgcagtcctgcatgtaattctctactgaactacacgcattcccccgaggtatttcgattaagacgcatccaaaactgtggccaaggaaggccacggaagaaggtcctacatgcatacagcctttctgcatgtagtagatggaaatttacttatttgaaacattctatggaaatttcatttatttctttttctaattggatctctgagacaaattatgcctgataagaaagttactattgaggagcacttacaatggtctagttagaaggcaagttagagcagcattattcaagtagcgtaacatgtggaattaacatattttgtgttacatattttgcatgtttgacatgtgcattaacccatataggcgaaatatctattaaaatatatagttgagactacagaatgagatgttttacaaatatacaacattcttttaatgccactgtagtgtgtgaaggcgttacgcaaaacaaaggtgtggggataaccactgaattttgaaggtttgcgacccagtgattttggataagtttagctcactgaccatcagccccctaaaaggttaagcttccaggggaacactggccatttattcacgtccatgttcatctcaggtctatgatgtggatggttaagtgatgttggatgtgtatacagaaaaaatatcagtgcaaagtattctggacctatgggtgtatggtattgttctagcaccatgtgttcttattctgttagggaagataaataatttatgtgttcttagatgccatgcatttattctccataaaagttgaccttaatccatttctgagataacaattacataaaaatgttgttgctatagaaggtagcattttagctagtaagggatcttggagacttggattacacacatgatactggatattacggtgacatgctcaagcaagatgtttcacatgtattctgtttatcatctgcttatctccttctgtagaggtcactatctattgacaaaaaatactattgttgttgttttttaagttacgaccaaatagttgggagtccttaaagaagaggtggtgatggagtgtgctctacaactttttcttcactttcagatctttcaagcgtgcacttgaaggatctttttgcatttgaggattcttttttgctttttttcactttagtgcttttggtatgtttgcttccgaacattattttgcttctttaataaattatatgtcacagaaaaacttatgagggtagaccaatttgtgccttttagggctcactttcctttttcactgttgtttatgtaccaagtctgttgattttgtttttctgtttgattcttttttgggataattgacatttgagtactgcaaattgtacttatttttcaatcttttactattaggtttgttgcatgtgcccgccaattggctaaagcactggaggtgcctttggtaaatgatctgggatacacaaaacgatatgtgcgctgccttcaggtacacttatacatggttctgtttttattcacctgttctgtatttctacatccaacaaatttagattattgtcatatgcaaaagttggtattttttacataggactattatcattctttgttgtgggcctttggcacctgttgccattctctatttcgttaaactaatttatctgacctattgttttgtcatccaaaacattgatacttccagattgctgaggtggtaaactgtatgaaagatttgattgattatagcaggcaaaatgggtctggaccaattggtacgccatttttatcttctgtttactatgcagtctcatctg

SEQ ID NO: 79083 - DNA, 692 bp, Oryza sativa
aggatgtacccaaagggatgcatgcatgtatgttctataggctgcaggttgctcaccgaagctcggatgcgctacgggtaggcctggacagcgacgatgatgtagaggatgtcccggcggcggcggaaatcagcatagcaacggtgacaaccaccatccgaactccgggttgccaagaaaaagagtggaacggctcaaagaccaactaaagatgctacacgagtcaggaattgcgccgaagctcacccgggatcaaggaatcgaagatcgacgccggcggccggagttggagaagatgacgccgatctccctcctcgattcaccgatccatgaggttctaggagtatcttgaagaggacgtctaggcgattctggtggcgcaagggttcggcttggggtggttcagtttggtcggaacgacgacaagaacccgacagcggtcatcgttgtgcgctccagggcgtttgtgggcacggtggcattcccgctcaaccactgcatagaatgggatgaaattagatgaaatagagatggcattgagagtaggttttggaacgcaaaagaagaggaaacgaccgcggctcattaacgaatgtggctatcgtcttcttcgcggccggcgatggagaaacggtggagaagggcagcaaggatgctctccctcggttggatctgccctggaatggtgggtg

SEQ ID NO: 79084 - DNA, 977 bp, Oryza sativa
tttgtgttgattaatgatgattgcttgattggggttcgctgctacagtaaatcgggttttgctagaggatttggaagaacataggacgagtgtgattcttgatcactccactttgttgttgattatagttcttgtctgaatttcttgtcatataagttctgcaggaattttgttctatccagtcacttcttaattcagttcttgtttacctccttactatccatgaattctcatacccagttagaatttatatatgttgtttctgaatttatatatgcaaacattgtgctttgcagtttcttgatagcataacacgaggccaatcgatacgccatgttttctatgctcctgaaaattgcaatcagaaacaagcgtcatttgtatcagtagtaacatgcttattgtcatcttagcagatgcaattgacaaacctgaaggatcttttgtgatgttcctgacattaaaatgctaaggataggcttttctgttactcttctgactacatagcattccctgataagaactcttgttgaattttcacagagcaaggaagtgaagaacaaggaaagaaagatatggaagccttaaccaaagtcatggacaaggtcaaggaagtgaagagtaacccagaagtggtggagaagctggacaaggtcaaggaagacatcagcagccttgctcatgctttacatctgggaaaacatggtaaatctttcttttgagatgtcttatttcctaggataggataatcatatttctgacaactatatggttgcatgataagtaggcatttcattatttacgcgtattcccgaaaaaggaagcacatctcattgtcacaaatagaactatagaagcacttgcattgtgtatagtccgaacatccaaaacctgaatattaacttttcttacatcttttcccataattttacacatgatcaaaagataaggaacatgaatctgaggagaaggcaaag

SEQ ID NO: 79085 - DNA, 825 bp, Oryza sativa
attcctgcagcccttaaaaccgatcaaacacggatgacggaccacagaaacatcttgacacatcaatacattaaaaccgactaaaacacggataaacggaccgcggaaacatcttcaatttttataatagtagagatataacacgtggggcttgtgagtttatctcctattaggattcaaaattggttttaacctatgacaaaaccaacttaattatctctttctttattttcttcttagaatcggactgtgggccaatcctgttctaacttaccaaacttagctgatataaatcaaccaatattttccagggagagctacaaatcggacgtccgatgttataaaaaaggacggtcaaatgtttcagttaaccgtttgtgcaacgttaagttatacatggtgaaacagaaaattcagcctaaaaaacatatagaaattttgtaaaacataataaaaatacatggtgaaacatattactatcacgtatgaaacattaagtttttattgtttgaaacatatgattttctttcatcagaatataataatgtgatatcttgttgtaaatatttaattataacgaattcaacagtgtgatcggatggttcattggataagtagtttaaaagaaaaaagattcttaagaccactaaatacttacatgcatgcatactgtggggagaaaaccaatagaatggcagtagagagagtaggggcatgagcatcttgtaatttttcggcctttgggaaacattgagttatacgtggtgaaatagtaaattcagttattaaaacatttaattttttttataaaacgggctgcaggaa

SEQ ID NO: 79086 - DNA, 13030 bp, Oryza sativa
tttctacaaaggagatagttgatgtgctcaagaaaatgcttgtggataaggcccagggccagatggtttcaatggatgtttttataaatcttgttgggagattattgcacaagatttctacagactttgtgctgacttttggggtggctctgttgatcttgctgccatcaactattcttacatcaccctggttccaaagatgtctgcgcctcaaactcctaatgattataggcctatctctttgatgaacttttcggtgaaaattctttgcaaaattttcgctgataggttgcaggtgttgatgttaagattggtgcattagaaccagtatggtttcataaaaggcaaatcgatctaggactgtttagcttgggcctttgaatacattcatcaatgtaagcattcaaaaagggaaatagtgctgttgaagcttgattttgaaaaggcctttgacacagttgagtatgaggaaatcctcaatgtgatggctgcaatgggtttcccatcccaatggaatgcctggatgaaagtgatcttctccttagcttcttcggctgttcttcttaatggtgttcctggcaagtttttaaatgcaaacgtggagtcaggcagggggttcccttatctcccctcttgcttgctttgggagcagatctgttgcaatccataatcaacaaggcacatcaaagggggatcttgtccatgcctatcccgatccctggtgatgataacttccccgtgattcagtatgcagatgacaccctcatctttatgcaggcctcggcccctcaacttcatgctcttaaagccttgttgaactcttttgctctctcttcaggcttgaaggttaattattccaagtcttgcatgattccattgaaactcacagaggataaagctcagatgtttgcttaaacttttggatgttctattggaactctgccatttacttacttggggctgcctcttggaaccaccaagccaaaagttatagactttgctccacttacagatagaattgagagaagactgacgctagttcagcttttctatcttatggtgatagactcacattggtgaattcggtcctctcattgctcccaacttattacatgtgttctctgtcattgccagtctcggtcattgattccatagatagagctagacgtcattgtctttggaggggaaatgaccttaattcatccaagaaatctcttgctgcttggtccaaagtttgtaggccaaaagacaaaggtggtctagaagttattgacctcaaagttcaaaaatagggctcttcttatgaagcatctgcataaattttataacagagcaaacattccttgggtcaacttgatctggttatcttattatggcaatgtgataccccaggttgctagaagctgtggctccttttggtgaaaaaaatggatataaaggatggttcaaagtgaaattttggtaataaaacatagcccaaagtggaatgaactcttttttttaaatagatctatagtttagaggcacatcaacttctcaaccacaccctagctagagtacacaatttggaatttacattgtgtaaccttgaatatattttatcatattatataatataattatgcaaaattaaatgtctgcttttaaagatcaatgcttttgatattttttatcggctttcgatcgatatcgacacgtttatgtccgtataatccgtttccgggtttccgatattttcaatatttttttgaaaggatcgatattttcaatattgtttccatctccaactttaccattttccaaaaaaaatatagttatggagatggttaagacgtttcacgaccgttttcacccctattctaaaaaggcaaattttggtataggacactgcttatatgtggttttagccttagcacactgcctaaactcacttttagggggaaacactccataaatgtgataatttgccagtggataccgcgccgattaaaataataatttccggttaaagaggagagagaaatcgtgtgaaatgtcaaaaatgccccttgggctcacatttcagctctatctcctatatctcttctcctcttcctgcccgcatgtcgcttcccgccggccgccggccatgcccgcacagacggcggcggaggcagcggcaagcagcagcagcaccccggccctccggcggcctaccagctacagtgcacggtggagcagctgcagccgctccttctccccgctgcctcgccacccccaccccctgcccctgcacttcctcccgccgtcggtcgacgcgagcgagccgtagctcccgcaccgcatccccaacgtctacgccgagccactcattgccaccgccgtagccgccgccgcccttctctcatcccaatcaccgaatcacaacaccgctgcggggcggtggctggcgcagcatgcaggccggcgaggcgatggctcgcagatccggcggcgcggagcggggcggtggcggatgacgacgacgatggtgacgagttcgaggaggaggaggacgcgtgaagctcatgcgcagcttctgccctcgccgcccgtgcaccgcttctcccccgccgttcggccccaaccgcaccgtcgcatccatggcagatgctgggtggcacaagattgtggcaacaacggtccctcctgccgtgcgatcacccgccgccggcgctctactccgcctgccacacgctcggccgacatcgccgctccgcctgcttcagccgccagctccgctccgccacagccgacgccctgctccactctgccggccgccatccttgccatctcctccgccgcgacgagctcaagccccggcgaccgacaccgccccatgcgcctcagagagagaacatatatagagagagagaggagaagagagacaggagatagagctgacatatgtgtccaagggcatttttgatatttcacgcgatttctctctcatcttcaaccagaaattattattttaattgacgcggtgtccactggcaaattaccacgtttatagagtgttttcccccaaaagtgagtttgggcagtgtcgtaggactaaaaccatacataagcagtattctgtagcaaaaattgccttctaaaaaatatcaaataaaataagttgttaactatagtaatcaagatctatcatttttttaattttgtagttgccaaaaaaaaaccaaaaagtattctgaattttaataagcatctatacactctgcgcacccaagttgcaagccaaactatttttttcatgaaatacgcacgcatgtgccgtgtataagatttgaacttgagacttcttagtctacacacatcatcactatcaactactatcagatacttgtgatgaggctcctctaacgtaccatagagggacatacgtttctgatgtgtgggtccatgaggttggtcccaccggttagggactcatatccctcggattttaagtcagaggagctgtgttttaaatacttattgtttagaattaagatgctattattttaacttcatatctcaaaatcttattgtgcttatttagtcacctaaataatcttgagtaaagaagtcatcaattacaaagttgatgtagctagccagagtttttgaacatgtaaaacaaggattcagaatatatatatctccttgcgaacccagccgcggccgcacggccgcacagagaggttattcgattacgcaaacatatcgatcttatcctcaaagatgatcttcccaagtcaaacgactcgatctcatgaaaacaaccagcaagactcgacccataatttttacatatatactccgtattactgtaattaacttgctgcatgccccctgcatgagaagccgataatatttttgtaaaagccatagggcaccgatcgatcagccgaggggcatgaaatttcttgcgcgaatcgtttactctagttattttaggtcctcgaccgagaacaaacgcgttgtcttgtaacatagaagaaattgacattggcacgccacttctcaaaacttgcatgcatgctactgtgcctatatatatggcccagcaaagcgaaagcaataccattaaaccaaaacactagctagcaacagcatagcactactgatgcatatataatagctaatcaaacactagtccgaagacgtagtatattctctccactgccaaatgcaacccctcctcctcctcttcctctctccggtggtcgtcctctcgtcgtcggcatggacggcccgtggtgaagatgaggcggtggcagtggcctcgccggaggtgaacccgctatactacaactgcagcctgtccggtggccgctacggtcaaaacaccacgtacgaggacaacctcaaggcgctggccgcgcggctcgtcggtgtggccagggtctccaacttcgcctcgcacaccgtcggcagcgcgccggacgcggcgtacggcatcgcgctctgccgcggcgactacaccggcgacgagtgcgccaacggcctccgcaaggcgttcgagaatgccgtcgagaaccgcctcttctgcgacaggttcagggacgccacgatctactacgaccagtacatgctccggttctccggcgaggacttccgggccaacctaacgaacgcgccggcgtgggtcgcgtggaacatgaacaacgtgaccggcgccggtggcgccgccaagttcggcggccgcgtcatggagctgatcaacaagaccgctgactacgcggcgtggcactcctccctgcagcgcgggtactgttgaatttataagcatataataatttaatttattccataaataaatcatgatattgtagatgtaaactagtataaatccatcattagatctacatatgtatactaggcagtaaagcatcaacagatcaaatatgcgtaatatattgaacacgtatcgagggtaccggaagactagttgctcagcaggaattactcacggttgcaggcgttgacgacggcgcgtagcacgtgagcaaagaggaagatgagtcgtcgtgaacgaacagggagtattcgtgcgaagcgcttcccaaaaaacttattgccgccttctccttgtgcaggatgtcgaaggtagagggtctcggcgcgcagcacgcgagtgaaaagaaagacgagtcgtcgtgaacgaataaggagcagttgcgtgaagcgcttcccaaaaaccttatttccgccttctcccagcggaggacatcgaagctctcccgatcgccgatgcacgccagtaagcgggatggagtagactacgagcgacagcgcgacacataggatgaggacgtcgaagctctcccgattgccggtgcacgccagcgagctggatggagtagactacaagaaacggcgcagtgcagaggaggaggcaaaccgccttctcccaatcgacggcgtagtacagaggaggcaaaccgccttctcccggtgcaggacgttattaagctggatggagtagactacgagcgacgacacagtatagaggaggaggccaaccgccttctcccggtgtaggacgttattatagagaggcctgctctcccgatcgccggtgcatgccggcgagctggatggagtagactacgagcgacgacgtagtacagaggaggaggcaaactgccttgagtgacgatgcagaggaggaggcaaaccgtcttctcccggtgcaggacgttattatagagaggagacctgctctcccgatcgccggtgcacgccggcgagctggatggagtagactacgagcgacggcgcagtacagaggaggaggcaaaccaccttctcccggtgcagcacgttattatagagatatcaggacagtgcagcacgttattatagagatatcaggacgccaaccggactccacgacggcgcagaggcaaaccgccttctcccggtgcaggacgttattatagagaggagacctgctctcctgatcgccggtacacactggcgagctggatggagtagactacgagcgacgacgcagtacagaggaggaggcaaaccaccttctcccgctgcagcatgttattatagagatatcaggacgccaaccgaactccacgacggcgcagaggaggaggcaaactgccttctcccggtgcagcacgttgttatagagatatcaggacgcctgagggatggcgcagaggagggtgcagtattatagagatatcaggacaccaaccgggcaatggtttcacgtcgtgcgcgcgccgccatgccatgccaggtgagcgagcgtgcgtgttccccctcttctctccacctcacacgcttcaagtgagtaggagggcatcatccccctttaaggaggtccccctctgctagaataagcaaatgtggtaactcccccatgcatgacatctaataaaggtggccttttgtgatttttcaaagatttaatttttgagtaggctaaaggccatctattaattcctacaggtacgcgacgggggaggccggttttggggagctggacgtgggtgaaaccagcgtcggcatggtggagcagcagtgcagcagtagccccgtcatgtacgcgctggtgcagtgcacgcctgacctcttgccggccgactgccggagctgcctggccggcatcgcctcgcagatgcccaggtggttcagtagcaacaccagttaccgcctcggcgggaggattctcggtgtccggtgcaacctgaggtacgaggtcgatcgcttcttcctagaaagcaacgagaccatcaagattcatatgccaaaaccgaaaggtactactacgcgcgtacgcgcgcccgccctttctatgcttgtctaatggcctctttttttttaaaaaaaaaactgccacaagtttttttttaatctaacttatagtataattgtaatataatttcactgtacctataatataatataatataacttgcatataagtattaaaataatatatttaactttatatctaacttatatagagattacaatgtggttacagtacaataacaacattttaattacaatgtaactatagtgtaattacattgtagttacactacaactataatatatatatatagttacatttgaaagtttttttaccaaaaatacttgcgacaattttttagcaattcttttttttaaacgcagtacaaacacataagctcgatcataacacgcgcataatcactcctataaacacacccatatgcaataacggagccaaaaaattctcaaatgtagggctcaatctatccatttattctatactaaaagtccattaaatttactacaaacactcataaatcactatgtgacgctcttacaaacggtcctacgccgccacgagacgctctaataaattagagaaaaccttataaatttcgagaaaaaaaaagaaaacccttgatttttatttaaatgaatgaacccattattttaaagcattagattacatttattaaaaaaatgcatcccacctaacctctccggaataaaaaaaaatcccatgtgatagtatgtataaatacgtaactacttactactcacggaaaaaacaacaaaaaaaatacgtgattacgattgaaaaaaagaagtattagtcctttcacctaattgctacgagagaaacatattcatacgcacttcaacaaaaaaaaaaactgaaaaagaatctcacgtgtacatataaatatgtactactattcacctaattgagaaaaaaacaaaaaaaaaatctcccgtgcacgtaaatagtacacaccgtcctaccctcctcaaatctttatacgtacaagaaaacatccaccgtataaaagtataaacttatctaaattagttgtatataggaaaagtattacaactacatttatattaactatcttataattatactgtctttctctcttttttaataattaatagtggtaactatactaatttatgaaccttggcactcctctttcccgtagaaaatttatagatatattaattatattttgattaaacaaatatcacatgaaaccaaattgtatcctcttcatgttattctcatccaaatagtcttataagtagtaaaaaaaaagtaaatttgacaacataggttattctatcattcgttaccccacaaacatttataactaatataactaatacaagagaaatatcacaacatgtattagctcatatgtgtctgaaggattagtgctcgagcaaatacttttttcacgtggttctcgccactaagtctgcagtattagattttttaagtggtagattgtaattaatacaagtaatgtgataatgtgattgaataaagtgccaaatttcccttaaaatcatatcaactgctatgttttgatttagaaaatactagtatgtttagtatcttattctagccctttaatttatatgttgtccaaatagctataaacaagttgtagattatgcaatcatacatatatttcctcagagatatacatgactgagttataataattgaatagtaatagtccatgctaacaaatatttcgaaacgaggttgtatttgacgacatatatcattccatcacatatatttccccacaaaatccatgaacatagctaagttagatctatagcatacagaagaaatatcaatacccacatcgactcatttgttcctgagagattgttggttgagcgaatattgttccacatagttctcggtaccatctaggctgattgattatttaggcaaattattggggatgactcccggtcgggcgcccgatcgggaaggggtaaaatcgggcgctgacgtcagcgttcgatttacgtgcaaaattattttaaactgatttatctcttaaattatttatccaaatcatgatctgattgcaccattaaattcgttgcaattaaatcttcaaaacaagaccacacatggatatattctgacaaaaattttttttagcttattattgacttatttttaaatgttgcatgatgttccaccagatatatcggaattgtttcactaagtagataaaaaatgtttcactcgtttaaatcgggtgttgtttcaccttatataaaaacaatgtttcagcaaatagcgaaagaatgtttcagttcactgcaacattagatctatacatatacatagtgaaacattgtgagtacactagatgaaacatttttcggtagaagaaaaaataaaccaaattcctttaatagaggtttccaaaatatgtaggtttttttgttgcaatggaatgtttcgttcatagcaacattagatctatatatagtgaaacattgtgagtacaataggtgaaacattttgggtggaacaaaaaatgaaccaaattctcttaatagagagtttccaaaatatgtgggttttttgttgtaaaagagtattttaattcactgcaacattagatctataaatagtgaaacattataaatacactaggtgaaacatcttttatagaaaaaaggggagcagaagtgggtaggcccaagtaagcacgtgggggagggggcgcggggggagcgcccgatccggctccccctgcgccgggcgaccggcaaagagcatttccgaaattattgggcaatatggttgaataaatttaagtaccgtccgtacacttttaactcttttactcttttaattagacttttctttatttgggccgttggggtctattaggctcatccacgctaatgaattaatggcttattttcattccgttaatgatcaagtagtttaaaccaatatgaggccttcatccaggtgaccctatgtccccttcttcgttgacaaaccttatggtattatattcatcctttgagttcttcaatttgtgatctacatataaaaactacaatttgtaagagctaaaagggtgaaaacacgtctcaaaaaaatgtttcaatgtacatggatgaatataacatactatataaatatataaatgtaggatcgaaacacaagaactaagccaaccagaggagggtgaatggtaggtatacccaaaaaccgaaaacttttagcggaaataaaagttaccctcaaattcgacggatcgtggtctaaccgaagttgtcctgtcagtctgatcgcctggttgccatcggtttgaccgagattagatctccggtctgaccgccgagatcagctgccgctcgctgtcgccgccgccagtctgaccgcccgtatgccgccggtctgaccgccagtgagtcgtcggttagaccgctgaaacccggtgaaacacaaatcgaagaactcttaaagtagatgacaactttattgattctctctgtgtttacaaagtgcaacaacagcactccttacaaaatctcgactaaactcgaaaccctaactaaactagcaactcaattgctcttaaaagcgataccaggaagcctcacgctccccctctatttatacatgaggtaggcagcctaaagccacgaaccaaactcatactagaagtcctaatccccataggaaaccctctagtacaagaaacaaactttatataaccaatcataccaaatttggactccttccaaattcgactccacatcccatacgcacacaatacctccatcgtatgccatatggaatcttcaccaaccacgtgcatcaactctagcctaagtatcccgcatgatatctgaccaccacggacatcgtcttaccaccaagccgattcccggtccatcaccgcaaatactctctcgaggcatcgagtcacctacacatgaaacaaacaaagaaaccatattccgagaccaagctatccccaacttgactcattgttagcaaacaacagtattacatacgtatagtatccatctagaagccataaccatgaaacaatcacggatatccaaagaaacaacccgaaaccgaaaccgacacagtgtcggccggtcagaccgcgggccggcctgtctgaccgctcaacacaagccggtctgaccagcaaccgcggcctggtctgaccggtcccgacaaaacaacaaaccctgttcaaattatatccaaaatcactttgacagtattctccaaatatcaaaaccaataatcacagatgccaattgttcatcacagaataagaaccaaaacacacattgatcttacaataaattacttcccccattttatattataggtcattttgactattattctagtcaaatttctttagatttgaacaaatttatagaaaaattaatagaaaaacatttacaacaaataatatatttgttttgtagtgaaaatattactatatttattttataaaactgggaaaacttgactgggaaaaaagttaaaattgcttgtaatataaaatagagagggtgattaatttgcacctacatgctataattctatcacattgcttgcatttgcaggttcattgagcgcagggaagatcgtcggaatcgtccttggagtagtagccttcgttattctaattttctccttgattatacttgcattgctcaaaagactaagagaaggtgtgattaagttgttgcgatggccttaattataataccgatctaattcttaagcaggttctgattttttacgtttaattaatatttccctgtgatttcgacctgtacatgtagtaattcaagagtcagaacggcaaaagaaactagcaaaacttgagactgagatcatagacgagattggaccgctcttttcacgctatactttacaacagataaaagaagctacacgtgatttctcaaatgaaatcggaaaaggaggttttggccatgtttacaaggtaatttgattagatgtaacgacatgtcttatctataaacatccaattgacctattatatactcccttttctgaatcttttgcagtaaatagctagcactgatccctccattcgacaatatgttcttttttacccgaatccactcaacaatatttgacattgggtggcattaagtttatttagtactcccagcatcaaatattgtcataatatcataaacttaccatattttatatacttactgtatataacttgtgaacaaagttgtataatttgaaggtgtgaaaagaattatgttaaattaatgttatatatttatatgacagcagggagtacaaattatcatgtggtcaaatgctaaactgtccggatatagtctcatctatactcttcttaggctgtgtttagtttctgaaattggggagaagtttgtggaaagttggtagtttgaaaaaaaaagttgagaatttatgtgtgtaggaaagttttggatatgatgtgatgtgatggaaagttgggagttaggggaaagtttggtgtgaactaaacacacccttaaaataaggcaatggtggtggcctcaccaagtatagtatttttttatttaccatctacccatcatgctttctactagctacccatgtacttttatgttataaaataacacatctacatatatatgattctatcatatttcacctgtacaatataacatctataggtacaaaattgtccaaaaaacctcactattaatttgttttaatccgtagtaaagcacgggcatttggctagcatgggtaaatagaatacgcttacgacgcagatgactagtaactgtgctaatcgcaaggatctgattattattgtttagacttaaatttggactgatgtactaaatttatgtgttttgccatcatatatttttagggtaaactaccaagcggaactgatgtagcagtaaaaagactcgcggtatcttcatctggccaaggttttgaccaatttatgaacgagattaaacttatggcaactcttcaacacaggaacctagttaggcttctaggtttctgcatccaaaacgaagaaaacatactcatctatgagtacatggagaacggaagcttggatgatgtgttttctggtatatatatcccaagttcccaacccttatattacgaaaagaaaaatccttataagatcatgtg

SEQ ID NO: 79087 - DNA, 10147 bp, Oryza sativa
ctagtcccacttgtttcattcgaaccctaatatatactccctccgtcccataatataagggattttgggtggatatgacacatcctaatacaatgaatatggacagacggtctatccagattcattgtattaggatgtgtcacatactcacatccatccaaaatcctttatattatgggacggagggagtattttctttttcatgatgtacacatattgcttagagagggtacagtacctgatactgtaccttgtaggcaactgaattttcacacgacaatattctgaacttaccaatgtttcaaaataaacggtcctgtgttttcttgtttgtagacttatggggctgtgggtttttagcacttcgcagtgagagctgttaagttaggattatgctgctcacaaaaatgcttaaaatatacttcaattagcagaatatatcctttgatgatggcaaaaccggcctggatgagaccaattacagtgatgtgtctgaaataacaaaaaaatggaagcagaagggtacggtgacaacttacacaccaaccaggccaacagagccattgaaagaattgcatagaggtacaattgctaaatggtgagcagtaacactccttgtgcgtgacaaacaaagctaaatttccctctgtttggtaactttggtttcaattcaagaacatacaattttttaggtgcaactgtggtaagcaaccagtgtgttcttttcctgcatcctagtgctaaggtatctttggaagcaccaaggttaacaaactgtcacttttaagtagctaactgaaaggattaaatgctaaatgacatcataattacagattatctgacatatatactaactgttttcggtgatgaactgatcgaaaatagaataggaaataaaacgacatttgaaaaatcaaccttatcatatatttaatttgtttctcttacatgatccttcctatttttaattactaaagatccatgtgttggacaacactggtgtgctatcatgccatgcagtgtgctgccatgggggatacttcctactttctaatatacccaactatcaacgtaagcatcaacttaaggttgaaagaaaataaaaattagaaaaagcagagggaaaaagggtccagttaacacggcaaaaacccatttttctcaaaataactgaacaggaaaacagctgttgaagcaacgagccatcacatgagacagtaaagctataagggcactagggcagcaagattaaaacaatccagttgctgcataaatagcaataacttaaactacagcagaaatcaatgggtatggaaaaatacaggaccatgaatgaacatcaagtactgatcctcagagcatgaagtgttaggtcagatataggcctgaaagataattaacctccaatatatccatccaaaaatgatatagttggacttcagcaggcaccttgccgaaatgaactccaacatctcagtctgaggatgtcaaggttgcagctcaggaggcactttcccagaacaaattgtggcataggcatcagcgagcccaggaacagcattcttgtgttgatcaatgtaccttgctacgaaatccttctcccgcagtatggcatatgttaaaaagccagcattttttatcaatcccttagccaaaaggacttctacaatataatgcctcggcatcaaccgcttctccaggctgcacgcgaacaaaacaggcttactcaaaatgtaatcaggctccaacccgactttggtgaccaaaaactctatctttctgcaaagattgttcacagaaagtcctagaatacttggcattttgtagaccataacacagatattgtcaatggagcatccaagagcgctactcaagaactttgtattgatgcgaagtttctcctcagaaattgctagaataaatggctctttgcaaaccatatgaccgatcttgtccacgcagcaattaagggtgctactcaagaactcaatcttactgcgaagcttttcctcagaaagtgttataatagttggcattttgccgaccatatactcgaccttgtccatggagcaattaagagtgctactcaagtacttcatcctcgcagatgcattgccttcggtgatgttgccagcaatagacagcatgtactttaatctactggaggcgagctcgacaccaagcttgccagtacgctccacagccgcttccacccgctttggattgaacgtgaacagccatccgggcatcttgacaatatctcgaacagttagcccgctctcctggaacagcgcgatgttgggcttgatcaccttctcaacatcagctctgacaattgcgttgttcctcctcaacatcttgagaagcgtctcgaaggatccccccaagaaggggatccagaactccagccgctcggcgacatcgcatttgcggacggccatcgcgccgccggcgaggaggaacctgccgatttgagggtccgacaagcccacgcggtcgcgcagagacgtgacgcggcgggagacgttgtcgggcctggcgcagaggaggtgcgggtcggaggcgacgacggcggcgaggtcggcgcgggagaggccgacgccggagaggacggcgagcacggcgtccgggttggcggcggacctgaggtgggagatcttcttggacgccttgagcgcctggtcgccggtgaggccgcaggtggcgacgaggtagtcctcggcggagaagggggtcgcggtggcggcggcggcggtggagagaggaaggcggaggcggcgcagatgggcgtagtaggaggcggaggcatggggggaggaggggacgcggagcagcgggaggaggcgtctccggaggtggagcatggcgccgcggcggaacgccgccgtcgaggtcggcggcgggggttttgcccggcggggtacaagatggactctttctttcttttcttttctttttttttaaaaaaagtgcgcgatccaacggcccgactcatgatctcgtatacggatcgacggttgttatagttacatatgtctctagttatatagtttatgagttgcagaactgtatcatatgtttagtagtataaaaaaaatagatttatcacacgattcatacgcttttcttaacggaaaattttactaccgagcatcgtgacttcgtgattttaactctaaaacactgcacaaagtgaatttgagagaatcgactcgataaacatggaaattagctcatggaaactgcacccattaaaatatttatttctagccgggtatgagagagaactcgtataaagaaatacctttgagctcacgtatatggtctttcagtctttcggtctttcatctatgtatctcgctcaagcatatatggcactgtatgtaagcctttagtttttttttccccttctacctcacatgctcctcttgctactctcaatctcgcaagaggacggggcgaggcaaggcttgatggtggcaatagggtaagaagatgtggaggctgatcgttcaagtgttatcctctccatctctttgcatccacctccgaatcatcacttttctagttgcggcgcgtggagggccacaccatcacggaggaacgatgccgtgaggccaggatgaaggatgcatcgtgcggctgttgacagaaaacacgaggcctgggagatctgcttaactccagtgcaggtccaaaactcgccttcggatgtataagtgtgccagttgatttgatcctgtaatcaacaagaaataaaaacaaaagaaccgtggttaaatctataaatgatagccgatcggccagatgccgatgacatatcatttacgtttgagccgatgtcatgtatagatcgatcggcgtttggaaataaataaaaaaggactaaatctattcgatcggctgtagatgttaacgatgtataattcttatgtcgacatatactttaaattaagtgattgggatagatcggtcgccatgccgagacggtataaatcacttaagctgaaatatatgttaataacagaattatatatgtttacagcataaccgatcagatagatccagcatgcatcagctaatactccgatgcaactctatgctaagatattaaaacaaacggaatataccaaacagaagcttaatatacgtgagtgcaataatatcttgacatgaagggcagatttaacatatcaataaagtatatggagcaaacatagttaaatcagataagatcggctgaaactccgatgctaccctaatcggcaaccagaaagcaggctagagattgatattctaaacacgacttaatagatcaaattcaactgatgcagcattaagtatgaaaagaagaacaatatctagacaatcaagccaccggaagtttcatagagtggtagatatcttatataatccaaatcaacagcaagatctaacctgatcgactgccttttgtatgcaaatgttagccgatagtagattaaatagagatattgctaaggattatgtaagatatatgataacttggcgaattatataaacgagattagagtgtcatgaagatgtaagcactaatctatgagaacataattcgtcataacgagtttacctcttgttgaagatcgacaccgatgcagctcaacccgaaagcaagaactcgttgaaatagaataaaagtaaaaggtggcgatgcgccggaattgtattgaatgtgtgtctttaattacatagggttcggggtctatttatacccgaagattacaagatatgcccataccggccatgaccattatctctaacaaacttctaaaatatcacgagtctttgcggcagactcttgcccacacttatctataaggaatttacataaataatctaattaatagatacaattgccttctcagaactctatccatacatggcaatcatcttgaagcacatcaacccgagcccgatgtcgcgcacaagtcgcattactagaatcggctataccaacttactcagcctagctcaaccttagccgatcctagccgtagccgatccagactctagccaattcttgctctgttccagaactcgatctccgcctccaactcttctctgattaattcccttttcctgatacgaatacttaccaaatttggttgtcaacagcggcgtggagggagtggcaacctgtggctgagtcacgccaccatgaaggctaggatggagggagcggcgtgcagtgctgagggttgcgtcatcgcggaggagcaatgactcatggaggccgcgatagagggagtggcatcgccgcaacaacgtatcatggtgcccttaatcaatcgtcgacactgacaagctccttgaaaaccgtgtcattttaccatgctcctccggcatggccactaatctcctcggccgccctaacgacagcatgtccacacatcccattgtgtttggaatggctggcatctacatctccttcccctaacgccgccacccatggttgaccaccatcgagctcaccgcacctcgccccagcctcctgtaggagtgagagaaagaggaagtagaaggggaaaaaatactggaagctagcccatgtgcttgagagagacaaagatagagatgaaagacctgacatgtggacctggggggtattttagaactttcacgtgatttctctctcctattcaaccacaaatgaatattctaatgggcaagttgtccatgagctaatttccacatttatagagtgatttcccctaaaagtcacttcgtacggtgtcctacagttaacaccgcgaaagtcacgattcctgtagtgttgggatgcgaattctttcgttctgtgtccctgccgtctccatctaacagctcatccctcagatgccattgtgtgtcaggccgtcccaagtgactgtagccctctgccccaatcaccaacttgatcaccgtactcacaactgtgaggcactgctcttcaccatcgaggacgtccatctcatctcctacatcattgctatcatcaccaacaaacatatgcaagaaggagctcatgttggggttgtccataccgtactagctcaagccgccgtcaatggctcctaaattcaactcgccacctatcttagtctcagctttgcctcttcctcgctttcctcccggtggcagccccactacacgccactgtgcctcgttgcagtcacacacttgtatcattgccacacatttccttgccaccgacggtctgatctgttagctgtgcttgcactttcactgggatgcaaacgacaacgtcgtgccgtggaagagacccgcccggccaccacgttgcctcattgcctgctaccaccaatgaggctatctctcattgtgcacaccttgccaaggcaggggttgagagttgaggctgcctcgcgatgggcttgcatctagcgcgaggcaacaaagtgggacaatctcattgacgtcctcttagcaggcggccacgtgcgcggccgacaatgtccgcctacacggtgtgaatttatatctttggtgataatttttaaaaagttagtgaattggattgcaaatttcggaatgtcatgaagcttgaaattttcaagagcccctaaatgaagggtaaaatatgtgcttgtcaattatcctagctagtataaacataatagggttaaaaaaaaggagcactacccataatccataaacttccccaaacacaaacaaatcacgccgccggcggctctgctcaccgccagccgccttccaccgccttcgccatgcttcactttcgagaactcctcccgctcctccgctccgccatcgccgccgtggcctctaaccctgccagccacacactaccctctctccacctccgcaccctccgcttatggactccgcaactgcgacatcgcatcgaggctcgagttcttgatccctttgttgggctcctacgaggtgcttctcaagaccgtcaagcgaagctaccgcatcctcacctccgacatagaggaggtcatcaagcccaacttcgcgcagctccaggagtgcgggctaactgtttgtgatattgtcaagaccaacccgaggctgctctcgttcaatccagagcgaatcaagcgctatgtgcatcgtgccgatatgcttggcgtgccccgttgctcgccggcattcaggatggccgtgtgctctaccaatgaaggcagcgtcactgcgaggatggagttcttgagcaggactcttggttgctccatggacaatatccttatcgcggttggcaagaggccaactattcttggcctatcaatggataatcttcgccgcaagatagagttcttggtgactgaggttggcttaaagctagagtgcattgtggagtgccttgggattctcaggtacagccttgagaagcgtatggtgccacggcattctgtcatggagatactgcgggcgagggggttgatgaagaaaggtgcttccttatatggtttaatcatgcaaggtgaggccgatttcgttgcgagatacattgatactcataaggacatggttcatgggcttgcagatgcttacaatgcatcttgttttgggaaaatgcctgtagtgccggattccactgttaaaaagagacacgggaggcgagatatatattgcaggggtaaggttagtatcgggccttagcatctgatgcttacttagatatcaattcatggtggattctcacttctgtgtcagtcgacttccatggtagaactgtaggtgatctaagttctgatatggtgatccatgcttcaaccatcgatatgtgcaaagcagatgagctgtcttgatctgttccctgcacatatcatgtcttattgctttagcacttgagctgacagtgttcaagttgtattaggctattagctttcctttttcatatcctacttgaccaaactcttgtttacatttcaagagattggccttaagaacatcgaattaccattttgaagttcattatgttgaaggaacattcaagaggttgctctgctctgggatcagccaccacctagtttcatggtttcacgcctatgtaacatacattaacctgtcaattatatttgactattttggttaggatttgctatgtttgaaatttggaacctcctgagttacatgcttgacaattacacttgtaggtcggctttacatctagcagacactcttttggagttttctgagttgcaacagtgatagaatgtatgagctcttggactgctttcttgttgtaactttgcaaaaaaagcaaggtgaataaatttcagacattatattttctcgaagtgcatataagattacaaatggtaggatccatacggaacatgcatacatttggagataggagaggagaaatgaggaggacgaggaagactagggggcaattttgatatttcactccgtgctgtggtaaaagagtgaaattgtaatgatgtttgcgatacaaagccaaacaactttgtgacttttaaagaaggaaaacgttcgaattaccctctgaactattgcagcagtacaagttactgcttaatctaaaaaacggatacttgacacctctaacttttcaaaccggataaataaccccctggtacttttaggcggttttagctagagctagcacacatgacaccaacgtggcaaaccaatcaaaaaatctataggacccactcgtcatatctctcacccatctctttctctctgttgtgtcttgcgatgaatttggagcggcgcctcatcgatcctgcccattggagctcgagcttgcttggggaggtccccaaagggtagcggcgaggaggcctttggaggtgttggctgggggtgagctcgagcactccttagggaggtggtacttgatcactccttggtgtggtgggcagtggttggagattgaggaggtgacacgctactgccgaggagcctaggaaggggaacttgggttcatgtgtggtggccggttataggggcttgttagctccccttctcctcgaggtggtccaactgtgagaactcaaggatgtggagctagagacgagagtactagttgacaatggcgggcgaggggagacgaacctaggtgcagatctagagcggaagagcattgaccatcacttccgaccaatgtctccattgacctccccaagtgagctcaagcatggcaagcgatattggcgagttgttgcctccatggacctccccgagcaagatcgagctgccgttccgagtagccgcctacatcaccctttatgaaagctcaagcttcgccttcaacgccctcctgagaagccccttcctcgccaccgcccactgcgcccacaacacccttgcgccaatacagagtggggtgatgaggctaataggtgggccctatgatttttaaaactccattactgattggattgtcacattagcgttaagtatgactgaaacctcttcgattgagtcagcgcatattttgtccggtttgagaaggttagaatgtgaaatgtctacttgtacagtgggtataattcaaatgtaccaacattttaggggtaatgcgggggtattttttccttgaagtatgctgaaaaacatttaaaaaaacaaaattacaggtccaagagaaatgaccggtctcccatatttaggggtagggggtggttagatccaggggtgtaaagttttagcgtgtcacatcgggtattataaaggttgtcgtatagggtgttagggcactaataaaaaacctaattacagaatccgtcggtaaaccgcgagacgaatttattaatccgtcattagtaaatgtttattatagcaccagtcaaatcatggagcaattagccttaaaagattgggtgaatagccaatgtggtccctgaagttttgcttcgggctcagtttagtccttgaggtttcaaatcatccaaacaagtcctccaaattaatcatttgggttaatatagtccttggacccacaaaaaagtaccacgtgagcatgccaagtcatcctcacatgtagcggtatgaatgaaatgatcattctacccttatataccatatagaaaagaaaaaaatcacaaacagaaaaaaataacaggccagcggcaatcgtaagtgacaattctaaaatgatcataca

SEQ ID NO: 79088 - DNA, 14257 bp, Oryza sativa
ttttttctttcttttctatgtggtatataagggtagaatggtcatttcattcataccgttgcatgtgaggatgacttggcatgctcacgtgacactttttgtgggtctaaggactatattaacccaaatgattaatttggaggacttgtttggacgatttgaaacttcaaggactaaactgagcccaaagagaaacttcagggaccatattagctattcaccctaaaagatttatctcgcaaattagtcacaatttgtaccattaattatttttagcttatatttaatacttatatacgtattaaaagttggatgcgacaggccgaaaaactttggggtggtatttaaacagggctagcgaaagatcggtttgactgctcctagcggctctctctctctctctctctctcccctcttttttaagcagccgcctttccccggcggccggcggccggcgacgccatgctccacctccggcagtgcctcctcccgctgctccgcgccgccgccgccgcccatccccacacctccgccgcatcctcctcctctctccacctcagccgccgcctcttctccaccgccgccgggcccgacaccgcgccccccttctccgtcgaggagtacctcgtcgccacctgcggcctcacgggcgcccaggcgctcaaagcgtccaagaagctctcccacctcaggtcgcccgccaagcccgacgccgtgctcgccgtcctctccggcgtcggcctctcccgcgccgacctcgccgccgtggtcgccgccgacccgatgctgctctgcgccagggcgcgcaacgtcgcccgccggctgcattcgctccgcgaccgcgtcggtctgtccgatgccgacgtcgcccgtttcctcctcgccggcggcgcaatgggcctccgcaaatgcgacatcgccccgaggctcgagttctggatcggcttcgtcggatcgttcgacaagctcctaccggcactgaaggggaacaacggaatcctcatgagtgacctggacaaggtcgtgaagccgaacatcgcgctgctccaggagtgcgggctaagtgtttgtgaaattgccaagctgtctacgctcaagtggacggtgctgtcgttgagtccagagcgagtcaaggcgtcggtgctgtgcgtcgagaagttggtcgtgccccgctcctcggatcggttcaagcacgtgctcaagtccgcctgttggatctccgaagatatgctcgccatgaaaatggagttcttgaggagcactcttggttgctccgaggacaagctccgtgccgcggtctgcatttcgccacatattttctacctgtccgacaagaacctttgccgaaagatagacttcctgatctccgaggttggcttggagcgtgagttcattgtggaaaggccttgggtgctcggctacagcctcgagaagcgtatggtgccacggcattctgtcatgaagatcctgaggaccatgggattgatgaaggatgctgttgacttcagcagttcacttgtttactctgagaaaaaattcgttgcaagatacattgatccttacaagcaagcagctcccacgctcgcagattcctacgctgctgcttgtgccgggaaaatgcctgctcatgttcaccgttgaatgtagattttcccaggttcgtcctttatctgatgctaattgctagcattgtgccttatgttgttatgctcatcactaaatgtttattcatggcaaattaaatattggcttttatccgtagaactaatggtcatccggagtactcataatgtgatcttctctttatgtttcaatcttggatatctgtatctcatgttatgttgctttcttttacttgagaagcagcgattgagcagtatcattaatatatgtaactcttctagcattttctgcttcctaaggatgtgccctgtttttaatcagatattggctttccttattgtgattatctgcacggttgtgggcttttggcatgggtaatttatatagggatgggacattccatcagactatcatgtagagctggtatttaccgaatcatcatataaagctggtagctaaacataaattaaatatttatgcttgatgacaaactgatgtagtgctgtacagattttgaaaggctaggagctaagaatgactaatgttgctaacttgctatcaacaacaacgtgggaatcctttaacctgttgagtcttgtaatatcattcctcaaaatattccttctgttacaattttgtcctaattactacaggtgggggattattttcgtgtttattttcctccaaagacccaatttgaaaattcagttattagttgatggccccttctgttggtggcaatgtggaaataacacttccaatattatatttgaaaaacccattcttggtggcaatgtggaaataacacttccagtattatatttgttccattatctacttttcttctgttgaactgttaattgcttaaactctcttttacattatttctctaatccaatgtggtcttaatagtttccattgttcatctctaatctttttggaaacatgaaaagaatcgatcaaactaaatatatagtaatggtcagttaagtgaatataaacatgtggcaagctgtttgaacgaggtaactcattcatccatttcaagatgctttcaaggaacctcaagatacttggctgacattataacttttcatcgacattgtttgtaccttctttttgtgcgtgtattttgttgtgagatgattttttttgaattgttcataaccatttagataacatacaggaaacgagtgcatgtgcacttaagttataaattgacttcccccttggtttttttttctatacatgtagcattatacatcttgtttcttcaggttgctgctaatatcttgtgctgttttttgaggcgggctacagaggaggcaagcttgtaggtataccttatcgtatgtgttacacaaatttaggctgttctcattcgaaggttggttatctgttgcatgaactgcagaaaccttccaagatgaccaagcatgtaacatttgatcgttttgctacctaggatgcatgtttgatgataaatatgatagcaagttccttgatcaagaaaagaaaaacaacaagaagaaagcaagttggggggccatgcatcaactgttgtggtgaaatgatgttcctgtatttttctccccattatctgataagtaaagagtataataaaaaaaaattgtgatggaagatttgacaatctgtctgaaatcttggtgtgaaatattcatgggctccaaattcaaccttggaataccattacgtttttcctaaaatcaggttatcagattttcgaaatgtctgagttgatgtggatttttttaattcatattaatattaggcaactatgtgatagcataatgcaataaaaaatataatttgaaacaactgtaatggagacattttgaagatgtcgctgtgtaaagccccaacgataaagttattgttgcacgtaaaaccaacaacttttcagttcatgatatatgaaaattattcgcctcaaaactgtgggttggcagaatatagaacacattgttaaaacactactgtaactgtttgtcaacgttcaacaatctctcaaaattttcaaattgaagtacaaatttatgaggaaagagtgtgcagatcccactccttccaaaaaataaaaaataaaaacaccccgctctagaaaagacaatgaaaaacaggcataaacaaatatgcgaacgtatgggccgtatttgcacaacttacagggctagtttgatttggagccaatttaacgtatgggccgtatttgcacaacttacagggctagtttgatttggagccaatttttgccctaccaaaatcttggtagcgctaaaacattagcaaattttggcactaccaaattgggtagtattcaatttgaactattgtgagtaaaatttggtagcaaaccaaaatatgcacttgctactccctttatcctataatataagatatggtcaaacgtgacatggtctccaaaactaatttttatcttataatttcttatatattataagttttgtagtaaaaaagttataatcatatgaaagtaaattcaaatgtcaattcaatgatataattcttagcaagtaaaattaaattcatattgtaataaatgttggtcaaaatgtttttaaggttaaatcttaaaattcatggtagcattatattttgggatggagagagtactattgaagttaccaaatttttttttgggagagtaataaattggtatcaaaccaatcaagcccatagttttgctttactgcgataatctaaaatgttgcgtcatggccaatttgatgaatttatacaggaaataaaactttccgtcaaactatgatgttcacctgttgtttgccaaatcattgtgtaaagtcaatagctaaacataaaccaaagttttatacttggtacctgatgttgcgctgctggagattttctgaggctaggaactaagaatgatagtgtcccccataaacagcaacctggggatcttttaattatcacctttttgacatgtattaaataaatcaaggaacatagcaggaagataccctttactaacctactatggagtcttgtagtatcaccctcacgaaaaggggagctaataagcgcacgattcttgatgccttatttgatattctgatgatgcatggatttcttacattcagatcgctctttccgttggtgtccttgtacgtaccatgtcgatttccttgctttgtgggacgctttctccacgacattcttgcatccaggaataccagatgtgccctccttggtagccttctagtttagggcagtacactgccaagtcggcttatgatgctctctttcaggggcaacttattttaggtccttgcctccttggggatgcatttggaaaagctgggctcctggaatgtgtagtttcttcatgttgctatgttgtgcaccgcggatcgtttggaacattgaggttttccgcatcctgattgttgactttaattattttagataatggatttttattaatccggtctctgtatccatggacatacataacaaaaaaaatataagagcacttagactcacacctcgataatgaggagaacacataactaaaaaaaataaaaacctacgacctcggcacatccctgctacccgacattctctcctgaaacgactagattcggagagtggaagttgtctagtcaccgtcgtgctgcccctaatccgtcgtcgttgtgaacctccgctagtaccatcttcatccactttaggcgagctgacgtcacacgccgctggttagcccaccttcatatatcgtcgtctagtcagaactagccgaccagacatgagccgccgggatccacttccgtttcgtgggattcctaggcctctgttgcctatagggccaccgtcatcgttgggatcctctttcgcctcccaaactcccagtccgttgtcacccctagggccaccgccaccgccagggtccacatttcttggaaaaaaaactcagtcctctgccgcccacactcccagtcgtttaatgtaatcattttgtaaacaaaaatctaataaaagctcttacaacaaaaatctcgaaacattaaatgtaatcaattggtagttacagaaaaaccaacatgcaatccaactgtgccacgttactgtaagtaaaagaaattttgtaaacaattattttattacttgcatcattttcctatttgcactgaggtggtgtttagatccaggaacttaactttagtccctgtctttagacactaatttagagtattaaatatagactacataaaactaattacataaatgaaagctaattcacgagacaaattttttaagcctaattaatccataattagagaatgtttactgtagcatcacataggctaatcatggattagttaggctcaatagattcgtctcgcgaattagtccaagattatggatgggttttattaatagtctacgtttaatatttataattaatattcaaacatccgatgtgataggaacttaaaagttttagtccaatctaaacagggcctgaaggttgaattcacaactgctttcgaagttgcagatgacaactagtagtcttgaatgtggatgtcaatttatttttctcaacccgacagaacagctgaactgctacatgattttacagctagtgtagctaaggttagttcaccaaacaatatggccactatcatccacacttttgctttttacctttttactggtacaaatcacaaacatatcacacaactttttctttctttctttgtacatttgtttcgaaaaaaattagtacaggctagcgcaacaacaggaccaacggatcctattctcttcaggtgatgaacagcaacaatttcgatcaggataacctgtaaaatcaatatacaaccatatccaatgttttctgtaccaattcggcgaaaggaaccgggcactctttcgccgggttgcaaagaattcgatttcagcagccaatgtcgaattcattctgctcggatgaaaggagaggagctcatttccgtggtgctgtagaacgagtcttccccgccgccatacaagttctcctctttctcatcctcccaccggaggatctccctcacgtacttgaacgcctcgtcgaccgtctggcggtcacgggcacgcgcctgccacacgaagagcttccggcccgtgtgctcgtagtacaggtccttgaacttcaccgctacgtagtagtacgcctgctgggcgagcgactggttgttgtggtgtgtccgcaccggggagaagtcgttgaaccactcgcaggtcgttagaggtgcgcggttgatcttctcctcaaagaggtcatacttgttgagtaccaggacgaaaggagtatcgcagaagcatggttgcctgattgtcaaacagcagggaatatttaattaaaaactagctgactagttcaacagaatccattcgagaacagtttcccatttaattattgcattacccacaacattattgccacatcgttcttgactcagttactatatccgaaatcatggagttgaaataaacttaattgttgtactagttctagaaaaacttgattatgatactggaattattacttcatccagtatttgtgaggttaagaattgccagatgcaggagtggagaaaagacaaactgtactatagagaaatgtaccctaaaagttcttagttttcaatgaaaaatagcagcttaccgaatcgtagcctcaaataactctttgctttgcatcatcttgttcaagagaggccgactgctgccatatacaggaggtcccacttggtcatagtcactgagggctacagagaatatcaccatgcggacatcctcaaacatttccacccacttgcagccatcattcatgcccttggcacttactctaatcaactgatatctgaggagcaaaacatataagaacattaagtgcacatggctgagatcgatttgcacatggcatgaagttaagagattacttggtaagaggctgggaatgtgcttcagggttctcaatgtaaggctcagacatgggactgcgatcatcaagggcgaattcaatgaaagccaacccattcccttgtgttacaccttcagcaaagatcacatctttctctgaaggttcatactcattgctcgatacctcaatggcctgcaaaggtattccatgtataggagaagtcagttgaacagcttgaaataaaaataaagttaactgcacatgacaaaaagtagttttgccaacatcaaaacagcaacaatgaagaataacacgtaatactgcaagataatggggggaacataattttggtttcagtaatatttgaaactggggaagggatttccttcctagcttcaaaaaacaacaaagcaaggagataagcaatccttgaaatattcaaagatggcatcaccagaaagaatagatacagttttctggatgagccaagctgttaccattgtaaataaataaagaagacaagcatatgttctggactagtaatcttttttgtaacaaatagtggtaatcaaacaaatatacttcaatgtgaataatgaagcaccatctctagcaacagtggattatattaataaaaaaaatcaaagatcgtaccctgctcaagaagtactcagcaacatcaggaaggaaatgcaattcgtcctttcttttatatgttgcttgtatggcaggatccttccacatctcatcaacaaatggagcgtattctcgcgttgcggcagggaagaaagcatctagatcgcccatcgctatgatatccaaaagccaatctgagaatttcttcagccttggatttatcgagtatatacaggaatttgaaccatttgctttattttcatctgcagcccagaaaccagttcagcaatacagaattgctgcagaaacaaacaccggagcaaatgaattgaccattttaccttgttgggtttcttcatcctctgaaattgtgcaatttgatctagataaagcttcttcctcaaagcgttcacgaccctcaagcaaaattccaaggtacttgaacatattgctttggataatcagtttgatgttttcaagttcttcttgggtgaatcttgtcccgtacaagtacttagcctggtacatgatacccaaaacatcatcagcatgaccatacaagaattagtatcttagaaaaattgcaggcactactaccaggtagatacaacaaaactactactgagagtcgataatgatgtgtcagaaatcaataaaaacttccaagttttatgctaagaacacaagtccggtggctattggctacaacataaaaacaactcatgccatctctgctctgtgggaagtatctgaagcacacaaacataggtcgccagctacaattaattgatttctacatcgctcaaaagtattactacataacaaagtaatctcatacagatccagttacagtgaattacagagagatagagaccaatcaaatagcaatgaaaatcataagagacctgtttaaaaattgtgcttgtaccagcaccatctggtccaagaagcagcagcttttggattcttttctggtccaaataatcaggaacagttcttgcagaatagtgaacttcatctctcgtttcattagagttcccaggaggcaccggaagtgaaaataatgcgcatgcaaaacgtgtcaaagcctgggaataaaatgatcattagcaacaagcaaatttagcttttaagtttgaggaaatggcaacggactctaatttattttttaaccgagatacataccgactcccagatttttcctttgatgttgttctgtccttcttcctcatagcgaccatcatcataaacccaaaaatgagtatcacgaggacattgaacatttgcaacctacaagcacaattccaatgatgtgacaagcattgcttattttgtggtaaaagaaatctttaaatcttggccattgattcaagggcccagtttagctaaaagaaagcattcaccactagtgccatttagtagcccttgctaacaggaacttctggtcgatgaactaaatagcctgatgtgtaatccttttccattatctaacaaataatagcatgctatctggaatgacaaacccactgcatttagtgaaacttcctaatttgtctaagctgtgaaaaggattacatttagtgaaacttacaaataatagtaagcatgaaaggtgagacttttctcaaaaacgaaggttatggttataccaaaagtgaccattttttgcatatttatagtataattaattggcaagttatgttacagttaatggttgggtatttttattttgaatatttcaaattatataaaataccccttccaagtgtagtggttcatgacctatataaataactgtgtcaaaggtactaagcaattgggaggcactaattttatcattcatgcttttcaccaaaaggactatctacaagcagcttggaagaataaagcatgatcggctaatagcgagaagcagttctaaagaaacagagatggaaatcattggtacctttagaattttcagctcaatctttgttatttcccttccatttatataaacttgggtatttccgttactggcgttagcctgaagcttcccagtaaagctgaggttagaactaataattctttccggtttttctccttcctatcagaacaaaacagttttatcagcacaaaatcctgttaaacttataacaagaaaattgtgtccgtatgctcataatgaatttacctttccccataaacctgactccttgtcataccaatactttccaggcttcagcttctgaggtggccgggagcaactaagcaggtctgtcagctcatctggccccagtggacaaccattcacaataagttgctccggccgaagctggtttgcttggcactccttctcggctttcaatatttgccttacttccaaggggctaagtaaccttgagagtgtccttgagttcttccctagctttgaccgcttggactcatcaattggctggccaatgcaagtgacgcacttgcgcccttccggcatcgaccccatcatcctcagcacacagtagccgcagtacctcgcatcgcacacgatgcacgcttccttgctctcccatttcctcttcccacaccgatagcacgccctcctcctcttctccttcttggtcaccaccacgtactgctcggacatctcctcgaactccttgctctcacacttgctgtccggcgtgaacccgaacgtcaccgtggcgcctctcctcccctcctgcgtccggcggctcctatcctgcggccccggcgagctctgcgctgaatcatgcgacaacgagcgggaatcatcatcatcatcgtcaaactcctcattctgcagtaccgaattgaccgaatccgagctgccgccgccgacctgcgccgacacgggctcggcgcaccgggcaatccgggacactgggagcgggatgggctccacaaccggcaaccctcctccgttcccaagcctctgcgggccggacaccggctccgccgtggggatctcgacggggtccaccctaggtaggtcataggccaccggtgggccgtcgtactctagggctatggagtaatcgagattcggcggcgcctccgggatgggggaccccggcgggaggatcctcctcagcatgtcctcccagctgcccccatccaccgcctccgccatagctgattgatagctcctagtactgcctcgttgagggatggagagctgacaaggttgaatctttccggaggggaagcgaatcgggggaatcaaaatccaatctttccaccaccaaactgaccttttcagagaggagaagaaagctcatttcacggtaatccaaacccgcggctgcgaaatgagggcggcggagggtggatctggaggaggaggaggaagaagggaagaagggagaagaggagaggagaacgtggaggtagcaggagaggagagcagttagcagtatgcctagttgcctaccaaaacccactttaccaaaacagcagtaaaaatttcacctttttttttgtttgtttgttcctagtactaaccaaattaacctgagttgatggattgattgatcaaagctgttgttgtatataaaagggagatatgagaccatgagacgaagggagggctcgctattagagcgagtataataagatgatgtaacaacggggagctaggagttagagttactatattgttaaatttgtttttaggctgtgtttagattggcccaaagtttagaatttggttgaaattggagacgatatgattgaaaagttgtatatgtatgaaaggtttgatgtgatagaaagttggaagtttggaaaaaaaaactttggaactaaacatacccttaatggtgtaactgcgacgataactttattatgagtttatgataggggtgtcttttcaggtacggtgagtaaaaatggttagattagattttcagtttagatgacagcgtgagagagtagataagcggtgagttagaaggattacaatgagaacaaaaaatctagcaaaatgagtgggggcgatagatgatgagtatggtcggtgataaggacaagagagacaatatggttaggagcacgggatggcgtggcggatccgattacgtaagccatctaaggcaaggcgagataaaactcactaaagttgataaaaaggatggtgatgacaacatagaggagaatgaaaaggagagtaaagggagaaaggcagagaagggtgtagttagaggggtacaccaatgctgacgtgtggaggtaaagtttttcgtcatgataccgttagagcaaatgatgtcatgagatgggatcaagaagagggaacgataggctaggcataggtggttgcactagcacacaacttgataacaacataatttgagcatttttaaataacaaatagattattataaatcaagaaattagcaataaataaacatgtaatattttattcatattttgtcacataatttaacatgtatctaaaacatctctagaatggttgtcgtgttaggttgatgaacgtaacttatttatttgttaacatgcaaaatattgtagggaatttattttcagatatgctaaccgtcataaaagaaatttagaaatttaccatatatatttaaaaatcaattcatttcaagatttgtgtttggatcttcttatgcaactttattgacgttatcgactaaagatctcattgcgttaagtctttgccaagttaatgtagaaaaacagaagagggtcacaaaccttaagggtagatgttggtatgaggtggtgattgttggtttcaggatatcacaacctcctctataattgtaggaaagaatggtctattaaaacgatagagaagaagcattgctccttgttgatgccgatggtgacactggtaaggagctcgatggtggtaagtagagagagggaggtgttgtgtggagggtttagtattgatttataaactatccctaaagaaattatcttctgagtattagatgtaatacgtaaagggtgtatcaaaattttctgcatagaaggaagagcaacaaataaagatggcaagaatgacaaccatgttcgatgagccaatagtcggtttcaaggtaaccactaactattgttgtggtaatggcaattgtatctattttatcatattagattagcttctgtaaatgaattgttgtgctgacacaccagtattaattataatggacgtgttaaattattcatataagacacgtaaactttccaaatacatctgtcaccacacatgaaaataacaaaagaaatcgaatatctaatggacaattaagtactaatagataagaagaaatatttgaagactaaaaaaaatgctcgtgcgttacaatgggtaaatgctattttaattttattattgttatacggtctcgctagggtaaaattcattgtgggaattctcttgaatattttttttagaaaatcatgagctgcaattaggagtctgtatttcatctcaagttagcatgagtttttttaaaagagatttcttatacggctccttttgtatttccaaaagcaaacaagcttaaaatccaactcaaacacggatatgtatttgtaaaagcgaataaacttaaaaactaactcaaacacagatgacgtactaaaataccgataaaaacatcttcaatttttgtaacggtagaaacacagacaacgtactaaaataccgataaaaacatcttcaatttttgtaacggtagagaagagatatggtgtgtagtaaaccaaacttgcaaggaaccatgaaacactgttccaactcataaggagcacggtcagagaaggttattgggccaggccagcaaaaattaggcccatcgtccgatcgagctgggagctgggcctatgcgcccacactgcatgcaagtccccaaatgggcctgatttttcactgctacttccaagcttaaggtcaaagtagagattgttttctttttatagttattttttaaaagatttaaaaaataaattaccgttttaaagtttagcaaaaaatatactcctcccacccta

SEQ ID NO: 79089 - DNA, 7325 bp, Oryza sativa
aaacaattagtactacaagttataatcattcacaaagtattaaatacgagccaaatctataaattctacaattacaaattatttcatcaccggaaaagaaagcaaattattaagccattagtagtatatgactttattgcacttacatattcatgatttagtgttggcacgtaatcttccaaaaaaaatcatgtatgaatataaatatttgggtacgcattggtaataaaactcacgccacacccgttaatacctcgaattttaatacctcgaatttgggttgggcatacccataagcacaaaatctaacccatgcctatgcccatcggctgcagtacccgtgggtacctagaccaatgggtaaaattttcatcccaattttcaacttgtactccttcattttccgcgtgcacgctttccaaatggttaaacggggtgtttttttgttaaaattttataggaaagtttccttagaaacatattcaagttttttagcgaatacttaattaattatatgctatctatcgctctgttttatgtgccagagggaaaggtttcccaacccctccaaaagaacataatcttagactaagtttgaactaattttttagcggcacgtaaaataagacaagtcattaagtaaacaagacaaacttgaaattaattaattaatttgttttttaaaaaattcccatatggtaattttatacatgaaatatatcaattagcagcttgggaagcttgctcgtggagaatgaggaaagcaggcgttgcaaaatgttgtttagaactcaaccttagtctcatcatgcgggtcaatgaatatataggcttaatttgatcttcgaacacatgggatcgagctaaatcttcagagaaagaaagaaagtatataacagttgaaaatatggagggctattcatcagtcaattattgatcattcttctgaacatggattttttttgtatatgttgttagttaatttggtagcagccgttgatcttctgaacaaacaaactgaacttcttaggattcctagaaaggagaaacgaaaaggaaaaaaaaaagaggcaaaagcacgatgcattcggtttcagttggtctgtcgctgttcttgtggtacaagtttgcgatgctttgaggagtcggattattaaattaaattaagaggaccacaaaagtttagaacgctcactggcttctctcccttcataaaagcagtgacggatctagaaacaaatatcaagatctaaataaattagttaaagttaaagttatagtcccatttctatctatatatagaaaaaaaattagtagggattaggtggagactcccattatcctcgcttcaaacttcagtagtagagacttgagtcctcgtcgctcctatgatacatccgctcctacctttaaaaatatatcttcaaagaaaattgtcttgtagatagaagctttgttttgcaaagaatgtttagtggggtcattaaacctctttaataccatttctacattttctttgttctagccattggaccaagagatactctatcattttcctcgttaaactatctcttgcgtaagttacttttaactagctaaaacaacaattttttattagagacgttattagagacgtatagagtatttagttaacataccctcccttacttttgtgcttcctgtttacacctaaatttggtatctaggatagaaataggaaaagattatcaaagtttggagttctgccggtttcctccagagagggccggtctgatcgccatgtgttggccggtctgaccgccatgtgttggccggtcagaccggcggtgtgtggccggtctgactggccgagttcgagtccggggctgtttttgtcggatcttgggtttccttactcgggaaggcatgtttcgggtttcctttggattctatcccaagttggacgtggaggagggcctgtagagggcaagaccaacccctatataagggggtaaggccggttcattctaacaatcaatctacaatcaatcaattgaatcgtttttcatattgcttttagttttctcttagtttgtccatctttgtcgattgtgccgtaaatcgtccgccgccactgcgagagtgcgacacctctttgtagatttatcctgaaaaacttctgttttacccacgagacgggtagttatttagagtcggctccgctagccggttatctatcaaaacccatctcgatttagcttttgctagattgaggtgattggcgactctaggatcaccgcaagacgtttaggtgttgcgatcgtgcttgtcaacttgtcacaaaaggttgccaacactttcatttgtttatcaggattgctgttgattactactatagctccctccaatttttgtgtgtttagtagcaaacaatgcttgttgcctgatatattcatcagtagtacatgtgtggagcacatcgttttcacttaattaatcgtagctgtatactccctccgtttcaaaatgtttgacaccgttaactttttaagtacttgtttgaccattcgtcttattcaaaaaatttaagtaattatttattcttttcatatcatttgattcattgttaaatatactttcatgtacacatatagtttcacatatttcacaattttttttaataagacgaacggtcaaacatgtgctaaaaagtcaacggtgtcaaatattttgaaacggagagagtactatacttgcaatgttggtgcatgtgtgtgtttactgtatctaagacaatccgatgtataatagcttagaccaaattcgtgggactgatggtcgaataactttcatcctcaattcatctataacgaacaatccttttgcgagacgtcaaaacctagtttcgattatctcgatgatttttacatcttcaatatatataataccatgctcatgcattgcaacagatgactcatatactaggacaagatccaacttattttttaaaccaactctttttttttctatttttctttctaaccaacaatttgatttttttaatggttttctgaaccaactcatttttttctatttttctttttaaccaacattttaattttttaatggttttctcgagtatggtgtggttgtgcgtgtaatgtgagagggagggatgtgacgacgtgtagtgtttttacagtagtaaaaacaattatgtacttttggttggtctgattttttttcctcaactatacagttatacaattagttaaaatcaatccttcatctccttagaaccgagtataaattaaaagttccttatgcttcagaaaaaaaatctattgtgtgcttggcaaaattaaccaaaaagtaactatctctttgtgtggaaatgtatcaaccttttgaaccaaaatctgcaaccttatgcaaccgattatacaaaatacaacagatgcttcacgtcgaggcttttctaaaggcccaagttctcaagatactattttgcaacaatgcaactttacttgcttagcaagggacaagctagagttagcatgtggtctcaattacccacaatcagagctaatgatctagtgaatacattagtttcaatttgtacctgtgtactactctaccaaccaaccaacatatggccttaatttgcttttgacacaattgactcatgctagctactcatattctaaattataggagtattattattaaggttgaaatcaccaatgacctttgttggtctcattagccatcaaatggatggaaccttccaatgaagatcaaactgggattctctgacaatatccagttaaaaggatagcatcaattaaggaagaggttagttggtgatttaattaactgctagatgtttaagttaaactatgtatgagtaatccagattgttgccagtaaactagggttagcatccaaccaactctaattattattaaattaatgttcataataatacaacagggtacgtggtacacctgtaagtcttaggatggatggaatatcatgatcccagcttgcctgttccatgtgagcataattccttcacccaactacatgcatgcatatattatatgtgtgcttgaaatacttcaaaaaactattagggctcataaacatggagctcgcttgatcctttttctactgaaaagaaaattaatcagctatatgttggctacagtggtagagcctattgggtataattttattactaaatctatggttttatataaattcaacgctaaatctgtattttggtgttgcactttttcgaatatagtttttgtgatagtttgattaaagtatatgtattttttaaaaaataatcaattccaaatgacatagtatagctctacatatgtaaaaaaacatgtcgggctgatatgtctcaacttaaagaataaatatcttgtaaatatccatactaaatgcatctaaaacatacatttagtgccattgaaagtactttcttgttagaattttaccatgttctacaaaatatatcaatatatcataatataaatttgtgactaaaattttatttctaagaccgcatctagtgcattatgacgtgtttttgtgaccataagtattcgacgcgcgagattgattggctactcagccctcatattaccattaaccacaacaaaacaccaacaaattaggatgagttctttcccccaagttcccaactcatttccctcgttttccgcgcgcacgcttttcaaactattaaatagtgcgtgttttgtaaaatatttctatacaaaaattgctttaaaaaatcatattaatctattttttaagttcttttatagctaatatatacttaattaatcatgcgttaatctatcgctctattaagcgtgcggaggggaggggttcccaaccagaacacagccttaatcaggccaccaacaagcaacatgtgccagctaggcttggaaatgaaacccccaaaagtacaccaaaaagggccccaccacaaaacacaaaaccggtactagctgggaagtgggaaattctatttaacagtccggatagacatccacccacaggagccatttgtatcttagttcttgtttttgtttttgactcttttgcattacttcctccaccctaaaataacaagttttacttcttgacatggctattaagacatggctattaagaaaagtgatagatgaggtataagctaggactataataaagacgagtgacaataagaatagtatggatagtttagtgataaaatatgtattttacaactacttgagataaactttgaaccctataagttattatattttgcgacggagcgcgtaccatgtggacattacaatggcaatacaataatagataaacattgtcaactgtcaaatcctccccttggcccttgggacccccatggccttaagctttgcaatcatgcaagatcactttggttttttccaacctagagagaagccaaagggatgaggagattctccatgattctaatttagatcgactatctccatgattctaatttatgaacatcctttcttcttccccttagtataggcggtccaaattggtgtgcctaaaatgcaggaacttcaaaggaaacaattttctttcatattaaaaaaatataacagatacaaaaaaaaaaccaccatgaatttgtgatgatttagtcggaaatggttctcagtcggtcgaaaattttccatatttaattaattattcagtgacgactataaaacctcaccgacaaaaaatagaaaaatcagattttgtatttggctaaaatcggaaacggtgccaccaccgtttcatctctacatgattggtttgcactcactagaacatctgtggagcctgtgctcagccagggtcagtgctaagtcagttggagatttggaatgaaatgcataagcatgaggtctttgccttgttggatgccggagcatggacagtggtccatccatggtcagagtctgtgccgttggcccgggagaaacggctgcacgcctttgacaatatgaggtgaccaattctccggtttgtgtggatcagatgatcaagtgatggtatatatactggagtataattcaattggcttgactatattcgaagtaacagattgataatgttatagattgatactccctccggtcatctttattagacgctgagagagctataagtataacttttccgtcgtcaaataaaagtgactgaaaggagtatagaactttttttagaaaaaaaaatttgtagattggcattgtaatcatatgagtggatgcaaatggagcaaaggaaggatgatgcagtgaattatgaagaataataataataataagacaaaagtagataagtaaatatgatatatttgaccagttgatcgatgcaagcagtaagcattttaattagttcatattttttttattaaagaagatcatatgtaggccccctccaaaggcaaacttctctagcatatctacagggtggcaaacaaaatcagatcctaaaatgtcaatttaaatgattgcaaatgaccagtttttcctactaaatgtatatactaactactagtcaatttggtcaaatttttgaaagtttgagtacacatatatggtttacatggatgggatatacaaagttctcatgggcagagacttgccttaaaaaacaacaaaatataatggcaaaatttgctataggacaaccaaaaaaacgtgtaattagctaggagacaccacaagaacgcgtttttgctatagggcaccgtaaaaaaactggtaattagctactggacaccctcgggattattttattataggaaaaagtacgaattacacccccgaactatcgtggtcgtccgaattacccccctgaaccacaaaactagacattcttcaccccctaactatgcaaaccggacgaattacccccctcggttcaatccacggtggttttggtctacgcggcgtaagcgtggcagtccagtcaacattgtatttataaaaaaaattgcgggacccacgtgtcatactcttcatccctctcttctctctctgtatgcctcacttttcctctctctctcacgggtgggtcggcggcggcgggcgaccacgggcggcgggcggggccgaagacggcagcgagcggcgggtgggcacgaggctggcgacaggcgggggcggaggaggaggcggggggcggcggtcgaggagccgaggccggcgatgggcggtggcggagaaggcagcgggcggcgggtgggcgctaggctagcgatgggcggggacggaagcggcagcgggcgg

SEQ ID NO: 79090 - DNA, 46193 bp, Oryza sativa
tgcgcaaataagaaagtgatggttttctcccaatccatatctcatatggtgttttgtccttatttctgttaggaactctgtttaacacatgattcgaggtcaacaatgcctccccccaccatgccttaggtagtcccgcggtgtccaacatggcattcaccaagtcagtcattgtgcggttcttactttcagcaatcccattagactcaggagaatagggaggtgtcctctcatgtatgatgccatgttcctcaaagaataagtcaaactcatttgagaaaaactctccaccacgatcagacataagcctttttatctttctgtcaagttgattttcaacttctgccttataaattttaaaatagtctagagtctcgtctttcgttttcaacaagtacacatagcaaaatatagtagcatcatcaatcaacgtcatgaaatatcgttttccacccttcatcaacacccccattcatttcacaaagatctgaatgtaggagttctagtggtgccaagtttctctcctcggcagccttgtgaggcttgcgaggttgcttcgattgtacacaactatggcacttaaaacctttgacaatggaaaacttaggaattaaacacatgctggaaagccgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatctgtctctactcagacgggagccactaacaagattcctgtcgatagaagggacatgctgcacgttcttcagctgcacgatctttcccgaagtaaacttcagatataccgtgtcaacaccatgaacagaagcatgtgacccattccccattaggacggtggaaccccgtgcgacctgataagaagaaaacaatgagatgtcagcacaaacatgtacattggtcccagtatcaacccaccaattagtagactgattaactgaaaaaacagtaggtaaattaccatacccgcttccatctccagtgttgcaaatggtcacattagcagacttagaagtctgccctgcaggtgccttcatccccttgcgctgtggacacttcctagccagatgaccaggttggccacacacaaagcaagtcctctcatcctgattaggattgttgttgttcttcttctgcttcttgaagttggtggtctgttgagctttgtatttccccttgttcttgttctaggccttgtgcacaacattggcactggactgcccaccatcgcccttagacgcaacatctttttctcgagctttctcctcaacatcaagagacgctatcaacccctcaacggagtattcctgtctcttgtgtttgagtgcagtaccgaaacttctccaagatggaggtagttccggagacctgctctcccgatcgccggtgcacgccggcgagcgggatggagtagtttacgagcgacggggcagtacagagtaggaggcaaaccctagattgatttcgcgtgtgttgcgtgaaggcggcggctcggtttatatagagataggtcgcttgatcagggcacccgcgtaacgaaccggataagtcgcgcataacttatcaagactccacgccgttttcacgcaccggattttttggaatgtttccaaaacaaaacaaatccgaatttcccgcagcaaaacaaaactgcaaaaggaggctgcatctgcgcaagggtgaggagccaattttgcggaccattcgacgcgtaggcgagcgagcgcgcgcgtgtgtttcccctcttctctccaccatacatgcttcaagtggctaggagggcatcctcccttttaaggaggtccccctctcgtagaataagtaaggtggtactaaactccacatgcatgctatctcataaggtgggcttttgtgattttccaaagaattaatcttcgaatgggccttagcccaactattaattctaacatctccaccagtggaagcagttgtgctctcggacgctgtccatgaagttccttctcggtatcgcttcatgctctgcagaccacagctccgctctccgcaccaacatgaggttacctgatagggtattcgtagcagtggtttggccatccgttggctttgggctgcacaaagcacagttatgtgtcaccagtatggctacctatacatggttctggatttattgtaaatagttgtagctactactacaacttgttagctgaataatacaatcactaccgaagaaaccatctttatccggtcagataaaatccacaatagcctcggttgcactaaaaaccgggactaaaaagaacttttagtcccggtttataagcgcaacgggagtatatgatctttaagcccggttcaaatgctgtcatgccccctggatctttagtcccggttggtgataccgatcgggactaaagatcatatttttaatcctgattggtactatcaactgaaaataaatctctcacacatcctcctcgattggcacggctgcctaccatatcttatcccctctctctctttccttctttatctcctcctcctccactccttctcaatcctcctcctctttccctcctcctcctccaacgattccctcctcccctcccctctccctctatgtcgcggaggccggcggcaggcggcggaggacgtgcgggggcgaccggaggggaggcagcaggcggtggtggccatcgcgtcgtggagggtggcgacggccgggcaggggtggccagaggggaggcggtaggcggccgcggctgtcgcgtcgtggagggcggctgcagccgtcacgtcgtggagggcggcggcggcggctaggtgggggaggaggcgacctctccctcccctccgccagatccggcgggaggggaggcggcaacggccgggcggggtggcggtggtggcgcgacgacgaagaattttttttcgaggatttgagatgtatttgtttttagaatttgtgatgtattgaatatgtgaagttatctgtgatgtatttgtgatgtttttttttagaatttgtgatgtatttgatctgtgatttagagatggtttggggatttcacaatttggggatgatttggggatgtagtgaaatcaatatgaatgcaataaaataaaatgaaaaaaaactatagttaataccaaccgggactaaagatggtataataccaaccgggacaaaaatccatttttgatcctggttattttaaccaggactaaagatggacatagtcctggattcgtagtcggggttacgaagcatgattgaagatcctttttccagtagtgaatcttattgatacttgagttatttcatggtactctatgatatgtattatgtgtactagttgagctactgttagttggatcggattataaaatcttgatacttgagtgataactgtcagattcatatgtatgggttatgaaaactgcgtaaagtcataccaaattggcacctatggggatctcttcttgttgttattgccaccgttccacgggtgatgctaataggcgcgtaagcgccgccaagcaaagtcgcgcagacgcgcacttgctcccagtcccacgcgagcaccttccgagccttccgctaaaatatgtgttagtgctaatctttagcggtttatactaattgatttttttaatgaaatgataaataaaatagttgggttgaaaattttaaaatacgaattgaaagttttcaatgtttagttgaaagttttcgaatttgagttgaaagttttcaaattttgacttcaaaagttttttatcttgagttgaaagtttaaaaatttcaattgaaagttttcaaatttgagttgaaaattttcaaatcttgactgaaagttttcaaatttaaattgaaagttttcaaatcttgacttaaaagttttcaaatttaaattgaaagttttaaattttcagtataaagttcattcgaatttcaattttttttcatacaccgtgtatataaatgatatgaagctaatcacgtgagatagaaaagagaaagacaaaaacaagtcagacgtgcttgcttccgcttctgtgggccggtgtgggcttagcgccatgcaccgataagcatctcgcgcatacgcggatgaggatgtgggccgcgcgtgaggcttgggccggaaacgcgcgcgagtcgtgcacccattagcaatttcgccgttccactgtccgagcatcagtgtcccctttgcattttttgcactcagtttgccggtgtagaaccaagaaggaagagggggagaagtgttggtataggatcgaacacaagtaaccaagcctaccagaggggggtaaatggtagggaaaaccaaaaacccaaaaacttttagcgaaaataaaagctaccctcaaattcgacggatcacggtctaaccgaagtagatgtgtcggtctgaccgcctggaacacgtcggtctgaccgatgtagatcgatcggtcgaaccgccgagatcgcctgccttcgcctgtcgccgccgccggtctgaccgcctataagctgccggtctgaccgccgggatgccgccgaacccgataaaacacagatcgaagaactctcaaagtagatgacaactttattgcttctctctgtgtttataaagtgcaacaacagcaccccttacaaaaaatctcgactaaactcaaaaccctagctaaactagcagctcaattgctctcaaagcgataccgggagacatcacattccctctctatttataccaaaaaacactactcaaaataggtgtaaaacttctatttccaataggactcaatacccgaaataccttaatttccaaaaccgcaccggccacataaaatccaaaaccgcatcgaaacggactcctctccgctgtcgacgcgtgtcccgtacgcactcggactcctcgtgcgcacgtccttcctgccgcatgggccagctgggcctcctactcctggaccaactcggcctccagccagctgccaccgaagcccaccgagccgctctgccgctgctcggtgcaaccgatcatgcacacatacacgcttcaccatgcatccctttttctcctcaaatttaatccaatctccttcgtgaacaccaacacttgcacacacacctcgtaaatcccgttgcgaagatctcttccacatgatgttcatccaccgtatgccatctcatatccaacttcgtcactcggtatttttgaccgtttggacctcaactcctccctaaatctagtcccgatcccgaccattgaccgaagttaacctccaagaatcctgactctagtcaccttctcacatgatatcctgaccgcactagacctctgctcctccctgagcatagtcgcggtcttcaccattgaccaaggctgacctcaagtcacatgcatataatcagacaaaacaaccgtttctaggcacagatatcacaacctgacccacattagtcacatgtactcacaccaacatccacacatctatttaaaccaattatttattaaatcatttgcgcagccaattattcatcacaaatattaatcatgacaatgatttcattagttgggagcattgttcgaactaaatctagcctaaccacctgatagcactaccgaaatagtcaccgagtctaggtaaaactgaattaaatcagtttacactaaggtttcctatcaattcacctccaagttaaccttctaagctaaatcacttctactcttcactgttatctaggggtgggcattcggtctaaccgaaaattacggtctcggtctttggtctttcgatcttttcggtctttgaaaagtgaagtccgaatttcagcgcgaaaaatgtcaggaccgacaaattcggtctcggtctcagtcctgaccgaaattcaacaacattttcatatatgcaaagaaataatggaaattttcaacacaaaatcacaaaaagaattcataagcacttatgagtaaagactcttattaggttgcatgcctagaagaagtagggatgtgaaaattaaagtttaatcctattaaacatagtggattgtaggttgcatttagtcattttttgataattcggtcttttcggtctattcggctacccgaggagactaaccgaattgaccgaataaaatttggtctttcactacttaggaccgaattgataaccgaatttctcggtctcagtcttttcggttcggttttttttacccacccctacttttatcagctagtacttgatacccataaggtatcagtagtaaggggctatttggttgctaccctgagagaaattgcctgacctaaagccagcctgagactaacacaggtcttgtttggttggtgcccttagattccaaacccttcgcctgccctgacgcagcccttcccgtcattagcgtgagccaggcgaccgaaatcgatcgcctgagctccaggcagcaacagcgatacatacttaccatcctaatctttatccaaagcggccacgcgacgtagattccaggagcgaagctgcgctgcttccgcgaagccgccgccgaccgccatcttgccggatccttgcgaagccgccgccgcccgccgtctttcgtaatccctgcgaagctatgctactctcgctggcgtgcgaagccaccgccgttttgccggatccctgcgaagctgtgttgctcccgccggcgggtgaagctgtcgccgtcttgccggatcccagcatagcagcaccgcccatgctagatgctgcccaggctgcctttcgtgcaaaatagtaagcagatcgatttgcaggttgccagatgcatttgcacatctgggcagaatcatctgaaggttgtgctcctgatgcacggatttgggatctatttgactcttcgattgcgttctcctctctctttttttccctgcttttttttctagatttttatcctcgttatgtatgcaagatttgtgcttgtacatgggaagttgggttcataaatggatcttggcaggaggtttagatgcaatttgtggcaagatttgtgacggccattaataattgatttagctgtgtaataattaaaggcgtaattgcatatttgtttctcaggcagcaacaaacaaccaaacaagcatatactcaggctacctgaccaggttagatgcattgtcttctcgcatgccactcaggcgcacagaaatttcaggcatgttgctcagggcagcaaccaaacaacccctaaatctagtacatggctaccagagctggtacccataaatatcagacctaatacacatgtatcatcccctgctacctatatatcatgtctgatacatgtaagtatcatgcttgatactgtagataacatgatacccttttaggtactataaataaataccgagaggtactacaaggtgtcattggtatcgtacataccatgatacttgcaagtaccataacacttgatgtaccacgagatatcatgatatcctaatggggtgtttgggactgactaaagtttagtccctctgcctaagtaacatgatattggaaaagtactatgatacaaggaagtatcgcgtggtacgaagtatcacgtggtactatggtaacagtgacatgaaatttgaaggcaccacgagatatcatagtaccacataagtttcatgagtatcgtctatatttaatgtttgtatcatagatattgtaggcgtatttagggttaacacttgtagaaacggtcgaaatttcagtaatttcaagacttttggaactttttgcacgacattatttacaatttaacaaattttgactaaattctaataaaatttgacaaaattcgcaaaaacaaattgaagaaaaacaaaaggacgagatatatatcatgtagatacacacgcgaaaaaaagtggattaatgaaatttgagaagattatagaagagttggcctggatagtcgcatttttttttcaggtgatacttaaaaggaagagaatagacagtagcatgcagctagcatgtacactccctccgtaaaaaaaaaaaaagtcaacctataagtcccattctagcactaggttagcttttttttttaacggagaaaatagcttagcttttgcattggcagaaacaacggggatgtttggttcatggcaacactttgccacaccacacttgtggctgccacagtctcttaggcagtctcttaagcatgtgtttagtttactgccacagttgtggcttgccacactttttcaatagcatgtcccacatgtcatagacttaattttcttgccaactttgccacactttgtggctagcaatttgtccaccacacttttgtggctgccacaacttgcctaatgttagttgtggtaaagtgtgaccagcaaccaaacacacccaacgtgtcgtgcggctcgtctcagaggtgtaacgatggatggacatcgttaactacggccgagtttagttccaaatttgagtttagttctaatttttttttaaaacttctaacttttccatcacatcaaaacttttctacacacaaacttccaactttttcatcacattgttctaatttcaaccaaactttcaattttggcggcgtgaacactctacattgtccctccgacgggatacagtttttctgtatgggttactgtaatttccgtagtaaagcacggccccattgctagttacagcaaatatacaaatatacagtgttgcgactcattgtccaaaagcaaatatagattcttctgttattacaatgactagacaaacttgtaacctgaataatgatcccctcctcatccatattaagccttgttcagagggattggaggggttcgaggataaataattccacacctcaatatatgtcaataaatcccctccaaatctaacagcagagctatatcatcaccattgtcttcatcataaaatagagtcgtcattcagaatctttgtaagatttgcattccttccatgatcaaaatatatgaaatctgactctagcaggcctttatctttatctttactaagactgcacgaagcagaaccaaacacatcaatagcagcattaacatcataaacttcaatggcgtcatcaacatcatcctcaaaaagatatccagatggtgggtgcaaaattgtacttgcattgccctcacaagtggtgcaaagacctgttcataaagccaaaacaaagacatcaacatacatgccaatggcaataatggttgctacaatttgtgtactacttgacgaaaaataaattaggagcaccacaacttagagttcagtgactcaccaaaacatgtgctatcttgaacagggcagcagatgggcttcgagtttgattcattaaatcgaccaggttgtgagtcccagaattgagcaaagaagagtgtgcgcttagggtttggtgttgtggttgcctcacgatttagtttgagcacagtgccatgggtgcttgccaagaagttagcatggtagcatctccagtagtgggattgaggttcctccactccacatatgaggtcaagcttatatcttggttcctgcaataacaaacaagggtagacgaagtcttagcacactggaagaaagcaaatgcagcaatcaaacaaaaataaaaaaacgtttatactctaaatttacccaaggatgctgtctggagtatgtgactagcaattcttccagcttgctgcgaacaaacctttgccggttcacatagtctgaccttctcctcgataatgctgctaaagcttgtgtatcaaatggaggcagtctttttctgccaatcatcgtggttagctgctcttggatcattgcgttaagctgctcccaatcagcgttggagattacacagccggagccatcactaatggatctcagcaagtgctgcaggcgatcaagcttctcgccgcagagggacatgaggaatgacccaagcatggtgtgctgcgggtgctctgaagccttggctgcagcagagtaggggttcttgttcgtcatcaccgtctgctgtagcttgtcagtgaggtcacactgcctggaccaaaggtactccacggcctcatgcttggagagcgagcagccagtggtggtggtggtgatggcacggagtagggcgacaaggccgttgagggaacgggatgcaatgcgagacatggcttgggtgtcagagatatcctgcggcaactcaacctcacaatcgccgccaccgccatcctttggatacaggggagggtatgcggcgtcgtaccagagggtgttgatgatgatgtttgatacgggatccaaggggccgaagcattgtccagacatgaggattgcgcggaggaggcgtccgcggcgcatggagtcatctgatacgggcaggggcagcacggcaagtgccctgatgtagaagcaatggatggtgtcgaggaggcacatgttcagggacaatatgtgctcacatggcggggaggcatcatagttcacatgtccatgttcttcacaaccaccaagcactttcgctacgcattttgatagctttgtctctatggctgcgctatctatcgtaagatccgagatgtataggagtttctgaaattgaacatgatttggtgagattccagcaaaacggtcgggggcggcttgagcacaagactcaccatttgggcagcacaagaagtccatgttgggcgggggccattggaatgcgttgaggagcaggtccttgatggactggacgtcatgggtggtgagcaggtccgacccctgaagcttgtggacgataggggagagtagatgagaggggtactgcgcggtcatggtgcgcgccaggtcgtcgggcgcggggtggcctgctttgagcgcggcgatccggagggcgttcttcatcttgccaccgtcggggaggaggggggatggcgggagtgggagatggcggtcatggtggaccaacttgatggcgaggaggaggtcgtaggaggcgaggtagaggtagcgcctggcctggtcgccggtgaggtagcggaaatagaccttcatgaaggcgatgaggccgttgagagaggtggatgagatgaacccccaccactcgctgtagctcctgcgggtcctcttccgggggagcggcggtgggtggtcttggagttggaggggcggtgatccggagaggtgggcgatggcgttgaggatgatgttgctgacggggtcggcgaggccgaagcagtgtccgacctcgccgaggcagtcgacgagctccgggatctcgtccaagggcagccgccgcgccgcctcgtcgtacagcttctgtatggaccggaggatttcgttggccggagggtgccatcgcttctcctcctccccgtggtaacaggtgaatctgccgaagcgggggccatcggaggaggaggcgccgctccgactcgctgctctcttccctggattttttggggattgcacgccggatctgagcccccggcttgctgtcgatttgtgaatttttcgccgcttcatatctcctactgctacgcctaccgccgccacaaacaacgctagccgcaccgcacctgcccggcctcctctctctttatacgccgcggatacctatcctcgtaggaatcggatacggtgtaccctggagccaatgcccagcccacttaactcgctgggctggattacccaacaccaaacggacacggtccctttccttccttcctagtagtagtaaggaataagttcacttttcctccctcaacttatggccgtgtatgaatagcatccctcaaccgcaaaaccggctataacccatcccccaactccgaaaaccgttgcaaatcaacttcccggacggttttggaagcggttttatcctatgtggcaattgacttgcttatatggcagttgacttgctgagtcatcaagcaggacccacatgtcagcggtctccacctcatctcatcttctccctcaccatgattcccttcaagaaacgggaaaggaaaaaaatcaagaagcggaggcgaggcgatagaatcgagcagcaagatcaacggcaagacaagtagcacatgatggttgccgaattcagagaagacgccggtgatcacgcgaaacaagaaaggagaacgaacaaaacaaattagagaccacgaaatcgtcgaagaacacgagcaaacagcaaacaagctagcggagttcttctagcgtgcgcgcgacgcggagcgggtgtccgccatacgcagctgctggcaatgccgccgtcgtccccgtgccggagcctctccgtcctcatgctgcagcacaacccggccctcggcgacatccccagtggcttccttctcggacggacggcgagcttctcccgcgcgcggacggccgccgagctatttccccgcgcgcggacggccgccgagctcctcccacgcgcaaggacgcccggcaagatcctccccgcgcgcggccggccggcgagcttctcccccgcgcgtggccggccgacgagatcctccccgcgcaagccctgccggcgagatcctccacacgcgcagatggccggcgacttggaggggctgcctcgtcctccacgaccccctctcagacaatgccccggcgtcctcccgcctcctctgcgtgctcgagccgggccactcccccgcgcgcggcgtggccaaccgacgagctcgtcccccgtgcgccgtcgtcgccgccctgctgatagaaggtgagaggtggaagatatgaaagagaaagaggggaagagatgaggtggagactgctgacatgtgggtcccgtttgatgactcagcaaatcaactgccacgtaagcaagtcaattgctacgtaggacaagaccgcctccaaaaccgtccggggagttgatttgtaacggttttcagagttgggggatgggttatacccggttttgcggttgagggatgatattcatacacggccatgagttgagggaggtaaagtggacttattcctagtagtaattagcaataagcccacctgtcagttcctggacttttacatcgtgttttttttacctctaaactgtacacaaccgtgcaatttggatcccacagcaatatagatgcctgcttttaatgatgtggcatcctagtcagcaaaataaaaataaaaatattatgtggggcccatgtaagtgacaagaaaagacatagggcccacgccctcttctttcttctcttttcttccccagcctcggtgttagccacgcaaggggaggcggccgacgggagaggtggggagaggtggccggcaagtctgagagggtaggggagaggcggccggcaagccagcaagccgaagctcgtcgacaaggagatcatcccttgcgacgcccatgtttgccaccgccgcccagttcggactggggacacgggtgaaagactgagaaccgatgagagggtaagagggggtctggcccctcaggagcgattgaagatagaaagggatttagacaggttcgggccgctgtgggagcgtaacaccctactcctgtatgtggttgatttgagtggaagaatactgttggggaggtatgtcatgagggccttcagccaacctgccgaaaccatctaggccgtcaaaacaacggctaagttcattggcccaagcccttgggcgaagaatacagacttacgaaggaatgggtcaagaatacagaattgccacgacccaataagctcaaaattcactgatttggatataggaggagataaggaggccgccatccgaaaatgggctggattgggccagcccatgttcggccgaaccctcatctgcgccgttggatgcagggtttggcgtggacgtccaggattgcatcccaatgacggttggagggcatattttcgaccattccaactgccacaaccgttattggcagctataaaaggacctcccatcctcacttcttccacacactcaagcaaggagcttctcatattctctcaagtttaatatactctctagagtacagtggaatagaaatagaatagagtctccggtcctcggagttttcggaagagttcgggtatggctctagtagcttttccttcttttgtaagacttgcaatatttatagaatattattcttaatatatttatggtactatacttcactctgatcatacgagtaccgactttccgatatattattcgagatataattgtctagctagcttactcgggagatgcgactgtgtgggtataatattcatctatatgattgctctatgtcatgacgatgattgtagattagtatttggtagcataagcgaggtgcttaggctattgaatatcattatttagggttatatgctgcgggacagtagaggtgggccgctgatggtgatagctcagtacgggtattcctccacgttagtatataatcctaggttactttcctggggagggtacttgttgacggtcgttatcgatcagtttcgaccgtcaatattaccaaaatagaggagaaccagtgatgcttgcaatgcatatacatgttagaataataatattccactagtattaggtttactaaccttttgcagagaataaccataaagtggaggagaatcgacattaactcagacgataaatcaatcggacgatgtcgacaatcagacttatgcatgaatgggccaagagctcagaattgacatgatgaattgggccaaaattcacaagtctacgaagtgaaacaatagagcaggtcgcctgccgaatttgggccaggttggctggcccctggttcggccgaacctccctctccaccgttggatatggggtttggcagggacgctccagatcttctcctgatggcggttgcggggtacttcagacatttcgcagcagttacacccgtcatacatgcctataaaaggagctcactctcttcacttcaacacacacctcaagcaagagctctgtcatattctctcaagttagtttagtgttattaagctagtagaataggaatagagtagaaatcgggaatccggaagccttcggaagagttcgggtatggctctagtagctcttctcttctctattgtaagctttgtactagtattagaatactcttctttatacatttatggtattgaaatactttttgaatatataaatgactactttacattatgttcatattatactgaatatgttgctaacttatctgggagatgctttagtgcgggtataatgtttgcatatgtaattactctatgtcatgataatgatattagagtagtatctggtagtttagacgtggtgtctagattacgggatattattatttggggttatatgctgcggatgagaggtgggccgctgatggtgacagctcagtacgggtattcctccgcgagtgtatataatcctaagttaattccctggggagggtactcctccgtatttagccccggttgtatggtcatgacgggctgtcgtaaggaactcgacagccaggggtagcttctcgaagtaccaggagggcatcagatagagggtattagctagtatatcagataactacccttggaatactctcgggtgaaacgctacaatagtatatccatgcgcttgcggatgaactctataaccataatataccaggagtatttctgcgccattgctgggaattatatttctagtaatgtcgttaagaaataccaacaaacatttctggcccgttgccggggaagattcataatagagattacctgaactaatactttataattacctctgtataatcatttccctttgcaggctaaccttggttgttttcacttttgttgtgaaaacagggtagtgcatgactggtttcaacttgccgaaaaacttcaaagaaaatccagaagctttcttccggagcgtcagaccgcgagtcactgctccgtagaaaactctaccgactaagaaaccagccgtagcagcgccaaccgactttcaagactatggctgacaagactccccgcgagttcattgctccctctgctgagaatgtggccattgggccgcagatcaacatgggagacgtggatttcgacttgaagtccagcctcatcactatggcgcaggctagcccgttctgcggcaagcctaacgaggatgccaatgctcatctgcagcagttcctggagatctgtagcatgtacaccataaaagggtgtcagtccagacaccgtcaggctaaggttgttcctgttttccctcctcgggagagcgaagcagtggttctacgccaaccgtgctgctgtcaacacctgggacaaatgttctacgacattcctctcgaagttcttctcgattggcaaaaccattgcccttcgtggaaggatttccagtttccagcagacaagggacaagtccattcctgaagcatgggaacgacttcaggagtatgtggctgcctgtcctcatcatgggatggacgactggctaatcctgcagaatttttatgatggactcactcccatgtcccgcgatcacctggacgcggcgactggaggagcattcttttgtaaaacggttcgaggagccattgatttaatagagaagatggtctccaatatgggttggagcgaggaacgactccagacccgtcagtgaggtatgcacaccgtcaaggagacgaaattactcgctgccaagctagacctcctcatgaagcgcttggatgaccacgacaaacggcctcaaggcactgtcaaggccttggactcacacgttacatgtgaggtctgcggcaacatgggacattctgggaatgactgcccagaaacccgtgaggaggcgatgtacataagcaacaacaacaacgggtaccgtccacaaggaggccaggggtggaaccagccacgcccgtattatcaaggagaaaccaatggggtagccaaggaagcgccatccagtgactcggctgacaaagagattcagccagaaaaggtcgtgccgcaggagtactgcgacacatgattgctgccatttcctcaacggagtaggaaatagttcgtggacgagcagttcgctcgttttttaaagtgcatctagggccctaatgattttgatgattgattacaatgcgattagagaggactaacatttttattgaagcaaatgtgaaggttgttatgtcctcgacgtgttgtaattcaatgcatatcccgtaaatgcgacatcgcgatgcaatggggcaatgatcaaatggtatattgtatcttttaccttgcattatatcgtaggaaagccgtgctattaagggggataatgcatagacatataaggagtgatggccggacatagatagagagagagacagagcttgaagagctcggttggtgtggagggaaaaggaccgacctcgtcgtctatttataggccgcggaagtcggttcggacaggagaaggagaagaaggacatggcaatggaggcgtggagaagaagagcacggcgccggctctgtccgctgattggccggtgatggcggttcgctccaggggctgacgtcgatggcgtgaggtgacggatgacgtcggcgatggttgcttggcgtcgagggcaagatggcagcaacgtcggtggcagaactgcgggcgacggcagcggctgcgcgtgcgagcgtgcgccaagcgcgtccatggcacacggcggtggcgcccacgggacagggaggaggatcggctgtgtggctgggccagcctgggtcttggtctgttagggttagggagatgggccgagaggagacagaagtagatttcggcccaaaggaattgtttcttaatttctaatagaatttgaaggagatttggatggctaggtttgaaaggaatttatatttggaggaatttatatgtggagatgaatttcaaaataaagaccttctaatttatttgagtgcaatatatttagaggtagagtggaatttgaaggaatttatttggaagcacttaaataaaaaaagaataatattatgaatgatagggctcctaatttggatatattttgggggagtatgataggaaaatagatagagaaaaataaataggatcttagcccccaaaatatatgatatgggttttagagaattatttgaggcaaaaaggaaatttggatttctggatgagaaggataaaatctattttcttagcacaagagcaattattcacaatattgcaataataatattctcatgccgataaggggatcaagccatataaattaaattggcggctaggtaaaaggaggaatttgaatatgggaatgttggaaggagaactaaggataggtttaagatcaaaggatgggttaacaattaattccaataaaattggaattgctttggtttaggttgtagcgcaatattgagaggttccttggaccatagttcataaaagtaaaaagggttttcaaactaaatttgaataaaaggaattttgtcaaaagaaggttttaaattaaaactagatcaagaaatacctccagataaattttaaatggagatcgcaaaagaaattaaacaaaagagaggttttatgcgagttagttttaggaggtccctctaattataatatcctaggtttaggaggttaataaaaacataaaaaccggtatgatgtataattagaaaatagctagttttcacgatgttacatactccctccgtttcatattataactcgtttgacttttttcgtagtcaaacattttaagtttgaccaagtttataaaaaaaatatagtattatttttaacacaaaacaaacatataataaaaatatattcaatgttagatttaataaaactaatttgatatttcagatgttgctaaaatttttttataaacttggtcaaactcaataaagtttgattagaaaaaagtcaaatgacttataacatgaaacagaaggaataattatttttgacatgtatcatggcatacgacctcattgtttgcttattggcttacaagtcacaaccaaaaattgaatttttcatatgcttgaattttactctactcttaacactttaggccatgtttgtttcggctttcgattattataatatgaattactagcattaatctgaaacaaatagaaatattattatattctataagtcagattagtataatctggtaatctcctataaacatgctttttcagattatagggtggctaaagacccactaccctttaatttttttttgcaaattacccaccactgccatcgaacccaacaggttgaacgcatccgcttcctctctgcccagttgcacgcgaatacagcgcctccccgcgtgcatctgcttactctctccctagtcgcgcgcaaatccttcccccagcccccaccctgcgccctggctccttcccccaagcgcaaaaatccatcccaagccccccaccctacgggccccttccccaagccacgctgccgccgccgtctcatattcctcccactccacaatagctgagggcatccaaaatagccaagggcattatagacattggcttgtcaaactcaataatccatgccattaataatccagataatcaaataactcatagcttattctactattgcttattataatctagcttatagtaatctggcttaataatttagattataatagtcttaagttgaaacaaacagggccttagaagccaaggttccaaggtagtcgcaatgaatcctatatatacttataaagttagtcatcactaagtgcaattaattttaattctctattctcacagccatccacgtcaccttaaattaatctagccaccggatttgcatcagacgtccaagatcgtcatcgttgatttgcccatccaaatagctgatgtgcactgaagagtccaatatgtttgcatatcccttccgtcctaattgggccaatgcattcgagcccattctgttttcttcctttaattgcaccatttagaggaaaatttgcctataataacaaaatttgctaaaattgcaccatttagaggaaagtttcatctagtatgtactccctccgtttcaaaatatttgacaccgttgactttttagcacatgtttgaccgttcgtcttattaaacaaattttgtgaaatatgtaaaactatatgtgtacattaaagtatatttaacactgaatcaaatgatatgaaaagaataaataattacttaattttttgaataagacgaatggtcaaacacgtactacaaagtcaacggtgtcaaacattttaaaacggagggagtattagagaggactattacaatgtaaatttgttccatgcctctggcgactacaaatttacagctcaaaactgatattatctgcaatattaagtatttatttgtgttttctcggattttgaagtcactacatttaaatggtgcatccatagagcaaatgctttcagggattatatgacgtttgcagttactctaatgtaatattggactttatcagctgcatgagggatactaggcacctgcttaccatacgatgtctcattggttgatcggtacagaggactgcatggtcaaatgagcaaaaattaaaaaaacatcgaactgctaccaggtagaaggtaactcattacaaatccaaaagtccgccctttaagctactcggagagaataaaacaccatggcatcatccttgtggtctcaaccttctgaataatcaaaacagtggtgcatcaaacattttcctcttcctattcgtcttcgtcttcctcttcatcttcttcttcgtaagggtctccaaaagagtcttcatcttcgtcttcgtgagagttctcatcttcatcttcctccacttcgtcctggtcattgtcatatccttccaaaatctcgatttccttacaactaaaaactgcacaaagaaacaaataagaagagcacagtaaatttcaagaggtccaacctgaaaattcactccaaaataaaaacttcaaatccattgacaaacttagtgtattggaccaacccttcaaaatacaaattgacataaatacttcattacttctccagatccaaaatcagattatgtccactacttcattcaaagaaagggaaacataataaaatgccgtcacttggagaagcattggtcctttataatatggttgcatcctatgcggcataattgctggattctctatagtatagcacacaacaagaagaaaattgtatggtctagggactatatgggtacttatggcaattcataaacaagatttttggacacaatggccaggagctgtgagcccaacataacaaatataatttagtgtcaccggagaacattaccttaggcaaacaaaactactaagcaatcttgcccaattattggttactagctgctatgatataaccaggatggctagtgcagcaagctggcacactcagcacctctagtacggtaaactgatggttacagaataacaaagttttctcacaataatagagttcaacaacgagataaaaagtatgtgaggtacttgcgtacatggaaaatggcatgcgagctataagatggcaatatcgactctcacaaatatacaactaatgggaaagaaaatcaaatcaaatgattgaaagatataattacatactacacacatgttgacatacttgttatgttatgcaagaaaattttagaaatcttaatatgcttttttgaatacaaccagccaaaagagtagtctagataatgtcttcccaaccataccaaatgcagtgcatatgctttcaattcccaattaatccatgatcctaacatccatttcccaataacttagagtttcgatactgcttactacatttcacgcatatgaaggcaaaggaaaatttcagaattgtacaaagaatgaagaatgtttaagtatgttgaatgtagacagatttcaaaactttgagtactctcttatcaaccgcttcgcatttgatttcaactatctcaaggtgtgttgatattacaagtgatctatccattgaatggcagtttcctttgattttcattctatgtttaggtccctgtcagaaattaaacattttaaagtcaatagaaaaatgccccaaaacttcaacaagtaatcaattggccaattagataaggtataccttggaatagatctgaagaatgagattctctagaaccagtgcatgttcaagaatgcaagatagtgcactaaaatcatcaggcacacaccagtattcattgagtaacaaagtctttaacttggtaaatgttgggcaccattccaaatcccttttgaaaataaactgggtaaaatgcaaacaagaagataaacaaatcctcagagttcaactggatataaacatagtataatagaataataagacaacataaactacttaaagatggaagtgcaagcataccaatctacgttcatttatcagcaccaacgtcttagcttctgataaaccttccaaacgcatgcatttgtggtccttgatatcataacaaggttcaaagccctcacaacaacaatccccaaagtcataatgactacacgattctttataacagtagaggactctaacaaatgcgtcaactaacgatggcatccactcaagcactggagtcctgccatggaaatcatccagcttcagagaaacaagactcgggatagcgatacgtatccgagacgtctcactgaaataggaattggttatgctcaaacgttttgcagagctagatgagatcttggcacagtcaaatttgcatgactcaaacactagatgctccaatgctggacagctcgagaagttaagaaagctgtcgtttaggcctatgttcttaagctgtagcctcgtcaagtgtcgggagacaagtggcatctcatctatcagaaacgggaagcgataccatatatcgacatcgagcaagaggaaccgaaccttgtggagcaaagcatgcctgaaccagtggttcacccgtactgtgtcatcgaggccctcgtctctgtaccaatcgagccaacggaaccttagcacgcacgtgtcgagaggtgcgccatcacggagtagcagcagacggtcgagaaactccttattgtccttcacgcagcgcagatagatatcgtcttcgccaatgcgcagcccggtggcagacttccagaggtggagccatcgccgggctagcaggcacgtccggacagcctcctgcgccggtaggaaggagagcacgtggtggagcacctcgtccgggagggtcccctatgcggtctcccccagtcgagggaggcgattccttggccatcttctgcggagacattccgtcgaacaggttgcgggcgtcgccgcggcgcccccactggcgtagcaagaaccgctcgggcgacacgaggagcgccaaatcctagcgtgaacgagcaggagagagggctgtgctgttcgggtaagcagctcacatcgccgccggaagctttcccccggccaccggagaccaaagagaagagagtggaacgcgcggcagcaaggatacgcacgccgacggcgcgacactcgctagcccgacgaacggtcaggtcgcgcggggggtgggggagagaattccggcggggcgaggcggatggagaagcagcgctgcgatgagcggaggaatcgccggatcggagtggagatggagaagacgacggggtcacagactcagagtctcacggaggagatgaaagttttttttttcttctgtttttttttttgacgggaaggagatgaagggatatggctgggtttccagattttttacttatttttaaaaaaagatttaacaaataaattttcaattttaaagttttacagaactatactctttccaccctatcacacggcgggacataaatcgtcatacagtagggcaatccatgtgacgtggcaccccgtaggagaggcgcaccaacggagagcttggcagcggcgcaaggtgggcggcgagctcggcggcttcctgcggtctgtggcgacgagggtggcaatggacggcggcagcggcctcttcctagcgacgacggcgtcttcgagtcccttccacaggtgaggttcttcgttcaaccaccccccccctcctcccctccccttctctctccatagaccaccttctctctccctttttttcccaaaccacccgtgcttccgcaaatcacactaatatgtttgaaccgctgccttttgtatttccttttattttgaatctaacgtggagcttgagaccgctgtccatgatggtacattgaacatgatcttagtagtagtaccctttgcagtggtcaatgtacctttataagaaatcctcctgagcaaaagatagcatagcggtaaaagccatcaccttttttcatgcttctgcaccaaccatttcttcaagctgaacaagagcattgtagcatgcttaaaggccaactccgcgcttcagtaaccaaaatctcacgttcttatatttataggtcaaattttaaattcaaaacttaattttggaggtaattttgtggttcttttcattgtggtttatatttacagaatttgcttttgaatcgctaaggacatgtatctaaaagttttacttataaattattttttgttgccaataacccatatggataagtataagcgaaatgttagcttatatttctacgcaggggcggaattagagtatattagggggtgcccaggaaacctgattaagaaaattttttagctatatctcacttttttttcaccatgtgtgcacccccgtccatacaaacttagacaccaacatcaatttaaactcgatttaatgtagagtaaattaaacatgtggcaccccgtccatttcattccagctccgcccctgtttatgcggagtttcttgtaaaaaaaatgcctagaacatgtggtccctttgcatgcttaacaatgtcttaactctggtcattctcttatgtttagtatgcacatggaatactttgttattgatcggccagtaatatttacaagtttacatgagcaattagtaacatgaaagtcttgtgcccctcaaataacagactcccaattaggggtggatgtcgagctggctcggctcggtctggctcgttagaataatgagctagctcggctcggctcgttatcctaacgagctaaaaacccagctcggctcggcttggtctggctcgttagaataatgagctagctcggctcggctcgttatcctaacgagctaaaaacccagctcgttaggctcgtgagctttgggggcagccgacgaccacggaggcacggaagcagctcaacctcgccggcaccttgacagctcaccggcgaccacggggaggagcttgacggtggaggaaacgagctcgagctcgccggcgaccacggggaggaacttggcggtggaggggacgagctcgagctcgccggcgaccacggggaggagctggacggcggaggaaacgagctcgagctcgccggcgaccacggggaggaacttggcggtggaggggacgagctcgagctcgccggcgaggcggcgaccacggggaggaacttggctgcggaggggacgagctcgagcttgccggtgccgtcaggcacagggggaggggcggagagcggcgacggcgtgtgggacgagctcgagctcgccgacggcgtcgggcgtgggggcagggagagtcggagagcggcgggccagcggcgtcgggcgctggggttaggtggcggcgtcggtcgctagggtggaggcgcagagcggcggtgttgggcgtggccgcgtgggccgcgtcgcgtggcgccggcgtgtgggggagacggggagctcagccgccaccactagggaagggggaagggaagctagggttttggtttttggtctattgggccttctaaataaatgggcctatgggctttgtggtctggcagcctagctcattaaagctcgcgagccagctcgagctggctcgttatctctaacgagctaaacttccagctcggctcgctaggaaaatcaaacgagccgagccgagcctgtcacgagccgagcgagctaacgagccacgagcttcctgtccacccctactcccaatcatatgcatactatgttttgagattacctttaggttaaatgaaatgaacagggagcattctgtcaataatagttaatttgcgtttaatggtatttctgcttaagccagtattaatttgcgtgcgtatctaagcgcggccgtgtattccctacgcactacatttataaacagagtagatacagaactccccacaaaataaaatagcaagtattacagcaagcccgtaattaactggtgattacgaattttaggattagagaggactattcaagagtaaatttgttcggtccctcagcctctggtgattacaaatttctaggtgagctcatgaatatgttgatcagtgcagaagactacacggtcaactgagcaaagactactagaaatgcataataaaacgtcaaaccgcttctgggtagatgacctaagtaacctagggactggtttagttcccaactttttcttcaaacttccaacttttccatcacatgaaaactttcctacacaaataaacttctaacttttttcttcaaacttccaattttagtcaaacttccaattttagcgtggaactaaacacagccctactacaaatccaaaagtctgccccttcaagctacttagagggagaaaaacaccaatgttaccatcctttaggtctcaaccttctgaataatcaaaatggtggtgcatcaagcatcttcattgtcatcctcatttccctcttcgtaagagtcttcgtcttcatcttcatcatcatcgtcttcgtaagagtcttcatcttcatctttatcatcatcgtcttcgtaagagtcttcatcatcatctccatctctatcttcgtcttcgtcttcgtcatcatcaaaaatcccgatttcctcaaaattgaaaactgcagaaataacaaatacgacaagcacagtaaatttcaagatgtctcagctgaaaattaacttacagaagtttcagttacttcaaaacgaaaacattgaatcagttgacaaaggtagtccattagatcaatctttccaaatacaaattgctacaaataccacattacttctccataaaaaattctgattatacccactacttcattcaaagaaaagaaacataataaaatgccctaacttggggaagtattgaccctttatttcctggttgcagcttatactgcagagttgatggattctctatagcctggcacacaacaatagagaaatatgcatgctctagggactataagggtacttataataactggtaaacaagatgcttggacttcaggcctcaatggccaggtgccgtgagtagagcccccacctaacaaatataatctagaggcaccgaaaaacattatcttagctaaacaaaagaactaagcaatcttatgcagttattggcactagttgctatgatgtgactaggatggttagtgcagacagctaaagagcacattcaggcattcagccctatggtaggttaagctgagacttcagaagaacagtattctctcacattagtagtttgacaacgtgataagcagtctgtgaggtacttgtccacatggcaaatgacatgggagcaataagagcaagtaataaactggaattcaagatggcaacatcaacataaactgcaatatgcaactgatgggaaagaaaataaaatcaaatgattgaaagatataattacagccatattacataaaaattatcatgctggttgtgtgatgcaaggaagttttaagaaatctttgtatggtttttcttctttggatactaccagccaaaagagttatactaggtaatttcttcccaatcagaccaaatgcagtgcatgctttaatttctgaatcaatccctgttcctagccatttccagtgaacttaagagtttcaatactgcttgctatgtttcacgcatatgaagaaggaaaatctctgaaatatagaaaaaaatgaagtatgttctttacgtatgttaaatgtagacagatacttcaaaacttcgtctacaaagttatcaatcatttcacatctgatttcaactatctcaaggtgtgctgatattgcagctgatctatccactgaagagcagtttccgttgattttcattatatgttcaggtccctgtcagaaattaaaacatttaataagaacaatagaaaaatgtttaaaaccttcaacaacgaattatatgtcaaattagagaaggtatacctcagaatatatctgaagaatgagattctccagaaccggtgaatgttcaagaatgcaagctagtgcactataatcatcaggcacacaccaatattcattgagtaacaaagtctttaacttcgtaaatgttgggcaccatttcaaatcccttctgaaaataaactgtacagaatacaaataagaagataaacaaatcctcacagtttgagtggatataagcacggttatagaaatgatataatataaacgaactaaagatggaagtgcaagcgtactgatttttgtttatttatcagaaccaacgtcttagcgttcgataaaccttccagaagcacacatttgttgtccttgataccataacaagattcacagccctcatgactacaatccccagagttagattcactacaaaagtctttagtatagaagaagattctcacaaatgcgtcaactaatgatggcatcctctcaagcactggagcccggttgtcaaactcatcaagccgcagagaaacaagacttgggacatctacacgtactcgcaaggtcgcattgaaactacagcaagtgatgctcagacgtttcaccgagttagatgagatcttggcacactcgaagaaacaaaactcaaacaatagatgctccaacgctggacagctcgagaagttaaggaagctatcatttagacttataccgtaaagctgtagccttgtcaagtgccgggagacaagaggcagctcatctatcggaaccgggtcataaaactcccagttttcaagctggaggaaccgaactttgcgaagcagagcatgcttgaaccaaaaattcagccgggctgcgtcctcgatgagctctttgctgtgctcactaaaccttagcacgcaggtttccataggcacactatcacggagtaccaacagatggtcaagaaactcctggtggtccttcacgcttcccggatcagtctcgccctcgccaatgcgcacccccgtggcggacttccagaggtggcgccatcgccgggctagcaggcacgtccggacggcctcctgcgccggtaggaaggagagcacgtggtggagcacctcgtccgggaggtcccctatccggtcgccgccggtcgagccgggcgattccttggccttcttccgcggagacattccgtcgaacaggttgcgggcgtcggcgcggcgccccccctgcggcctgcgcggagcaagaacagctcgggcagacacgagggcgcgccgataactagcaggaacgagggatctcctgggtcagcaccaagcagctcgcatcgccgccgcggcagcttccggccaagaggccaccggagaccagagtagaacgcgcagcaccgcgtggcgcgtgcggcagcaagagtacgtacgccaatggcgagaagcccgacgaagagtcagctcgcgcggggagagggaatccgtggggcaaggcggcttgcagctggcggcggcggcggcggcggcgcgcgcgaggatgagcggaggaatcgctggatcggaggaggtcagcctcgatcagtttgaggcggcgaggagagagagagagggaagggtggggaaatggaggtgattagtttcaccctatttgcaacgatttgccactgccccacatgtatagacacatgagagcccacatatcacagtgagtggcgactcgttaattaccatatccaaaagtgacaattaaaggatgcatgtgaaaatatacccactgcattgttcatgtataattctaatgcttctttctttgggtgaaaatactccaattgacatcctaccagggtttcccaaaccgccggagtccgggttacggcgccccggtggtaagcacggttaccgcgcggtaaccacgataaccgtgaaaaaccgtacaaaatttatcaaaatttcaaattattttttaaatttatttgaatttaaggaggttaccgcagtatttatattaccgtacccccgcggtaagcttggtaactgcgcggaccttgcatcctatgcagttcctttaaatcaattcgaacacataggtgttcttctctcgtcaacttatagatttttcctcgatttccgttagcatgtgttttcaaactgataaacgatgggtttcatagaaaaaactttctatatagatgttactttaaaatataaataaacacatatttcaagtttttgataattaaaagtcaattacccatgcactaatagctttctcattttatgtgccttaacttcatattcatcctaatcaatctcaaaaaccacctagcccttcggtaattaaacgagcaaactactcccatcgtcgcgaaatataagggtttttggctggatgtaacatagactacgaatataaacagccgagtccatattcatagtactaaaatatgtcatatccgactaaaatgtttgttcgaaatacacccccaaacttcaaaattgggtatcaacccccctccctcaactattgaaatcgtctaatttacacacctaagtggttttcttcacggggtcgaggtcgccccgctgaccccgtcccctctgcaagggacgcaagcacccaacgccgtctgcgtcctactatcacaacacgtctaatatgtgacaggaaaacaaatggagggagctagacggggatggaggaagggatgaggccggggatggagggaggtatcttgccggcagcttcggctcctccgtggagcttatcgagggaggggagaagagagtgtgggattgacaggtgggacccctatgctgacgtggaactacttgttgaatggcatccaactataccaaaaccagcttaaaaaccactccaagagggtaaaatgtccagtattgatagtttaagggtgcaatatacctagtttcatagttcggggtgtaaattagataacatgaagagttgaggaatgtacaatgaacttatccctatattttggtacagaagtagtagtatgctagtatttgacaagaactgatcttttaagatcgcataacagctttatcagctattatttgataaggctctaaaagaaaagctatgtttcgacaagaatgaagtaaaaatgtcaatttaaaacaacacatctgataaccggcttaatcattgataacactttttccccccaagtatcagaacaagaacatagttgcagaagcaataagacatcacatgagcactaggaatcaaaattaagacaatcaggttgctgcatgacatccacaaattggacccgaaaagcattaggagggatcggatagttcttgtactgctaaaatcaagattcgagacagacattacaaggactgacatcaaggctcacagcaaaaggtgttttcatgtgatgttgtcttactcttagctatgagcctgaaaaataaaatgaaccttatatcttaagctaagacttttgcaggcattttcccagaacaaactgcagcaaaggcatctgcaaatccatgaactaatgtagtgccctttgctagtttgctgtggtcaatgtagaagtatcttgctagcaaaaatgatactactatattgctgtaaaattcagcaccatttttttatcaatcccttcaccccaggtatctctactaacataagggcacccacaatggttatctataggctctctataagagatccatatcagcatattttcctacatggaagatattaaatgaagagagagagcaaaactatctactaacttagagatagtctatagagaaaaacgagacaatgcatgagagagttatagatactcatgtagacatactattgtggtggtttactattaatctagtctattgctaagatgtacatgttttatagatagcaccttactttaccattgcgggtgctctaatgcctcggcatgaaccgcttctccagactgaaacaaaagcattgcagcctcaccatgcagtccaactttggtaaccaaattaactcttatatctccttgcagagtttattgttacccaaaaaaaaaaggatagaatctgtaatcccttggttgcttcttggcatgctgcacgaagccctttgcttggcctggatagaagttgggtcagctctacttgtttcatacttcctccgtttcacaatgtaagtcattctaacattttccacattcatattgatgttaataaatctagatatatctatctagattcattaacatcaatatgaatatggatctagattcattaacatcaatatgaatgtggaaaatgctagaatgacttacattgtaaaacggagggagtatcaatcataaagccgaaatcctttcaaccctacaaaacacaagggaaagatttctgtcaaccctgccagtactacagaaccaagtgtgagacagtgcacttagaagctccacacatcgcatattattaaggggcgcgggctggggcgatgttggtgcgggccacgtcgcccctttttcctcccgccgtccgatcaggcgtgggcggctgggattgaggcgcgcggtggaaattttgcgaaaaatccctccgatttatatataattcaatatgggtccctagcgaacagttcctatgagccgatgttttacgtgaaagcccttgtagtagccggatattccgtgcgtgggagagaaaaaacgcgaatcgggaccgcgctgtacaatcttaaagtcgaggggattttttgcataatgatccccattagcccacccacccccaaaccctagccgccgccttccgtctcgcctcctcccactcgtccccatcctctcgctctcctgcctccgcctccgcctccccctcgcgccgccgcctccgtcccgcgcgaccgcctccgcctccgcctccgcctacgcctccgcctacgcctctgccttcccctcgcgccgccgcgtccacctcatcgccgccgccgtcgcttcgtcgtctcccagcgcctcagcctccccattgcgtcgtcgccgccgctgtcgccccgtcgtctcccagcgcctcagcctccccatcgcatcgtcgccgtcggcgagcgcacccatctccgcctccactagcgtcgtcgcctcgcgccgccacttccaccttcgcctccctccgtccctgccgaccgccgtctccggccaccagcgtccggatctggcccccatgtggtcgggggacggggatctgacatcccccgtgcgccgggcagcatctccgcctccgtcaccaccgtcgtcgtcgccgagcgccgccacttccgccaccgcctcgccccgttgctgacgagcccgccgcccctgctgcgtgcttcgccgccgtcgccgacggtcggtgctccaccctccgttgcggctgccatcgaagaaacggcggtggtgacggagccggcgccaaggaaggcagtggttgcgtcgagaagaggaggaccgtacgtcgccaggcggctccggctttctctagaggagtggagttgcagagtgacgtggaagccggtggcacacaggagctagccgacgagcttgacaccgagcagcttgggctggagagcaagattatggccatcaggaacttcttggaaggaccccgaccatgtcctccgtgatcccatttttactttctcgcagaatatgctccaaatatgcaactttcttgacatgaactgtgcatgttttttgtgttttgtctcagcccaaccgccccaacgacgtgctggtgaaatagtgagcttactgcaaaaccggctaaacatgaacatcaccttcaaggagctgcaggtaaagcttttttgtccttctgttaattttattcctaagcacgtttgcttttctcatcgggggtaggacggtcctgctgcggctcaacctccactggggccacatgctttgactggccatcatcagcagggtcatccagcctcctccgccggcgagggcgaccagcctgtactgcaggcttggaccgccgtaggggactgcgggcgccatggaggggccgtgctgtccctgtgaccaatggacgatgacagttgcggctgccgcgagtccacgccgactgcgaggcggttaatgtcgatgacatgttcagcctgcgtagggatagccagatcggcaaggatcagtttcatggtaattttttcttgcagctcctccctgtcagcatcttcttcctctaatctattctagattttcagtgtatcaacatgattgatttcgcagccaaatataatccattccttccgtcccactcctattaaaaagcttgacctttttaccaaccgatgtcatgttgttagccacatcctgttcttagttttttctaattgtccattcgctcattgggttatgttaaatatttttgaacgggttacgaattttgcaatatagtactaataaaacacataacgtctctccttttgtggagttgtctgattattatctaggatcattcactgttaggcctcaacacatttttttaattcctccataatgtgagagatactaatgactgttctcaagcagtaaaggaaaaccacatatttagattagttagccttccttttctactcttctcccgccatgtattgtttagtttatagaggagatcagatggacatatgctaccaagtctgtcatttcaagttctaaaaaaaaagtcggatcatttcagtggtagttgggcaaaaatatctgttggcatgcgagaacttttgcctacttattttaagaatgtttttgaaacctaattaggctataactcatatatcttggaatgtcctatttgttatatttagcgttgttttcattactcactgatgaaaaatttaggcaggggtgcatggattcacatgtttggaatgagatcatgaaaggatagatggcatcccaaggaactgaagaaaaacaaaaaactgtaggatcagcaatagcagttagagaggctttctggttttttgaaagggtattttagaagtttactcaagctgaggttttggatacagttaagcatttcataaacctttctgatgtgctaatacactccacatgtaaatatagaaagttactataatggacttttccaattgtagctatagctgagtgctaataccataaatttgcaggtactaatgaatacataatgaattgatctacccctccactcaaagcctcaaatcatgtcgctccatacaagtcgaatggccttgacaaggcatcagagatatcggtttgttcggattctgctgatcaaagttttagagtcgaggtctaatatggttgatcacagggccaatcttgtgcaggtatcacagaacatgtttcaggcattatcttatcacatattccatatgcttatattatcatcctttttttggcataaatgcttgtaccatattaccagtagacatctgctagcccactagaatctcttgatggagacgttaaaaccgccatggatgatcatttagttgtctgtttctgcttctgccgacataaagaaaatcacaagttcactaaacatctcccacctgtggtgactgagaaataggagctcaactgcacctgcttcaggtggtcggctttcctccatgggacatggacagagctatcatccacaatgtagaaaaaaaattaatattagctgggttagctgaaggacaaggccaactaaatttcattaatattttaggagagtggttacaaagattattacaccaacaatagggtgtcaaaaccgggtagaaaaaacaagggatcaaaacagccggaatcggtactgtctctacggaaatggccctcggtcagttggtaacaggccatatttatcaattaaactattgtttatatgtagctaaaaaggacaacggtcaaaaaggtaccaatgatatgaaacgacactcagtcggcagggaatttccgtggccattttcatccctagaaaaaaaccgacctacaagtgtcaaagccctcaaggaaatttaaaggtcatatcatgtaatatgcaacaatgcaacataactaaaatgggagggagggagggagggagggggttgttaaaaccaacttttttaccacaaaaaggtttcaaatttggatctgcatatgaaatttagttgacacgaatttttttgacaggttttgtttgctcgttgtgtgatcattgttgcagcagtacatgccatccatctgataaattaccttgaatgtctcaatgttgaccacttaacattagcaatttgcttctttagattcttattgcactccgaaaatttcactatatgctcaattctattgttcctatatctaaaagcagtatcatctctaaatgattatccacttaaagcagtaccatctctaatgctattgttgctatctctaaaatgttgtgagtggaacactctgaattgcttgtgaggagcaggtaaatggttgttgtagttaacctaaactgcaaccgttttttagtgtttttatcaatgaatgattctcctattttagtgccactaaggctaaagctatttggtagagagcttggtaaaaagactacttcctccaatcaacagtatttgatattgggagtaataagttagtactcctgatgtcaaatattattgctaggagtgaattcaaaaagttagtactccctacaatcaatagtgttattgtcaaatattattctcgtgtaatgcattagagatcacaattctttgcttagtagtcatttaccatgattttttttcattttctggcaaagttgaaaaattaagcgaccatgctcttatttgcagcagtttcatggatgcagagctattggaatttgcaaactaaaacatggaccccaatgaacgtcacgactttaaaagtatgtcttgtgcacatgattttgccctactcactttcttttttgcagatatattggcatcggttttctcgtatcacatttgatagatgaattgtttgtagtgttggtgcataatttgttatatacatatagcttccatgcatattggtaggatagaaggcattaatatggactttgcctgttgtacatgagcacacttgaggcctaagttagattttcagtcagccgggaggtccttatgcactatgaggaataaactagcacacttggaggtattgaggtgttcttctacctgtccatttttggttaacatggatagctactcatgtggtgttcaaactgccttgtaggattctcatagctagattaaaattcacagatattttctatgttgtcaacttctttttctaatggcaaatcgcaagtgttctcctacttcctggtgataagtataaccttgcttcttcttgttattaacaatcctgaaattgttcagtacaatggtcgttaatgtatatgatataactttgtgagagtgttttggcgattttttattatgtatgttttggtctgagattgagaatacatcttataaactgaaatcaaggcccaccttggcactaatggatcttcatcctctgtttatgtgtagtattgtatttctgatttcctaaagtggtcttggtgaaggttgatgatttgtatgttttcactatagtctcgttgtttctctgtttattgaattatactaagatatgactcaaatttaatagttgaaatgagcttaggcttttaaacctttcttccattatgtgtactgtatgcattattaatgtattaaattctttataagataatatccatgtttagtgacacttaaaaaagaatcacgaagaaatttaaccctactggattttctcttatgtatcatgaccaaataacgaaccatatcctgtgccataaatatatcttctgagaattaatatactaaggataaaatctgtcatatagtattaataaccctcctcagaggacaattgcatgcctgcatctttttttatgtacttgtttctgggtttcttttattgccatgtcctgtttgggtttcttttattgccatgtcctatttgggtttcttttgtgattgtttgctcttgccatataggctccacggtaccgactgtgacatattatacccacagatgacgatgaaatttggtggagcttttggtgaagaaaaagcaattggaggacgagaagcagggaatgattccatcgaatgtttgaagcatttgttttggttttctgttttcagatttcttgcaagcaaatttaaccatagcatcacaaatgcctagcccttcgatggaaatttagatgttttagtagtttaaagtgcagctataccttttcattgtatttgatttgcgcaagtaccagaactacctgaacaagtggaactctcattattaggagttttgttgtaattatgcccaaagacaaatgattgtgctataactatcactactagcaaatgtggtagtttgtgtctgatgacttttgctacagatattaatgaacattgattttcactaatcatagacaaacgccaattatgcatctgtttgagctgtccacaggcggcgcgccactggcgcgccccagcctctagtctctacaatggcgcggcacaaggagcttggcagatgccatctgttgcagcaaccaaggcaatgccatcctgttccaacttccacatcaattaagggtgtgtttagtttacgctaaaattggaagtttggttgaaattggaacgatgtgatggaaaagttggaagtttgtgtgtgtagaaaagttttgatgtgatggaaaagttgaaagtttgaagaaaaagtttggaactaaactcggcctaattcatttgagcttaaaattggttaggtgtaattatggcaggcatcaaagctaactttcgaagcatcaaatttatcatactgtagttttgaagtagataattggaaggcttatttagtgctagatgacagaacgatacagactatcagacatacataacttcttctttttcagtaatgagcaaataaagaataagagattgagggaaaggagcattcgaaaaattacccttatcatatttcctttcattctgaatgcatggcatttctagttcaataagaggatatccatgatatttgaccattcaagaatgattaagactacatcggtgcttaatcagccaaccaggccatgcattgtggcgtcatgtggactactatctagaaatcgtaaacatgaactgaaggttgagataaatcggaattaggaaatgcagagggggagaaaatgaagcatgaaaaactgcgagaaccctgtttgctcaaagtacgagaacaagaaaatagttgtcaaagaaacaagacatcgtatgagcattaaattaagggcactaggccagcaagcttaaaacaatcgagatgctgcataaatatccatgacttcaaccagcatagcattatcaacaatcagattgtttgtagttctaccgttgatgtcaagatttgaaaatagatgttacctcatcaactgataacctcagaaaatgaagtgttgcattagctatataggccgggagataatagacctgcaacatgagtccgaagatgttgagttagacttgtgcaggcaatttcccagcacgaacagcagcataggcatcagcgagcccaggaagagcatcctcatagtgatcaatgtactttgctacaaaaacttcgtcgcgcatacatacacaatggtagaagtcaagaccttttcttatcaatcccttcacagcaagggcttctgcaacataatgcctcggcaccaaccgcttctccaggctgaacgcaagcagagcacaggccttcgcaaaatgtagtcaggctccaatccgaccttggtcaccaagaactcttatcttggcacggagtttcgtctcagaaaatccagaacttgtggagacttgcagatggcatagcggagctcgtccatggagcaaccaagagtgctactcaacaactccatctttgccctttgattttaaaaagtctaacattttagattgcaataaagacacatacgcgtgcacaccactaacatttgataggtcctaaactacaagcagagcactttgcgtaacatatattataaaatatataaccaatgtgaaagtataaaatatttccaaatcatattaaaaacctacttcctccgtttcacaatgtaagactttctagcattgcccacattcaaatagatatatgcctagattcattaacatctatatgaatatggataatgctagaaagtcttacaatatgaaacggagggagtaccgtttattgtcccaaaactttacagtaaaaatcatggtgaagatccaatcctagcagcatttgcatatgaccttgggttgtgcaattccctgggtgaagatcataatatccacaattaaagcaggaatactgtaataatgctgcatttgaactcaaaatgagacagctaagcttgaggcacactctttagctgttctgtaagtaaggattatgctgtttgcagaagtgcttacaaaatcattagcacaatcatgatcatggtgatgtggtcttgaaataaatgagaaatagagcagaaaggatacaaactgacctggacaacagaaccagagaaagagttgcatcgaggcacatttgctaaatgatgaacagtgccatttccagtgcctggataatggtgccaaacaaacaatcacttgatccatatgcctgtctatgagtggcactcttcatacaatcaacttgatgtatcaaatcaacgataagaccatgcttttcgaatttcgactagtttctctagcgcatctccacaaagccaatgccagcacgttccaatttcaacacctcttcctgatcaattcgttcatttgtacttccaattgcttaggtgtaattgtgttagccatccaatgtgttcttttacttcattctagtattatttagctttagaaacaccaaaattaacatactgtcatccaagtagataactgaattcttaatgcgcagtgaaagtataattacagattatgtgacatacataactgattttcagcgatgagcctatcaaatggcatttgaaaaaatcaacctgatcatatttagtttatctctcttacatgatatgtcttgtttataattactagagatccatgccccgtatttcaccagagaagaatgattgaactgggcatggaaaacattgatctgctagcatgctaagcagtgtggtgccatggggatatttttttaatatacccaacaagctattgaaataacaattgaaggttgaaataaaatcaaaattagataataccaaagggaaaaatgatgcaggtagtactgccaaaaccctttttgctcaaagtacctgaacaggagaatagtggttcaagaaacaagtcattgcatcagcagtaaggctgtaagggcactagagcatcaagatttaaactatcaagttgctgcataaatagcaagttagcaacaactcatattacaactgaaatcaaaatatgaaaaaggcatgaccatgcatgaaaaccatcacaccaattagtgatcctcacaacatgaggtatgggcttgaaagataattaacctccaaagatgttatagttggactccagaaggcattctgccagaatgaattccaataactctgtccgaagatgtcagtgttggacctctggaggcactttcccagcacgaagtgcagcataggcatcagaaagaccagggacaacgttctcgtgctgatcaatgaagttttttacaaaacaactttcgcctagctgtacatatgagcaaaagggaacatcttttttcaatcccttcaatcccttcgcagcaaggacttgcacaatataatgcctcgccaccaaccgcttctccaagctgtacgtgaacagctttggcgtcttcaaaaggtattcaggctccaatctgaccttgccgaccaagaactctatcttgctgccaagatttgtctcagataatcctagaatttgtggtaacttttggaccgcagagcggagcttgtccatggagcaaccaagactgcgactcaagtactccatcctcgcggtggcactgccttcgctgatgttagcaaaaatacccaccatgtacttgaattggcctgaggtgcgtggcacgccaagctcatcggcacgccgcacaaacccttccacctgctttggattggacgtgaacatccgtggagcaaacctggccatcttggcaatatcacaaacagttagcccgcactcctggagcagcgcgatgttgggcttgatcaccttctcaaggtcagagagcaccagcacgttgttccccttcaagatcctgaggagcgtctcgaaggatcccaagaaggggatccagaactccagcctcgaggcgacgtcacacgcgtggatgcccttggcgccgcccgcgaggaggaagctgccgatctgggggtccgacaagcccacgcggtcgcgcagggaggcgatgcggcgggcgatgttgtcggccctggcgcagagcagctgcgggtcggaggcgacgacggcggcgaggtcggcgcgggagaggccgacgccggagaggacggcgagcacggcgtcgggcttggcgggcgacctgaggtgggagagcttcttggatgctttgagcgcctgggcgccggtgaggccgcaggtgtcgacgaggtactcctcgacagagaagggggtcgcggcggcggatctggcggcggtggagaggaggaggcggcggcggcggctgaggtccagagaggaggtggggagatgggtggcggcgcgggcgcggagcagcgggaggaggtggagcatggcgccggcgaggccgccgccggccgtcggccggcagcatgagaggcggagcatgtcgccggcgacggcgaggctgggtttagcgattttgctcggcagtgtggagtgtgcaattttgggcatgttcacttcgatgcaattttcaaccataccaattttttttccaagttaaaaaaaatgtcactaaatatttctatctgtcaaaatttcggtattaccaaaacttggtaaggtttattttggctacaatctaagcaagccctttgctttttaccccccttccatcaaatatatttgtatttgttttttcaagagtaaagtgcattggtgatccttaaacttgtaagcttgtgtcatgtaggtccctaaactctcaaaatatatatccaggtcctagaacttgtcaaagtgtatcatttaggtcccaaatcgacacatcccctctaggatcctacgtggcgctaatgtggcatatgctacatggacatgacgtgttattttcttttcttttttcttctttttttcgttttcttctttttcttcttttttttccctttcttctgcacgggttacagtgaaagaaaaagaaagggaaaaaagagaagaaaaaaaagaaaaagaaaaaaatttaaataggtcccatttgttagttaaaataatgccacgtcatgttcgggtagtatgtcatgttaacgccacgtaggatcctgaaggggttgtggagatttgtgaactagatgacacactatgataaatcattttgagagtttagggatctagatgacacaccccctacaagtttaaggaccgccccacctcttttttcagtatgaagattaggaaactgctcctatttttgtttcccctatgccaaaatatatttttttcaggaaaggtcagaagacatggtttctaaaatccactatgtttttttttaaaaaaaaatataaaagcactaggagtaaattgctattgccacactagggatctcaaaagacgaaagttgaaccgtattgcaagattgaagaggttagttaaaatgatagaacagagaagatgcgaataggagcatagggagatgcaaataggagcaaaagaagacgttgtagtttgattatttagggcccctttcattcaaaggaaattcataggaattttagaggatttcattactataggaatttttcctatatagtcctttgaatcaaaggaatggatcctatgaaattcctatggaatgactcttcccataaaagttttggagaaaatttaacatgatgtagaacctcatggaaagaatcctttgagtctttatctttcctcaaattactgtgtttttcctgtggctaaatcaaacaatcattcctatgtttttcctgtgttttgcaatcttctgttttatacttgcattcctgtcagaatcctatgtttttcatattcctctgttttttcattcctatgattcaaatgggcccttagttcttcaggagaagatgtagaaacaaggacgatgcatgttggagctccacaatagcatactcaacctcacatccaaagagatggaagcggtagctagacaaggatcacaagtagtggcaagtgtgtcttagggtaaaagtagtgaggattcagatcatagttgaggcacaaaagggacatgaaaaaacgacggctcgcggagtttacatgttggccataggcatagcataaatcttagcaagaaaaaaaatcaggacaacgagtgacccaaacttttgcatatttttcagttggttaaagttgttcaaccagccaattacataatgtgaaaattttgtttaccatgatttaggctaacaaaaagtctacactctacaaacaaaccaacatattggacatgactgaacttgcatgagttgcatctaagaaatctaagcaaagaaactgcaactatcatctaatccaatgcctgcacaagttgagaagtcaatagcactatgtctgaaaaccatatatcattcctggtgacttggtgagccataggtttcaacaaatcgcagcaagaagaatgaaacgggggcttttcttgcttccagcaataatgcaatatcaataatctaattaaaataaacctccaaatgcgtggcaatggcaaattggcaacccaatgaagagcatctccctaaaaacacaccagatgcagccacacagggcatgcatctaagcagagcacgttcagcattttcatgaacaccataatgttgacaaaaaaaggaaaaaatcgaaccacccacaaccaaaatcagctacgtttaatcagttgaacttgaacagcacattggatcttgtcaataagagaatggtagcagcccaaagattcacccattcacacatgaatcacccacaaaaggataaaactctgtaaaaagatttgacagtatttttttccccaatcaaatattattaagaacaaaaggcgccccaaatttagactttacctcataaaccacatgctttagaagcaaccaacaacacaaaagctacttccacattgccccattgccatccctgtccatacctcacactgcaagtacccactggaaatcccaccaatggctagggcagatggtggtgccagttgaagccaaggccgactttgcctatacaattcatctatcagcccagtttatcagaagtacaatagcttagaatcgatattatgagttgtatggatgcagttcagttccacttgtacatcatgcatatatattcaaatgaacctcactctctactccaaactgatttcacgctagtcccacttgtttcattcgaaccctaatatatactccctccgtcccataatataagggattttgggtggatatgacacatcctaatacaatgaatatggacagacggtctatccagattcat

SEQ ID NO: 79091 - DNA, 6438 bp, Oryza sativa
agttttagacttggtacggatgctcgtatttaaggccaatttattgtgtttctcaaaaggaaaataatttagtctcgttggtacgcacgatagaaaaaacacacaagaacagaaaaaacgcaagaatgaaagtagtatgtgttttttttttcaattctacagggatcataaacatagagaagttgaagagcagcctttgattgaaaccaagataaaaaaaaattgaacaaacaaagttcccaaagagatatgatctcttgcttcttttttacatggaattggaccataggaatacaatcacatgaatatttcctaccttttcttaagaaccaaaggagcatataggaaaaacaatccttagaaaattaaatctcaaaaaatactttgccaatcctccatttcaaagggcccttgaagtttttcctctacaaagaaagtcaacaaagatatatttgggagcctatttggtcacagtcatcaatagtaggcttcaggacttttgaaaacgataaattctagtactgaacagcatcttacgcacgcagatacctggaattggggcgcaggattggaatttcagaaatatcatgcaatcatgctctaatgatcaaatgcaactagaacaagttaatacttgaaaatcctcatgatattcaagtatatcttgatatcccccctttggaaaagtcaaatacagctcaacatcatctcctcgctgcagtgtttctattcaagaagtaaaagggtcaactactgaaaaagaaagcaaggaaaaggtaagaaacttgcaaacttggcgtccatttctcctgcgcgtccaagattttcagctggcacaatagaaattgacctgcaagaattggccttttctcctttttgttatatgagttcattcataatttctcatcttgaacttcagtgcaacccattgtgttagtttgagactaaaatttatattcacgcaaagatgctgaaaatttgttgtgttagtattggcgaactggcgctctcattcatacagcatcatggcatattggcatgcatagtttgaacacaatatttacttcacagacgaatctgagcaaaataatctctttaatttcaaaaaaatccagtcacattctgtacttgaaagtttgcgaatccaggctatacagctcgttgtttacaccgtgccctggattcacctcaggtcaaagaggatgaacatactaaagaatggcagcacacttatgaacaaacaaaacaaacgacaaaaatggtgtcatctctgatctaagctacaactaactaaaaatttttgctgttatagcttccataacagcagtattgatatcatgagaccgctgcatgaacaatgccatggcatgatcacttgattcacttcccaagctttgggagtgtgagagacactgacggtgtctgaaaccccatgaactgatcccttggtgacctcctgatctccgggctcgggatcgggagcttgcaaccggtaggcgtcgggagacccatgtagtgcagcctaggtgacagcctgatcttcgggcttggccgaggagacggtatcggcagcctgtttgtagtaggagagggcaccactcttggtgaaagattgacatgctcaagagccatgctctgtagatcagccgggtagtcccggacacagccaatgcgagcaccattcgcggttgcccatttgaaggatgggcggctggccatgatcggtgccaccttggtgtcctcgctgttttcgacaaccgcttccttcactatgtctacctcaggcagctcaatttgtgagctgtccatgatctcatcatgtgtgggttcagtaggcttctcagcttcctctggtttctcctctgtcttcttgaatgacgggaattcatcgtcatcgaccgaacatctctgcaaaatcgcattggaaatgtttcatcagatatcatccctgaagaccttttgttttgagacaagcaaaagttgtttggtgctgaatttaccttgacatcggcaagatcaacactgttctcctccaagaagctgatgaactctctgaagttctcttctgttgggaggtagtgaccgctgtatggccatatcgcctgaagaacaccatctttggcaaccaatcttccagcagccgttgtagctgccccagctaggaaacttgagtgctgaaatttacccttcttcttctgcacagaggattaaattaaacacagttagaatcgattcatcgtaacacaagaatgcgctatgcagaacccgcaaaataaaacaaaacggatactacattccaattattacctgtccaacatacaatgatcttgttgtgctcaacacaaatatccacttggaatcttcagtggtgttcacaagaactccactcttcctgtacatcagcttcccaccctccacaacaacttcaaaagcttccctctcgttctgaaacagaaacaatatattcagatttgtcaggcaactgcaaaaggtttcagattcggagatcttcagagaaggaaaaggatgctgaaggcacgtactggtccaaggtacatgatcagctgtgaataaagcttgcttctcgggcacttttggtgatgcatgtctctcccagctcctacatccagcctgaaaaacccaaagaaaacaacattaacctctgactacaaccaatgtgaacctttgtcagatgaactgaacattagtttcagatgtctactactcctaactacttaccagtaaaagaatggctcagtgctcgagctcgcagaccagatgtcgtagtacagatgcaagttgtggccgtagcggtggcgcgggtcgatctgaagtagccgcaaaaaagattttgagcagattagtgatgagttcttcatgatttcaaacaagagcaaagaggtgagatcgataattccaggaagaggggcttacagcttcgagccagtgctggagcgcgagcttctgggctttctcgttcttggagaggcccttgccgaccttggcgatgcgcttgccggccctggaccagcgggacgccgcggtctcctgcttggcctcgtcgaagaaggagatggacttgatgtttaggcaggcggagtcgtaggccttccaccacagctcctccacgacaatggcgcagtcggcgaggttccgccgggtgcggtgccccttgaacagcttctgcaccttggtcgccgcctggtccagctccgaccgcggcttcggcgagatgaactcgatcagcgcggcctgcgccggcgacgtcgcggcgtcgccctgcttggctttggggctctgctgcagcagcaggatccccggccgcgcgccgttgatgcaccggctggccgcctcatcgtgcggcggcggagcggcgacggcggcctcctcggcggcagtgggctcccagttcttgaagctgagagacctctcgaggacgccggcgccggtggccatgggcttggaggaggaggggagcttcctgcaggcgaggagcctggtggaggagggcgacctcaccggcggcgagcaggcatccctggggctgtgtggcttcggggaggagaggaggaagcttctctctgtgttgagtggccgcagagtcatcggcttctccttgaagaagacgaagacgacgtctacttgttgttcccttcccaactgctctgcaaaatcatggaccaaaaataagataagctttggaagttggaacgaaatccatctcagaatcagatttgtactggcagatagcaaccatttggttgaactgactagatatcaatatatatataaaaaccgatttttattcatggggagtcaacaggtagacggtagaccattggtggcctatcccaagaaaacattttgttttccttgaaacaattatcgagaggaagtaaaaacggcaggcctaatttgaaccttgatgcagagagttgaagaagaagaagaagaagaagaagaagaagaagaagaagaaagaagaagggagcaacgagctactgctgtactagtgcataccggctgagctcggcggcggcgatgaatagaggaagatgatgaaggagaaggcggtgagcttgttgggtgaggaatggagctgggcagttggtgattgggaggcactgtggttggctcgcccatatataggaggaggaaggatagatggatggatggatggatggatggatggatggatcactcggttgttgtgcggcgactaccagtgatgactgactgcatcagcgtaggagcaggggcgagggagagcacaagtccaaaatggggaggcaagagtggggaaggaaggagacggactgaccggtcgtcgctcgcgcgcgcggaggggagcttgacgagacgatgcttccttccgcgtatacgtcgacgcggctggctggccatgcctatgcctatgcctcggttttcctgtctcgctctcgcgcggtttcgtttgtacccttccggcgaggtgacgactgacgactaaaattttcctttcacgagttttcttttcttttcgcctcttcttttctttctctttttttttttgtttaaaggagaattgaattgcaattcggtccttctcgtgtcaccattaatcaattattactattacgcaacagactcactgggcgagctagtacagctagggggtgcccaggaacccattaaaaatttttttacctataatttatctattttcaccatatatacaccccatcagtataaatttaggcatccgtatcaagctaaatttgattcaaaccagagtaaaacaaacgagtggaaccctcctttattttattctagctccgccccagttttaacaaatctcttcgttcttcttctgtcgctaaatgtagttgtgtttatattcatagaaaatgtaactatatttaaaactgaggattgtatagtaccttagtaaaagggtttttgaaaatattaattatatactttgaacaagccgatctcaagcgagcttcactgttggctcgagctcaacaaaaactcgagcaatctcaaacggagcatgcgtaacctctgagctttcacgcgtgttcggctcgagcttgattattgagctggccttgtaagttgtaatcagtgtaacacaagaacaaggataaggacatctcttgcaaaaactggataatctcattgacaaaagagaagaacaagaataacatgctaaaacaaaggatgatgtcaacacatgttaatttatcatgtggatacatataaatgacatatttcatccactaattaattaaataaaaatttatatgtattctggcttgtttggagctcaagctgccgtgagcctcaagctcttttttacaccctagtagtattatgtaactctatttgtccagtagctactagcaccatatacacttctcattaaaagagagagagagagagagagagagagagacagtcctaactatgaaagctaggatttgatttttattttttgacgaagagagcgttttggaatatactacgtgtaaagagggtcagtatgcaataagggtatctaagcagggtcctgagtgaaacaaatgctctttctttaattagatatatccgtactaaaggacaggaaggcagggacaattggagcagacagggacaaataaacgattcatttgcctttactaaacgcggtagaattttctatagttactcctacctcttgttttctaccgcctgatgtgcttgctgctgccgctgactcccttcttccacttgtggtagatggcttctggtaaacgagttgatactactactactgctgcggctgcatggaaaagctctaatactgtttgctggggctcagtaattccaaactgtacttgggtgtgtttaattcatgttaaaattggaagtttggttgaaattgaaacgatgttataaaaaaattagaagtttatgtgtgtaggaaagttttgatgcgatgaaaaagttgaaagtttgaagaaaaagtttgtaactaaacaaggccgaagtgccttgtaaattcaggattttgcttttcatgcgcttttttaaaattcctgtggtaggttttggtttttaaggttcaatgggaaaattgttttgcttggatttattttcgtaaaagctttcaaattcaagataagccatacatgcaaggacttgtggaacgaaacgaaaacaatggcacctattagttgtaatcattatacactagatgtgtcttttgatttcacaaattgttggtcaaaatccacaaaaattgactcttttaaaattgaaaatacactctataaaaatctaatgcaatgaacaacactagatataatgggctcaaaattcatttgtcaaccaagcaaactcaaaagctcaacaaaaagtcccaagtgctctttgtactaccaaaatccacattcactaaaaaaaatatgtata

SEQ ID NO: 79092 - DNA, 883 bp, Oryza sativa
atgtcccaggacttgcatctggtgtgcggctacgtgatggttcagcttcgctgctttgcagttctcggctactagaaacaacaggtcgccttaaggatccgcttgaccgacccaacattgtcgaactagagaactacaagtcaattgaggatcacatatcacatcgcaaaaagataaccaaaatatcttcaggctttgatggagcatttatcacaataacaagtcaaacctaaacaaaactaaaaaaaactcaccaaagcatcttttgaagtggacatgtctggcctaaccggggacttctgttttgataagctgccagcatttattcctgtaggtggaacctgacgtcgtgtaggatcatctgaccacccgcttcttcttccctcttcagtggctaaatcaattcaggacataaaccatatagaattaatgaatgcagatttcacaaaacatatgagctaggtcatagaaacaaaataatctttttcaaaactcgcctcatcaagtgtgccatgatttcagttacaagcaagagtaggttatgcaattatctgataggcaggaaacagaaaggaacattttttacataacttactgtttttactgttaccattttttaatcgtaatttatgttgcaccaccttttgctctaatcacctgatatatgtgttgtgatttgatgataaattgtaaagaaacaagcagctatcaccacatctcctctactattataaaaattgaagatgtttccgcggtccattatccgtgtttgagttggttttaattttatgttttggttttaatctatatctcctctactattataaaaattgtagatgtttccgcgggacgtaatccgtgtttgagtcggttataaaaattg

SEQ ID NO: 79093 - DNA, 3955 bp, Oryza sativa
tacatcttgatctttacattgattgtggatgacatgtttattacttcctttattttataataaaatcatttttagcccattttattactagtttctagcgatccttatatatcagaatttgtgaaagtaaaagataaatatattgggaatagataaatagaggaataattgcattggaatttgataaagtgggggttaatctttttagttttgtatcagtatttttcatctcctgttcactgatgatagtctccctttagtccaatcgcagcgatcggcagctattgggaaacctaaacccagaattttgaggaaaagtatcttacgctgctagtcctagaaggaagaatgatcaagggaaaattcaaaagcataaaagaaagattcagcaagagagtcaattactgatcagtgcctcagagaaatatctgtcaaatggggagaggttcttgttaagttggttttgcatagcctccccaccccacctatgctatgatcatgttcaaattctcgtatttgtgatgatcttaagcaaatgttaaggaatttctgatgggataatgaatttgaaagaagaaagttcattggcttgcatatgacaaaggctttatatcaaaattgggaggagaaattgggtttagaggtcttgagatattcgaccaagcattaccggtcattagtatttgtcatgctttataaaataattttggaatggcaccgaattaccctctccacctcggtgtattcctaggcatcatatttatatttccaagaaacacaacgctagtatgaaatgttttcttttttaccttaagatcggataaaagttattgatattaatttatagttgacatacactagcccaacctatctagtttaggagttagttcggaggtgattatggggtgacgtatattttagcacgaggatatctcggcacaaaactattttttttacaagtttctttaagaaattccaaatccatttttgttttcaaaactatagaatccgcataagtttgtgaaatcatgaagcgataagctatcaaaattaaacaatatacaaaccgggctcccttaaaatgcaaaccgcggaggccgaaacagctactcctgatcaactgcgacgaggtgcaacgttaattgttacttttccactctggcccctccacttcccatcaattcccgcttttaatccgaacgagaagaaggggggggggtgggtcgcgctcgccgaaaacaaagcgccaccgccgcaccacaaggaggaaaaaaaaaagaaaggaaaaaggaaaaaaaaatccccaatccaaaacacactccgcccctccgatccccccctctctcaaaccctagctccccccctccccaccaccaatcccccacgcgattcgccggatgcgcccgcccgacgcggcctaggcccctgcggttcaccggcggtggtggggtgagagagcgcgcgccggcgaccggcgaagaggagggggggggtcgatggagccgcgcgtgggcaacaagtaccgcctcgggcggaagctcgggagcggctcgttcggggagatctacctcggttcgtgccgccgctccccgccttgtggggggatttccgtttttttggttttttttttggtggattgtgttctcttctggtgtcgctgaatctgttgggtgtggatttgcgcctgcaggtactaacgtgcagaccaacgaggaggtcgcgattaagctggtgagttgatgcgataatactcatgttttcgcatattctacaattttcctttccctttttttttggggggggggggggcgtcggggtagtcaattagtggattggggaggaagtgatggataattgttctgaatcaaaataacctatgaattcaccctagcacatttggactggtaatttgtgtaatagaaaggccaataagcactggaacaaatgtcgcctgccatacggcttgggaatattttgatatgggttgggctgtgtaagctcttctgtctctttcacccagctcgtctgtctctttcactctcagtagtttagattagtaaccgtgaattgattttacagtgtattttaaagggatgtggcagctggacccttttcatctgtttacatccatcagcaaaaaatacgtatttgtttacttcgcttctaactgtaaccctgtcatttacaatctttttttttttgaaatgtatgtcacattatcagtgtgagaatgatgtttgttattatgtctcactcagtcaatgtctcctgattgtccatttaaacaactgcaggctttgccctatatggttgataagcccctctttggactgatatgcatttctttttctttgcgtttgtccaggagaatgtgaaaacaaagcatccacaattgctgtacgagtcaaagctgtacaggatacttcagggtggaagtaatgcactttcttttatttactttttttttccttttgcattccattttttttccctgggagataataacctgcattctgtttttgtcctgcagctgggattccaaatgtcaagtggtttggtgttgagggtgattacaatgttttggttatggacttattgggcccaagccttgaggatctctttagcttttgcaacagaaaattgtctctaaaaactgttctaatgcttgctgatcaaatggtacagtatgaaattaaggccaagtgttgttgctctttgtgttattattacatagtagtcctatctggttaaatgcatttgattgtttctaatttctccatatttttattagataaatcgagttgaatttgtacactcaaagtctttcttgcatcgagatattaagccagacaattttctcatgggccttggaaagagggcaaaccaggtaagtgatttaggtgctgtttttgtgcttatagttctaggtcttaattgtaacattaggtggctgtagttacattttctcccttatccgttgtaggtatacatgattgattttggactggcaaagaaataccgggacacttcaacacaccagcacattccatacaggtaatatattgtaatccatctatctatgaggttcatatttattaatcttttatgtttgcatcaaattatcatttttttcacttatgcattactttattaaaattgccttcgcattgcctactgtcacctcactggtcactataactatattgtgtttattcataaaatttggtcatcgatgaaagttttttcttaccaagtgccattcttcttctgagtgagacttctacccgtcttaagaaaccatatgacaattgtctactgaagtgcagagagaacaaaaatttgactgggacagctcgatatgctagtgtaaacacccatcttggaatcggtaagtctggtgcaacttgaattttgatcccatgcctatgttaaatgcacaattgtatgcatttcttcaattattttgtcttgctggtagatctagtttgacaaatgaactttggtatttttttttcaacagaacaaagcagaagggatgaccttgaatctcttggatatgtactcatgtacttcttaagaggaaggttagttatgttagctttatttgattatctgcttatatggtctgttgtgctctaaacaacacatttgctcttcttggtaccagtcttccatggcagggtctaaaagctgggaccaaaaaacagaagtacgagaaaattagcgaacggaagattgctacatcaattgaggtcattcttcccctctgaagatttaattatggctatggaccaacatattcttaccagcattttctttttcatctgcaggctctctgtcgcggatacccttgtgagtttcaatcctacttccattactgccgttcactacgttttgaagatttgccagactatcaatacctgaagagattgttcagagaccttgggctgcagga

SEQ ID NO: 79094 - DNA, 640 bp, Oryza sativa
ttattttggccgcagagcaatgcattgtctagtgtggagtgttgcattagtttatcacacgtcttattgtttactccgacgaaaacaactttatgctgtatgtgtcttactcgcatatctgttttgaaatcgtgttggaacatatagtcaggtttctcttgctgagagtttaattacggctgcttgcttcgtgccctggaaaactcgcctgactcaggtgcaactctcaggcgtccgattttgtgcgcctgtggctggatcgacctgcctgagcgagagcccccaggccagggcagcaaccaaacaagaagtgaatctcagttgttccggtattcaggtaagtcagtgaactaggtgaaaataactgttcaacaagttatcaaccgaagtaggctgtgttctcgtgtcaaaggttgggaacccacggagtgatagaccgttttttttttgacaatttgatccttctagaaaacttattttgaaactaaccctcgccaaaaacttcaaccaaaaataggctgtgggctcagcgccagtctcgttggcactgagctctaacgggtcagcaccacgtggatccactgcattggcgctgatcccgtatacctgttaagtacgtgaagtatattttgatatcaac

SEQ ID NO: 79095 - DNA, 57841 bp, Oryza sativa
ccgaccccctctctaggtcgccacgtgcggtgggttaggtggctgcctccaggcactcacctacccgcatttatggcgacctgagtggttgcgctacgccgcatttaatgcggcgtgcagtgcactcaaccggtctgtgatcggtcgaatgaccgatggaacggcggctgtgtacccccaccctgtcagtgtgccaggcggcatacggcgtgctctgtcccatcacatcataatgagaggctttttagcctctcatcatagcaggagtcggtttatccactctggtcaaacaggagcctagaagtcttcatcccttaaatggcgactcacaggggcaccccccgtgtcaggcggcaagatttgacgggccccatcatcaagacaacgtgcaatagacaagacatgcatttaatgcaaagattgtaatacttctccactaagttaggttgttgggcccatgtggtaaccccttatggtataaaaggaggtccaggcctacttagggagggggtgttttttggacggatagagggaggatgagccattttagactctagagcagtctcttgcccctgatgatcaacaccaccttctactccaacaagaagatcttgtaacccccaactcaatgaacatagcacatgagtagggtgttacgcttcatagcggcccgaatctgtataaaccccttttgtccaatcgtctttgaggggcctacctaaccccctcaagatcacatgtaacgctccgcttttcgtgagtcgttaaaaactaactcggcaaaatcctaattgcgaaaattttcgttctttgtgtgagagtctaagttgtgccaaggatcccaatttaatcccgttgttccctctcatcgaaatcaaaatcctccccctcatccaaattcctcttccgattcaagtctctgaaatcaaaattctgaaattcaaatccttcctttgaatcctcgccaaatacttctacgaatccagaattattcaaatcccgcctcgaatcctttccttgactccaccctatgttcccgagaacaaatacccaagtattccttttgaaacttttccatgactcctccttgagtttcccttgatacatccctaaaccctcgagttcgaatatcaaattgaattcgaatccaaaccctaaatctctccaattctatccaaatcagttttctctgtaaaagtctactttacctccctgtatttttggatggaccgattttcctcccccggcccatctcccctccccagcccatctctctcctttgccatctccctcacgtgcgctgcacgagccgtcgccgagagaaggatctctctctctctctctctcgttttctcgctccctctctgtttctctctcgcgccgacaccgcttcccgccgtcgccgcccaaaacctccaccgccttcgcccattcccgcgcgcgcctcgcgaggtggccgaccggccggtcgccgccgacgccatgcgctgccgccttgcccccgctccatgccaaaccgaccgccgccgtcatcgtcgacgtcatccatgcccccccccccccccccgccactccacgccgcacccgtccaagagtgggagaagcagctgccctccctctcctcctcctcctcactctccctctcctcattatggcaagggaccaagcccctttttccccttctttttcccttttccgaccactaccggtgtcactgcctctgcgccgcttgaccgaccacgccaactcgctctccttgaccgcgccagcccgcgctcccgtggttcgatttccgccgctcgatccaccgccttcgccgcccaacgcatccacgccgtcgccgctttcgcactgcccacgaaaccgccgctgccgcccgtgaacaccagccgagctcccttgaccgccaatgtcggtttccctcctccaaaccgacctctcctcctcgcctataaagcccgcgccctcctctctcgtttcatctccgcctcgctcgaaacacccgcgcctttgttgccggccgccagctgctcgcccccgccccgccgtcgcgaccacctcgccacgactccctctgcgtcgccaacgttgctcctctctcgccggtgagctcctcgcccaaattcttgccattgcatcatcttggataagccccgagccgttcggttgctcgctcgtccccctaaacgtgccgccccgccgttgctctgcttcgccgccgccgtgcccgactgtgcgccgccatgggccccctcgccaatccctcgcgccaccaccgtccttgagctccctaggacctccccaaaccattccctagcgccgtcgccgcccggcacggcctcgccgccattgccgcccgctcccgaagaccgcctctcgtcgccagccaatctcggtgccgctccatccaatccgacgccggaaacggattccttgaaccccggagatgctcccacccctttgaatcgaaccctcgtcgtctcgtcgtgttttccccttttgctctccggtgattgccgccgccgtaatccaccgtcgtcggctcctctcgcgtcgattcctctcgccgccgcgcgtgcgtcgccggtgaccatcgggtcccgcgtccccgcgtgcgcatcgcggtcgcgtaccgtttcggctaggcccgagtccgcgcccccttgtcccttccctcacaagaccacatccccgatccgacgagcttggtcgccgccgccagccaccgtcgtacctcccctctcaaatccgtgccgttaaacggattctccctgacctcctctagctgccggcggtagccgctcgctccggttcaccgctgctcgccggaacgcctcgcgcgtcgtcggccgtccgatcccgggcgcctcctcctcctcctcctcccctttcgcccctgcccgcgtggccgaccacgtggcagccacctcagccccgggcccgcttgactgggtcaagtcgcgcccagtcagcctcctccctccgtcttccctcccgtgcgcgcggtccacggcaagccgtgcggctgcacgtgggcccgccgccatccgtccacccggcgcgccgcgcccgaaccgcgcgcacccgaaaccctagcgcccgcccccgcgtgcgccctccccaccgtgaacccaaccaccgccatgtgggtcccgcgcggtggaccgcgcccaccccgtcgggcctccctctctccccgcgcgccctaatgggccgtctccccatggccgcgctcggcccaatggccggccaagccttgtgaatctctcgagccgcgcctaagtcgcccgaggaagtctaaatccgatccctccttccttttcttttccaagggaattaataattccttttccttgtccagaaaatccatttagacctccaaaattcatatccctcgatccgtagctccgatcgcctccgttccacttccagtaattccgtaaaattgagacctatttaatggcactactaataggtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttatttgcaacttgcattattagaatcacacttaacttgcttggcctcggtttgcgtgccaaaccgacggacctacccagtagtcgcactaatttccgtaggtcgtactaccctgtttccttgtcgctccacccttgtggtacctcggtattcgtgttctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtaggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagttgatttgtgaatgcctaaaatggcctatacttacgtgaggatttgatccttctatgtggcatgaggtaaccctgggtcggcttgggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggtagctggactctgggagtccgagaaaatgaaaaaggctctgggagccgattaatcaagtggaatggctctgggagccgagaagtaatgatctgacccgggaggtcggtacattgccaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatataaatatatatagttcctccgccctgaagagaagataaagtgaagtgaagattagggtttcgtcctggttcccagccgtcgcctgtggtgttgggtattagaccgttggttccgctgctgctgttgttggtgttcgcctcgtccgtgtcgtcggttgtattctcgggctgtctgagctgcaacctaagttaaggtaaataagtcctctatttattttaaagattgctatgattcatatttgtcaccgtgggtaccagcactatgtcctgggactggtaccgagatcgcggtttcgtaggaagcggttcgcgcagttttccctacgacacgctcctgtcaggtgccgttgtacggcggtatcagattggggtgtgacatcacataacttcgctcactgggtcctcaaatctcacccgctatcctcggctgaaaaaaaaaaagaggggcctcacagttctctggtggaggagttcaccctctgacaatgtcactttcaaagcaatggataatgcacaagtagctttcccatgcatgaaccagaacatgcatgtaggataagctagctaggtttaatccatatagatatagtacaagttcatagtcaatggcgtggacgtagtaattaattagtgtgtacatgagggatgtgatcaacttggtgacttgataagcacagtgtaagtgtaaattaatattctttttgatgacgttgtttgctcggactaatataattgccactggaattggattccatagagttgtttatgaaagaatgccttgccaagatacgagacagagatacagtggaaatatgaaacttgtctaagttggatagcgttctgatcagcctgcaagcaaaactattgtacgtacagttagctgatcaagaattatctcaaacttaattatgtcttcataacatctttcattgagatttcttgccggcaaagtatatatgtgacttataatgcatatagaagttcgttcagtgcagtttcttggaacgctagagaggatatatgacgagaacatttttttttcctgattcacaaaacagtctacaaatgatagttaatttttgtttaaagataaaggagatattttttattgcagtataagatatcgtctataaattatagttaaaaccaacttatgatgaaaatgaaattacatgttaaaaaataaaaaagaaacgttaaactatgttttctccctatacaagtcatttatatcgggcaaattgagtaaatgcccatgtacacaaattgagtaagccaagaacaaaaccattactacaaaacaatacttatagtgttagtttttccccctcatcaatgttggttttgaaactagcactaattattgagcacttatgagaggatcctcatgttaccggttcctaatccgagagtgatagggtgacaatttgaaaaacaaaagagctggtacgactctattgaagccgagccgatgcatcatcatcgagcatctttatccacaaaacaaaacaatcacgaatccaactaaagtagcagtcacaaaggcatcctaaaaattggtatggttgaatcaaacactttacagaacatagatccagttttttgcataatctctaagcatatacaaacatccatatcgaacttttttcggaacaagcacaagacacgcttgttaactagaaaaaaaaatcccattgagtgtcaactcgttttttcaccgtgatggcatcagatccatcatccctcgctcctccggcatgaactgtcactagctcacacgtcgttgcaatcagtgcttatttatttgaaaaactagccatgtggaaacacattaatactggtttttttaatgaaccagcacttatgtggcatcattaatgatggttattccatgcggatgacgcgcatgggccggcgggtggacaggaaaccgctatcaatgctgagttttccttgtttggtattgatagggtgttactccctccatcccataaaaattacatttctagctaatttagaacaaaacaataggattggaaaataaccataatgaccttatttaatgaacccattgcatgcacacattccatatatacaaatgattaaaagaaagtttgagagaattaacccatataattagcatactttaattacaagctgagagaacttaaggaaacttatctagatgaatcaatttgctagggcccaaatggctagatatataatttttatgggacaaagccttagagctagaaatgcaatttttttaggacggaggtagtacgattaagcagttttgtacttcctccgggctaataatacttatcgttttaggtaagggtgaggtcaaactttagaacttttgattatgaatcatttttaaaatatttgtctttcaaatatgatgactacatgtatagattagtcttagaaagtacttaataaaatcatatatttgttaacacttttatacatattataatggacaataatggttaaagttgtttttttaagaccgtgctcttatccaaaacaataagtattatcaaccgggagggagtagcagtgaacatggcttaacatgtgtcttttagagtctggaccctctgcttcgttgtgcaaaacatggacttatttctccacatgtactatatatgattagagaaatggaagtttttatttctgatatatacaaaaatggaacgaggaacatgtttcaaagtaacaaaccacccccaacacacacatgaagaccaattcgattcaatcagaagcagttcgaccatcacacataaccgagattttaatttaaagagattttacggcctagcagaacagtaaaatcactttaattttttttatcactccttaattcaatttaatttgagggctcgttttggcgccggcgccgctcgtcggagagctgctttgcgaacttggcaagctgatctctgttcgtgccttcgccggccacatccacgtaatggccggtctccaggtctactcgtgagacgttcttgtcgagaagcatttccccaatcttcaccaggttatccatgttttccttggagcagtcgtcgatcgagcccgcactgcccgtcaactgatcatactgcatttacactccaacagatcgatcatatatcgatacaacatcttgttaagttagagaaaaattttctaattgtcttctttatcgaagaaaagtcacaaattacgactaagaacaaggtgaaactagaccttaggctccttaatttgaaaagaaaactagagttcaggctacttttgaggtcctgtttttccccaaatagactcaaacgcagtgcaatatatggacattgtttaggtcctgtttaggctactttactcagttttgacgttccactttgatcattaattttttattagaatattgtgcaagtcttataaagaaaaaaatatacttatatgatttttacgttttcaaaatattttgagatactaatggtcaaagtacggtggtactacctctttatggatagtaaaaacttctcatctagcacaaataggtattttacctgtatgcgtaagtagttcttttcgcattgaagagcgctgaagagcacaccgaggtggatgtcaaccatgtcagcactagcagaagtaaacatgtcgatgatgggagctgagctacccttgatgagccagttgaagattccccacttggcagcgtccttggccttgtatttctgatcgtgattcgacccacagccgatggagatcaccatgaacttgccatactccgtcggcttcaccgggaagaagtcgcaatcttccttgtcctcgaggatgatatacttggacacttggctcattgcacacaatgtctacacatacagttccatgtctatatattattatattccaacagatatactccctccgtctctaaatatttgacaccgttaattttttagcacatgtttgactgttcgtcgtatttaaaaaaatttatgaaatatgtaaaactatatgtacacatataagtatatttaacaataaattgaatggtaggaaaagaattaataattacttaaattttttaataaaacgaacggtcaaacgtatttaaaaaagtcaatggtgtcaaatatttagaaacagagggagtattattaggactcttttgcagaatgggattttcacaggaaatagtttgattcccttaaaagtcctaaaaaaagaaacctgaggtttgcatcggcgacacgtggtgcttaccgggttgttggcggcgaccccaccgtcgacgaggttgaactccctcgtctggccattgtcgtctttggtctcgaaatagtgcgccgggaagaaggtcggtgcggcggaggtgctgatcgaaatgtccgacaggagagcattcttcagtggcttgtacttcaactgatcatcaccaaaccatccatatattagaaattccaaacatttcattatcctttatagtttatacccatgtgtgttgactataaggtttggtcccgattacttcttaaaatgggacacttttttctttatataaaacgtcggcaacagcctgatcgttcgaaaaaaagactatacacaaaaatagtttatctttggttaatcttcattcgccaaaaattctcttgttctgattaagccacctaattaaaactgtgcacatcatcgtcttagctctatttgtggctatatattccactggaaaagtggatattgacattgatgattgatatccactactagagcaaaattggtggtagctgcttcactgatggggggtagacgaaaattatgctcgtgtgtaggtgatgagcccggtcactgaaacatcatgggaagaaagaaaacgacgctgtacctcgaatttggagaagatggttggttgcaggttagcgatgtcgaaggtgggaataaccacgttcgtcagcgccttgtccagcctcgtgtcgccgagcttctctcggagcagcgaatggaggtacttgccgtcgtactttgggccactcaccatcctcagcgtgccggcgatcttggacaagacccagttcctgcgaattcaccggctcattcaccattgattagaatatatatataaataataatcaagttgttgcaatcttcagcaagcaaacgatgcatgttgtactaagaaatgtaattttatatgacaaattggtttgctatgtgtgcatgcatatgcatgggactaggttactacttctgtgggaagatgctgggcgagtgttcgatgtagaatttggccaattcgtcggcggcgaacagtggccggttgttctcgtttggagcagtgagcatcgccgtcaggaggccaccggtgctcgtgccggcgacgacgtcgaagtagtcagcgatcctagcatccggaccatccagtttctacacaaactcagacaagtcatcactaataattaagtcacagtgtaacaagaacaattcacaactttagttcaattatattgttcatcacttacttggagctctttctcaaggaaggcgaggatggtggccgggatgatccctctgacgccgccgccgtcgatgctcaggacggtgaccatcttgaccttttcaggagagctcgaacttgcaccttccggtgagctagcacttgccatcgttttgctactttgatagctcaaaatcaggctaatattgatgcaacgacttatggaacgaaagaaagaacaatgcaagattggcggtgattagcaggaaggcaagcaagcaatttggggttcttttataaagacatgcacgtttgcaacagaaggaagcaaggaacaaagattggccaggtcagctgcagagatacataggctaaccggcagttgccaactaagactaataaaaacttcatcaagaaaaaaaaattaagcctaataaacaacatcgtttaattagctttaattaatcatcagttcctttcaacggtttggtgccttgcttgaacttttcttgaaaagaatatctattaaaatgctcttagtttgagaagaaacttaacaagtgctgcgtcaactacaacttgtcatataatttcgcaatgcttgcagatcgcgtttaattaggataacatactgagacgtgcttaattatattttctctcgagcaataatggaaatgataatagcatgcatggaaccaatgtgggagaaaagaattaatgtagataaaaaggaataaaataagacaaattaactaacagcttcggttaattaagttgcatggtttgcagtcaccaatccaggaggaagaagcgaaaaacagaaaagaaaattaggggggggggaaaggaaaaggagataaggaaaaagaagaggagggggaaaaattatggttggtgtattttactatatttacgtggtttttagtagcaataagcatccacacatctgctccgagaggttaagagatttgcagattttgaggagaaaaaaggcggatatacagtatatattacatatttgacattcaaggaaaaaagaaaagcagatatatattgcatatttgggttctggttacaacaacgttcactctgaaaagttaagagatttgcacatgttgatagagagaagaaaaaggaggatacttattgtatatttgggttctggtcacaacaatggtactggttgtttgagccatgcattaaaagccacatccaattttgttttgatttcactatgccttggtttttagttaagctataggagtatctatgttaccttaaaagagagaatcccttatataccactagaatttgaccagtttttttatatgtcacttaaaattggtttctcccttatatgccactagttcaagtttttctacccttttatgccacacccaccactatagtgttagttgactgttagttaaagattagttttttttcgtaaatgaccaatatgccctctcaactaaaaaatgtgtaaacttcaaaaaaatcataactaatttattttaaatcctttttgagtgaataaaattttgtcagaaccagtgaaaaatgctctttatattaaaaatattgttagaaaactgcatgtttcatgcttacattgaaaatttatttgtgatggtaatggctaaaattgcatgtgatgcagaaaaaatcaattttcatatgttgtatccagtagctatattagtactaaaatacttattattggttgtatactaattctcaagggcaaatgcgtctttttacaatgaagttaatggtcaactgacggtggactgacggcaatggcataaaagggaggagaaacttgaaccggtggcataaaagggagaagccaatttgaagtggcatataaaggagccagttaatttaaagtgatatataagggattctctctactttaaaagcggagttgtcctccatctgccccatgtagagcagtagaggtcgtctgctccttctcgtgtggtaaccattgaagaatcctctgctttattatccataatccatccacccagccattactcaattatatgagcttgattcgtgtttattctcaattcatccaatctccaattatatgggtctgatccattgcaaagtacgggcatattactagtaattataaaactctaaacctaaaatttgtttctgtttgcttgttcatgaggctttgactgatatccatatatattggattttctcaaatcgtataagaaatcggagccatcttttcgctttgcaaacgaaaagtaatttgtgaataaaaattttatatatgtgttcttagcaatctaaaagcaaaggttggaaaataaaattcgatgaaaaaacctcaaaatcagctcatgagaaaattcaaattttagctgataattgtaagcataagcgaaaagatgaggcccagatttacatttccaatcagacggttccgttcatatacatatgtatatatgtatgtatgtatatatatatatatatatatatatatatatatatatatatatatatatatatatatatatctctatatataaattgctatgctcccctcacacacaaactaagttgtccagttgggggtggaaaattctattattttggttgaaatatagaacggcttgtcggaaggtatatatatacaaaggatgagataattaatgtttccaagtacttgcattgacatcgtcaggaagtcttagtgctcttaagaaacaaaatatatgcattacaatgtaaacatgtttacaacgaggaacagatgtaatactaccagctaagacctaagaagatgcaaacataaatccaccaatgttgtctctcttttcttaacgttatcttctcaaagtagaacgcgtgaaacaaaaaaaatacatacagctattatgattgataaataagatgctgtgagcttgtgtgttgtgatttgtgataatgatcatactaaaaaagctgtggatccgtgttgtttattgactacttcgaaccaggtgggaattaaccaaaaaaataatcgagattgttaacctggttgttgagtggaaggtaaagaaactaagctattgataaatatttaattagttattttcttttgtgtcgcacgcaatttgtgcttggagatgaagtcggtttgattgacatcaatttcagttttgcaagtctatattgatggaaatagcgggcacacttcccttccttcacttcatgaataacttcatgtactactgctgaaacaaaccatgatgacagggctgcgcaaacaaaatagtagcccggtgaccgaacaatagtacaagtcttaatcatattctgtgataaatttatacaggctaacagcaggtccagatatgatcatacgaacgccctccaaaattatcaatctatagtaacaacagaattagaacattacagaggctttggttcactcgcaaagacaaattcagttcagtaggcacattatagtacatcatcattttatgaatacatacaaggaaaaagaattagaaaacagacagtacaacaaccacggcacaactaataatcaacctgttagacaagatacctgtgttacaagtagccagtaagtatggaagactgacagcatagatgagcaaaaatctttgagggactcatgcttttcatctggcattgaaaatagcaatctgagtttaaggtcgaaccattatcatgttgcatccagaatgcccttaaaatggttagccaaggcatatgttaggatcatcttcatctgagtcaaactccacctgccatccaccattgcattttaatagttagtggatacagatgctggtataaatttggattgcacagtggagaggagaaatgagctatcctctatgaggcccttgggtcaaaggacattacctctactgatgccacatcactgtccgccacaaaaatatgaagtgcattatgtgacttagtgtaaaaaggcttagtaattgggaatcattcattattgttgatagcaaaagcaacttaaatctcatgacagcaatacaaagaataattagcctatatgagcaaagctattgttattctttctatattgagttgactactaagaataacatacaaaagaaagagccatacaaaaaaaaaatgtgactcacattttcatccctgtaccatcttccatggccatctcgtttccatcctgaagcagtgaatttgagttcttgctcctggcgtttttggaaatctgcttgctcctctgcaagcattttggttgcagttctgtcaccagcaaagatttttcctttcacagtatctccactccatttttccattggaacactaggagtaacttgggaatcacacagtgaagaatttgatgtcctctccagatcatgagatttcttgttggcgctgtcgatgataaatctgctggactgtgcttccaaaatagcttgtcttgtctgctgaatcaatggtttttctttcatatcactagacctaacaccataatgttgcttaccagaacttgaaacggaagcttctggagaaatagcaagtctcttgttgatctcttgttgtcttgataattctttctccctcagcctcgattctgctgcaatgtgccgtgaacctttattatgcatctgttcatttgttgtcatttagagatgaagaaaataatcaaagaacacgtggtcgcaattttcaacaatacaaaatgcaaaagagacggataacgaacatatctcggtctaacatatatatactccctaggatcattcaacacaaagtttcatgtacaacatgatgcacagagcgctttagaccgaaggaccaacttggccccaagctcttttcattggataagaaactggatctagagagccatatcactcgatgtttgaagcaaaaatagctgacacacactaaagtaacatggacaaatgaaccaaccatacacacagaatgctactgatccaatatgtattcatgacaatccaggaaatttcacaaataagcttcacggacaagatttttacattattctagacggcaacaactgacaacgattgtggcaaagaaattcaatacggacagaatagctccacatcacatgacaacacaatagcttcacaatgctaatctctttaatcaaaacatcaaacacaatacctcatcatacttaacttaagggaggtactactggcttaggacacctacttctctcataccaatccgaattctgaaccattcttatcaacatttgaaccaatctatcttgtgacagtttcctaatccatggttcattcagaccccaaataaaaatcgattggtcaggactagaaatttaacgagccggtcttcgtgctcacgcataggcaagaacaatgtacaccattaagcatctagaatccaagatgctagaatccaactacgtggttagggtaaaggaaggcgggggcacagaaggggatcgcttacggagagcatgaggggggagtcgaggacggggcggtgggggcagacgaggcaggcgaacttgccgttggagagcctcctgaacgaatcgggcgaggacgaggatggggacactgccgaggcggggagcatgaggtcgtcgaggcggcgcttccgctgccgcgcgtcgcgcgcccagctgtcgccgccgaacacgctcatctcggcgttcgcgtcgccgccgccgccgccgccgcagtcgccgccgggaaccaggaggaggggaactctgaccgggccggatttgcgctctacttgggctttaacaagagactctgagtacgatgggctacatcccgaagtggtctgatttggcccggcccatgacgcaacaatagtacggttaattgggctcttccttttgcacagattccattttctaatgggttagtgaagtagtactcctcgttttttaaaaaaaaaaacactttttataggagtgcactcctgccaactttgcttgccaaaattggcttgtttttttaattaaaattttttgttgttttacaccaaaattttgattgttttgcactagaaaattgcttaccaaaaattttgattatatcagtgattcagtgaaggagtaattgtttttggcacatggaagtgagcaaatttctaggtgattgtacaatgtgattacttggattatattcgacccgtgattttatttggaagttccatctatgttccctcattctccctagagagtttagcgaaaatttagaagaaactaccgttaaacataaggggaaaataacttgtacccccatcgtctcaaaagaatgttggttttaagcatttaagtttttcacaaaaaaaaagttgatttctactcctttttcttaaaatatagctacatttagctaattatccaagtacctagaaagtatctatattttttgaaacaaagagcgtaaccacttaattacccttgtcgaattattagatgagcgtatcccttcaatacatttacatccctcgcatcctgcgaccacgtcgtatcttactttttttttttggaataactcataccagacagcacaaattcatattgatagagcaggaaaaaatcataagattataaccctgggagatcgtactcagaaaaacgaagaaaaaaaaccaccacccatgcaccgacagcaccaatacacaaacccaggaaaatgctagcaccgaaccggccaccgctaagccaacaaagaaactacagctggaatcgcccaaaacccaaccctaacaaacgataccaaacttcactctatccacatctttagggttgagggagagagggtgaaagagaagaatggaaccgctctccccctagaccctctgacgtagccaacttgcataaactagggtgctggcacagaaggacatagtctagagcgagcttgcacccattgtatgggaggttttggcaaggggttgcttagacaacgactccagggagagaaacaacgaaagcaccgtcgccaccgtccatcgagttctcaaagagaaccgagactaagttttcacccggtagccccactagaggggatgagatggtacgacaacgccctcaagaggagaagcgagctcgaaaacgccaatgttgccgacctgaccaaaaccgggctaggttttcactcgccgcctatgattccacacctacacgccattgctccaccactggcggccagcctccgcgtgccgccacacgggcactctctttgcgcgctccatgctggactcctacgcactacactgccagccacgcatctaacgccatgttggcctatcgcccgcctgtcacgccaccttgccacacgcccgcccccccccccacctccacggcctgctcaccgcctcaccctcctcagaggcactgacccacgcctcctccgtgtgagcatgccacggcgtcaaatcggagcctccacgtgctccctttgcctgccgccttctctcctcctcgcgtcgccttcgcgctctcagccccgctgcccgctcatcctcctctaccctcgccgcctctccctccttaggaacgctggggctgcccacgccctatgcctcctccactcggtcgcaccgtgggctgcgccaccgtcgcagtggcctccgcctcctccgtcgtaagcgcaaacccctctggacggcgccatgatctcctctgtcggcaccgcgacctccaccgccagcatcgcgacctcctccacctgcacctcagcctcctccatgggtaccgcgaccgccaccgtcagagccatgacgtccttcgcttgtaccttggcttccttcccgatgcggcacggccagcgccgctccatctcgatctggccacgggagcgccactccatcccgatatgaatgcggggggccagatccgctgccgagggaggtggatccacctccggcatggctggatccgccacgccgaccattcggtcaccacctcccacgacccgctgctaccgagcagcccccggtgtccctgccgctgggcttcctcgtgggggagagcgccccaccgccgccatccatatggccccggctttgctgacgagccactcgggcagcggtgaggcgaaggggaggagggagggggcgatagccgctcactcgaattaaaattactaaacaatatgtttcgtgcgaaaacgttctatataaaagttgtcctaaaatatcaaatatatatatttgttaagtttgtaataattaaagcttaattaattactctctccattctaaattgatctgagtatttcataggtacaccaagaccaaaaaaagctaataactctctcatactatatttactctagcagcaaactcaatgcatgcaccatccccactattttctagccaatagcaaatcaatatattgcatatgggttataaatatatgtgtgcatggatgcatgcatcaatgtccatttactccaatgcacaaataacgaatagaactaataaatgaacacaaatatgtaggtcatttaggaataaacccaaaaaaactatatgtagatcaatttggaatggagggagtatgtgctactccctccggttctattttaattgacgttttggacaatgacacggtctacaagatatatctttgatcttacttttctattatagtatatataataaataaatgcatgtttatttttattatagtactttaaaagataaatctgtatatgttgttctagttcctttaaactaaatatttttaaaggtattgatgattaaagttataaaaatttgacctcaaacttgttcaaaacgtcaattaatatcgaaccggagggagtaatagctttctcatgtgcgtcagcttaattttcttcttcatttatggagtcgtaaatctatgtgtgtggacgtagcagttcatgttcatgctctgttccgagtcctgtgacacgaagatcgaaacaaaaacacaaatcgaggacgccaactaaaattgctgggcgcacccgcaaaccccactaccaccaccgggcccctcttcgtcctcctccgttccatctccttctcttctctttcccagcagaatcccagtcaaaatcccccgtgtcctccccccctacggcggcgaggcgaggcgacgcgacgccatggatcccgccgccgcgcggcgcaaggccgagcggtggataggcgtggcggagaagctcctgatggcgcgggacctcgaggggtgcaagcagttcgtctcccaggcgcgcgccgacgacccgaccgtccccggcgccgacgacctggccgccgccgcggacatcctgctctccgcgcagcggcggcgcctcgcgacgggggcgcccaacccgtacgccgtcctggggctcgactgcgccgaccccgcgtcccgcgaccccgacgtcgtccactccgcctaccgccgcctctccctcctcctcaaccgctcccaccccgaccgcccctgcttgcatgccttcgccgacgccgcccgcctcgtcgccgaggcgtgggcgttcctgttcgaccctgtccgcaaggcctccctcgactccagcctcgacgccgcagccgccgcggcggcacctcgcccgcctcccgctccctctccacagaagcagcagccgcagccgcagccgcggtcaccgcggccagcctcgccaccgcctgttcccgcggcaccggaggtggcctcggcggtgtcgacgccgccggcgcggccaaagcgcgggcggccgccacgcgccgctaaaccccaaccgacgccggagcggcagcaggaggcggaggtggaggcggcggcgacgttctggacggcctgcccgtcctgctgcaacctgcacgagtacacccgctcctacgaggcgcgcacgctgctctgccccagctgccgcaagccgttcttcgccgcggcaatggccacgccgccgcccatcgtgccgggcaccgacatgtactactgctcatggggcttcttcccgatgggattccccggtggccctgcgttcgctcgaccaaccagttcttcttcttcttcttcttcttcttcttcttcttcttcttcttcgccgacgaagcaagcaccggctgctctgggattctatccaatgggaccctactccctgccattgccagctcaaggcgacgctgccgagggcaatgcagcagttggttccggtgatggcacagtgacagcgccgtcgccgccgccgccgccgccggcggcagcgccattgccggtgaagcccaaacttgtaaagcttggggcaaggaagcgagggaggcccaaaagcagtaagaacaagcatgtggtgatcgagatcaattagaatgtttttttggcaaattttgctcttcgccaaactcatggttctgaatgtgcacgatagattctttgtttgctgatgagaggggcaaaaatggggtgaaaatgaagagagattggatcttctacaagaacagcaattttggtgatgaacaattttcctcttctttcagttggaaagttggttctcattagatggttagattctgtgtgttgtgccatgccacctcgagcgcaagatttgttgttgtaaattgtaagattatcagatgggttgttggtagtgccaaatgtacattactttaggatgatgcaacttaatctttatcttcaggagaaaaaaaacaccaccttagatgacaacctaatatttcatctacaatctcatatatggtctactaaatttatttttctagacatggtttgtcaaaccagttgttaataactaatattactcctaactcgattgttaaaaaaacatattaaaaattatttagtaattcccgcagcacttgggaatcaactagtttctatacagttcaaaccatatattgctcaataattataaagcttttacttccataaatataaatataagagattctaatgtttaaatttcattcacaaatatagaagatactatagtattatttctcccactcaatcactctataggctctaatcgacaacactgctcttcagctgtaaccagctatgctatagccgatgtatatattttctttaccatgcactgtagtggctgctgctgtgcagctacaatttagctacaccgaacatacccatatttattttctccctattttaccctaacaacccttccctcacccacccattaattaatgagggcgtcatagttattctctttattctcaagccctctttgattttctagcaaaaacatataaatttggagggtttcaatactacagaaaaaatttctatcaaggttttttatataaaggagtgaagcatatactctcttgctcttgaaattactatagaatgggtgatcttatagagattttataggaaaattagcaaaagctccatcctcttgaaaatttttctttgatctatatctcccatccgattattactttttatacggtctattcaaacagtcatttatatttctttttgtttcacaatactctattttggatttatattcctatcaaaatcgtgtttttttcaactgctccattttttcaattccaagtttgaaaagaactaaatctctttagtaaccctaggcatagctataagcttttgaattgaggtcctctggtgtgaagtcacatggacatgatcactgattatgtgggtcactggggatgaaaacggagcggatagtttctatccactccggagaaaaacaaatacatatacctttcggagcgaaaactctcaaatagttcatatacggatgcgaatgaatggtgctattcaaatgttcgctgaagagataaaagacataccccatttctttataactttacgacattcaatatacctttttagattttaatagttgcccatctcttaacacttgtccacactattaatattatttaaacctttaaatattttgtaaattatacaatatttcatataaaatggtctaattatatatgatgatatttgtttctattagaagttaaggtggtttccgtgttccgagaaaaaattgtttccatattcgtgtatgatcatattcgatcattttcctattcgagatatttcgtatttgtttctatatccgagctattcgcattcgttttcttaactagcaaaaaaactgaaaacaaatatggtatgagcattgtccatccgtatccactctgttttcataccacgtcggtggataaccgctattttctttttccattttctttttccctccgacatttggataaccgctagattcagcaagaaggagcccggatctagcgtcttcgttctttgtcggggcagctcctgcgtcccagagcccctgcaagcccgatatccctgaccacaacaacaacaacaaccataacaaatagtgtgtatgacgatatgggaggagaaaaagacatgtcggttactataggtgcatgtgaaggcggagaggaggaactatggtggctcatggagaaagagtagtgatggtggctcatggagaaagagtttgttgtcgatacaatcgctaaccgagtttgttattttttttaagtattgataatacatgggccaccagtcatcgtaaagaaagaaatactaatagctactctttccgtttcatattataaatcatttgaattttttcttattcaagtttgaccggtttataaaaatatatattaatattttttttaaaaacgtattattaaaatatattcaatgttagattctactccctccatactcacataggaagtcgtttaggacaacgacacggtttccaaaacataactttaacttcttgtttctaataaaatatttattaaaaagttatatatgtagagcctgtttggtacagctccaactcctaaattttgctcaacataactttaacttcttgtttctaataaaatatttattaaaaagtgatatatgtagagcctgtttggtacagctccaactcctaaattttgctcgaggagataggtctggagtggagttgtggagctgcctaaacccagctccacaactctagttcattttatgagagggctccacccagctctactgccagttttggtggagctgaaactgtttggctgagctccaactccaggaggggtggagctggagctggagctgtgccaaatagacccgtataatttgatgaaagtatttttcaagacaaatctattcatataatttttacattttcaaactcaagttcacaataacttgagagttatttatgatttatatttctaaggtttgacttaaacattatcctaaacgactttttttataagtactgaggggtatgaactagtttggcattttagatgctgttaattttttctataaatttgtataattttagatgcagcataatacgacgaaacagagggagtagttcgaaggtgtagtagtcgcgtgtcgcgaaatgtcccgtctcgttgtctcctctgctccttgcgccgccgccaaggcgagtcgcggctgagccgggagggggcggcgatctccatttggcgagcagagcaggggaggggattctggtgagcatccacatcctctttctgattcatctctctcccaccgggactactgttgtctggaatttgctttgcgttaaccctagcttctcttctagatctggaagaacctcttctcctccttaaacctctcaaaagtttgggggttcaactgaacccccccatgtccaaagttggatccgcccctgcttgtggacagtctctataacagtttttttttcttcttactctgtgctggtgcaggtctgaactgatcatcatggtgaaagaacatgcagagaaaggagatggcgttcaagaatgccaatcgtctcctgcgctttcagaagataacttgaggcacagtttccgattgggagatattacatgggttaagcacactggctcgtggtggccagcacaggtacgattgcatacatcttccgagctttaactttgaatgcacaaagtatcgttctttcataagatgatgagatattttcagtgaacggtgcattaggcaggctatattctaaatcgtaaaatattaatgttggctgggataatagattgacatttgtagatatatggaattggcatgaacttctttttgaagttcagatgatgcagaagctaagaagtggacttttgctgactgctactttgtccatgatcctagttttcccatgtgtatatttacactggttttgttttgtttttttttttcctctgaattcaaggtcgttgaaaattcatgtatcagcagcaagcctaagaagacggccaagcatcatgttccagttcgtttgtatggcacttgtgtacagtaagggatcttattaatgcgctatgccttcttttctttccatgatattctggtgacaaaagtttatttcttttactattttcagcatgtacgtagacccttggaagtctaacatggaattcaaaatggtatgcacaatatctatttataaggatactgatatattgtcattgctcccgtgccactcattgtagatttagaaagaaagtgcctctgacacagttgaccatgaattccataactcacagtcatcctccctttctcctttgatgttcccctcactttaaacctctcaagtaaaaaacttccaaattgaacaacttgactcccaactgcatttcaaactttgaaccataaaattcccaatattataaaccatggttcaaactttaaactatgaaaataaaacaaatttcaactgcaaataacaactttcaattaaacaacacaattgctttcaaatcaacactttgaatgcttcaggcatgacatcagatctaagggcagcggcagcacgtgctggatccgctagtagcagcatggcagtggagttaaaaaaatgtgccagatcaagtgtgagaatggagtgaatgggggagagaatgaagaagtgaaaggagattttcacatggtcgcaaataacttagctgcctctaaatcatagttggcctgttctaaatttctactccctctgacagatatccaaggcaaccatgatatcactaggtgctttcttggctggttgttggcttataagcaacagccagaatttgaattctagaacttaattttagagttgatttgggtttttgtaattgttttctatttttcagccttgtcttttggactgctaagaaagtaagaatagaaatataaaagtcttaccctaaaattatatttgattgcttcgtttattttcttcggcttaccaggttatcactgcagaatgataacataaaccagtttagaatggttataatacaactgcttgaaaaagctggtttgggctttcaaacttttaaaaaaatctgtgccatttatcttttctcttggaagaaaatgaatcatatcgatattcattttatatttcacatatgagctcatcgcatgcagatgctgaagcgagagaataaaagtgcaatggaagcattccatgaggccgttaagaaggtacgacagtcacctttgcataattgcatcacatatgttaagatgtaactatgtttagctgctgaaaacatcccataatgcaggagctgtcccacgttaattcaccttgcgattctactgaagaagctggcaacttgaaaggtgagtttctgtttttacctgaagatatatatcacatatacaagtttttttttactcagctttttagtggttatggataatgatttgatcattcgttcaatcccttattcgctctttattactagagaatttttgttcttctgccatccagaatttacccctcttgctactactgtcagttagactttgagtttgtaaaatgaccattccaaccctgcctcaaagctaaccgttgtagaccttctgtcagtgggagaaaatatctaggtggatgactggataactggatgacacagtgaggtttataaaactgatatatgggtcacattgtcagtaactcattgttgaggcatgttagtctttattggaatcgagaacatttgaacaagcagtagtggaaaacagaaaagagccatatggcgatactaacaatagatagagcagaatttggatgacagaagaaagaatagctattttactagtaaaaaataagaaattatatgtcaacaatgctctttttctgttaataaaatccttgcaatggtggtattaagaagtagtatggagcagcatcactttgaaggtaattgatatacatgatcttcaaagttcaaacatcacataatatcaaatattgctcaattggatatgacgaacataacatgcaaatgtactctttttctatgaaacaaaaggattttttttgcttggtgaaatgcaagcatgtataagtttaaaactgtcattaattttgatgatatcaagtgggttctacagacaacatgtcaatggcacattggtattatttcctgactcatgccatctatttagtattaatccatttgcccctaattttgcttctttactatgtacctaaatttattttcctgatggtgtgactgaattggacacagccaagacctcttccaagaaagtcagaaagcaaaagggcttaaaggaatcaccagcctctgagcatatgggagaggatacaaaagaccagcatagtgcagagcagcaccaagaacttggatatactgcaacaactggagttgccactcgtaaaggaagaagaacgcgagaaggtgcaagacaactcagtcctactgatggtgaagatcaagccagtggtaaaaaagcttctattgagggttcaagttataagacagaaaaacaagttggttctgtatatgatgaagaggcttgtaagatgacaacgacagagagatcagtgggtagaagggaaggactgagacgatctgcttgtacacccatgaaggcatatttagatccatcggaggatagaacatcacttttcagtgatacaagtgcaagtgaaggtgcaaatgaagtaaatagaacaccagagaattcaaatcagcatgaagatgattcaaccatagatggaactttggcttctcatgcagaaataagggttatggttagggatatactgttcagtgacattattgccaagcagcatgctgctgagatggcatatgtagatgaagtgatcaatggcatttgctgcgctagtgaattgaacataactggtgatcctactcctgttgcaaagggtggacgaggcatcaaacgaggtggtagtagggcagaggcggagtcaagtaacattacacagagatctagaaaagggagaatagatcaagcaagtagcaatggaaagaaaagagctaaggacacctcagaaaccatgaatcatgacaacagtcccaactctttgagagggcctttcgatagtactgtaagtagattcccttgcccacgcccatacttctaaaccttactatctcaaatttcaacactaatttgaccaaaatccaccagagcagggatgcagccatggaggaactggggcaagttagcgcgcgtcaaatcaggatcatgcagagtcttgctttgattgctccgtcaggatccccgtttggcaaaaatggactggttgcatcaaccagtttataattctgagttaattcgaatatccttgaaaggtattcgacagatattcgaaagctatcataactcatgaactcagcttcggttacacctaaccagttgctcgcttaggtcttttggagaaacccacaacgctacatggtcttctagaatgcaatgcgattgcctttatgtgtagtagaatcgactgaatttaattgcaatgtgagcacaacattgtatctgtaaggccacaaaatggtcccagtatactgccaactgaattcatacatgagtacactattattatgttagtactagtaccaagttaaggctcaattattctctttatcttaagatatcagaatgcgccaccgtttgaattgaggccccctattgcaatgttcgtagtgatttaaatagcaatgaaaaaactttaaaattaagttttaaaatttcaattttggcgatggttgatttcatacaaggggaactatggggcctgaaactttggtgccaataatgcattggcctactggtaaagttaaacagtgtatgtaacagcttgctacagcaaggttaccagtgttgaccattgcagaattgcaggttagagttaaacttgagcttggaggtgacgactttaaaccttggagcagtatttactcttgtctgccttggaggtgaccaacagaggactgatggatggactgaaaatcttctttctttgagaagttttaggtgccggtgaagaacgtcagagggactgtttcatcttcatgaagaacaatacgcatctgagagcctgtcggcattgacatgacgtcacgtctgcagatgattccttccctgaacgatcaagataaacaaggttccctgttggctgcatggcgattgtcagcccaggtctcctcccgagaacattccaagtgctcatcacctaacggcccgttgggttggagggagtttttaggagggattgagagtttagagggatgaggctattaactgtattgtttggttgggagacatgggaattttggtgggatagggatggggaattgaggaatgaactccctccttttcaatacctgggtagggggtgggaattgggagggaattcctcctttacttcgcctaaacaaatctcagccatccgttttcattaatgacctaatcttcaactaaactccctatcaatttccaccacctctatcaaacaagagactgggatgaaaaatcaaattcccatcttaatctcaccatcaattctctcgtgtaaactcctaatccccttccctcatgttgccaaacaagccgaagctctagaaaatgtatgcaaaattagggaaaaaaagtatggcataacccttaaagataaataaatgaacggagccatcacgatataagcgaaatgatatatttgcaaacgaaaagtaatttgtgaataaaatttttatatacgtgttcttagttatctaaaagcataggctgaaaaataaacttcaatgaaaaaacctcaaaattagctccaaatttaaggttgaaaatttaaattttggctgataaacataagcataagcgaaaatatgaggttagaaaatttgatccatattaagagaaaaaaaattatgtatagtgaagttttgatctcgtccacctttttcacaatgtgatgtgagaagagcttcatgcttaacaaaagagaatgaagaacaatgtgaatatatactagcagagctggatccagtgtgggtgccaccctacctcgctagatcaccattgatagaactagagagggaagggggaagaagagggagagaaggaagaggggaggggagggcactaaaggaggaggaaggagatgagtttctctctaattttattttggatccgtctttatacacgagcacatacatgaagatacatagtaacttctattggtagcatgttttacctatcaaggtctcgtttgaaatacatgcaactttttttttgacgtaatacctggaacctctttaatatcacacggcttaaactagctcttgtatgatccttcacaaatcagaactacaaaattaccgtgttccaaaggatgtcccaaagtatttcgaaatttgtagtaccaccacattaaattccaggaaaaaagctagattactcccaaagcacatttgttatgaatcacaaaacggggtgcgtttttatgagaaagatgtaagcctttgctgcctggacagggaagaagaaagaaagaaagggcaaaccaaaaaagtaaaaagtgagtgaaatggtctgcatacgcatcatgaagcttgacctgtcactgccttctctcctctgctttcgattgcgttttgtaaaccaaaggggtggtagtactgaagctgccgcgtcgcgaggggacacgccataaaggccacggttaacttgtcccttgtctcggtttaaccggagaggagagtgaggtcgccatggtgaaaaaaagctgcggcccatccggcatttctcctttttgtttgatattacaaggtagaatcacaggcgcacacaccactatacgcgcaacatcacactgacatcctataaatgtgtcccctaacacatgctataagatgtgaaaaccagctatatatttctgatcttactaaagttccgttgaaaaccaacatatacatgcttaatattcgtggagattttaacatagtagcagagtcatgtatcacttagtgcttccccggctccatccggcatttcactggagcgatgccggtgaaatggcaccagataaaaaggctcagctggagagagtttttttaccactgtttgggggtatgcaaagccctgtgccgcttgtcttcgacatcatgagtttccttcttactctctcagttttaaaatgtttgacaccgttgattttttaagcacatgtttgaccgtttgtcttattaaaaaaatttatgaaatatataaaaccatatgtgtacatgaaaatatatttaacaatgaatcaaatgatatgaaaagaataaataattaaaaagtcgacggtgtcaaatattttaaaacggagggattatatttgtgccagagaggcttcgaatgactacacacggccctgctgcatgaagcagtaggtatcgtcgtttgggtatcatgggcaaaaatagcggtagtgtgtgtaaaaaaaagtttgattcgtctttaattaggctgtgtttagattgatggtaaaaaattttaagtcacgtcaaatatacggacatacatttaaagtattaaacgtagtctaataacaaaataaattacagaatctatctgtaaactgcaagacgaatttattaagcctaattaatctatcattagcaaatatttattgtagcaccacattattaaattatggagcaattaggcttaaaagatttgtctcgcaatttacatgcaatctttgtaattaattttttagtctatatttaatacttcatgtaggtgttcaaacgttcgatgtaatagagtgaaaaattttagggtgggatctaaacagggccttagacttgttataaagttctgattgatggtagataaaaaataatttatgataattgtttgaatgcacgtacgaataaactaaatgatagaaagttgaaaaggttattttctaaaagttttcaaagaaatgctaatgaaatggagtattagaaagttgattaggagcttggaaagcatgccaacgataatccattatctgttactagttctaaagaataggccttaagtgggtgtagtggtctttattctttttctagtcgagtatttgacaatgcacaactgagtttatggacgatctaaaatatactgcttcagataaacttatgtatctacgttttccttcttccatcggtctacctcttcttttcttcatggccacttttgtagtctccggtaaggaacgattgtatgccgaaagcttctaaaccctggagcgatgagcatgttgcaatggcaacgtagtatagaatgggtgttctcatagcagcttggcacaatccaaccgatgtcaacatagatgagctcgcagtggttaatactacgggtccttcgaatcacaagaataaaaaaacagaaaaatagaaaaaaaatctaagaatctgacaggaatataagtgtaaagtagataattgcaaaccacagaaatctaataagagagatatattaaaatgaaaatttttcaaaatgttggagctctttctaagtttatttcaaattctataggcaatgaaccattccatacgaatttcataggatttggaaaaccccattcctttgtatctaaggagcaaaaaagaaaatttattgaatcctataaaattcaaagataccctacatggactagggacgaaaacagtcgaaaacgatatcattttcttgaaacgacattggtacggtcaggaaagtgagttgacacaaacaaattctatccaaatagcatgtctctaaatactaggtgttctaacagagggaaaatgatctaatagtataatgtggattgttttataaaattagtgacataccaatattactatactatgtagtaaaggccaaacttagacaaaaagtcatatttatattttatataacaaacattttattagataaatgaaattgtaccatacttctattgtgtgtaccatatccacatatttatttattgaaccgatgtacaggagtatactttgtgttaaaaaaatccaattttaaagattaatctagacacgtattgttagaatttgattttctttttatagagggagtaaggtttaaggggactgcctcattcatcttttttttttaacaaatgactgttgactgcccctatcgtgataaacatccatgagaaggacttaattaactacggtgcactgttgggataaaatccatggatcggccgacgcgcgcttttgaccgagggcagccgacaaataacgttcaaaggagggtccggtaaagaggagggcatccccagcaggaattctgatgaaaatccccattccccaaaggctgccatcccctgacacctccctccgatcatcccagcctccatgtccctcccctgtccccccccccccccccccttcttcctctttggttgcgtcttgcgtcgcccaacccaatccacccctaaagattaatttagagttaacataaagcttaatttagggcatgtttagatacactggtaaaattttcaccctatcacatcaaatatctggacgcatgtattgagcattaaatataaatgaaaaaaataactaattatatagtttgcgtgtaaattacgagacaaatcttttaagcctaattgcttcatgatttgacaatgtggtactacagtaaacatttactaatgatggattaattagacttaataaatttatctcgcggttttttggcggaatctgtaatttgttttgttattagactacgtttaatactttaaatgtatatccgtatatcttatgtgacaaccaaatctaaaaaattttctccaactaaacaaggcgatagcatctataatttgcttggaagcatatgtataattagttcttttatattcttatataagagctaacatttatcattttcattttttttctctcctccacctgagtatatatagttatcttatagcctacttcctctatctaaaataggattttggacggataggacatttcacatgaattctctaaaatatctcatccgtccaaaatttcttatattttaggaaggatggagtcctattaaacttaatcttacatactcttttcaacttggtaactgagtatatatgaagttgtttagatttacatcatttcaaaccataccatttttaagtacaattgccaaatatgagcatcaatttagtttattgccaaactttactaaatacataagaaatcttaccagaatttggaaagttatattttggatacaatctgaaccttctctttatttcaaaataaatatagctgtgcagttaaaatttaaactaaataactaagcccgagtttagtttcaaactttttcttcaaactttcaacttttccatcacatcaaaactttcccacacatataaatttataatttttccatcacatcgttttaatttcaacaaaatttctaattttgacgtgaactaaaaacagcctaaccttaaccttattttggttgtgtttagttcagcgcaaaatttagattttggttgaaattggagatgatgtgactgaaaaattatgtgtatatgacaggttgatgtgatggaaaaagactgaactttgtatcaaactttaaatctaaacacagcctttgaaacggaggcagcacacatcggtcgttcgatccgccaagtgaaacgcgccaaaacagccgtcgtcccgaccaaaagagtagcttcccgtgtcggcgccccccgcccccccgtatacatatacccctcccgccctctttcccgcctcctctcttttaaaccccacgacaaccacctcgcttgccattctggactgcgggtgagatcgatggtgacggacggggagtgctcggcggcggcggtgaggaagggtgggtcgccggcggtgcggagccacagcgaggcggagcggaagcggcggcagcgcatcaacgcccacctcgccacgctccgcaccctcgtcccctccgcctcccgggtacgtacgagatcgagacatccacgacgcccacgatggcgtgtgtgcgtgcgtgcgtgcgtctgacgaggttggtgtgcgtgcgtgcgtgcagatggacaaggcggcgctgctgggggaggtggtgcggcacgtgcgggagctgcggtgcagggcggacgacgccacggagggcgccgacgtcgtcgtccccggggaaggcgacgaggtcggcgtcgaggacgaggacgacgacgagggcgagcgcgacgaggggtgttatgtcgtcggcggcggcgacaggcggtggcggcggcgcgtcagggcgtgggtgtgctgcgccgacaggccggggctcatgtccgacctgggccgcgccgtgcgctccgtcagcgcgcgccccgtgcgcgccgaggtcgccaccgtcggcgggaggacgcgcagcgtcctggagctcgacgtagtcgtcgcctccgacgccgccgacaacgacagggccgtcgcgctctccgccctccgcgccgccctccgcaccgtgcttctcaaccgcgaggagctcctcgccgccgccgccgccgccgccaccgacggctacaagcggccacgcttctcgccgaggtgtagcagcctaacctaagcttcgctactactcgccgtacgtacgtacgcggcaaaacgaatctaagctaagctaggggaacaatgcgatgctgatacactactaccggtttcgtgtcacaactagcttggtgtttttttgtttgtttgtattccctccatctcaatatataagagatttcgaagtaatacgatatatcctctgtttcatattataagattttctagcattatccacgttctcatatatatatatatatatatatatatatatatatatatgaatgaatgaatgtggttaatatgttagaaagtcttataacctgaaacggagggagcagtattataaatctggacaaattttctttctagattcgtaatactaatatgtatcatattcttctaaaatctcttatattatgtaacggaggggtactgcgtgtcatttttccttgctgcttgcctgcatggtactagtaggctggtaattgtacttggcaaccagtatcgtcacgtagactttgtcaggtatactgttgcacggttgcagtgttgcgaagttgcaacagtggagatgtgtggcactggtgcactttttgtccaccagtacttcagtagtttcagtattggctctactgcagatcacatgaatcccttcgtgttttgccggcagtaggggccagtgtgctgtacttctacaagtctacaacacgacagggcttgctcctgctgctccggagttaatacatgcaggaaatgaaatagtagaagcaaaggtctaaatgcagggcttagttcacattcatttcaaaccatgtcattttctagtaaaattatcgaatatgttcatccatttagtttcttaacaaactctggtaaataaataagaaattaatcttgccaaaacttgcaatattaccaaattgcaaaaattttagcattgataaggtttattttagctacaatctgaacatgcccgcaatgttgcaactgcacgtgcaaagtcgtggtatctgatagaaattgaatgttgaggaatcattacagctccccctctaagtaatttttagaagcagagagacaatttcactctatattatctaggatcctgaaagcatttggatactccatcccaatttcaagattttcgagattttcccaaaataatcatctaacaaagtatctcttggtttatttgtgctaaaagtaaatgtgtatcatggaatgtcctgcatgcacgcgtgcaaccaatcaattaatttatattggtttaatccatgcaacatttaaagtgtgaattaattttcgttgaacacaaagtgacggagcaccttgatcaatgaggattaattccttggtcttgatgtcatttgcttagaggatgatcaaattgggatggagagaatattatttaggatctaaaagtgtttggtacagcatcaattctacaggataaaaatagcgagtaaggatctcgaagaatattatttaggatctaaaagtgtttggtacagcatcaattctacaggataaaaatagcgagtaaggatctcgaaagcgtttggtacagttccaacttcacgggacaaagaatatcggggtaggagatgtatcaaaatgtcattggaatggtttaagtggaagcccagaacattgctggcaccatttctcttcgtttctctatgtatgacgtttagcttgaagtctactgttaatcttccacatagcacccagttgaaccaaaccagaagagccccttaggaaatgcatggacttgccagacttgtgatgagcattgcagagagctcgaaaagttcagaatgaagaaaggcatatataccaagaaggcgagaacttatgactatcccacacctaacgagtgaacaatgtggccaaaatgatgctgggatgtctaaactcagaagttcagaacaaacccaactaccctgccagactgccacaccatcagttcaagccagaattttcctaacccccctgacgaacaacatctcgagataattggtgccaccaattccaccaaagttcagagccttttatattggatggtgaacaaccaaaccaaggccagggacttcaatagctaaagcacacagatcaactaccaataagaccattgctctggcttacctgatcacagattgctataagtagctccagcatcaactcctagcttcacagcctcacaagcatcacctcacatcaaaagaaacacagtagccttccagaacacacaaaaacaacagtcacttaccatggcttcttctggttgtcatcttctggttctgctcctggccttctcagccttccattgcagctacgcagctcgtcatcttttggacacagcagctgcagctgcagcaccagaggcagccccagctcagccctccatgccaacagttccaaccacgctgcctccgataccttccatacctgcagtccccaagctgacagtgcccccaatgccatctgttcctatcccaaaggttaccattcccccaacagccgctggcacaattccatctcttccaattccggccattccgaccaccataccaaccattcctacagttcctgttaccctgccaccaatgccctcaatcccaaccactattccatccattcccaccacaatcccgacgacgatccctaccattcccgggttccagatgccaccaatcccattcatgtcctcacctcccaaaaccactagcccctgaagttcttcaagaggatgagactgatattcatggttactagtcagggatttggttaggcatatgttgccatcatatcagtgtgtacatttatttgtgttctgttattggagttatactggcttgcattggtgtgattgtaaatgcagctaggcagttgtactatcatgtttgtgaataaatcatttcttggtttgcataacataccgcacaggatataagcttttttattgttctttacacgatcacatacagcgacagagaagaatgtgacacctactattacaaggctttcttctatttgacagaattttagcatggttttagcaatttaacatagtacatcaggaggaagcagacagacaggtgtgcttcttggtcctgtctctgcttaaaagtggcttgatataaactgtttgcataaattttctaagcataatctactgataaggaaaaagctttactaaatgtaagcagtgatttgtctcaattaattcttcagcaactcttcaagtcacacaagataatgaagatatacacatgtatcattgcaacaagataatcttctaacgatattgtaaagaaagaggaagaaacaatgcatgaagccataaattgcaagaaaagaattacgcatcaaaataacacagctgaatcaaaagatcagccaaattaatgtcaatttggtcataaagatcatggagaagttatcataacatctctttcaacatatcaatgctacaagagtataatactaagacgttattattggtaacttacaatagatggtagacaggatgagaaactaatatatatgtatgtttggaggatcaataatctcagtagaacatgattctgccgtttacattggggaactccaatctgaagttgctgctaagaactatcgtcgagtcaaaggctgaatatttcaggggtagtagtagtgcctataagttaaataaataataagccaaatatattaaagatcagatgacaaggaaaaaaaatatcaaaacagggaaaaaggtaaagaaaaatatttgtactatatgtgatatggaatatcttagtacttacactggttaacagaggctgcagtaggcacaacctgaacattgaatctgcatggtcacacttaaccctatgattccacttataggagtagttctattttcctgctgcaggctgaatttactgcattcccaagattctcaattttttcatattccaatttgaacatgaccataacagtaccatctttcccagtgtcatagtcctgtttgatatcttcagcttggtaatgttgcaactgtttcaaggttcaacgcagtcataattaggctgcagaaagaaggataaaaaagtctctgaaagaaatgcacattcagttgtactgttttttttacagaaaatggaaccgcttaagccactaatcatcacctgatgatagactgttcccaagagatcaaatggtacctccatacccacacgagcctaaagtgaagtcagaaattaaataataattataccaagtccatgcttcatacgtagttgcaatgaccaagaaaatgcttatgcaaaagaattagatattatcacctttggttttacaagacaagtaggagcatcttttaggcattcagaagcaaccccaccataagctctcaccagcccaccagttcctaattttatgcctccaaagtatctatacaatgtatagcatcataatatgatggaaagtatcaaatagtcacaaaccatctgtctagccaaaagttgtagttaatgtacacatatatctgtcagttagtgacagtattatctctgctcaagttgaggtacttaattcagtagaacactaaatagcaacaaaagggtgggtcacaattttaaaattacatgaaatggtttgcttaacaaatcggttacctgattaccaccaccatgaccatatcaatgccagatgaaataatggcagagtatattggctttccagcggtgcttgaaggttcaccatcatcattgtaacggaattgctctcccagctaaatagacatgtataaaagaccaatctttcatcaacaaacattactacatgagcatgaattgttgtacgattcaggtatatgtacaaaccttatacgcccagcaattatgggttgcacggggatcactgacctgttacaaaagagactcataaatttaatcgataatataccacacaaaaaaaattgtaaaaccaattttcacatggatgagttttctggaagccgaaggtaaatggaccaatattatgtgtacacatacaactgcaaacttaacctcacataaacaacttgtgaaacgctaaacgaaatacctgcaaatcctagatgaagtttatatcattcgaaatagcacgcattcaacttagctaatgagcgaacccttcagctaggtatggacactaaaactaaaggatgatggattagtactttacagtgcagactacactgaaaaactatcgagttcccctatagaacaattgtctgctctcccttcaaagaaaaaattggcgattgttggctgccacatagtcggacaagagttccctgtggctcaaggttaagacttaagacttgcccgatttggggcgtcggtgagggagatgataatagcgcgcgtggagggggacgcacctcgttgaggaaggacatggcggcgcgctcgtcggggacgggggcggcgatggcgatgaacttgctcttcttgatctcgcgctcgcagctcacgcgacccacgagcgtcgtgtacggggagggggagacggaggaggaggaggacgacgacgacatggcgcgcaggcgggcaggcgccaacgcggccaagctaccgccacaggaggagcagctgcggtggacggcggcggcggtggcggcggcgtctggtccggggagcaggagcgggagagagcggaggcgtggggcaatgcgcacggccgccatggatgggtggaaaccgtgggtgcgcgcaccggttccgtgtagccacggagatgctgctggtcgctctgacaggtgggcccagattgtcagagcggactcgccctatgacaggtggggctcacgtgaacagagggcgaaatactacactcgacaaacaaaccatctacataaatacacaaattatctcggcattatagagatcaacataatctttcaacaattgatcatctttattcatgtagaacggagatgaacacaaaaacaataaaacataaacttcttaagggtcaaccctctagaaaatgaagaggtccaacacaagcaaattcagttggaactgcagcacggacgacatggtagaatcagtttgggagtttaaacaggccccatccacatggtatggaaaccaccattgttgcgatagtggattcccctatacatacactctgggacacaagacaaaattattaactcttccaagaaagggaaacaaagagttcctccactcttcagtagccccagttgtcgttacggatttcatcatcgaacttctgcttgacctcaggatgctttgcaaagtattcatctgctgtcattgtgctgatatttttctgtatacgtgaacaagtatatgttaaagcaaatggaaaaatgctcttaataatggatgcatgcacaaccaatctctgacaaatggactgcaatatacaagtttcgccagagatcatcctcaccttcatctcctgcaattcagcaagctccttctctatcctctctgactccttcagagactccttttctgcttctttcagctcaacaagctgcatatgacgtgataaaagagaaaaggataaaaggtgcatcagtatctaaagggtacagaaggataacctgttgaagcaagatgagagaaagacgggcacatataacagaatgatagttccagacaagggtgatagacttatagttcctcaccagcgcatcaaactttggcttgtactgaggagtcacggtgtcaacgtacttggggatttcaatgcctgcatttatttcatgcttagtatcttcactacaagtaggcggaacaaactatataaaccagaagaattaagcaaaagtaatacttgcatggggtcaattgcaaattcaaagtgtaaggttgatgtgatcagcattttactaatattccaacaataaatttgccttttcccatccggaaaagggcatgtgaaataacacatactaccttctattgactaaatcacagagaagaacatgcatttctgagcatattacagtgccacaaaaagcattaacatttggatttacaaaacaacttgttcctttgaaataaaaaggtacagccaattagaatcattaacatggtaggtagtatgtgctaattgcatgtcagcaacatggtacgaagatatcgtattgattgacattagaaggaactgaaaacagcatatacatattactgatatgatctgaaagattcaaaggtctatacacaagagcgacaacaagaaaaggcataacaaggtcattgaccagaaaattagcacacgctaagagacaaccaagagaatcaacccacataatcatcaaacaacaatatcaactagaaagaacatatttgccacttcccacgccttatgaaatattgaaatatgttgatgtgattatagaatcatattccaataatagattagaaaaaaaaaatcaatattgtcaaacactatttctgagcattaagtttgtaacatcactgtagaacaatggtacaaagacacactaacgtttgtgcaaagaaaagcacactcaaatttaaccctacttccttgaaagacgggatatgtttgaagagtaaggccgtgtttagttccacgccaaaattggaagtttgaagaaattggaacgatgtgacgaaaaagttggaagtttgtgtgtgtaggaaagttcgatgtgacggaaaaattggaagtttgaagaaaaaagttggaatctaaacagggcctaaaatgcttactttcataagcttccttgtacatatctacaactttagacccaattccttttctgtagtactcccagtcaatcggttggggctcctgcagtgtcaaaagagagaaacttttagaaacataatacgggacctcagaaattaacagcattgagaaaacgcatgctgcaaatcaagagaaaatgcatgcatccaagagttctagattcttccaggcatttttcaaggtaaaagtaccaaaggaacatgacggcatcaatttgacaagacaaaggatcattttaattcaaaccatattaatcttattagccacaaagacaatacagatccttggtgatcgaacgtagtctgtagactataataaaaatccaaacgcgcaaacgcggtgaacggaataaagatgtccataattaacaacgttcttatgctgatgatcgtaagcaccaacgatgtgagaatgttggcataacgacgactacatttgtatgggttaacctatctccgatgtatattggtaaagtccaaatctaactgaatatcaacatgccaacaaaattattacaacgcacacgaatacagaatatacccaactaaatggatcgattccactaacatctcaccatgggatcttcgcattcaatacaagatcagaaggatcggatacgggaggatgccccccagatccggaaaccctaggtccgatccggcggcggcgggtgtggggtgggggggggggtggtgaatacctgagagaacttggtctggagctggtggttgacgtcctcgaaggtgcggcggagggtgttgaactccttgcgcgcctcgtcggagacgagcatcttggccatcccctcccagtcgatcgccttcccggccttcgcggccactccgccaccttcttcacgccgttcccgctcatcttcctccgccctcctctccctttcctctctacctcgacctctctctctcccccctcgttcgccgccgccgccgccgctgcagtgagctccgaccacacgggagagagaaatagggagatcgagccacgggatggggatttgcctggcctctctgccgctcgcgtggggtatactagttggcgactcctagtgggcctcgcaacgaattcccttgggccgtcggcccatttctacccactacgggccttcgtgggctgtaacacagaccacgtagggactatttgtcaacaaattttcttagacaattttgctatatatttatcgacaaatctccccccccccaaattttgacagatgtaattatagtacaatcataatgtaattactgtaacttacatataattacactgtaactataatgtaacttgtatgtaactttcaaaaacctctccataacatgttatttcagtaaaatagaggtcgtggaaacaaattctttcacatatgtgtgtgctgtgatttgttttcttcctcaccaaaataaatcttgtaatagatcttacatacaagttacactgtagttacatgcaagttacagtgtaattacactacgattatactgtaattacatctgtcaaatttttagcagaaaatttgtcgacaaatgtataggtggtcgtatgtaattatgatacaatttgtatataactttcaaaatcatatgataacacgctattttcatgaagcggagatcgcgacatcactcacgtacgtacgcttgatctttttttctttccaacttgcatgaatcttgtactccctccgtcccagaatataacaagttttaaggttagacacggttattaataaagtatgtagaagtgcggttattaataaagtatgtagaagtgagtggtggagggttgtgattggatgagtagtggaggtaggtagtaaaagtaaatggcggaggttgtgattggttaggaagagaatgttgttggagaagttgttataatttaggacaaatcgtgaatgttaaaagttgttatattttgagacggagggagtagtaaatctattgatttagaattatgtgaaagttttatatagtagccacaaatactttagttatatttgataatttcttagaaaaaatttatcgataaacataaagcaaaatcagcccgcataccgctgaacccgttctgaacatcacaattcacatgtggtagttttctcgaggagaaaccagtaaaaaaaaatcatcacatactcacagcgtgatgctgaagagatcactcgggattatcaactcttttccaccacggatcagagacaggtaaaaatgagtacatcggtgcatggagctgtgggctgtgggcggtcatactactccagcatggaagagataaagaagtgaagaagtactacgagataataaagagagatggatgtaactgacgagctaactgatgaactggtgtcgcggtacgcttggaaagcagagaaagcgagcggtgcatcggcttgagaaaagcagagaaagcgcggtagggagaggcgagaccaccgcaggttgctgtcctctcctctccaagtacaggcgaactggaactacgtgcagaaatcggagatgcagtcgccgtcgcagcaacgaaaccgccggtatacacgtacgtaccgatggtgatctgcgtcgtcgtcggagactagcgcttttgcccaggaatctgatcaacaaatttttttttaactatatcttacttattttcactatgtgcacacctctcaatataaaattagacactcatatcagcttaaactcgatgtaaagtagactaaattaagcaagtacatctctctatatttcgttatagctccacacctgctggtcctccaactccaaccaccatggcggcagaggagatggacgcggagcagcagcgttgtagcggcatgcaggtgagtggggacgagggtatcttggtggtgtactcacaggcgttggccggcctgcagagttggttgtgtacttgcgctggtgaatggtgatcaccggctaatggatgggaagaaagtctattcgtcccatgaaagagatgtactttagttctaaagaaaaaaagaatgcgtaattcatagaaagtctattcgtcccatgaaagagatgtactttttttcaatgtcatctaaatctttaaaatataagttcaaacttaattaatacaagtaaaaacaaatataacaaatctgacaaaaagaattcgtaattcatagacatttttttaaaaaaaaatttatataggtactagaattctccaaatctcgtgaaatgacattataaattaatctatcttaccttttttataagaaaaaaagatgattttttagactataagtaaaataaaacgagaagacattctctctagcgacaaaaatccataccatggatgaaaagcaactcagctagtactctgtgagctggagtgaataaagtgaaggccttcggtccctaagtttgttagtactaatcagttgtctgagatttgaagaattctactataggctttttgacctcaatatccaacagttgcatgaggagatggtcgaattaggtcatcatggtaaagggtaggattgacagggtgtgaggtgaggtggggtggatagtgtaggggtgtgtcgggagagttcgttgtgcaaatggcagagagctagtatatactttctccattccaaaatatatgggattttatacggatgtgatactttctaatataataaaaccgtccaaaatccattatattttgggacaaagaaagtacatagcaagcacctcggccaccaaggaaattagaaagacagtgaacggcgataacaaggctgagataacggcggtgtcgtctggatcatatgaaaggaaggagagcgatgagcagcagagaaatgagattgcatatatgatcataattataataaagaatataaatagctagcgagacttacgtcgtgttttaggcatattttcaaaattttctcgtcttcagtgagtactatttctaaactgataaatagtatgctccatgaaaaaaaattccatatcaaaatttcttttaaaaatcaaaaacaaacttattgccaccaaacatcacgtcctaacagcttacttctattttggattagttagcagtgttgctaaatgaatgtccgatggtaaaacactcataaaatctggttagcaaggttaaattatccacaccttggaataaaatctggttggtcgttggttatagagtttccattggtactttcgcggcctaataagtgttacactatgtttagttagccaacagtataaaagcccctaataaatgtaggattttatattgggttgcacagagcaatggcaattaaatcaatccacattactccctccatctacttttgatagtcatatttctaaatctgaaaattttatttgataggcatatttcaatccaacaacctatcatcttattgattttcttgaatttaatacgtgactctccattcttccacacatgattggctacatgggctttgagaaatataaatattaatgaatcgcttgtttatgaggaataactagtagcatatttaaatggatgataagtagaattacttatccttggtctatgtgtcaagatgaaatatgactatcaaaagtagatggagggagtactatatactactccctccatttcaaaatataagacataaccagccctaacccaaataccaagagaataattattatcatcttatagattagatcatcctaataaatacaatacatgcatccaatagaatattagagaacatgagagtggaggatttaaaaaagtaataatttagttagtggaaaaaaatttggtggaggaggggtgcagcgggcctgctgtgcagccctgatctggatgaacgacacgtggcccagctaccgatccaacgagagcgcgcgtagggcctccagcacaagtctcggctggctcccttcggctgagaatcgatcggctcccgtcccggctccctccgcgctcatgcttccctcgatgcgccagctcggctaaagtatatccctcccttatttctcgaagtctcgatgcgcctgctcatctaccgccgctgcccgcgtgttcccctctgcttctctcatagcagcgagcgccggcggcggcggcgagcggccgtgccgtgccgcgtatgtgtcgtctggacaacaagtctgattctgataggtacgtcatctctctagaaatcagaaccaccaccagcgtctgcagatccagattatttgctctcacctgaaactacagctgcaatctctgtttcgtttctgacaataattcagcagcagagcaatgttcaatacttatgtatatttattttccaatggtatctcccgggtgctttcctcccgctgaagaagcacaagacagcaaacaactgaacatatatataactcttgctgtaaactaatgtacgcatacatttcgaaatcacttccctaaaaatggaagaacatagttttgaaattgtttcctaaaccttggactagcggattaaattgctcattttcttgcaggttcttctcctggattggactgatggattagaatcagtaagatgcatattgtggattgagctcaaacctcatttttttatcatggtggttctgtattttctgtgcaaaatataaaggaggaaaatgctcagcctgaaaggactttaattgccacaagaggatggttttcaaaggactgtagtttaatatgcaggctttgtaatatgtactatgtaatctgcgaaatgttaacagtttgtaaggattgtagttgaaatcatacaagctgcaatgtaattgcaaggaaattcatccgtttgtaatctgtacaatttttgtaaatctgaaatacacatggcagttgataactaaagttatataattatattagcacaatataagaaatattatgattgtcatgatcatggtcatcctctacatataggtgaacatcatccatcatcaaacaatgctgattgaaaaacatgataattaaagaactagacgatattacctgcattatccgctcgccgccggctccaacatccccggtgatttcgacgtccatgggcgcaggtgattgaaatccatgtccttccatgccatgtgctagggcaggtgaaaacaacacgagatgagatgtcccggcagctgcagggtcctcctcctgcccttctcctgccatggaagctgatgcagctgcgttgcccgtggagacttgtcctgccatggctgctgcagtgctgcggttgccggcgatttttgccgtgatcttgaggcgcaggatgagacgtctcactccacgtccgcgtgatccaggggcacgcgataggagctttccaatttccacacccacgagccgatcgagcgcgtgcggtgatggcagacgaacaggcgcatcgagagaagcgtgaccgcggggaacaggatcctctgacgtagatctacgtcagagggacgtccgacgccgctacaccccttgatcggcatcggatggaggtgaataagcacggtagattaactggcttcttttctgctcacgctgacaaaatcgaacagtttactcgctcgcagggacgtcggccggcgcggagaacgacggcgtcatggcgacgttcagcgcctcgtcgtcgcgcgtgcaggtgcgtgtggccaggaacatcagtgcgtacgccgccctggagcgcatcgccaccgcctgcgccagccggagtgcgtgcctcgggggatggcgaaataaatcccggccggttgtggcccgccggagacgtagtcaacgtggccatgcagcacccatcccggcagcaaggccctccgtacgatcaccatgtcgttcaacttgcaggggctcatcgcaaatgccattcactagcacgctggcatgtatccaagctcaaagcacaaccatgatgtcgattctggcaagaagagtaagattcagcagtgctccgtctgagcgtgagctcgaggaggcagctagccatggcccatgcaaggttcggccagaagcgctgaccccagcgacaggaggtcggcgcaggcgaaccacacactcaacacggacggctccgccgcaggatgctgcgtgctgcgggcctgcggcaccgtcgacgaagaactcggcggcatatgacgagagaagcggccgccggccaggagcgagcctttccgttttcgtgggttgatttgtcagcgtgggccgaaaagaagctagttggtgtgctgtgcttgtttacctccgttcgataccgatccagcggcgtagcggcatcggacgtccctctgacgtagattgctctacgtcagaggatcctgttccgagaacggagggagccgggacaggagccgattgattctcagccgaagggagccagccgagacttgtgctagaggccctacgcgcgctctcgttggatcggtagctgggccacgtgtcgctcatccagattggggttgcacagcaggcccgctgcacccctcctccaaatttttttccttagttaatggcctatatgcatgcatgccttatattatggaacatcttaaaaaagtggttgtgccttatattatggaatggagggagtactactagaaccagaataggataataattctaaatttatatccatgtaattttggcccttttgtcaatcagaatcatggtcagaacaagcttgttttttctgtggattataattcaaaacgattttaaaattaaaagtttggtgttcaacaataactttggatgaattttatatgtcctcataaccatcataaaaatgagttgggaaatgaagtgaccataataccccgaaattaatctaattaaaatataaaaattgaaaatacttttgccgatactttgttacgtcgtatgtatttgagtcgatttttaaattcgttcgcatttgaaaatatataaggagtcgtataaaatatccttttaaaaaaatcacatactaaattgggacgagagtcggactcctaattgcttcagaatttttttcaagccataagaaagcaacatatagaatatgaccatcatccgaataagagttccgaattagataacaatactatcaaaataaaattctcatatatacttttcaaaaaaaaaatctaacaataatacgattaaaatagtcttcaccctttgcaacgcacgagcaatttttttagtctaaaattcaaaatcagttccaaattagttttcagctgtccaagcaacaaatagtagaaaatataaacacattccaaattttcgatctcaccagacattgagtcgtcaacccttcgtgaggtaaacagcaaagttaaaaaccctaatgacttttactagtgagccaacatcaattaactagatatattttgatactctatgcaactttgcaagaagatcaaagggattgccttggccttgcatgtcatcacgcaagcactgcatcactagcttcgatttagctattggtacggcggccgtggccgtggtgcgctcgccgccgccgccgccgccgccggcggccatacctcttcatgctggcacgctgacgcgtacacaggttgagtcgtcgtcgtcgtcgtcgccgtcgccagagctatgccgcgcggatgcagcggtgtcaagtgatggtgctccggtggctccgttcggcgccgcccgcggtgttcgtcagcgtcggcgccgctgccggagacgggcgccggcgcgtcgtcgtattccgcggggaggcggtggaacgtggggctggcgaacgcggcggcgacgacgacgacggtggtggcggcgacgagcgggcccgccacggcgcctccgaagatctggccgtgtggccccgcgagagatatcgagaggccgccgagcgcggcgcgtggcgccgccgcggccatggcgggcgggaggaacgtcgccgatatggagaggatctcgtaccggccgtggaacacgaccacggcggcggcggcgccgccgccgatctccgccgcggcgccggaaggcaacgggtggcggagcgagacgttggcgacggcgcccgtcccggcgagcacgcagatcccgaggccacggcggcgcgcgtaccccgcgagcgcgccggcgacgtccccgccgcccgggatctccagcacgtgcgaccgcatcgccgccgccgccgccggctcggccgccgccgcctcacgcgtgacgaccaccggcggcttcggcttgttcttggaccccggcggccgccccctcctcctcttacccaccaccaccaccgcagcaacaccctcgccgccgccgcccgccgtcgtctcctccgccgcgccaccaccaccatcacggctgtccacctcgtcagagaagcactccagctgctgcttcttctcgcccatggcgccgccgccgacgacgagcttgccatcgccttctcctcctcccagctgactcctcctctccatacctccctcacaagcagcagctagctactccagcttggagtgtgagtgcaacaatagctaagctaggaggagggtccctggctgctttaccctaccgggagagatttcttgccgggagagggagcacggtgaggtgtaagtgtaagtgaagcaaagctggagagaggagagacaggaggacaggattagccactggatccggagagaaaaggacatggagctcattacctagctaataatgccatactccggagcctcaggtagctgcagtttatttccaatctctcctgctgctgaaatagtatagattttcattgacattttaaaaatctgtagctgtaaaatttagaaaataaattgactagaaacccaaagttgataacctagttttttcatattcttactagaattctagagctcctccaacaaagatggataataagattaagtgggtacgcaaaacaagaaagttattagcatataatcaattaaatttttattattataaacttgaaaactggatttatttgatattttagagtaacttctatatagaaaacttttatacaaaatataccgtttagcatttttaaaagcatgttaatagaatcacatcttacctgtgatgccataagtagggcccttccattttcctttgatctcctttcatctttacccctttcaccgtctcctcctcctcctccaactgacatgatgcatggccggtgtgtgtacgctatccagcatccacccaccggccggccgccgcaccctttgacggcacggcagcgacacacacgcacagccgcgaatccgccgccacctctcacgctagctttttcatgtgccgacgccgcgacgcgagcgagagatctgaacatatgcatgctagtacaactgcgcgttttgaatgttgtagtagctagaactgtcaattatgtggaggatattttggagggcactctaaaaccgatcgagctatattggttgataagattgacagggacgtttgcaatttggacgaccaatatataatcaagcacgtgatataaacactttggctggctaacgtgataggcccaagcgatggacctgatatgatccatccacctgtagctggcttatccaatcttggtcctactccatctcttatttgtgggtttatgcgttcaacatttgactgttcatcttatttaaaaaattataaacaaaatcacacataaaatattattcatatttatcatctaatgataaaaaaatattgatcataaaaaaatttaaataaaatgggcgactaaatattaaacatagaaaccgacaaataaatttatcttgagacagacggtgtacttggcccgtggaataggatggagttaatgttgttcgctttttaagggaaagaatccaaagctagccgcactctgctatcaatcggtctctatccgttatcgacccgtacgtatctctggaacgcgacgtacaacatgtcaagggtgtagtagtacttgcagtcttgaataattcattcacatgttcgtacctagcacgccgacacatcaagtaaaaacagaatttgaggaagtgctggttcctgatgcctacttcctccgttgtaaagttcatatttaatccttgaagtacaaattaagatagagcaaaaacgaccaaaatactcttcattgatggagaaaatagtattgatgattgagtatgtaagggtattgaagtaatattttttttatttgtggataaccttattttggaacaaacagtataatctaaaaatgaacttatttatgaacgaagagagtacttctataggcaaaacaaaatcaatatgtgaatagaagcgttaaaataaattccctctagttatataattcttatcattttgaacattaaggttgactatcagtaatgtccaaaaatatagtttaaaggcactagaacaacgtatacatattagtcttcgaaagcactttaataaaattgattatttatttatttattatatttatattataaaattatattcaaagggtgtgttctaaagtgagttttcagacggatgattagtcgcacgtaaacaagaaacatgattagtatatgattaattgagtaaaaacttaaaaaatagatttatttgttttctgaaagcaatttctagataaaaagttttcacacgtaacatgccatttaatagattgaaaaacatgctaatgaagatcgagaaactaagtttagggtgcccaaatggagtttagaacgcacccaaaagatatgttttgcataatgtacgtgtcattgtttagaatgatataaactatagaaccggagggagtaatcaacttatggatgaactgatatgtgtgcatgtatgctctcaatataatgcttcagcttagtagtcagaccacatgcaattatatgtgcgtggctttgaaattaagtagggtggaattagctgcaaagtggttgctcctccagtacgtcctcctgttgtcttggttagaattcgtggtggctttggtggatcagatagagacgctacaatctacatcgacagctctggttttgacctggcaggcacaggcacagcacgtatggacggagacggaatatggtatggtatcatccatgcgcatccccttcggagaagaaattggttgctgagccctatttcttttccaacaaacggaatgatagctgaatacttcgtgtttcttttttttaaaaaaaacattcttatatataacacttttaaaaaaactattttaattttattttttaactataatatttaatttattcggttgtacccttaaataattatcgtaagtcgctcagctatttagctacctagccaaacaccctaaactttacacaagaatctgtatttccatgtcatagcaatatagcatacacagcatccgtgagaccatgatacgctcgttaattgctgcacttgtcaatcaccccaccaggcttgctagctagcagagcagatgaaaccaggtttgcccatccgctgatcgaattgaaggcagcagatcaaacctcttgggatgcagatccaagatgaataaacaagatgcgtgcactgactgaaattttcagccattatctacaaactgagccattttttcctttttcattgcagtggggtaataatacatcctacattattatacctctacaacccaaaccctccacatgtcaataaaatgtttgggccgtcctttccctagccgatctcctcaataaaacactattggcttctccaggatcatgctcagtcccatctaacctcctcctatattgttctgttaacttactactaaattgatgtttactttggttagtatacaaggaagaactttcatcgccctgattccaaccctccctggcaccctgaagcctgtgctcgtcaggcctatactgatccacctcttgacccgatgaactggtacccaagctagactttgatcgggaataagtcatacggccgttttccccatgtccgaacatagagccatcaaagtatgaaacttgatcaccaaatatgaggcgttccatatcctcactggtagagtttctagtgctttcactgctgtcggtgctatgtgaccctgtgtcggaactggtgaaaattgatgaactctcacttggactaggagattctgctggcgaatatggtccatgtccaaactcgtcatatgtatggggcaaatcatctgtcatgtgatctgcgtacatctgaccaccttggtgtatgggacctcctccatgccaccgtcctgaatttacccttgccttgtccttctttacacgtgctggatcttgagccatcagcgctggccttacagagcttggagctcttggtgaacacctgaaatggttgacaaaggatttatatatgtcctgataaagatccaggcaagcacagacaagtaattgccagtgtctgctattcatgagaacttctcttttttccgctccttgaaacaagtggcaaaaagaaaaataacaaaaaggatcttctctctaatgaaacaagagaatctaccttgcatagagcagcatgtatgcgcacttcgacatgacattttccagagatacaggtttgacctgaacaaagcaatttaccctccagttagaacaaaacaatggtgcagtgccttttgaagtcgcgtattctgttcagtatgctttcactaacacatagattatcctcagtaagtagtactctcatagctaaagattattcattacttaaaataggaaaacaaggctccggaagatccaggaatgaacataatcggctttactaaatagtgttttaccagtgataaaacattgggcaggtataggcaaaaacatggtgaaagagcttgtttacctgactgtcatctgttttgtaccacttcccatgcgtgtccttcacatagcatacataatgaccagaaaaggcggcattcataatatcatgatggacaaccactgcatacaggctgtaaacaggggaagtgtcatcagcttttgggctcatatagcgctgcaagttcaaggtctctggaaatctgatggctttgttgatctttccaaactttccagactgtatagatacagaagaaaagtattagtcaaacactaaatacaatttcaatgcttgttggacttattcaaaactaggataaatgaaacaatgaactcttgaataagtaaacaagttccttcagtgttgctattataagaaaagcaaaaaaaaaggtcttattgtagatgatacctgatatcttttcagcgcaatagtcaggacatttggtgcttccgatattgtcagcttctttttagcgcgctcatgcgatttgcatctgacattacatagtagagttaggagtatcagcattagggactaggcacaaaagcagtcaagttacacagaagtgattaaatatgtagttattacagctctaacacgatacatttattatagaactagattaacaggacacgtcttatgacatccaccttcctattatttcacagaagcaaagcaattttaacaagcaacagagcgttccaccaattctttttcaaaagtccctcgagaagatatctcgttttcaagactaaaatatatgcaacttttgcatggatatacatgacaatttctgggaaatcaattttccatctcaacaatttgccagatctgaaggcactactcatgttgttgtagaaagcttggatacgg

SEQ ID NO: 79096 - DNA, 25195 bp, Oryza sativa
  unsure (1)..(25195): unsure at all n locations
tttaaggaataattaataaaatacaaatgggtaggtaaggtggcacgatgagggtatttgcaaaaaataaattcgtgaccttagtaaacactcttttataagaagatattgatagtggcagtaaatctgcgtgggtgtacgtgtatgcagtggagtacataatagtgcgttgtttttcttctgatttaaaaaaagagaaaattgtgtgttgaaggagtgagaatcaaggagtaaaccatgcataaaagggaattgcgctgttgtattaagaatcaacaggaaaggtaaaatatataggagtagcatcttgtttcattgtgactccatgatcgatctatacgtacgtacaagtatatatcaagcatccaacatgactaattacagatttttaggacctagaggtagctagctagtagctgtcaggatcaccttaattattccaaatcaatcctaaactgactaaactactccatttctacatggatgaacagctagctttgcgaggctttccagcatttttgcatggatgaagctctctcacagataaaagaagaagaagaaaaagaataaatttaaccaataatgaacagttgatcaatgtctatgaagatctccaatcttcatgtctacatgttaacagctcgcacggcagctgcagctagcgatcgagcaaaaccggccgcgatccacccatggacgggacgatgcgcgttggccggccggcggcgcgccggcgcggctagttacggttggtggcagctggctccggagccgcctccgggaccttggtgacaaccattgccttccgaatccgacgtgcccttgtcaaggacctgcaagatgagctcgccggtggcgacgccgccctgcaggccctgcagccagctgctgccaaacaagtcaccttccagcagcctcgccgccatgatcgcgttgcagcattgcatcagcagcacggccaccaccaccaccctcaccatcgccgacgacgacgccatgatcgaattcagctgcagttactactgtactaagttactaactagatttgtttcagagatggcagacaagaattcaagctggctgcctacgtacgtgaaaatggatgaagaaattaatattgaagcttagctagctaggtttgttggaagagagacaggacgggggttggttatatatagagtttggtggtaaaaaggcggtgtgcaacaaaagtgaccgggtctattcttcatttcttcggcgccatgtaaaacaacgaactaatactactattattaagcttttgatttggcagtttcgcctcgcggaacaaaaagaaaaacgcggtttttttgagctagcgtgcgagcgggccgcggtctcgtttaattcaatttcctacgtttgacattgactacaagtactgtacgtatggccatttcaagggattttgagatacgatcaaccaacaaagccaggttacagtacgttgttcgtttgctaactacattctcatgaaggagtagttagttaaaatagtatcatcatgaactcgattgtttaacctccttgcctgcgtcagctcccgttcgttgtcggaccaaccgaccggcgtacgttcgacccgtacttcccgacttgcatgtactccctccgtttcaaaatatttaacaccggtgacttttagcacaaaattggccggttatcctaatccaaaacttacctttggtgaaaatattaaattataagcccaccttaaaatatactttaccatggatccaatgattaggaaaaaatttatatattgccttaatttttttgatataagccaagcgtgtcaaacatgtgttaaaaagtcaacggcgtcaaacatttcgaaacggagggagtaactaactacacgttttggctgatcgagacgatttcaatcgatcgatgagcaagagaggggggtattcaacgagagctatagtcagccgaactggactgactgatctagctagctgttgtatacgacgaagttaaataattacgcacacaatctcatcactgatcatccaatcgatatagagttagctggctagctgctacatatacttgaattatattgtgagctagagttagctagaactgtacttcaggttagttcatgcctgccgttgccggtctgtctgctcactactggagaaaccattattaaaaaccgggactaaaaataatttttaaatccaaatttataagagcaacatcactatttaattattagtgccgattggtaacaccaaccgggactaaagatgatcatctttagtcccggttcacacgttatcagggtttgtcagcaccccccccccttccccattgcagtgcgtttggccaaccgccaacctacatgaagcgcctataggtcgttaatttataactttcgagaaattgataaatgtttttaataaaaagaaattattagatgagattgatattgatattatcctcaatgatttccatcatatcaggaaatgttcgaagaaatttttaagataatgcttatgagttttggatataaatattacttttgattgcaaattaaatctgttcatctgtaatatggcataaatgcatacattggtaattatattgatagtggcagtaaatctgcctgggtgtatgcatgtggagtagtagtgtgttggagaccaacaggaaagataaaatacaaaggagtagcatctcttgtttaaaaaaacacgaatattagagaataatctaatatcagataaataaaagagatgaggctttaaatccaggttagctagcccaccatcttgtgaagctagctggaaaacccggccgtggacgtttctcaaagtatagcatctcttgtttcattgtgacttcatgacctatacaagtatcaagcattaaacatgactaattacatactttcaggacctagatgtcaggatcaccttaattattccaaatcaatcctaaattgactaattaaactactcatttctacatggatgaacagcagctagctttgcgaggctttccagcatttttgcatggatgaagctctcatagaagaaaaaaaaagaattaaaggaattcaaccaaatgaacagttgatcaatctctacgcagatctccaatcttcatcactactacatgttaacggctcgcacgccagctgcagctagcgatcgagcaaaaccggccgcgatccacccatggatgcgacagatgcgcgttggccggccggcgaggctagttacggttggtagcagttgcctccggagccgcctccgggaccttggtgacaaccattgcctcccggcggcgaccctcccttgagcacctgcaagatgagctcgccggcgacgccgccctgaccctgcagccagctgcccagatcaccttccagcagcctcgccgccatgatcgcgttgcagcactgcatcagcagcacggacaccaacaccaccctcaccattgccgacgacgacgccatgaatataattcagatgcagttactacaatactgtactaactagatttgtttcagagatggcagacaagaattcaagctggctgctgcctacgtgaattaaaatggctgaagaattgaagctagtagtaaggttgttggaagagagacaggattgggttggttatatatatagagtttggtggctgtgtatacatacgtacgttgaaagtaaaaaggtatgtgcaacaaaagtgaccggatctattcttcggcgccatgtaaaacaaccaactaattataatactactattaagcttttgatttgtcagtctcgatcgcctcgcggaacaaaaagaaaaacgcggtttcaattttttgagctagcgtgcgagcgggccgcggtctcgtttaattcaatttcctacgtttgacattgacaagaactgtagtagtagctcgtgccatttcaagggattttgagatacagtacgttgttcacttgcctactacattcccatgaaggagtagttcaaatatcatcacgaattcacgataatcaactcgatcgttgtttgacctccttttctgcgtcagctcatgtacgttgtcggaccaaccgaccggcgtacttcacggcttgcatgtaatcaactacacgttttggctgatcgagacggtttcaatcgacagatgagcaagagggcgtcgtattcaacgagctagctagtcacttagtcagccgccaatcgatatgatcgatcggaccgactggactggctccaaaaaaaaaacagtaaaggtctgaataaactaagataaatctatagctttctttcatatgtatatacaaaatttgtagtgaaaacttcatgaagaattccatggtgttattgtgagtagtgaatgctcgagtccccattgtactcatgctcttgatccgcctctgatctagttgttgtatatgcatgaattgtgagctagagttagagcaagtataatagagagctataagaaggctgaatactgaggtggatgagagaggagaggagagagatgagaagcggactataagtttacagccggcttaggcacaggaaccaagaaaatctgtgagacagacaggtggaccatatgtttacagtgaagagttaaccactatatgagtgagctgatagataggctataagtaagcagctggctatattattacccttgctcttagcaaacttcaggtgttgctctctgactgccgttgccggcccggccgctgcattggccaacctacctgaaacctaggtcgtttataataactttccgagaaagtgacggcgactttgatcgatcgatatcgtctgtgaaattcatatgttcattcgatcaaatcgatcacaccgtctacggccggacgtgcagtgcgtgcgtatagtaccggcaggtttaattagtttacgcgcatgcatcagtcacctgctgacttcaatccacatcaccaattcaccaccagactcacccatcgatctcaaattgaattagggcctcatcgtacgcttcaactgatgctaaattttaaactttaaactttaattatagagttcattttaggatatattttttaagatcgtcttttaagttgttaacaacatataaaagctttagccataatcttttccttgataagtcgctttgatatataattggttcttagccaaccgataaaggctgtgtttagatttaggggtgaaaagttttagcgtgtcacatcggatatatggatacatatttgaagtattaaatatagactaataacaaaacaaattacagattccgccgataaactgtgagacgaacttattaagcctaattaatccgtcattagcaaatatttattgtagcaccacattgtcagatcatggagcaattaggattaaaatatttgtctcgcaatttacacgtgatctgtgtaattagtttttttcctatgtttaatacttcatgcatgtgtctaaacattcaatgtgacatgctaaaaatttttacccgggaatctaaacatgcccaaagctattgttcattgcacagacttttaatatgacacatgccatagtagtgcttattagctcctaaatcttttgtattttaagacaaataaagtcaatagtaagggtagtgtgtgtgtgtgtgtgtgttttatatgtgtggtatggaagttttccgacagtaccgataccatattccgaaaaactaataatatttttatcgacggttaccattttcaaattttatttttcccaatttctataagcgtggcattgaagttgacactaaatagttcaattcataaatataaaaattttccaatcatttttgccagtttccgaaaaataataaaataatgatatcatactaaccatttccgactaacgtaacttccaacaatatgcctgcggtgcagccatatataataccataaaatttacccttcactacaacatcatgacagcattaatttcttccaacaataccgcaaacttcacaaatataaaagcgaatcacgctattgtattaaagggaaaaccaaaaggaaagtaaatttcttctaatgtgtcggacagtatccatgcacatgatcctcagattacacactttcaggacccagctagctatatatgtccctgacttaccttgttccaaatcagtacgcctaaattgactagactaaactacaagtctactgtctacaactatgaacagctttgcaaagctccacttttacatggaagctcttacagttaacatgggaaaaannaaaagaaaaatgccaagaaaaccttnggaananttcccaaggnnaattgggggcacaatctcacntatgcaggagctgagtatatatatatgtcgaacttaattagatcttcatgtacatgttaattaacgtcccgcgcgcctgcagcgaacgagcaaaaccggtccgggaatccatccatggcggccgaccggcgcgcacataagctgccgctcgccgaccgaccgccggcgcggcgaggctagttacggcgtccagcattttccggatccggagccgcctggattgggaccttggtggcaatcattgcctcccggcggcgaccctccattgtcaaggacctgcaagatgagctcgccggcggcgccgacctggccctgcagccagctgctgctaccaaataagtcaccttccagcagcctcgccgccatgatcgcgttgcagcactgcatcagcagcacggccaccaccaccaccctcaccgtcgccgacgacgacgacgaccacgccatgtatatatattcagctgcagtacgtacgtactactgtactagtagtagcaacctaactagagcttgattaattcggctgttgattcgatcaatcggctagattgtttaaattaattaattcggagtggcagacaagaatccaagctggctgcgtacgtacgtacgagaaaatggctgaagaactgaaactatagttgtttgtgtggttgtggggaggcaggatcgattggctggttatatatagagttttggtggctgtgtatatacgtgcaacagaagtgactgtccaggtcggtctattcttcagcgccatgtaaaacaacgaactagtgctacttttaggctttaatttgattgatatttgtctcagctcgcgcgcggaaaaacgcggtttgtttgagcgagcgggccgcggtcacgtacgcttaattaattcaatttcctacgtttgacattgacaagtctagtaagtattcaagatcattgatacgatcaaccaaagccaggctcgtacgcacatacgttgttgcttgttagctacgtaccgtgcccagctacattcccatcaaccaaatatatgacctccggactccggtccttgcctgcgatagctcccgttactggactaccgaccggcgtcttcacggtttgcatataactacgtgtaattatagcatttttgaccatttagctagttgcaaaaacttattataacaagaatagatcatgccaaaatatatcttcaaccaaaaacacgcgacattggtttcatcgagtatggcgcaggtccaaccagggttcccccaaaccgtttttgcggtggttaccgccaccccacggtttggccgtggttaccgccaccccacggtttggccgttactggccacggtaaacgtgcggttaccgtaagatgtaccgtggtttcaaaaactgagaagattactgcacgtgataatcgtgtggtaaccatacggttttgtaaaccttgggtccaacatgttagcgccacgttctttggtgcataggttttgccatgctagatctaggaattgagttcaacatccaccaggccgtgctcgcctgtctttccttgccctctcattttctatcacgagtcagccgactcaacttgccctcttttcctgtcccacccaactcatctcctctcctatgtcttcaagcttcggttctctcttgtagggagggaactctttgccaccttgttgccttataaactatttggaacaacggtagcaatgctactatacaatcacctctcatttatttttcaactaatcttacgccttttctcaatccatcctcatttaagattaaacttcggtgatattataaaaaattcacaggtatcaaataataccacaaagtttccatatataccttcccttagtaccatgtcaagatagcatttcttccaacaataccacaatatatatatatatatatatatatatatatatatatatatatatatatatattgtgttaaaagggaaaaccaaaaggaaagtaaggtacattccagcttataagcagcaacacaaatttgaatttgaaaacttaattttggagttgattaaagggttcttttattatagtttattttttagcctttgcttctaaattgcttaagaacacatatacaaaagtttttattgacaaattgttttttgggttgttgatgagtaatttgcagcttatatagtttatttataaattaatcagcatgtgtgaaacgatcactgtgtaaatctcttcttgtattgacaagtgtgtatgattcatatatacattgaggatcaacctagctagctatatgtcacggactagtacgctattacacaaatcaatacgcctaaattgactaacctaactacaactatgaacagctttgcaaagctccattttctgcatatgcatggaagctaactagctctacgtgtgcaggcgtatatatagaacaaataaatcgtatcaaatgaacagttgatcgatcgatctactctacgagcaaaaccgggccacgatccatatcgtccatggcggcgccggccggtgcgccggtggccggcgcggctacttaggcggctggtagcactggcctccggagccggcgccaccttggtggcaatcattgcctggtggtcccgatggcactaccttgagcacctgcaagatgagctcgccggcggcgacgccgtcctcgccctgcagccagctgctgccaaacaagtcgccttccagcagcctcgccgccatgatcgcgttgcagcattgcatcagcagcacgcccaccaccaccaccctcaccaccatcgccgacgacgacgccatgatcgaattcagctgcagttaattactactgtgtactaactactagatttaatttgtttcagagatatggcagacaagaattaaatcctcttaattttgctgcgtatatattactacgtgaaaatggatgaattggagaaggtagtagctagtgtatagtgcggtttgttggaagagagacaggatgggctggctatatatagagagcgagggaagagagtttggtgtgcaacgtaacgtacaaaagggaccgggtctattcgtcggcgctatgtaaaaggcgctacttttaagcctttttttattgtcatcctcgcctcgcggaaaaacgcggtttttttgagctagcgagcgagccgcggtcacgtttaattcaatcgtcgtatgtttgacattgacaagtacaaataccattcattcaagataatattcatacgtacgatcaaaataaaaccatgtgtgtccatgttcgtacgcatgtatacgtacgtactcgttagtaatctttttttttaattgtgtgcatctcagttatatgtagaacaaatatatcatctagatgtaatttaatgagtttaataaaatagtaactttgcctgcgcgagctatagctctcgttgttggaccaatccaccgatcgaccccggccgtatacttcccggcttgcatataacttacgtcgatctcgtaactacacacaattttgccgagacgacacgtacgatcgatcgatgaagagatgaactagttagctactagtcgtattcgacgagctagtctaccgtggatatcgcgatataatatgaccaaataactgactgactgattactacgtagtactttacataatctacagtattaattactagctatgtacgcagttacgagcgaacttacttggtgcatgcatatgcatgactatatgaatggtgaagcaagctagcccggccgctgtcgtcagtccatgttgctctatcagacttgctggctgccttgccgagcaagtttaataatatagtctactgctcgctccaaatcatctatagccaatgtaatagccaatttatacaatagttgcttactatactattaatacttggtcccacctgtcatatacatattacgttttggagtccatgctgcagctagctatagatctgtagcccacttctcttctctcttcctttatctttttaaaatatgtttataaatagcttagagcctgctattgtatctgctctaaattagtccttatgacttccgagaaagtggcggtgattttgattatattagtattggtttggtttcatgggcaggtttattttacgcgcatcgatcgatcgatgagtcacctgctgcagactcatcaccaattcaccaccgactcaattgatcgatcgatctaaaaaaactgaattagctagcctgctacgttgcacatatcgagatcttaatcaaacgcagagagagtggattttaaactctctacgttgcacatatcgagatcttaatctaacgcagagagagtggattttaaactctctggaagatgtcctttcgttgttttattgtactcaaatagttataaaaaaatagtagaaaaatagaagaagtgttaacatgttatcactctacaacatacaagttaaaatttaacttttgcaagttataaaaagataaattaaactatatctggttaagtcaaatatatttttttcattgcaacatgttgaagttactgtgcaggttgcaaagtgatctatcatatattaatctattttattaaaaaaattaactatttaagtgatatgtaaataacatggggacgtcccttgagagtttagaaaatttttcccatttgacgcatgctatagttgcttgtttagttactacctagctcgatctcgtctcacatgtcctgacggtcaaatgctatgtcttgagtacatatatatgttgacctttatatatttcaatgttgaccaagtctaactatagttaagtcaaattgtgtaagatgtagcaggcatgttttgctatatgtaagaacaattaatatatattatatatgcatgcacgttacatgccagacaacctcatgttgtattgttttcatctcataagaggatatattatatagatctcaccatcccctcgttttatgtatgtcacttaaatagttataaaaaattataaaaattaataaaataggttaatataaaatatatcacttcacaaacataaaagttaaaattcaaactactacaagtttaataaagataacaaatataaccgtgaatgaatgataactttcagttttttttttgcaacttgtaaaagttgaatttggtttcgcatgtttgtagagtgatgtatattatatttaatctatgttgttaactttttttttatttttttataactatttagatgacatgtaagaggatatcctcttgagagatgaaaatccatatccttttgttcttctccttgctgttacattctgtttgcaatcactttgtaaattgttttttaaataaatatataaatacgtatcaaagtatatatatatatatatatatatatatatatatatatatatatatatatattacgtcctacacaatacatatatgtactttcattcattgtagtctaacaatttaataattattagtgttcaaagttgaaacggtcaactaatataaatgcatatatagatcatcatcaaataccaaaattaattgaattaatccaaataaaactatatatctttatcatctggcgaaaactactttacacaatttaattacaattgtctgactattttctctcctatatactccctccgttttttaatatatgatccgttaattttttaagatagattgatcatttgttttattaaaaaattatgtaattattatttattttatcgtgatttgatttatcatccgatgttctttatatttgtacaaaattattaaataagatgaatagttaagtgtatatcaagaagccaatggagtcttatatttaaaaacagagatactacttgcatgcatgatatgctctaattattgactactacactgattatgaataatatgaactatatatacatcattcgacttcttccaacgtacactccatctttacatatatggaagctcctaattactgcatatatcattaaaaaccaaataatgaatgaaacaatctctacagatcatctagtatatatttacatgcatacatgtcgacatctacatacaactaaacagagaagcagccggtgtcagatcgccgcatgcagcagatggcgatcgagtagtataattaagctagctagccgctgccgtggcatggtgcgccgttgccgccggtctcgccttgtttgcacccattgcctaccggcgtggttggggtgctggtcttcagtatctgcatgacgaacatctcgccgccaccgcctccgccaccgccggcggcggcgacgacgtcgcccttcaacggcctcgccgcgaggagcacgccgcagcactgcagcaacacggccgccaccatcaccgccctcaccatcgtcttcgccgacgctgacgccattaattatatgatttcttgatgaattcttaattaagctagctagctaggtgctcggcaatggtgtaaagctcagtgagacgacgagtgaattgaatatagcagacagaaagtgcgtttgctgtacgtcgaatgggtagctagcttgattaaagaaaagagtaatagcttgtttaatttgttggaggaaatcagacaacctggcttccttttatagtagtacagttcatatatgttcgtgacttgaccacacgttgaactgcatgtactagtaaaaatcttaacagatgaacgggtctaatcgtacgagtttaccagtagtactactaattaattaacaacataacatgccactgtacgcggttttcagcgcagtccatgtccaaggttgaacacgaatagctagttaggttcaagaagacgtgcagcagcagttgtagtgctgctacgcgtgagtattactatggaagctaaggggatgtttggttgatgcctaactttgccataactaagtttaggctagttgtggcatagtggcacaaatatggcttagaaatagttggccacaagtgtggcatgcttagctctaaatttgagagcatgacacgtgggtcccaaagtgtggcataacataattgcggcagcgaaccaaacacatgcctaaaaaactatggtatgactaaagtgtggcgtgacaaaatatggcaacgaaccaaacagctcctaaggcaaagttaatcagtcatgtatatacagttacactcctacaaagacctagtagcccctccgtcccaaaattaatgtagttttacattatttatattcaacgtttgactgttcgtcttatctgaaaaaaaaagtttatgattagtacttttatttttattaggtgataaaatatgaatattactttatgtgtgactaaattttttaaataagacagatagtcaaccgttggacatgaatctccacggttgcatttattttgagatagaggtagtgtgtgtatgatactccttccgtttcaagttataagatattttgactttggtcaaagtcaaattattttaagtttaactgagtttctagataaatatagtaatatttataatactaaattagttgcatcgaatcaataattgaatatatttcataataaatttgtcttaagttaaaaatgttactactacttttctctacaaacttgatcagagttaaagcagtttaattttgatcaaagttaaaacatacgaagtactagtcatgtgcctatgtaggaccgtacggacgttctgattaatccgtgtgtaactcgaccttgaccccgatcgatcgagcgtccatgcccttgaattgacacattcgtttggaccgaccgaccagtgaatcttcctcgatcgtaacggccgggttcgaccagttaattaattagttccctctgaaacaagcaacttaactcgatcgatcagtagctactactagtaagctcgtacatacacacgcacacgcacgtactatacgcctcgccgaaagaccggaccgttacttacacacatacgagtatacgacgagttgtgtagacgttttcatgatacgattgcgtgggtttcaagaaaagaatgatatacgagttgtgtacatacgcacggctcggtatcgcccatcgatcgatcgaacgcgatttggtcggctctgttcagctacgtactaccttcgtacacataaaaaaatcgtttaggacaacgtttaagtcaaaccttaggaatataaatcatgaataactctcaagttgttgagtttgaaaatataaaaattatatgaatagatttgtcttgaaaaataatacatatatcactttttaataaatatttttatagaaaaaagaagtcaaatttatgttttgaagaccgtgtcgctattctaaacgtctttctttacgagtatgagggattactaattcagcggtttaattaagttgatgcctgccgctagctagtcgcggcgcgtggacgactggttgaattcatgtgtaaatgctgcagttttcgccgaattctgcgtgcgtgcgcgcgcgcgcgcgtggtgcagggatcagactgatgctgcgcatgcgttagagcaggccgtggcacaaggctctgcgtctgctcggccaggccggtcgtccagtgcggatagggaactgggctgagaatttggggccgcggctgggggatttttttaagggaaaattgaaaccatctcattataatttaaattaccctttttttttaaggacgaggagatgggggcatgaggggcagatccagcacgaaggcgacagggtttcgagcctccactattaggtgaaaacgcccccacgaagactttactaaaattttttaccatatgtaaatgggagggggaacggtaactctatctagtttgctcagactctagtgctatttctttctggatccgccactgaacacatgactggtttcttttcataggtacctgcctaaaatctagactttttaaatatgtgtatacctagctctttaattgatttaggtagtcaaactagttgatcaatccaatacggttatgaaacatctccaaaatgataaagaatgtgttagctttctccccctcatccttttctcctcgctttctccctctgctaggggacggcgttcccgcacagtgtcgctttgcaagggagacggtgacagcaggagacaacagcgacaacatatccggatgtgcgaggcggactcatgcacgcgacaatggatccgtgagggcaaggcgaatggcgggtcccctcctattggcctcatcgtcctcaacaaccgtgtgcacaaggcaggctcgactgacaagccatcgagccttcctccctcactcctctctcgccgtcgagccgccctagcaatggcgccctccctcccttggatgtagagagggcggggatagagagaagggaaatgagcatctatgacgtggggcccatgattagccaatttggccaatgaggggagaactttggcaggtggattatcttggtcatctggatggagaggtgttagaggaggattttttttttctaaaattattaaaatttggtttacaaaatcaattgaaaagactgttaaaaacgctcgaactcgtatattagccacgttcaactgcatgcattggaaactaaaaaaaattaaggaacaagtctattttctattccattcgtaagcaggcactactagtaaataatttgtttttttcccccggtccagccgtgtaagtacacggtccatgtccttgaacgatttattaggttatttagcccactccgaaagttaatgggctggctgtgaacctccgcaaggcaagtcacgtctcacgtgtaagctggactgttggatatggttaaaacatttcggcctaccaacgatggtaaacatttaaatcaatgagccgtaagcccttgctacataggagtactccgtaacatggtgattaacaaattgtatttgaaaaatgcattcttattctctctagagtgatagtctcagtgttttttttttatttcaagacaatatataccaatacatactcactccgtcccataaaaaactaacatctattcatatttgtgataatagaatatgtcatatccattaccaatatcgttaattacatgcactactgattaatactaagcagcaaagacagaaattttattgtattaactgaaaaaaaaaatctacgtacggaaaacaattaaaaaccggccggaatcagcttgatcgatcgaggtcgtcgtgttcgcgacaaagaaaattaattaaaactaagtaacaagctaagctagctagctaccggcggccgggagtactgccgatgcatggtgggctggggctgctgggaggggtcgggccttccttgcacgtattgcccgtaggcgtcgttgtggcgccaccgccggtggtcttcaggatctccggcgtgacgacgaacatctcctccccgccgccgccgccggctgcggccaacggcctcgccgcgaggagcacgccgcagcactgcatcagcacggccgccaccaccaacgccctcaccaacttcgccgacgccgacgatgccatgtttgtgagatctctgatcttgaactttagctagctagctatattaagctgtaagatcgatcaagctgattgttatgaaactattaggaatatagagatccacaattaatctcaggcctatacaatgtaatcagctagagtattcctaatagagtactagtgccgatcgatcgatgagtaagtgatgatctgaatgtagcagccaattaattaagtacgtggacgtactgtcttaattgaacgacatgggacaggatgggtttccttttatagataactcgatcgtacaggtatacgtacgttggccacacgttcaactgcatatggagtatgcagaaaaatcagaaaaacaaacaaaggaccgggtctattgtctattcgtaagtatttactatgactaatgagagtttttactgtccttgaaagggggcggtaccaaatctgaaccgtcgatctagcttcatcggacggctgagattggatggtaccgcgtggtaccgcacgcgcagattggggcggtaccgctggggtaaaaccgtattttcgcgtaacgaggtaggggtccgtgatttcctgccgggatcagaccggggcttctcttccctttctctctgagcgccatctctttccttttctccctgttttgttctgattctcgacgatttcttggcccacgcatagggatttccccctctagaaccagcgcaggggaaggaaagatgggtccggtcgatcggcgcatgcgtcgtgcctttgctgccgccggcgcaggggatggggggatggcgctcagatctggaacgagcgcgcctccatccgctcgtccggtcgatcggcgcgtgccgttgtttccgccggcgcaatgatccccttggagcaatggaggtggtaggcggagggaaggatgggtgtggtgttcagaaccaagcaccggcggggagatgcggctgcataaggtgctgcgggtgtcgtggcgtaggaaaacggagaagaaccggaagatcaatgtgctacactgcgaagagttgagtccctgcgaaggtagaggtgttgcgggcgtatttcctttcgcgcagatggaaaaagctaagccgggtaaggtaacatcaagcacttgttcttcctttcagtttgaaagaaatgttgcaattgactggagcttggaaaatagagatagtagttttgaatacatggctgataattgattggaaataacctagatggaaaaacagtgttgcataatataaaagtttagatagatacacttagatggaaatacagtgtttcaaagatgccactaattggcttcaaagcttcattgtaacttcagatgtggacgaattttctgaatgtagacgtctgatgtcgtcgtggacagcaagcactatatttagagtagtgttgattaggttggcggcgacctttagtctgaaaacttcattcggttcctgaagtcaagagggagtgaaaaatatgtgtaagagatgtgtaacactaataaaatgtgagtcatagtagcttagtacttttcggagcagtaccatatttaagaagtcgctcgttaattcctttccatcccaggtctccatgaacttcaaagcatttaacccacatgaccaactaaccatagaaattgagaatgtcagttagcaataattgttagttaaaagcgtattgatgatatttcacctgtctttctgttgaggtacactctttgggcacagtggccattttgcaacatttgtgtcagtccaggatgttggaacaggacgttctttcaccgtgtaatcaatatacttggccacgccattgatctgttatgtgttaaaattacttagaacatatgttattatagcatataggaactgttattgcgatggagcttactaggtttttaatatcttcgcttgcattgtaccattgtggctgcatctgcattgagtcaagaatttgaatttcttggcatcttgcattaataacaattacgtaccaatgcgatttgtccctatttattggtaggaagaccttcaggaaatagcataagttaaagtagtttttggaaaggcataaaaataaatgatgacctgatttagtaccatatcatggaccatgtatctttgggcaaacgttgatctggattcaatgtatcttttacttggctttcctcttgtcttaccaacggcacaccaaacctggacttgcgtttctttctcaattagagcagaaccgtactgcctggtgtggccttgttgattgtcgtttatgagttctgtgtaagcttcaatgacctgttgcaaaataaaaaaaaatatagaaatgtatgggaaaggtagaaattattataacagataaaaataatcttaacgaggtgttcaaccattttgattttgatgaactatcaagcggcgttacaagtggcagtagatgtgcacgtgatagctctatgtcttgtatactggcaagaaccttagttttttctgactggaggatgtaattgattgttattttatctttcaatgtcaaaccaaggttcgctgatcctgaattggatatttgaattttgggctcgaatgtttttttgttatgtttgtagaatatgaaatcactttgagtttgatatgatggcttgactgtccttccgaactgacctcttagtctttctgcaatggttttgttattgtcatctgtctcagttgcttcatccccagtgattatgaacggagcttcctctgttccattaccatcaatctctttggctaaatttgtctcatcctagagaagaagacataaaaaattgaatgctcgaacaatagttttgtaaattagttcagtacaactcaccgtattatcttcatgcatctcttcagtatggtaggcatcctttcattgcctaaatcgaatgttcgattatcctcgactttgttgacatcagcttcttgtttgggtctaaatgcatcggcttgtatagggactgacttcctttttttggacagggtgtttttgatgtcctgtaagagttgcagttcatttagctatatattatgaacaaaagctatatattatgcagttcatttagccagtgctgctttatgcttacctcgatggctagtgtgtttttccggcatatttgttccacggaaagtaacttgtttgtcaatttgttctccatgaactgaatggacctttctaactgttggagcatgtcaacaagtactttgatgtgacctgaatgctacaagaaagaagcagttggttatgacattatgtgtaggaagtaattttttgttgataatgtgcactcaaaaaaactgagctaagaatgtattacctctacggctgcaatttttgctggagatttgattttcgtttcatggtcatcctcacactgatttagctctctgtcatcatctttttccttctcattgtcagtaccgtacggcatgtgatcattagcatatgcaaaagattgttgtgcatctatttcttcgttgtcagaaagtatgggatagtcattttctagttcctcaaaggcagtgtcttcctcaattctctgttcattgatataaaagtcactttctctgtcttcaaagccatgcgtgtcatgctcatacctctgttcatcattcaaaaagtctggatgttctatctgttcaataatctgtataacatatggcagcaattagcatatgatctactactgcaactagtatttctgtatgtgcagtaacttaccaatccccccccttcagctgttctgcagtcatatttgtttctcaacctgacattggctgcattccagaatgaaatcaggggaatctgacgtccattgtaattgatgttgcagaactcagagtttactgccttcacatgttcccaataccaacactgaatgcaatgtaaaaaataagcattttgagtacaataagaaaataaattcagcatgtgataggtttgtatagtacctgcagtaatggaagattgccttcaatattttttagtcctcccttgaattccttcaagcaatcgcagagatgttcccttgttaagcttgcccaattgatagtgtgaatttttgttacatctctcagtaaaggtagatagctggagctgacatgggcctttgtagtaggacaaaggatgtacccaatggtgaaaaacatcatccttctaatgaaatcttcctcgttgatttcagattgtttcgattcttctaaaattgcttcttgcaatgatatgagtgaaatattcttgctctcgccatccttgtgcctagaataaatcttgtaatcctccgtgatcaatggcggcagtttggaaatcaccggtccttcggctggaatatccaatatacactggacatcccaaagtgtgatcggtaaactcttgtcttggatcaatattgtttggcttttgacgtcgtaccgatcagctaaccaaatacaaattacccggttgatgttaatctctggcattgctaacaagcctccaaatccaattttttccatggccgctgtctggagtggattcaaacttctcaccattgttacaaatttatgtggggagctagcaatggtcagttcccttggtttctaagaatgagaaaagtgcatgcaagtaaatcaccgtacaagaagtgaagagcaaaaagtatgttgagaagaagcaaataaattttaaaataacatacataccacggagagaataggtagtttcctaccatgacgccctcttttgccagggttgcggcgacgagcagtggaagtgttgttgtctgccatagaaatgtttagaacagatatgtgcgtaggaaatttgaactgaaactctctacttatatgtgtgtagcaaaaaaacgagttaatgacaccggaataatcttgtattgaacttaagtacaggttttgtgtcgtttgatttttaaatgtacacatctcactgtgcatcggcatatattatacgtcaatccactgtgtcaggtgcatgcagccgtgtagcaatcaatgccattatagtctattctgtttccaaagcgaatatgggctgcttttgttgcatggcctcctcggtacaccacacataaaactgatatacatgcgtgcattccactcggtataataaagcagtcaagaacggcactgcagtcaagtatgaaagcagtcaacaaaactatgcatttacacggtttaagtatgaatgcagttccgtcgaaaaattaacattagggtgtgtaggataattttgatggaaaagttggaagtttaaagaaaatattacatccaatgtaatcacttgttgtacatgagatcactaattttcactaacataatgacaattactacaaacgatcccattaaccacgcacgagtatcgtcgagctcttttttctttttcattaattttttttatacgccaattctagttcagagatatggtcagccgtatctaactctaacttcattttttcttcctcggcctttgtattccgaacgaaacaacaccagtcatattgtttcgaaccggttagcttggtagcacgttccactgcatgccacatctgctcaagtgtcttctgaactcttgggtgccatggttcgtcgacccaaaaaaatttatcgcactgatcctcttcctgaaacgaataacagttcgtaaaaaccaaccgaatgaattttcttttgttttcaaggacttttgagctcacctccagcggacaacctaagaaccttcttcctgtgtcaggtccttcccaagctgtcctccgtttcggcgtgaggccatgcctgcaagttagtctggtgccaagctcctctccacaatactccgaatcttcaatgtacatcgggacatccatgcacagaccatggcgatattcctacaaacacgagatcggtgaagaaaaaaaaattgaaaaatcgttgaaaggtacttgtattttcatttaccttaacagcgccgtccgccattgcagcttcgttgttctgtaccttcttgcttgttaccatggctgttatctgtggagtgaggatgaggttgatggatgcactagtgtgaccagcaactagctacaaccgaagcagcatatatggacgagtactaaatgaggtagttggttggttcgctagtccaaccatcaatacaagaatttactactatccgacctggcattataaaaaaatgaaattataattaacggaattgacaaaaaaatcatataaaatgaaattataattaactagagacgtcgagactaggagcggtggttcggaccatgccgggtgtcctatgcgcaacacatagagactctgcaggtgttttcctaagtctattacttgtcatcggactataaaatcaactgttcagtactggtacacgaaagttacgcgttactatacgtgtcgagatgtacaaaagtgtgtataacatgcccagatgtacaagatttgtgtcacgttactaaattgagacagcagtacttaattcctgcatgcgcacacggttaccaatacgcacttacacagtccaccaaacaattactaatacttatccatccacccactcccctgtgcattaaccatggaaggtgagcagccaactcagttcgtccccttatttcttcaaccattctcctcctactgcttcctctttcttcttcttcttctgctctttcttcttcctttggcactggaggcggccaggctgtcctcggcactgcaggcgctgcggccggttgcacggctgcaggcgagctcgcggtgggacggccagctccgagcagtgcagtgtgccgactagagtcgccgaggtgagctgtggtaagagccgatttcggagacgacaccatatatcaggttctgcttcctcccattatattccatttttgatgcgtatcgtgatgcctatcttgtcacttagagtgaaacacaagtagcaatgggggacggaaatgaggtcattgacatttcatcagatagtgacgatggtgatgcctatcttccgattttatccttttttcgtagcattacacctactaacaagtttggattaaacacgagcagaacaagtacaaattgagataaacaagatttatcaaagcgtgcgccgttcaactattacaacaggtgtttattaattctcattaatttcagttttagctttcaatgattacaaaagtcatatgaacttgtgtatgtgaactctaaaaaacaggacaatatggacctcgtactttctctggattcgacaagtactgctggtatggaaatgatgtcacattaacaaaaagtatgcatcttcaaattgctcacgttgccgcagtaaatttgccgctgtcaagagaacccttatgaccaatgcgaaaatggtatgtaaaatgactttgttgcttcatgtagtttgtactatggctaatcaacttttcttgcagacctttgcagtccagtttagcgagcggtacataaacaagtacattgggagtccaattgatgatctgatggtgtctatggctggaacaacacagtcatatcaaatgaggctgaagaggtccaaggacagtagggcaatgctgaccactggatggaaccaactgattgatgcaaaagcattcgatgagggtgatgtttgtcttttccatttcaaggaggttgacgacgttcttgttctgaaggttcatgttctcaagtagtgtggtggatgaaaatcaccattttgtctggcaatatgtaatgccatccaaattcgtatgatgtaaagctagttaagaccttattatgtggttgacctttccagtacaatcttattatgtgctagttaagacttgattatgtgggtcaactatctgttaatggatgcttgtcaagatggaggaactatctatgtgttgttgtgtcagtcactggatgcttcgatgttattcttcagattactcaattgcgacacttcttcggtatgcactacaattatccaaagtactgagtaacagtagcacatccactaaacctggagacatgatgctatcaatatcagcatccactcgacttgaagccaacatgcaacctttccaagtactgagtaacatcatcagcagtttgactcaattgcaaaacatattaagatgctaatcatccaacccaaatataaaaaagtacttcaggtccattacaattttggaacatgttcaaacaatataaactgtacgcacacaacatcaatatacttcatgttggaccatacaaacatccatgttcaccacagccatcctgtactccaccctctgggacagcaaaatcacacatcttcgttcactttcctgtaaaaaaactgggctgcag

SEQ ID NO: 79097 - DNA, 30394 bp, Oryza sativa
  unsure (1)..(30394): unsure at all n locations
gcaaggggaagctgtcgcacctacttctttgaggagcgctgtgagcaaatcctaccccaacagcaaattctttcaggaggtacaatcttgtactttagggattttgggcacattcctaacagcatttattatccaaaagctcgttatgcatgtataacaacctactaattcggatacaccccctatctactctgcttgttgtctataatgcatgcagtcaatgttctgaatcattgaagtttgaccacaaacatacataaacatttaggcttgtgagatgtaatttcggatactaaatttgctgtcagaattaatttgttcaatatatcttcattgcaggggcaaatgaatgatgcatctgaggttttgggggtgatctttgagtgcttgcataagtcatacacttctcgtgctgactgccaagttaaatctcatgagatcaattatattggttcctgggattgtgcaagtagttcctgcatagcacactgtctttttggaatggatatccttgaacgaatgaactgccagagttgtcggttggagtcaagacgactcaagtacacttcatttttccacaatatcaatgctagttcacttcgaactgcaaaggttagtataccctgggttggatctcatggtatttattgattctattatttcctttcttctgtgattttttggcatgttatttcctttcttcgaactgctatggtttgttagttgttacttgttccatgatgctattttttttttttcaggatatgtttccagatcattcatttgatgatcttttgaagattgtgataatgaatgaccatctagcttgtgatccagaagatggtggttgtggaaaaccaaaccatattcatcacattctttctagcccccctcatgtttttacagttggtaaacttctttatcttcaatatgtatggatatctgcttgcaaccagtcgtttcagtccaggaggaaggagccataacaaatatttaatcttgcattttcgttgtgtgtttgttagcgtaatgctacacaattgcctgctccatttacagtctgacttggccatctttaaccaaacaactgctattccattggcttcctgcctgataacttctacatttgctattgaaaattttctgcatgtgcttgagggcatgtaagttctctgtgtaataatactctttattgacatgactcttcatacttttgctttttcagttttggggtggcagaacaacaaagaaagtgtggatgacatatctggaactttggctggtatttcaactgagatagacatcagtactttctaccgtggtctagaccaaggaagcaaacattctctggtgtcagtggtatgcctatgaggactcattttgttctttcacataatcacatttttgaatggataaaagggcatgccatttttctagggcatttcatgtttgtataagaactttcaaaattgacagtttgctaaatgaatggtacaataggattggatttgccttttgtattaactatagtgaatgtgctattagcctatttcaagttacacagtttgcagtacaatatttctgtcgtgaagtaggtactactggagtttactgctggcactatggctatactgtgggtacattgctaacatttctttttcctattgccattaggtgcattggccagtgggtgtagtagcattagctcaatattgtatatttcactatattacctaaccgcatctaaatccagtcttctaaagtagaaaaacctgtcaattaaataatgcatctagcctactatttttacacatgcaggtctgttactacgggcaacactatcattgctttgcttttgaggatgggcagtgggtcatgtacgatgaccagactgtgaaggtaacaacattataaaccttcagaggcatacaactctgctgattcttactctagcttataagaacttggttctggctcgtgttcttacttgctcccttgtttgtgcaggttgttggtaattgggatgatgtgctcgtaatgtgtaagaaaggtcacttgcaacctcaggtgctcttctttgaagctgcaaagtaattgttccttcagataggcttttccttgtggtgttgtgaagattagaaattgataccaaattcgttttgagctgtgggggataaaggcgtaaagtggtaattcagcagttgcactgatcagttagttttgtcatgccccgtcataaataaacggtcacatgagaatactagaaatagaaaagccagtaatccttttgtttaggttttttggagcttcggtatagttctgatccctgatcctgtcaataagattttggcataggagtgggagggtggccattcgatcgtttgccatctagaggatagagaaaatttcagagattcataagcattgctgaatttattttgaagctgatccgaatgcatcgacgatgtacagagttgtgtttaccatgggaaggctataggggtggtgttcattagtttttggagaagggcgagttgtgatgcaaaactggttgtattcgttggaaaatgttggggaagggatatgtttttgggagcacggtgcttacattgaaatgttacagaatttccataatcctggcaatgttaaaatgaatggtcgccatgttctttaaagcgatgttaaattgcctgagtgtgttactctggctggtctttgcaacagtactcttcgaattccaagctcatacgttcactattttcctcgattatttccatcatgaagatgcatttatttctcaatgggttgtacagacattgcgatttaagtggtaggctaaataaggctttcgctgttatcctatgcattattgcaatctttagagtggccagttttacctggtgcgatctatttttagtcgtccctatactgagttctctctttcccgtcatagtagttcctctaccttgtaaatttgagactggggtttccaatttgtgcgtagcagagcatattgaaatggacaccggggcacagaaggatgttgaaaatgcgagacactgaattgttgcaataaaaatgggttatgcagcgcaataagcttcgggcttgtttagattgatgtccttttaaatcatgttattatttggtaaaattgataattatttggttatacttagtttgttatcaaattttgatgtctattatcaaattttgatgtctacgtaatcttgacaacattatattgagcaaattctactaaaacttagcaatattattcatttgtcaaaattttgacattaccgaattttggaaatgttcattctaacatcaatgtgaacagacccttcgttaaaccttggtaatgttatcaatttgttaaaaatttgacattactaaattttaaaaatattcattttaacatcgatgtgaatagacccttcgttagtagtactcctatacatgaaagttgctaggatggtttggtggacagagcgccgccaggccgctggaggccggggtggacggtcgcggcgccgcgctaattgcggcgaggcagggcggcgccgcacgcggcgcggtgccggtgccggtgccgacgccttcgcgtgcgcggcgcggcggaggcattataatggcctcgtgaccagctttctcgcactcgaaggccttaatttccgggatccaatgggctaaataaaaggcttcgcggcatccaaaatgggctgtattcaattcggcctgatcctaccaaggccattattagttttctggaatgagagaaaaaaaagagagagaatattaaattttgcaattgaattttgtttcactttgcagcaagtttagtattgatttcactttatattacaaagggtatacagaaaatatgtttcactttaaactggtttgtactgtcatataaatgaacaaagtttcgtcaagattttatgaaatttcacaaaatttatatagttttgatgatgtgtgttgttgtaaggtgaaacttatttcgatgcactttaggccctcttcttttctccaacaagagttggatggagattaagattttcgtggcacgcttttcaagctgctaaacggtacgtttcgtgcgaaaacattctatatgaaagctgctctaaaatatcatattaatctattttttaagtttgtaataatttaaacttaatcaattatacgttaatactatatctcgttttgcgtaaaaaaacttaatctttatcttcagaagaaaagaacaccacgccttagtgtaaaatcgtcgtatgtgctaaatctgatgcaaagggacataagatactcgctaagataaaggagaaagtgaaaacctggacatgagcggaagtgaaaagactcatgaaaatgttaccatagcttttttaaaacatttgtatagctttttttttattatttctgaagtctttgtaaatacttttactcctactctacattgaaattggcactatcttgtgtcagattgttaaagaaaaaggagctctttacatggtgcaaaacgcaattaacattgaaataaaaaaaatccttgattctactccgtacgtagtccatatattttctttcagccttcttgaggttatcggcttactgcacgggcatttcgtagcatgagccgtcaaggttgagagaacttgttggtcaactaaaagcacgcacaggaactgagcattagggcatgtgcacatttctgcagtggccgaacgtgatggtggtgccagatagactgccactgccagccagctgctagatctcgtttctgaacccattatataacaataatactattaaattcctaccaaataaaaaatcatactacctccatattagaatataaaaagttttagagttagacacggttattacagaaatagataaaatttaatggagagatgttgtaattggttgaaaagtggagatagatgagaaaagtaaatggtagtggggttgtgattggttgaagagaatgttggtaaaaaagtaattatattttgggacaaatcatatatgctataaattattatattttaggacggagggagtactacaaaactaagcgccattttcacacacgccattgcgaagggagcataactcaactgattagttacttctggtggaaccaatccgtctaggtataaatcctagggcctgttcactttgatgtcattttcaaccttaccaaattttagtaaagttgcaaaaaaaaaggctacatttagttcgctgccaaattttggtaactatataagaaatcatgctaaaattttggcaagttgccaaaaaagtggcaagttttttttggcatcatagtgaacatgcccctagattttacacgggtgctaatatttacgactaattattatttcagtggtaggcgatgtacccgttggcagcgagacgtttgtagtaactttgtcaatctcaagatatatcgacccagtctttcggaagtgcttatagagataaggtgtacgtgtgtatccataagagtgagtatgtgcgcgttatgtacgcttgcatttatattgtgtttctataaaaataaaaacttatgcaagcccagataggcagtacagcgtagcaatactagcagtactactccactatatacttagtactactactactgtaatgaaaccattaagcaccaactaataaaatacaagacagatttagtgagcacatatactaatactaaaatacgtctcgagatccagatccgtacagcgtgcctcgctatctcgcattaacattgcaaccggtcgaaggtatggctatcgatgtctctctcctgtatgcacgtacccccttcttccttgaagcacaaacaaaacaagatctccaatgaaaacttggtaattccttgcttccttcctccgctccccgtcgccgcgtgcgcgcaccgacgcagccgcaaccgccactccactccgccatgcgcgcgacgcctaagagcaggtacaatagcaggctattagctagctataaacatattttaatgagataaaatatgagagagaagagcagcaggctataaatctgtagacagctgcagcgcggactccaaaacataatgtgtatatgataggtgagaccatatattaatagtatagtaagcaaatattatatgaattgactattagattagctatagatgaattagagctagtactgtgagtagggcctcgtctcggtgcaagcccactactggctccagaattcgcagcgattagcgcctggatttctcggttgcagctggctcgccgtgcgtgacacccgatttttgcatcggtgactcggttgcgtcggtgcgaccatttcttaggtttattggataaatggatgtgccgtaatttctctgtacgtgctgagaggagctagttgcacgttgtacgtggccgtatcattcaattttaaccacttgttttccaaccaatcgagtggcatgaaggaagttaacagaactggtttatccgattggctctgaactttgaatacgccttttcattaattttctgcagtttattttgtatggaatgataatgtataataataagtagagtaggattgaagggaactccgttttccattggtgctcatgacggtgttccatacatgtcgtacttgatcgcatacgcggaaaaacaaacaaactactacaaaaaccgttccgtcctacgtacatgcgtggcattcgcctttgcacttttgatgattgcacgtactagtatgtagtacatcagtaggattcaaagccaaaaaagaagaaaaagttaactcctgagccctgatgcagtgtcgtgcctcgcgtcgctaggcagccaaaatctgcaaagacctaaagaaaaagaggttggcgccgacgacgacgagcacgcgagatcgatcgatccgtccacattctcgctggggatttctcagtgacaccatcagtacgcgccacgcatgtgattgtgaatgtgtgtactagtccaacgtccactgtctctcttccaaagtccaaatgcactgggccatcgtacaattgcaaagcaaaaccggcgactcagattttgaccatatgctggctgctgctgctcgcgttacatgtgaaccagcatatatatacacatctcgctagctggtaaacaatgcatcagcagtagaaaatgcaggatgctagtagcaactactacggaccactagtctagtacaagagtgttgtgttgtccccagctaggcagccaggaggcgagacggggcctcgtctgctgctcgatctgccacgcagcatgtggcgatcgatcgatttatcgatcaaaagcctcgccccctgcagcgtgcgaggaacacggatgtggctgccgctgctgctgcagacgcgacccccccttttcccgtcctatttaccctctcgctcgattcgattcacggacggtgagtaaaatcgggaacggtgagattttggacggaacgaactgttcgatccagacatccggtaacggacacacggtaataaagttgtggaagagtttggtgatggtgagtgagatcatcctttcggtttcagtttcaggccttcagagtttacaatgctgtcacgtgtaccgtgcaacaacgcagggatggaaacggtcagtctattacagaaaaaagacggtaacatacaacttcgatttattaaatttatttctcataaaattaacaagttaacttaaaagaatttatcacacgaatagtcatagtcattttgtttgtagtaactataagaataatagaaaattaattcatcatatttatcgatttaactatttagtactaccgaacaatacgatgatgaaaggaatcagaaaaaaaagtgttatgtatggccagaataaaattttttatctaaaacagtatcactcacaaaacgaggcttgaaattgtgctcattttcgtgatcatttttatccctcgtgcttacgagcgagcggattatcctgaagcacaagccttgatagttgatacggtccagataagagcgtttcggttgaaaatcagccggccggtcgcgtcgtcgttccatggctagtagcctaatactccctccgtttcaaaatgtttaacaccgttaactttttagcacgtgtttgactgttcgtcttattcaaaaaatttgtgaaatatgtaaaactatatgtgtacatgaaaatatatttaacgatgaatcaaatgatatgaaaagaataaataattacttaaatttttttgaataagacgaatgatcaaacacgtgctaaaaagtcaacggtgtcaaatatattaaaacggagggagtagtacgtactaatgtactagtagctgtaggctgtgtttagattcaaacttccaactttttccatcacatcaagatgtcatacacacacaacttttcagtcacatcgtaccaattttaactcaaaatttcaactttgaaagtaactaaacacagccgtatacgtgtactacttacaaaacaacacgacgtatccgttgcaggctcatgtcgtagacgcaccgtctaacgtctcgtctccgagagggatcaacgctccaaacgcaagcgtccacgggtgaaatttttggtgtttttcgcctacctcatagtagtaggtacgtctcgtatttggcagattgtgctgcattgcaatgcaggtgatgggcccatgcgtcgtaatctgcatgcacgcgccgtatacgcggaggggacaaacggcgcgtacacgacgcaccggtacacgtacgggcgctgcacagcgtttcacgggccttttcttttgcttcgcttttggccttgggagcattcaggaatcaggattcatcagcagctgaagatatgaagaaatcgtacgtgcagctgtgcgatgagagaactgcaaatgcggtgcagtgttgggttggtttggtttggttggtccctctcctccactataatccactcgcctactggtactggtattacctctttttcggcgatgaaatcgcctggctttatgtaaaggcaagtgttcccccccctgctgcttactggctttattagagtaggtacaatagcggcagcacggactctaagacataatatgtgtatgataggtgaaaccatatattaatagtatagtaaacaactattatatgaattagctattagattggctataaatgaattgaagctagtagtgggctatacgcttagttggtggttaaacatacatggttcgtcactgatgatggctcatttagtcgttgtgttttttttttgacattggagtaaccactgacgcgttgtaacattggcctgatggatatcgtgatatttaagtgttcatacaatcatactaccaatctatcatgcaagttctactggcattcagttggcatttttcgttcattgtaaaagctagtaggtacggagtatcatgcataatataactgctcctccgtttcaaaatatttgacactgttgattttttagaacatgtttgaccattcgtcttattcaaatttttttttatgaaatatgtaaaactatatgtgtacatgaaagtatatttaacaatgaatcaaatgatatgaaaagaataaataattacttaatttttttaaaaaaaacgaattgttaaacacgtgctaaaaagtcaacggtgtcaaacattttgaaacggagggagtatattataggccgattgggaacaagatcaagtgctcaaccgcatttctgagccatatgccgactgaattgaatggggctccaactaacctattgcgtataggccagccacggttactgcatagaaattgcgatggaccttcaattccatctaatagatgaatcgtgtactacttacgcaccgaacaactcatggtggccttcccccatgccctttgtcccggtggcctcaccgtacctatgaaagatacctttcatttcgttttcattttaccactactcctaccttgtactaggagtaactaacttgtcagccttcccgatgtagagtgcccatttcctgaatatggcatttgctgatgaagtgatgacactggctagtggagtggcatgtgctgcgtgtgtgtgtgaactgtttagctgaaggccaagacatcaatcttgcatagcattaaacctgacagagattggtatccatgttgtttgtgatgatttggatcagccatttttataagaaaacaaaagctgttttgattgacaaagagcaccactaatccaccactatagcaagcttagcagatcatactacttgtgcatttccgtgtttgcccccctggttgtgtcatcgcggtttgcaaacacctgcacatcactacgccgacagcttaaaattagacaggtgtacgactaaaaagggcttaaatctactactgtttacataaggacatctctgctcgatcagctatgtactactggcagcattcagctacctccatctgattactccatgctctcaaatcgtaacctccaacagattataggactcaaacagctcagtgactacagatgattcgaccgaagtcgcatacaaatgggtgtgagattgtgagagaatggtcaaatttacttggtatacgagtaaaataatctgaactccgaagcatgttttgaggagggaagaagtgagattagcaccgagaagagtgagcttttgcagagcaaggagtagtaggtaggacaagtggtgacggggagatgagcccactgtctcagagctcacatctcacaggctcacagggtcgcagtgatgagctgccatctttgtactgttccagtgtttctactcctcttgcccccacacgggcacactctttttcaactcctctctttctctctctacgagcaactactacggggttgagagagagagagagagagagagagagagagagagagaatggccattataatagagccataggccaaaagctcaactgcactgagagcagcatcagcagcagttcactgtcactcttcccaagaacgggtgccaaggaatcctagaatccaagaaaggcagcagctgctgcagcaagaacagcacagggggagaggtggtggtggtggtggtggggaagaagaccacacacattcggctgggtggtggtcttcttcttctgctgctgctgccgctgttgccgcttgttggagtgaggagagtgggtgagtgatggggagggggtgcctggctgcgctgctcggcggcgcggtggcggtggccgtgctggtcgccgtcgtccactgcgcggtgacgtacgacaagaaggcggtgctcgtcgacggccagaggaggattctcttctccggatccatacattacccgaggagcacacccgaagtatgtagtagtagtaacagcattcttcaagaatgtgtggttttttttgggacatttcgtggaggggagtttctttttgggggttgttcgtggcgtgggctggcggtttcttggtggaaatgccatggaaagcgaggagctttgttctagctttgttggaggtttttcctttcggcatcagattattcgccaaccatttttttttctgaacgaaatgagggggttcttgaggtttttcttgaaaatgctgctcttttggtctgctcctgcaaccattttgggatttttgttgctctgcaatggtgatatgttcatgttccaagctataattttttgggggtaaaaagagatgagcttgtttggtctcgaatcttttggtgctgtactgatttttcttcgtgtaaatatttgtcagatgtgggacgggctaattgagaaggctaaagatggaggcttggatgtgatccagacctatgtcttttggaatgggcatgaaccaactcctggaaatgtactgtctctttcattattaaccccattttttaacagtgtaatggcacatcagggatttcaatggtttttgctggcttcgtgcagtacaattttgaagggaggtacgatctggtcaggttcatcaagactgtccagaaggctggcatgtttgttcatctccgcatcggtccctacatttgtggagagtggaattttgggtattcctcaagccttaatttgaccgtagtaaaaacacacaaatgttcttttttttcaccattttctgttccttgtatgtccatattttactttcgtttcatgacttctgttgccatgtaaatttgcagtggatttccagtttggttgaagtatgtaccaggcatcagcttcaggacggacaatgaacctttcaaggtttgtggaagtatttcagcatttctggatcttaccagaggtgtaaatcttgttcatatgtgtttctgacttgagttttgctttgcagaatgcaatgcaggggttcacagagaaaattgtgggcatgatgaagagtgaaaacctctttgcttcacaaggcggtcctattatcctctctcaggcaagtgcaaaactttgcttcccatgtcatgtatattttttttagagagagggcctcaaccatgtcatgtatatggatgcaagcacattgtataacattgggttagtacgtagtagtggttgagtaatgtgttgtttgcacgattcatcttagcctgcacattttcctgggttgctcatggtgcggtgggtgttattgtttggacacagattgagaacgagtatgggccagaaggtaaagagtttggggctgccggcaaggcatatatcaactgggcggcaaagatggccgtgggattggacaccggtgtgccgtgggtgatgtgcaaggaggatgacgcacctgacccagtggtatgatgatcttatcctctgtcaaatactaccaccatcaggtgtaaattgtgaaactataccgaacatgttaatacaattatacaacgatacaggacatgctgattcgtatttttgcgagttcagtgggttatctccataagaggtcatgattggtgttctaggtttctagcatatgtatgagcatatttgtcgcctactcatatatcaaacatatattagaagaagaaaaattgacgccaaccacattgattttgatcttgtgaaatttcagtcgtggaatatacaaatatctcatgacttctgtacgaacaaattattgaaattacatttaacctctgttctttaaacagatcaatgcatgcaatggtttctattgtgacacattttctcctaacaagccttacaagcctacgatgtggactgaagcttggagtggatggtaattttttttccccgaggaaccaatatctagtgttgcaagcacaatcccagtacttccattgatgtggttcatgtttatataatttgattctgttgattcatagtggtagtataattgctccaatatgcaaaataattcaggtttactgaattcggaggaaccatccgtcaacgaccagttgaagatctcgcatttggtgttgctcgcttcgtacagaagggtggttcttttatcaactactacatggtatgacagatagaggctcacttatgttttctttaagcttcctaaagggtgatactcattcttgttggttaattgattttccctcaactgtaaaagtatcatggaggaacgaattttggtcgcacggctggaggtccctttatcaccacgagctatgattatgatgctccacttgatgaatatggtgagttacaaggaatatgcttagagacgttttctgtattgagcatgatttataagtgcccttatcaatattatcatcttctgctgctgttatttctctacactatgagcatatttgcagcttttcaagcattaagagtggatcttttttaaaaaaataaaattcagctacaccactatattcttcttactcaatccttttcttgtggggctaatacacaggacttgcaagggaaccaaagtttgggcaccttaaagaactccatagagctgttaagttatgtgagcagcctttggtttctgccgatccaactgtgactacccttggaagtatgcaagaggtctgttgtgattaccctttcctctcagtgaagtatatatatcttaaccagcttgatgtttcatttacatattgaatttatacttcaggcccatgtgttccgatcttcctctggctgtgcagctttccttgcaaactacaattctaactcgtatgccaaagttatcttcaacaatgaaaattacagccttccaccttggtcaatcagcatccttcctgattgcaaaaatgttgtttttaacactgcaacagtaagtttggcatatgcttatcccattatagcatggtttcaattctgtatcccttttacctggatcaagtatatgatgactttgcttacctgattcaaactgttgtaatctccacaggttggtgttcagacaaatcaaatgcaaatgtgggcagacggggcttcttcaatgatgtgggagaagtatgatgaggaggttgattcattggcagctgctccattgctcacgtcaactggtctacttgagcagcttaatgtcacaagagacaccagtgattacctctggtacattacgaggtaatgccagtcgataagttgcactttgcacgtaaaaattgcaatgtacataacgatgaatctgggaaatggtgactattagaaccccttgttcgctgaactttgcattgattttctgattatggcaattgagaaggtgtcctttgttctaaattttagttttcacagaagtaacgattttctaaaattatttcatcaccattgacagtgtggaggtagacccatctgagaagtttctacaaggtggcacgcctctgtcactcactgtgcagtctgctggccatgcgctgcatgtcttcatcaatgggcaactccaaggtttctacttgaaaatgctccccagtctatagagtattaatgtagtaaaaacttagtgaacaaaataacccgcaaaagaagtaatgaataaaatgattataattcccttttgtaggttctgcctatggaaccagggaagatcggaaaatctcatatagtggcaatgctaaccttcgtgctggtacaaacaaagttgcactgttgagtgttgcttgtggactgccggttcgtgctctcatctctgcatgaatttgtacatgtttacagcaaatgatcaattgtatgagttggatttttcttgtcctgctatatagaatgtcggagtgcattatgagacgtggaacactggtgttgttggtcctgttgtgattcacgggttggacgaaggttcaagagatctgacttggcagacttggtcctatcaggtatattcagcatactggtagcctggtgcgagttaacgtaagaatgaataaacatgtgacttcttccattccaggttggcctgaaaggtgaacagatgaatctaaactccttagaaggctcaggctcagttgaatggatgcaaggatcattggtagcacaaaaccaacaaccgttggcatggtatagggtatggacaattaaccttgccataatcatttgatgattacttgcctcccattcttacgatagtttgtttttgtaggcatactttgatactcccagtggtgacgagccactggctctggatatgggcagcatgggtaagggtcaaatatggataaatgggcaaagcattggacggtactggacagcatatgcggaaggtgactgcaaaggttgccattacactgggtcatacagggcacccaagtgtcaggcaggttgtggtcagcctacacagcgctggtaagaacattcacaacaatatttgaattttctggcacctcttgccttctcttttgctgtacacaaaaccatcatgtactacttgatatttggttccttttcccttgtccattaaaactggagtgctccatcacatccctttttggttctattgtctagtcagtggagtactatattaacaataaaaattgaactcttgcattcaggtatcatgtgccaagatcctggttgcaaccaactagaaatctgctagtggtttttgaggaacttggcggtgattcttcaaagattgcccttgcgaagcggacagtctcaggtgtctgtgctgatgtatctgaatatcatccaaatatcaagaactggcagatcgagagctatggggaaccagagttccacacggcaaaggtgcatttaaaatgtgcacctgggcagaccatttctgcaatcaaatttgctagctttgggacacctcttggaacttgcggaacattccagcaaggggagtgccattcaattaactcaaactctgttcttgaaaaggtgagaacgctgtttggtcattttggtctacctgaaatttttttcttaaaataatgtggactacctgcacctggacagaaagacccttcgcagcaaattaaccctgttcaaaccacttgaattttttatcattttgcaaagaaactataatcactgcaattagtccatgaacttaccacacatatcactgattttttctggtgcttatttgaatagaaatgcattggactacaaagatgtgtcgtcgcaatctctcccagcaactttggtggagatccctgcccggaggtgatgaaaagggtggcggttgaggcggtatgctctaccgctgcatagggcaatttctttgccgagacgaatttagagatggcaccaaacaggtgggcttgtgcttgatcaaagcacacagaaagcgatgcagagtagagttcaactgtaaagtatcgacgccacatagctgtggctggaggattagagatcgattctagcattcactcagtcgaatttcagattagaggattctaactctactgcatctccatgaattgttcagagtgaccaactgctaattgaagttggtcctgggatggagtgcagggagagtaaaggcaaaagattggtgcattcttttgctcgcgttagtgtgcgtgttgtgttgtttcatctttcttgaaaggaagaaagatgccgatgaattgtgcatgtatcccatatgaggaatcgttgattgtgcagtgagcatgatatgctgcagaacaattgctcgtgtcatattctgaagttcagaaaagaggttgtcaatttatcttcttcagataaaccatataattcttgtgatgaggcctgagggagatttatgccacagacatatgccgcactagaaaacaatttaatcgttttaaggtaggaaagataccattgttgttttttcctccccaaagtattttttgtctgaaagtatgaaatgtggatgatgtattcagatagcatagggtaccttgtcaccaactgagctcaataattgaacttgcatttctggcaatgaaaatgggggagttttccctttcacaacagtaaaaaaaacggagaacaattgagctcaatctggccggcagcgtgctaggcatgatgcttgcggctcaatgactgacaaaacattatcctgaatgaaattgtggaccttgccccttccggaactgatgaccacatgaattattaacagttgagaacataggggcatgaatgcagcaatagctcccaacagtaatgaaacaagtagtaataattttgcatctcatatatgggacaccccccggtgcacattcagaaacgaacaaatgattgtgctaaagaaatactgccacagccaaaccgacattcacgcggccaaaaaaaagagagaagaagatgcagagtaaccacaagacattcattcagctctgaacaacaatatattagtgctaaaatggaagagcaaacaaatgcagcgtaaacaacaatcagcaagcaactgtctctctctgattaactgatctgataaaggtctagaaccataaactaggggtttagaaaacgtatcctgtcagtcagaaaagcagatgtcgcgcgtcccgttgcgcgcagcaaatctgcagcgcaggggcaatccaataataaaaggagcttcctttttgacgatgtgctccccctacccttcgacctcgcctgtcggctgactgggatgcggctaccgacgcccgcccgatctcctgaatgttttttcgaggttatttcgtcatgaatttgctctccaatctgagtgatatggtatccaaaatcagtgcagaatggcatggcaaatccacggcttcgacgacgccagcgaatgttgcatgttattgatgcataagggcattagggcagcacatttggcatctggaactggtcgaccgagctagattgaaatgtcgttgtttgtgcagtgagcatagcatcggttcgttggattgcatactgcaagtctgcgatgacggtgcatttcaacggccaatgtcagctgcgataggattcaacggctgcttgcatccatctcagatggtttcgatagagaagcactgtatcgtctcgaatttgagtgatggtacccaaaaaaacgatgaagaaaatcttatgtggtaatctttgttgctgctctacctccatgttgccacgacaagtcgaaaacaagcgagaaaacaagggggacggagaattgaactccgaccccctaccgtcgcgaatcatgtgctgcctttcctttcgtcttcgcgcgtctgttttgggccgtttcacggacaacggcatgtcaaatccacggcctttctcgtgctcgtgccaaggcctccaggcgttacacgctcgtcatcggcccaagcagcaagccaccggcccaccgctcctctttccctacttcgccgagcccaagcgccgccgtcttcgacgacgccaacaaacgccgcagaaaacgagatttggggcctgttcactttgttgcaaaaaaaaaaaaaaccttaccaaattttaacaatgtcaaaattttgacaggatttcttatatagttatcaaaatttaacagcaaactaaatgtagctacttttttgataactttaccaaaatttggtaaggttgaaaatgacatcaaaatgaaaagggccttgaagtgagagatgtacctccaaacaatttttaatagaaaattgtgagtgtgtttaggattgatcacgggatcttggagttgaaagatcatgggcagcacagcacagtatcggttcattggattgcacactgcaaacctgtgatgagtgcgcatcatcaatggccaatgaccaggatgactggtgtagtagtaccacgtcttgcatctcagatatgtctgatgtctctaattcgctcgaaacaaatgtagaaatcttaggtgcacaatggtgatgattcctgttgcagctagccagcgatcttaccgttgccttgaaaaataacgataatattgagaaaacagggggttcggagaactaaactccgaacaccacccgcgccgtgtatttgggccgtctcacgaagatgtcattgcaaaatggaataagttcacttttactcctttaaaagttgtcttaatctaatccatgatcctaactgtaaaaccggatatctccacccccgaactactgaaaccggtgcaatttaactcccttggtggttttaaatggcggtttcgctgatgtggcgtctatgtgatagtgttgacctagtctgtggcattgacgtggagtttaggtggcattagagttaaaaacatatatgtgggacccatttatcattcacacaaacaaaattatagggcccactgacatgtggaccctacatgtcatcctctctctcttcttcctccctctctttcccttctctctctccacttcggccttctgcaagaggcgatggcggcagcggcagcgacggcggcggtggcgcgagggtaggcgctggaggcactggagcggtggcggcgacggacggggaccggagtggcggcggcgcttcgggctagagttggcgtggatggaggcggaggcggcgacagaggagatggcaggcggtcgagggccggagcgacggcgggtcggcggagagcctggcggccggtggtggctagcggggagagagctagtggcgaaggccgcccccatcttcctccctcctcgccgggctccgcacgcacctgccccgatcggtggagcggattacgcggttgggtccgtaccacgggctgccaaaggcggacggcttgggcttcgcggcggacttacggatggtgatgcgggcctcgccgaagagggatgtggacgccgcgcgaccattactgcggaggagagcgccgtggcgagtgagtgagcatctgagttgctccacggctctggggtctacgccggcggctgtggtggcacggcggcgggtggccatggcgagttgttcgggccttgcctgcctgccgccgctcccgcccgccgatgcacggctttccgtcggggcccagctcccttgacccttgatgccgtcgcctgttgccgcccgccgctgtgcgcccttcgttgccatcgagccgctaccctcgtttctgtcggatgaaggtgaatagaaaggggagaagaagagagagataagggagagggagggaggaggtggggctcacaatattgtttgtgtcaatgacaactgggtcccgcatatatttttaaattctaataccatataagcaccacttcaacaccacgtcggacgaaaactaagtcaacactgtcacgtagtcgccacgtcagcgaaaccaccctccaaaatcacccggagagtcaaattgcaccggttttaacactttagggtcaagatttttggttttgtgattcaggatcacggattagattttagttacttttaaggaaatccaagtgaacttctccttgcaaaatccacggccttccgctcggtcgggtccatgcgcacacccgcgcgtcgtcgtcggcccaaccaaacaccccaaaaaaccaccgaaatctcacgaggcggcaacgcatcaaccccagtgcccgtgtgcggccgtgccccgcgcccgcgcggctgtgccgtggcgggctcgcggcacggcacggtgacgcgcgaccgtacgtgcagccactcgctcgacacggctgcctgcctgcccacctccaagtacatttaacgtcacctccatcctcacacatggactgtcctcccacctgtctcccgccatcgtctcgccgccgcttctccctctccctctctctctactcatcatgtgtgcggatgcgtcgcccatgcatccatcgccaaaattattggtcacctgatgaccgattctctcctgtgatttcagtgcagtttcagcgagatcgatctacctttccgggacgcctccatgcctgtggcttggttgacgatcaaagcgtgtgcgtgccgacgctttatggaaagtacgagatcttgatagcaaagcgcagagagagaaaaaagttgggaaaaaaaagggggaagaggacgatgctggatgacggaataaagatgcaattctcgattagattagatggatagagtgatagatagatagatagattgatagatactattgttttttgtctctctctcggacactcttggcctacctacctcctgttcatcatcagtcgggagaggcaaaagctacgaaagccatctgtccccagctaagctctgcttttgcaaactgcaattgcaatcgcagtgtagtgtggagtgtgtgctctgcctgtcttgtagccataggcacacaagaatgtggttgttgatctggatcgcaaggcctgatcgtatcggagtaacggaatgtgacatcaaaaggcgacgacgcatagaaaaatatctcgccgtctgattttttttttactttacctttgcatcttctcttctctgtcccatcctgctcatatttcaccacctcgtgcagactggaactgaattctgtatagatcctgcatgataaagagttcagtttgtatatgctgctcatgaactaagccgtacctgtacgtacgcaaccggatcaatcatagaatttaagttccaagtgatcacaatatcagttgctacctcgggatgcagtcttgcaggctccattggtactttatgctactatatagatagatgcctagatggtcaatgtttatctgccaattctaccaccatctgaatgtatatatatacaatcagccagaataaatagttgtggcacatgaacaaacaatcattggcaactgatgtgaacgatgatgatccacagatcgaacagctgctggaacccggttggctatctccactagtagcaacttccacaaggctgcttcggcgaaaaagaaaagaagaagtcagaaaaagacgacaagagaaacaacccaactgcaaggtgatgaccatctagacagacagggttaggtagtgcgcttgctcagcagctaaaatgttaatggcatcatcacccgtgcgcgtttcacgtgacttgacatggaaaattcttctttatcccccgttcggtagagaaccattttctgaacgcatttcctttttgttcttgtcctcatttaaagattacaacgtgcagtttttaatttcaatatcaattaaattgttaataagaggtgcatatgctccttgttaatcccaatccgtccttaacaatgttgatctgggttagttgcatcgtgattacctccgtaattttcctaaaattattggaccttttgtctgaactcagctgtcgttcatctagcgtgaaactgccacttgttcgtcaggtagctcctctcttctcttcttcctatcctatctttccgtttgattttgacagccttgtgttcgcatgcagcgatgattggccacattcagactcttgccaattgtcctgaacagcgttctcttctatggactggtcttgaacagtctctgaaagtagcagaagtttattctctattatcctacagtatctcagatgaaaaataatcattagaaacttctgttggttataggacaccacaccgttctaacagtgtagcagaagagattggcgaatcatgtatcgacacggcgaattaagatagtcccaatcacctaattccagtgacgatccaacagaattgaggtcagcttgataaagaaaagtaaagtggacaaggtgagtgtaatcacagaaacgtaagtacatgaggaccctgatgcaattgcgttgggtggcacaggccgatcgatctgaatgagtctgaaacttcttcggtcctttttcttttgagggaaacaggagaggagacccctcttcgtttcaggaaccgacatgctagtatctgttagtagctggggtgatccaacctgatgggatgtctataactaaatgtgatatgacctgtgtttcttgaaaagtaaggattgtgaactacacatttctgattgttatgggcctgtccctctaaaatggagtactactctctgtcttgaatatagtcgcaaatgaataatatgtgtatcttctcctctttgtaactgtaaggttgtgggttcgcgaaaaagaagtgaggttgtaaatttcaaactagaattgtaaatgtggaattaaattcgcccaaatctatgaagatccctgtcatggcattattgaatagatttgtagtccattgaagactaattcgtttccttgtacagtaacgagacttctaggtaacacaatcagatactgtgtaaaaaaaataaatgagatgtgacctgtgtttcttgatagtaaagacatgctaatgacattctcaacgatttcctaatagcttgaacaaaacaaacctcatgatgaaactgaaattactaaattatttataatttttctgagaatcatatgccttagaatacattccatgaaaattgtgaacagtcacagagacaacaatacgcattccttgtccgactgcatgactctaccctattatggttcaaatcccaatgtctacaaatatggttttgtgcatccttattcggtatagaggctagaaataatcctctttttctttaaaaaaaatgcgttggttgtcaattatactcagctataataatcgcattttttcgccgaatctcgtctcttcgaagttggcccacatgtcagcgagaggcacctgcaaagcaaaggcaaggagttgggaggtcaaattcattattggaggggaccatgaagacacttgtccttgcacatcactacctcatgcccaatttctaaagcaagtgtgtgccaccaaactgaaataaagttgagcattagttttgtggccttgggggcctcctgttgcacttttaactagaaatgaaaagaaatgagagattttgggcaatgcaaatgtatatatgcagtacatttttttgcacttcgtcctgtgagatgtctgcatcctccccctatgcaaattgctaaggagcatctcatgatcagttggagagattggaaggttcagaagggaaaagagggtttaggtctaccaactggttgttagcagactaatacgtcttaacagatgccgtcacctactccgagtgatcggcctcctagcaatcaagaaccacctaaatatggcaagctgggttagaattcaggtaaaaacacaccaagcaagtgataactgaattgcacctactctatttgaatgcacagagtgaactaactgaactgctcaacaagtactgtttgctgtaagcgcaaactcaagaagagtaaaaactgagagtttttagactgactcctttttgtgctactgtcagtggatgaactgagttaattcattggaaaaatcattactacttgattgttcagtcaaaaaaattgaaagtgaaagaatccactagaatttgcggctagctccatgtacagactacaaaccaaattgcaagttcagattgagcgttggatgatccagggatactgcaatagttgcattcagtcaatctcgtccgttcaatttcctgctgcatgttcgactgctacagccgatgaaaattccagtgaatccacgagttgaaacctaagtgagaaaatgagggagcggggaaagagatagagaagaataatcgaaaggaaacagacaaaatggtggtggggtttctttaggatttgtagggagatagtgttaggcagcgccttattggtggcagccgtatattattgctcaaggaaagagtgaggagttagaacaactctagtgtagcctacagagtgaaaccaaaagagagaaggaaaaaaaataacaaaaaggagtagatgcagttttagttcttattattctaatcttctctcttgttgcaatttctttttagaatccttgggatcatctctgtccccgttctgggtggtttctgtcatactccaggaactgtcttgttctagctctttgcttggtctgaaagtcgatttctgcacaggtatatagccttatcctatcaggtttaacgttgttctttggttgcatcagtttgtctttgagtttgatctgagaaaaccaaaaggaattatctttttgggcttgattggtgttcatatgaattcttggtattgtcttctgccttcttgcttgttgaactttccgtttcttgttagctcctttgtggttggttggtgtgccaactgaaaagattgcttcttgttacgtagattattgttgagattgttttctgaatttctcaagcagcggtgagtttttgttgaaattgagctgaatttctctgaaaccaactatttctggatgcattcgtttttgtagcttgctgagaaattcagactcctttttttccttttcatgatttcacaagtactggtttgaactgctattttgttcgcattagatgctgaatttatcaaattgcaggtactgcgaaagctttgggaatagtattgcagaaagcgcagcaatctgaagcttactgtccaaggtagacagctgacataagcagtttagcacttgagctatgttggattcacttcctcgtcttcctgacatattccagtttttcctctcttctttcaagaatcggaattacttcagttgtactaggaattctgaacttcgtttgtagttgctgtctgaatttgtggctactgtttactactggactcatcgtcacgtctctgacaaaactcagtacaccatgttgatgcacgagatgtttttgctcctattaaatcttctgtggttttttctctgaaacgtctgactcaagtatgaatgttactagaaagcaacaacctaaaatcagattgcagcaatccagcagtctgaatttactacctgaaatcatctcaaagacgaattggtactactagttttgaatcctcactcgttttttttgttctcttttgcagccagtttgcagctgaagccaaagactgaatctttcatcagggtttgataatatcaaatacccttgtgatgacagagttaatcagtttgtctcgtcatctacgtgatgattcttcttcagtctgtctcttcttctgcttctgaagacgatggccacattcttctcctcttccaccaatcagagagacctcaccggcggcggcggcgacggaggcgacatgtcgttccagcactacccaccgccgtctaacccttactcggactcgtcggccggcggcctgatcccgctcccggcgagcatcgtgtcgcatagccacattgcgcacggcggcggcgacgagccggcggcgttcagggaagcggcgacggcggacggcggcgagatgggcctgcagacgcagctgctcatggcgcacggcgcggcggcgcggggacaccagggcgggctatcgcttagcctcggcacgcaggtgccggtgtctctctaccagtacaggccggcgggcatggcggccgcctcgctgctcagcccgagccagtcgtcgccgatggcggggaggagcgcgcagaacagcatctacgtgcagaactcgaggtttctcagggcggcgcgcgagctgctcgacgaggttgtcaatgtccgcgacgcgatcaagcggaagggtgacaagaaccagggcaaggattccggcgagtgcaagggcggtgacgccgccggcgacgacaaggccggctcgaacccgcaggagcaggagagcaattcagcccccgagctctcgccgtcggagaggcaggatctccagaacaaggtcaccgcgctcatggccatgctcgatcaggtaatgcctcgatctccatgactccatgtcacttccgaacaagaagaacgtgctcgtcaatggaggttttgttgcgttgtggcgcgcgcggcaggttgatcggaggtacaggcacnnnnnnnnnnnnnnnnnnnnnnnnnngtcgtcgttcgacgcggtggccggcggcggcgcggcgaggccgtacacggcgctggcgctgcagacgatctcccgccacttccggtcgctgcgggacgcgatcggcgcgcaggcgcaggcggcgcggcggggcctcggcgagcaggacgcgtcggcgcagggcggcggcggcctctcccggctgcgctacatcgaccagcagctgcggcagcagcgcgccatgcagcagttcggcatgatgcagcagccgcagcacgcgtggcgcccccagcgcggcctcccggagtccgccgtctccgtcctccgcgcctggctcttcgagcacttcctccacccgtaagaaccacctccgccgtcatccatgtcgatcgatcgatctcaatctaatcctcaccaatggcgccatgaatatccataggtatccgaaagattccgagaagctgatgcttgcgaggcagacgggattgtccagggggcaggtgagattgagctccatgaactcgacgctctcatgcaaagctgatggattcaaatcaagaagagaattccatggttttttttttctttttttacgtaggtatcgaactggttcatcaacgcgcgcgtgcggctgtggaagccaatgatcgaggagatgtacaaggaggagttcggcgcggagatggactccaactcgtcgtcggagaacggcggcggcggcggcggcaagggcaaggacgaggcgatctcgtcggaggaccgcgacgagttccagagcccgtcgagcgccgccgcggcgaggcacgccggcgtcgcgggccagctcaacaacccgttcaagtcggaggcgatgggcggcgccgccctggacgtcggcgtcggcgtcgtcggcctgtccagctgcctcggcggcgccatgggcacgtacgccaccggcctcaacctgaaccaccacgtgcaccaccccggcgccggcggcaccagcctactgcacgacgcgctgcaccaccaccaccacggcggcggcggcgacgccaggttcgtctcctacggcgacatggccgacctcggcggcggcggcggctacgacggcggcagcgtgtcgctgacgctgggcctgcagcactgcaacaacgccggccccgtcccggccgagcagcagggcctgctctacggcagcgccggcgacttcgactacatcaacggctccgacgaccggcagcggttcggcccggcgtcgcagctgctgcacgatttcgtcgcgtgatcaaagcacggcgcgcgatggatgcatcgtctgcggcggcggcggcggcggcggggaataacgcaagacggcgtcagaagcctgggccggccggccggcgccgtcggcgagggtatacaggtatacaagcaatatacacgtacactcgtgtgttgtgttgggggggtaagtaaagtgatcgaagtaggggtgatcaggggtgtaattgtaaaactgtatatgagaagggggtgtagcttgctgtaaagatagattggtatttttgctagcttgcagatttctctactgattgatgcatggatcattcatatatatatatgtggtgatgtgttgggtcagattggaccagatgttcaatggattactgtgaattgcagctacaaatgtttcatgttttgtaccagatgttataaagcaatgcagataggaggggggggggggggggtgtatgagttttgtaacacttttttttactgcaagttcatgatctgaacttctgaagatgcatgagacagattgaaccaagcacacaccatgaaaaatttcagaagaaactcagaagcaaatataagtgcaatagtcattttaatggtcatatatcaaactggcagtacttgaatacaagagaatctcattatgtccaggaacttataatgcgaaaggtcaatcaaaagcatcttaattcttacacttgataactagtatatgtagtgtgccccattttgcattagtattcaacttagcatgctgcataccatctgccaaacacttcaaaagatcacagaaaacttgctcaggttgtttttaattcctccccctagttcttcgtcacatgttggtcactggtcagcattcaatggtggtattcacctacaaaaaaaatgtgaaggacggagatcagattatgatctaatcagacttcagaatcatactaatcattgagatatacctttttaatagggctttgatatcttgtttcaatgcagagctttcaaggaacctgtcctcgctatctgaaacatccaccgttgcgagctcaaaatcatcactgctgcagagctcattccactcgaaccacagcttcgacactcgttctttcttgaaggcggtgtggtgatcatcctcctcaggcgaatcagcagcgacgaggcggtagcaatacaccattttagactgtcctggcctataggcacggccaatcgcctggcgcatcactgaagggttctcatggacatccaagatcactatacgagacgcgccaacgagggagatgccctcgccacatgccttgatggagccaaagaagactctagcatctggtgagttgttgaatctatggactgcttgctcacgctgatcctgagttgagccaccagtaaccctgaaaatatgtacctctgatttccatcctttcattctactgaccagcttttccaagaaaatcaaagagcgcacatactggctgaacacgagtaccttccctcccgtggcttctgaaagagacaacagattgtgtacaaacttggccttcaccccgtcgttgatatcaattccggatatgatggaaccgatcttcctattggtgacatttccatcatctgcatcagctttattggcattcttcaagcatggatgaagagaaacggcattgcatctcgagcgtttcgcaaatttatttattccatccaagcccttaataatatgttcctgtttgctactcatattgagaaaaactgtaaagtccacaattccaggtagctcatccaaaagcttgccttggtaatagtgaagcacatctgcagttagctcacgaagattttggataatcaccgctctcatcttgtcatttccatctttctgacggtgttcttgaaccaaatcaaagaagtccttatctga

SEQ ID NO: 79098 - DNA, 1242 bp, Oryza sativa
aacaggacggcatcaggctaaaaggcatgctgaagctcctatctatgttttattttgtttgctgtaagaactacatgtcatttcagccatttctggtaatagaagtggggaaggcctacctccctttctccaaaaaaaaaaaagatgttatagaaaggatatatttacccaaaacagcctcttctgtgactttagcgtgctgcctcaccaattcctctttagcattaattgtcaaaaatgcagcagcaagtttatcattcaaactcttcaagttctcctttacatcttcatctctgacatttgaagatgactgtggctctgatgattgaccatgccgtggagaagaatcatttagtttaaatcccaatgctaacttctcattcgagggttttgtgactccaatctcttgggtcccatcatccctaacccttgaaggcattccaggtgattggccaagatgtggtgaagcattgtttgagacaggcctcagaacctcctggtttaacatgagcaaacaaaattcgaacactcaggataaatcatttattatcattcagaaaaagaaataaaacagcatccagatttagcaaaagatgccatatatgtataaattatattacaagtattaactatttatgtccatatttagtgctattaggcagctcatttaccttcatacaagaaaacacaaacaggttgacaaaaaggtacatcaatatagactgttgcagaacttaatagttagaaccttgaaaaatatgcatagatttcaagagcatcttacaggagattgggcgaattgaatttaattgtctttagttggcagatactattcagaataaattttaaggaatgaattttctcataattagaagaactctcttggagttaactgaacagggtacttaactcccttaaatactaccagcatcattttgtctgttcaaagctttttctttgcttgcacggaaaagggcattacaaatattatgaaacatcggcacatcgctacaacattttcattaatagaagtcgagattcagcttcatactcaacctcaacatgacagattttatacggtttgagctactgttatgagcacgatagtctgtactcggtaggtactaggtagcaacatgctgctcaatctctagtaccataatacatcaagtcaatatcaatgcattcatcagacattatcatctgaaccactatgctccattagaatcaggccaaactata

SEQ ID NO: 79099 - DNA, 20092 bp, Oryza sativa
tgttgagggtggaggcatagagcatcagggaccacttcgagaatagctcctgaagttttgtcaattgcatctgcatcactagaatttctgtgttctgagggacgtgctctgtacgattgcttccgctgacacatgtaacagataatgagaaatatttttgaacaaaaagaaggaatgtagaaggaacataatgtagaaggaggctaggcaaggagctatttagtttaagagtagcaaaatgatttccatgtgcatttctataagagaatctgtttcatccctaggtaaacaggccactaagaatgtaagtatgtaacagcaatattcccgaaaaagtatgtaacaacaatcaggtgactacagcctacaggacagcaggcaaaatataactagtttatgttgtgatgataaatggagcatgtgtgctaccatgaagtaattttggaaatgtcataattttaattctttttcagtaattaattatagtaaaataatttggaccagaaatttcatacctttttccactggtactcaaaaatattttcaatacgttgctggatcagaccacaaacacgacagacaatgcccaaatcatctttcatcaggaaatcgtgctggcattcatcctctgcttgttcacaagaattctctgatgggacaatgttatgatcgcttccaacagtctggtgaagcaaactaagttagtgagccattcaacaagaagaaagtaattacaaaccatgaaataagcaaagattgaggagcattgttaaaaagaactcagttgtaaacaagaggcaagtggtgctaaaccatacagaaagcaaaggtagaaggagcatgttaaaaagaaggaactcagttccagggtgatggtaaagactaaagataaaacatttacaatttacatgttctgaatggcaaggaattgagaagtgagataaaacaaacagaactttttattgacggtcaagcaaaacagcagaatgatactaaataaaggcctgtgcattaacaattactcgtatgaatttcatacagttggcctgatcggctgccttgtttgcatttcagtcagccgctacagggagttgtatgcacttgcatggctgcggtagttgattaggccaagtgagaacaacttcctcagagtgagcatgaaaactgttataaaaccttccagaaataactatcagacaattaagggatctaggcagtgaggtaatttctctcatagaaactgtacgttatatcctgatctatcaaacaacaaacacagagacaatcggaatataaagagagtcaatagtcaatggtgtgcaaatcttatgcgtattcccaaaaaataaagaaaaagccaatggtatacctttgaacatgccattgcaaggtacatgtccatccaaagtccttccagctcatcaactgggctgctgttgtcatattgatcaaaatttccattggttggtgactgactgcgcataacttcacaagctagttcatcagaagcaacagagatgatctctttctttaagttcccttttatctggacattttcagcttgtgcttcctcttcccctatctcctcatgaccactctgttgaaatgcaagagtgacatcaaataaataattttcagccattcaatagtataaacttaaatgttgaaacaacacattttgtcatactagcataagtttagacaaacatcataattttaaggctggtatatgctatacgctggtcatggaaactaaggatgattagtttccacctctcttataagttactccctgtagttgaagatataagttattctgggtattgttacgatctccgatccacacacatttggccattactttttatagctctctgtttgcaaaatttatagaatatttctttttgaagaggagagagggatgccctctcccgttctgctaatagaaacgataacaagctcattacaagccaaaatgtcatcaggggaacggaaaacaaaaaaaatctactgggagcctgctaactggatgctccaaacttgaaggagacagccacacaaaactactagttttccttgcacagccattacaatcagcttaaggaacctggacagttttggagaacgaaaaaaaacagagatttgcttttgtgtttcttgtagatcgtctatagctttttgaaagtaattttagtgacataactactgataaaatttcatgcaacaactatttattctcaaaggtttcaaactttgattgcccacactccaggacgactaattttggatcagggttcagggggtagtatgagattccgtttacccgtaatatgcataaaactgcttaattcttgtatacacattagtagaataaaatttcaggaataattgagcacaccttgttgtaaataacatcgttgatgtccatactatcctttcctttcttaactgcttgtgcttcagaactgatgttttcattatccagcatggagatttcctgttgttgggcatgctgctcaggcagaacgctttcttcaatataattcgcattttgcttggaatcagatgatttttcatctacaaaggatgcaacactgtccccgtcatcagaatcaactaaaacaactgttgtgttagcaccaatattgtccacattagcaaaagtataatcttcatcattgtctgaatccaagtcaattatattacgacaactagagtttcttccatcttgcacaaggcgatttgtttctgatgacttgagtggactggcatatggcaactggataggtacttcttgcagcttttgtaggatgctgataagttcaagccgcttcatactgattgccttgtaatcattcgtggagctcccatacttcaagtcatcgcattgttcaagcaactgatgacacaaaattctgttacgactaaggatgcttgactgggactggacccgtgaagagctatcgtgaccgctttcatgcttccgccttttgcagctatcagaatccatcctagaacacaaaggaagacttgttagtgttttagaaggtgcattgtgcatttgtgcatggatgattgcaataataaaatgttagtacattgcaataacaaaaaagataatgtatcatcatgaacagaactatcactgatgcaaataaaacatgcggttgttctgaaaattgaagaaaaacaaagcaatacttcgatcatggatttactaccaacaaaaacccatctttctgtctgaatcaaatccatctattctaatctgagcttgctcgcaactcccagacagccgcttgcagtgaccaataccacagtccacaagggaccctaaaaaaaatcgacttcacgggaaaaaaaatttgcaatcagaactcggttattcgatgcttgtttcacaatccccatgtgtagagtctagacagttcaattggacccaacttgcaattagtttgccaggaccataaaccttggggaaaaaaccccaaaacccaagaaacgcacaaagctagggatagaaaggaaatgcccaatctgaccgcaaaaatgcctaaccagataactgaaacaacagacgtgcatgcaaatgggagagggcaaggaaaaacatgatgagagaaagaaagaacttctatttaggaattagggaaaacaagaactgaataacacagtgagaaatgcggaagaaactcacctagcttccttctgggttgagtgatcgatctctcctcctccccctcggagggacagaggaatctgaagaaccttgcgagaatcgctatgagggggaagaaatcaattcaccaaaacttcatgtgagcactggaagttggaacgcatgatgtgctgtgctcttcgttatgattcttgtgaaacacaccactgaacttccaaaatgtgaagtagtactccaggctccagtacatatacactgaactttcttagactgtgcagctgggacccacgtgagtgggccatgcatgtcatagaggaattgacatgggttttccctgacatttgggaggatccgaacggttcaccttccagggtgctttcgagaggatatggcgaccggctggtggtccaacttcgccgcctctctctccgactcctcgtcggcaggagacaccgccgatgccggccgcgccggcgagagagccaggcactctccggcggagtcgcgtgaaaagcttctcgagcgtctcgccggttcagatggcatagaagcaatatgcggcaagcaacgcggccttcaaaatcttcacatttctcatttttgtgtacggaaagctaaggtcatgtacagatgtgccctcaatcttctcacatctcaaatctcattcaataagccaatacatacttatatactcactctgtttcacaatgaaagtcattataacatttcacatatttatattgatattaatgaatctagataaatgtgataaatgctataatgacttacgttgtgaaacggagatactacatatgatccagttgtacaactcaaataaatatacaactataaatcaatttagagaacatgtataatgcactgcgactgtttataatcgtcgatcaaattcaattgtacgtgagtccaactgttgggacgtatgcataacaattttgttttcaacttcatgcgcgtgaaagtattgtgttcgtggtggtcaagttcctgcctcttgtgttctcggtcgtcttgggcctcggccaccttacgtttgttcgccatggcctcctgctgctgcagctcctgctgcgcggccacctgtttcgcctgcgcctcctccatggcctgctgccgtagccgctgctgcgcgtccacctgtttcgcatgcgcctcctccacctacctccggtaccacgcacgccacctcggcgtcacggccttgttcttgtgcatcgcgacgaacctctccaccagcatatccccgccgtcctcgagggcctcccgcccgatctctctcgcccgagcgatgaagaaatccaggatcacgtcgaagaatttcttgtaggagggggagttgtccatcaccccgtggtagattttgcgcaggaattcggagtacttctcgtcgtacttgtcgccgccggcgacgaggccgcagtgggagcccggcgacgaggtggccgcgcacagcctgaggaactccagctccacggcgtggaacgccgggcggaagttgtcgccggcgccgcggtggccgccgccgcggaacgcgaggtcgaggcggtcgtgcgccagcgccgccgcgtgctcgtccgggaaggcgcccacgaggcggtgcttggtcgggttggacgggtcgaccacgcatgccgcccatttgcccgtgcccttgtctcgctgcacgccgacgtagtatctctgtgtcgacggctgagcggtggcttgcgccggcggccgctgcagtggcgtcgcggcggcgggaggagtggaggtcgcggcctgagaggatggcggtggcatggtgcgtgctggtggtggtgctccttctcccccggtgttcggcagtggcgcgtgaggctccgtgggctggatgggggctccgattgcacgagagctcgtcggagcggggtacctcgccattgctgctctctgttgctgcgacacgtgaggattcccggtcggagtcgggatggtcggaacgcccggcgacattgccattgacggagctccctgagcgttcgacaatggcgcgtggggcctcacggtggacagtactgctgtatgagagctcctcggaaccatggcctgcgccattgcagctcgcgctccccgcatccgcttgtgttgcaacggtgcggccgggatgccggtcacagctatgtgggagctctgacctgccggcaccatcccagccggcgaagctccctgcattggtggcgccgcccagggagccctgatagcgcctctcatcgacggagcgttctgcacgggcagtgatggcgaaggacccctagcggtggtagcggcagcgccggaagctccaaagctcgccggccgcggcacgccggtcatcggtgtcgcgttctgcctctgcattgtcggagaaggcgagggagcccttgcggccgtaccacgagcaacgggagccccaaggttcaccggccgcggcccgccggtcatctgtggcgcgttctgcgtggaaggggaaggagatgaaaccctcgcggccgcggcgccaaagctcgccgggcgcggcacggcggtcatctgtggcgcgttctgcacgggcggggaaggcgtcgcggccgtagcagcgccaaggctcgccggccgcgccgcgccggtcatcggcggcgcgttgtgcgcttgggaggaaagcggtggaggcttcgcggccgttggagcaccggcgccgggagcagagagcgccgccatgttcgcctccgtgatcgtggtgaagtggaaggaaggatacgtgttgtgtcacgaaacgtcgaggccgtgttggcgacttaaaccgaagccatgtcgaaaccgagttgatctcgctatgctccgagtcggattccagcttggcacacggaagccgcgaacgaaagcgtattttgtgattacgtttagggtggctctattttgatttctacggaatacgtattccttgtttgaacacggctttagttagtaacactcaccaattgggacgaacacctcgactcctcgagtcaccaatggcgattccccgtcgcctcgccgccgccgcggccgccgaaaccaccaaacgctcggcggcaggtctcgccgccgccctcggtggaagcggagggaagcccgcaacagccgacctggccgctgccgcgacggccgcggcggccgccggtcgcgcctccgaatgccagtccctcctcctccgcatgtcgcgccgccgcggcgcctgccgtcgcgagatcgtctcctccctcctcggctcctcccccaccccgcagccgcgggtgtttgacctcctaatccgcacctacacccagtcccgcaagccccgcgaggccttcgaggcattccgcctcatcctcgaccaccgcgtccccatccccgccgccgcctccaacgccctgctcgccgccctctcccgcgccggatggccccatctcgccgcggacgcctaccgccttgtcttctcctccaactccgaggtaaacacgtacacgcttaacataatggtccacaactactgcaaagccctggagttcgacaaggttgacgctgtcatctccgagatggagaagagatgtgtctttcctgatgtggttacacataatgtgatggttgatgctagatttcgcgctggggacgcggaggcagcaatggcgttggttgactcaatggttagtaaagggctaaagcctgggattgtgacgtataattcggttctgaaagggttatgtaggagtgggatgtgggataaagcatgggaagtgttcaaagaaatggatgattttggtgttgcgcctgatgttcggagttttaccattttgattgggggattttgtagagttggggagattgaggaggcgttgaagatttacaaggagatgcggcaccgtggtattaaaccagatttggtgagctttagttgcttaattggattgtttgcaaggagggggaagatggaccatgcgatggcgtacttgagggagatgaggtgctttggattggtacccgatggtgtgatttacacaatggtaataggcggattttgtagggctgggttaatgtcagatgctctgagagttagggatgagatggttggctgtggatgtttgccagatgtggtaacttacaatactttgttgaatgggctctgtaaagagcgcaggttgttagatgcagaagggcttttgaatgagatgagggagagaggggttccaccagatttatgtaccttcacaactttgattcacgggtattgcatagagggtaaactagacaaggcgctgcaactgtttgacacaatgttgaaccagcgtttgaggccagacatagtaacatataatactttgatcgacggaatgtgcagacaaggtgatcttgacaaagccaatgatctatgggatgatatgcattctcgtgaaatcttccccaatcatgttacgtacagtatcctaatcgacagtcactgtgagaagggacaagtggaagatgcatttggttttttggatgaaatgataaataagggcattttgccaaacatcatgacatataattccatcattaagggctattgccggtctggaaatgtttcaaaggggcagaagttcttgcaaaagatgatggtcaacaaggtgtcacctgatttaattacttacaacaccctaatccatggttatatcaaagaagataagatgcacgatgcttttaagttgcttaacatgatggagaaggaaaaggttcaaccagatgttgtcacatataatatgctcataaatgggttttctgtacatggtaatgtgcaagaagctggttggatttttgagaaaatgtgtgctaaaggaattgaaccagatagatatacatacatgtctatgataaatggtcatgtcacagctggcaactcgaaggaggcattccagcttcatgatgagatgcttcaaagagggtttgctcctgacgataaattctgagggtcctcattttcttctttattggattccgtagagccattggataatttaggaaagagaaacgcagggctgcaggcactgtgcagtttgtgaatattcagaattctgctgaaagtctgaaacaaatgcctatggatttgaaggtgagaaattttaatattctgcagttggcactataacatcttctagtctcttcatgccactcttctacttattgacctagtggaaccaaccatgataaatgataccaagttactattttgagtatgacttggtaagatgtaatgctatccattttctgaccagcaagaagctaaacatctactgagtattatttttctcttgacaacagtggtgcttggttgagttacttttttccttttctttttttttgcattccatccctcaataattttgtttgagatttggtaccatcacactgaggctgtgtttagttccatgctaaaattggaagtttgaagaaattggagcgatgtgatggaaaagttggaagtttgtgtgtgtagaaaagttcgatgtgacggaaaagttggaagtttgaagaaaaaagttggaatctaaacagggcgtgactgtaatttccataggctgctggttaattttgtggaagtctctcccatcaggtaacatgttccatatacttcttcgccaagacccaggaatttgctatccggggttgtgcttttgttttcggggcactggagaaatcaagtacacctttaaattttcaggtactcttcaaaccaaactcgtctctctctctctctcacacacacacacacacaccaaaaaaaaaaaactgtgcttcctcccttctatgttttgtcaagacattgtgtagtggtagtacattgtgtagtcccacagtgatctgaaccaccgtttgagatcaggaaaaggattcaatttggcaatgactgtacagtttattctcacttgtattaattacttatcttcacttcagttgtttgttcctgttcagggaaccagaagtttggaagatcactggaaaatcctagttggtgagagatattagtacacaaagcatcgtgatgtctgagatatctacatataacatacagattccataatgatctgcgaggttatttgctattactggatcttccttacgtcaaagatgtttcttttagtcatgccatgatacagacagacgagtactgcttgctaaggagtcacaatcaacagaacgtgattgatcagaaggaaacggcaagtgagttcaggaaaaggtaacattcaaaacaattataaaaaagatgtcatattgaaaacaactctgcacaaatcagggcaatcaaaacttctgtacaaaaagaacaaatgaattggctgtggagggttaaaagggctccttaagaataacctctagaagaacaggaaaagaacagaaaagaaagaaaaaaaaaatgaatattgtacatgtacatgtttcaaagctctcatggtgtttggcatcttcttccaggattgttaggatcattggtgcatccagatgcacctggctttgctgaagttaagaacaccgtgcttccctgtcgtggctgcgatctcgctcccagcaatctggatgcatgactgatggtgattgtggtgctgaagatcagcatgaaaatgagagctagaggcagaacttgctgtcttctgatcggcatagttgagcagctgacctcctggtatgttctgaattcttgtggaaggcgagttacgaaggctgaaaaactggggtgaatataaagactgtgtcaacacgtatatgttcatatgttgtataaatttataatgctcttgagcgcgtttggttccttgtgtgtcaagcttcgatgtgcctacccgagggctcgacgcgttgtcgcggtcagctacgacttgcaaaaccattcatcacgtggttttcatgtaattgtaaaccttgaccttcgcataagagagcttgacctttggcataagagagtcttcgtgtagaattcatacgaaatccctttcacagtttcaacattccagagttttaagtgcatgatcattcaatactattccgtactctccaaggctcagtaaggaatgctaaatctctcgttttcttcatgttaaagaggatgcagcttgaatggtcgaattcacaattgacggctccaccccaaaaaagttcaggatgactcgaagtcgaatccgcgtaatacgctggcgaaaattgaatgggccaaatgtagcccatatccattttattcatgggtctttgaacaattgagctcgaaagcccagctctctctcgtgaaaagcttaaccgacctagctctcgagggcgcgctcagaaccaaaaatttcgaaaaggtaaggccgaaatcgccgcctcctccctccggtttctccccctcccagagcgtagcctgcgcctcctctcgcgatgcaccacggcggcggcggcggcgcgatccgcgtgctgaatgtggcggagaagccgtcggtggcgaagtccgtcgcggagatcctgtcgcggccgtcgggcgggatgcggtcgcgggaggggcggtcacggtacaaccgcgtcttcgagttcgattactccatcggcggccgcgcctgccacatgctcgtcacctccgtcacggggcacctcatggagctcgagttcgacgaccggttccgccgctggcactcgtgcgaccccgctgatctcttccacgcccccgttcgcaagtccgtaccccaggtacggctctctgtttcctgctacccatttctccgaacagttggtgcgcaacgcgcggtgtcctgtgaattgtgccctcaccagtcacgtgtcgttttttgcatggtgtggtctcttagtgtcttgcgtccatggagttggctgtgtttaactcacggtgaaatgtgcggcactgaaatttcgttgactagtttatgttcgtgcgtttggtggtgtactgtacctggattccagttcgtgggggcctgagggtctaataatgagtacctgatttgtactatcaatggatgcgtctgctgattttgtttagggtactgcacttaaggaactctattctagggttcttcaggagcttgatcgggggacatcgcatgattgctactcgtttttgaattgggaaccactagtgctgctggtcatttgcactgttgcgcagcagcaatctggttccagtcatatacgtctgtgtgttgtactatacatgtgatacattaagttattgttattgtgataggaagagggatacagtaatgcataaactgtcctatttggttattttgaaaaactgaaggctatacttgctattgctggtataagagggtagttgtatgccgggctggccgacctagtatgattatatgaacaccctggcagatactattctcaggcctcaggaagtcgggcttttgttctgaaattaaagtttatcctacaacatcatttatcttgcagaaaaattagtaaactagaggcagaagttaaacagatatacaagtttcctctcattcttccgttcttccagcatcaggagaacaagatgctactctttttgtcggttgcactgccacaaccatgctggagcttgcttgttgtatgtgatttggtgtagcagtatgttttctccatagtcatcattgatctgatagattgcctatgtatcttttccttttgtctttttagaatctcctatcttagatggatttattgggtaacatgcaggcatgccttaaattgctgagaatgaccatgctcatttgtctatttgcccaaacacgtgatctgtttttgtgttttgatgctagtggtatggtctgatggtaatgaagttataattactgctccagtttctttttttttcagctgaggtatattcatttttttaattaattgcaggataagcaagacataaaaagaacattggaagaggaagccaggaagtgtcagtggcttgtgctttggcttgattgtgatagagagggtgagaatatcgcatatgaagtgattgatatatgcgcaggtgccaacagccgcctcaacatttggagagctcgtttctcagctttgattgacaggtatttgttgctactgatgactttctcttcttgattgcaaagatggcatatccatctcctgcatcgcacgggtatccccattcacttcacatccggcccgattggtgttactttgagttagttgtatggagatgaactatggtgttcaagttgactggataaacccgacccacagtcccacactcatcccaaatctcctgttaatgtcttaaagaaatgaaactgcagggaaatccatgaagctgtgcaacatcttgacagacccaacaagctctttgctgatgctgttgatgcaagacaggtaattaaattatcattccaacctttgttgatgttgcattctcttgcatcacatctactgagaagtactacagcaactctagcaaactaaggtcctcgaagagcctctgccacatgttctgactataatattatagcttttgtactggtataggaatggaatgggacgacggtatattttctccttcttatattattcttctcaaatgaaaagcattttcttgcaccttcttagtgtcttgaagatctccgatgattattaagaattttgtacaggaaattgaccttcgcatcggtgcctccttcacaaggttccagacaatgctgctgaaagatgcatttgttcttgatgacactggtgatgataggaatataattctgagttatggtccttgccaggtacttcactatagagtatgaacagaagatactaaatgatgcctactttcatcttggtgtaacatgttctttgcattgcagtttccaaccctaggatttattgttgagcgtttctgggagattcaagctcatgaacctgaagagttctggacaataaattgttcccacacttcagatgaaggcactgcatcttttggttggatgtaagatgcactcgacatgttgtactgattctttcattacaaacgtcatctgagattatttcttgtttggcagacgtggtcatttgtttgattactcatctgctgttgtgatctatgaaatgtgtgttgaagaaccaatggcgacagtgagcccttgacatcttttatttcaacaccaatgttcacgaaataataacgataagtatctttgatgacagaacaaaagtaccagtttagttgtattttttccctgcaggtgcaaaatgtaaggaatcaagagaaactaaaataccccccatatccactaagtaccatagagcttcagaaacgtgcctctaggtacttcagaatgagttccgagcacacaatgaaggtgttaaaaataattctattttggtaaccttgtatacctagaacagttttgctagccaattatggccacatatcactgaactgattgttttgctgagtgctctcttgtcctgtctatatcaggtggctgaggaactttatcaagctggatttattagttatcccaggacagagactgataacttctctccaaacactgacctacatgtatgttttcaaatttactagttcctcttgtccattcttatttcatggtttgatgattcggattacatgttattgaatatttgcacctataactttcatttttacataatttacatgataaagaatatgttctcaaagtcaaatactccctctgttcctaaatataagcatttatagcaattcaaactttgtacacaaatataagcattatcttggacacagttttcaaagtaggggaatctaagcaatttcagccagtcagatgattgggagggaatccaagcaagggcatttgagtttcgcctaaacccttaatcttttctaaacaacctataaatacttatatctgggaacagagagagtaattggtttgttacttttttttttggtaattggttccccttttcattttgtgtggatatgctaacacatgatgatccccgtcacgtttaaatatttgatttataaaattctaatcatatgtcattcatgaaatgccactagaaaatattaaaagcgttttctacactctgataaatacctgcgatggttataccattttaaccttcccttgtttgtttgttttttcaaaaagaatatatctattttttccgacatgtttgggtacttttgatgtagtccatcgtacatgaacaagtggctcatccaaattggggaacatatgctcagcgtcttttggatcctgaagcaagactttggagaaaccccagcaatggtggtcacgatgacaaggcacatcctcctattcatccaacaaaattttcagctggggaaacaaattggactgataatcacaaagtatgtgtctttcctatatagcagatactatagcatttttaatattttttaaaggcagtatttcttatgttctacaagtgtgtaataaaactcttcatatttgtcttcttgtgtccagaaattgtatgagcttgttgttcgccatttccttgcttgttgctcccaacctgcagttggagctgaaacaactgtggaaattgacattgctggtgaacagttcaatgcatcagggcgcgttgttcttgctgtgagcatcctcaaaccttgctggaatcgtctattgtttcataggtgttgcaaacgtgtaaataggcagtatccatacaggacatgtaaatatgttacatatcctatacctctaattctgcttgttctttagttctttaaacactttgctccactaataaatctggtaaacaagagtaggagaaagtgtatttcaatcagtaatagaaacaacttgatcttatgtacagaggtgacatagtcttaacttttaagctctgagaagcgtcttctttgtgttgaagcttcaatgtgagtcttgggttgccattcctcctttagtttacattaattggttctttaatagcattgttctgaaaaaaaaatcataaaacaattaactgtgccagttgtggtgcactgcaattaatatttattgggaagggaaacataaaggatgataaaatgtttagtcagtaaacaagaatgaaatgctaggagaactcatgaaaaatttaactttgccaattttgatgtactttaactgctttgatatttattggaagggaaagaaaggaggagcatttaaatagaaagtgaattacacagccaatatgcttaactgtttacattgccaggtatttaggtagcatatttaggaaatggaccttctgctggtacaggtggaaatgctgtgcccaggagttcaggaatgcagtgtctttaatttaatactccagaatacattttcctttctaacgttagttctagtgcaataggattatttcatttctgggttacttatggcaaaattccttttctgcatgtcctataaaatatgttatatactctcttctagaaaaattatttggacgtatatcggtttgactcatggggcggtacattacttccgacatacatcattggacaacaggtttgcttcatttgtaccaacactttctcattcattttatagtgtcttctgtgctatgtgggtaaaaatacctgtgtggaatgttcttataaaagcctgcaatttaaggatgactgtaaatttatattcccaattaaaaaattgatccttctgatatgttgtaacagttggtgatttatagggaaactgtgcaattctgtatagcagtgtattagtcgctacaatttgtatgcattgcttgctcaatatttagtaactgcagtatatatgaatcagttgttcattttttttgaaagaatattctggttgctttttagttgtttaccatgaggagttgatgaccttgcagtttgttccaacaactttaacgcttgattctggaatgactcgcccacctcctctgcttgctgaagctgacctccttggttgtatggataaagtacacttcttgtcaatctgcaacataatattttcttgtggcaatatcatatgtatattgagttgtgccactaaaatatttgactgattgactcctttcgcttccaggcaggaattggcactgatgcaacgatgcatgatcacataaaaaagttacttgaccgttgttatgcaaccaaagatgcaaatacacggttctccccaacaaatctagtatgtttcatcacaactaagttttcattagatcattgcatgtagcacaatattcattgtttgcaattatttacatgttagtgttattatgacatggcatctaacagaacttcagctatctaatctcatcttatgataatacaatttgtttgattacctggctagaatattctgaatataagtttttgcccgcattgagagaattatattaaggccctctttgtttaggcttaggcttattggcttagacttttaagtcagcttattggcttatacgatttataagccggtgaatttaatgtcttaaatttaatggtggagtcatacatctacctcatataagccaaaaaagcttctccaacctagcttttggcttaatagtgttagagtggcttatggcttcaaaaaagccaaacgaaaaagctgcatctttgtttaggtttagacttttcggcttataagttggcttataagcctaaacaaagagggcctaagcctgtgtgcagattgtcataccttaagtcataacataagataaataaacagaattcccatttcaaatataatactctgtagtagcatgttgcccagatgatttttttaccacaacaactccattgcttttctgaagaaatctcttattatcatgtgggcactgctgtttggtatgaaagtaaggattctattgagaaccagggctaccaaccagggcttgaaccttggttctcacagaaaaaaaatgccccttgttgttgtgttcccctaaagtacaggttaagacacgggctgtgtcaacgagttcccgtacgagtaagacctggcttttggggcattttctcgaccttaaatgcaatgcgtttgggacgtctcttcccttgtgttgagcttttcttttgaatgtcagattcatcaacatttttcatgcttatagtcatacgtaatgcatccacacttttggacaaaatagctgaaagtattacttctaatgacatattctatttatttccgttacatataccttctgtgatttctattggactagtcctgataagacagtttaggggtttgtgctgacccggcaaaagtttagtgggttttttagccaggccggcctaagataggctgaccaaatttacttaagaaaaggagtatttacacacatacaagtttcagacttcgacaagaagctgtcgaagtgaaaggatgttgccacagcggcaacttcctaaaaagaaaaaatacaagttacagaaggttgttactctcctaaaacattgaaaaccccagcttctttccagatcgctgcttcgtctttaattgcgccaaaaaggaaccccgctgttcggctctgattctggaatactcgcgtgtttctctccttccaaatcatccaacagaccagcagcaccaaagtgtcaaatgcgctaaaagtttagtgggttgtaaaatatatttatctggttcacaggaaatactgttctctgtaatatattttttctccagtgcagatagtacttgtccatgagatactttttctccattgtactgaaaatgaagctcatctgctaatttcacacgtgtcttttgtttcttttttctctaaatgcagggcgaggcattggtgatgggttacgatgaaatggggtaagttgattcttaaacctcacttactgaacccatgtaatatgtttggtttcttgaaataatttaagtcattttaggtatgagctttggaaaccttatttaagatcaatgatggaagctgatatgaaatcagttagcattggtacaaagagtaaatcagaagtacttgagaattgtttgcagcaaatgaaggcttgttttcttgatgtaagttcttttttatgtatgtataaaagtaacaatatggcgcaggaagtgaagcatagaaactgttcatcatctattgaattgctctgacctctgagtttatatctagtagttaaccacttatcattggtataatgcaggcaagggcaaacaaggtgaaactctttgatgcaatgggaacattctttgcaaggtttgattggatccatttggctttcttctttcattgctacaaatttctagcttcactttgacttttgatctaggtcaagtagaccggtcaatgagacacagaactccatagaaactgtgagaccatgtgctgcatgcaatgaatctgaaatgtttctgaagcaaaggccggtaaaattatcttcccatacatcttttctttcttgaaatggttctgaagcttaggcatattggaagtgtcgcactatgtccatgcttgagctttgcttttctttcctcagactggcgaatttatggttgggtgtcggggcttccctcaagtgagtaacatgtgtgctttgcttagttaccagacctcttgttagtaaaaaaggaaataagaaacaattcattaatcttgccagaaaagagcatatggaactaataatgcagccaaaataattgaactccgacgaaaattttgatattaatagtcttcctgaactttcagtgtagaaatgtagtttggctcccacgatctctttcaggggctgctgtgactgatcaagtttgtcctacctgtgctccaggtgaataatttagttccccaattattgaaattgtaccactagtatgatcaatgattttcactgatggactgttcctttgctgattctcctttgaatattgataatctgttaaatttacaggtccggtttataagattcaatttaagtttcggcgaagggatattccaccaaattttgatgtcgatcacctcggtatactctcctatttcaattgaagttccatactcactttagtttttcagttaaaacttatatgaccaaaaaacaaatccttctttcctctcaacacgtacacatcttttgtttggttacatactaaggtgattcggacatatttcatgctgttataggttgtattggtggatgtgatgacatactcaaagagctcatggaattaagtagatttggaagtcatagccagactgcaacaccaggtatccgcaaaatgttgagttcatctttttaaccgctacaagtcaagttgtagagaattagattcattaggggtaatcgcaatcttatgcttattgcaactcaaaatatatagaatctaaaacaggcttgttttgtggattcaccttattttgtctcccatgttttgcttactacttcctccgtcttttaatagatgacgc

SEQ ID NO: 79100 - DNA, 4990 bp, Oryza sativa
tatcctgcctctcattttcttaaaagctaaaaaggagatttgtttataacactagaaagagaatggctacgactaaagaatgtaacaaccgcgacgtaggtccgaaaagaacatagcaactaaactgtcctattgaggtagaaagaactctagttatacaaaacaaagtcatcagacatgggatagaacctgatcatcagagtagtgctcagaatgtgacgacacagacacggtgttctcggcgcctcccgggctcttgtctgacggcttgcgcctccagagccaactcgttcgatccataaccatcaactgttcaacagatcagagctgaaacccctgatttcttaattaccaccgtatgctgcttttcattgatcagcagctcgcccagttgcaggttgctggtctggatcaaacaacatgcagtagaaaattagcaccgagaatgataacatttgattgtgaaagacgcaacatcctcaacacactacctactataaagaaagaagaatgccgtgacaattcacaagcacacaacctttttgcattgactagtagcccacagcacatgctgcaagactgtcacttatttcttttttcagcacaacttggcaaaagttaaatcagactagcattcttactgacactaaatccaatcagaaacaaacagtgccgagaaaacaaagagatcaaaacattgcaagagaagaacaatgcatcattgtaccaaaaaaacagtggaggtaagatggaatttatcaccattgatacccaatcaaaccctgttgttttactagcatgcttttgcagtagcagcaaataaaacagtaaaaaaaaagtaagtgttttttcacagagagaatgtcagagtgcaaaataacagtagccaccgactactcgcaattccccaagagaacccaagaaaccagggtgaaaatccccgaaaaagattgcagcttgacgccgaaattcctctcgaagcccccaaatcaagaggtattcccactaaatccggcggaagaaagagtaacaaaaacagaaagaacaaaaaaatattcagaggaagcgaagaagaaattccatgagggaatccaagaacgaagcgagagggagcaaaaaacaagcagaggtagagcaggaagcgaggagggatggcgggcattaatacctcctcgaattcaacgactacacggagaagacgggaatgcctcgcatcgcatcgcaagaactccgtgaagaacacacacactctctcaatctcaacaccacatttcttcttgcttcccaataactctctctctctctctctctctctctctctctctctctctctatctctatcctcttgagctgagctgggggggagagggggggaaaagcgcggggtcacagctcacgcgggcagatcggagcaggaggcgagctcaaaagcggaggggaaagaaaggcgcggggtccaggccatggccgccaccaccacctgcagctttcaccatgtgaggccagtacagctatctccctcctctcgcttctgcactcaactctccctctcccccgagcagaataaatgcatcggggaaagtgataaatgcaacacagcatccaaagctcaaaaagaaaagaaaagaaagaaagaagaagaaaaaaaaacagagagatttcacgacgaacaccgccatcgacgaggtcgaagaagaagaagaagagctcacctgcatcatccgccattggcgacccgcattaccttcctccttcccgcgcgtgcagctcgaatcggggaagaaaagctcgcagctttctcggatactactactactacttctctctctcctacccccactctcggagtataatagtgcagtgttcgatgcaaccaccgggggattaagattaggattagtagcagtggcggttgatgatgattctgtgtttcgctgctgctgctgctgctgccgactttggcggattgattgcgagattccagcgacgggtttttagctaattaattaattaattaattaatcagaggggattaagagtaggtacaatagcacactattagccagctataaatatattttaatgagataaaaaataagagagaagagcagcgggctacagatatatagccagctgcagcacggactccaagacatcgtgtgtatgatatgtgggaccacatatattaatagtgtagtaagcaaatattatatgaattaactattacattgcttagggcagtcccaacccataacactagacatagtttccataaactccacatcatcaagaaactagtacggagtactagacactactcttccaatgcaaacaccactattccatacttcaatttaatgctacttatctcacatgatgtcttagatgttgtgaagaaaccatgtctcatgcaagacatggtttccttctctttcctcatttattcacttgccacatcattttttatcctaggtggcaacttatttaatgctatagacacaatcctagtcattgggttgggaatacccttagagcatgtataatagcaggctattagccagctataaacatattttaatgagataaacgatgagagagaggagtagcgggttacagatatgtagccagctgcagcacggagcccaagacacactgtgtatatgacaggtgggaccatatattaatagtatagtaaacaactattgtatgaattggctattagattggctatagatgaattggagctagtagtgggctgtactattagacttgctcttatagatgaattgaagatagtagtgggttatactattaaccttgctctaatcgctgtgttaagagcatgcccaacagtcacccaatatttgattcccaaaaaatctgaattaggaattccaaaataagaattgggcccaacaatcaccccctcctccaagagaggcccaaaaattaattccctatcatttgttagtttgccacataagcaaggtgggcctagttcggtaccgatcgatcgtctccctccccgcaccagcgccgagacttctccctccccgcaccttctccctcccacaccagcgccgccatctgtgtaaatcgcatcatcaccagccaaccagtgtcctgagtgctgcggtttctacaaaaacggaataccaaggatatgccatagctattcgtgtcatcaaggaggtaatccctagcaaatcctattgatctcttgtgccctagtcaatatctgtctctatttggttatgtggatatctattgttggaaaatattaagtttgatctaataattaattttatagattgattattgttgtattcctgccatcggttctctccattgcacttcatccctgtggtaaacgctccaaccctgtggcaataaaaaagagaagatgagtcgtcgaagtaccctcctccaaatgctattggatgaggagtctttatcggatggcgacgaagaatttatttctttggcggttgatatagtgcacgatgagttcgacgatgatgaagttccaaagcgtggtggatctgttataggtcatgcagtaattaatcgggaaagattggctggacatcggagattatataatgattatttttctgaagaacctacgtacctcgatgttcagtttagacgcaggtttgtagcagtgctttgttttgacaatatttgtttgcaaaattgatattaaaaataattaatatcgttaattactatgcaggtttagaatgagacgacctctgtttttacgcataatgaatgctatagaagcacatgatgaatattttgtgcagaagagaaatgcggctggtgtgcttggactgtcatgtttgcaaaaggtaacagcagtgtcacgtatgttatgttatggaatagcggcagatgcagttgatgagtatgttcgtattggaggtagtaccgttattgagagttttaacaggtttgtggtggctattgatgaagtttttggagaggagtatttaagaacaccaaacgagaacgacatagctagattacttgctcagggggaagaaagagggttcccaggaatgttgggttctttagattgtatgcattggcagtggaagaactgcccgactgcatggcaaggccagtataaagggaaagagggagttcctactatagttttagaagctgttgcctcacgtgaccgatggttttggcatgcgttcttcggttcacctggatctcacaatgatattaatgtccttcaacgctcaccgctgtttgcaaagctagctgaagggcaggctcctaaagttaattatagtattaacgggcacgactacactatggggtactatcttgcagatggtatttatccttcatgggcaacacttgtgaagagcattaagctgccacaaggaaataagagaaaatattttagcaaagcacaagaagccgctaggaaggatgttgaacaagcatttggagtgcttcaagctcggtttgctatagtccgtggaccagctcgtttttggaaagcacttactctgaatcagataatgagagcttgtataatcatgaataacatgattgtggaggacgagcgcgatggtgattttgatctagtttatgatgagatgggagaacaggtgggtggttcccatgaacgtacgaccaactttaatgattttattagtcagtacgaaaaaattcaagacaaggaagttcacaaccaactaagggaagacctcatcgaacatttgtggaatcatcatgcagaccgatattaattttacattatatattcttatagataatgtcatagattgtaataattggagattcacagcttgtttttaaattagtacatattgagcttatagtaattatttattgacaatgtgatttattgttgaattcgatacagtacaatagactgaaaaggacagcagtgcatatcctttttcaggactggatatatatacaggatatacaccacaagggtgta

SEQ ID NO: 79101 - DNA, 69194 bp, Oryza sativa
aaaaaatcaacggcgtcatctattaaaaaagggaggtagtatatcgaaagtaggccttgttgtcatttgttaaaaaacatgtatattttatgatcatatttgttgtttcacagcaagaaatcagagccagactgcaagtggtgtaaggcaggggtcttcaaggcaagatttacatactagctttcatccagccgtgcaatttactaacggacaaacacctgttgtgaatcctcaaggttttcgttcaacccatacccaaagctcaggaaatgcatcaggtgactgtactactcagtaatgtctacaaattgttatgcaagccaatcttcagctggcctggcaacgaaaaagaagaggtaatgcaagctcatgaattgatcttgagctattttcacacgcaggtcaagtacagtgcacatcatgtcgagaaccctgcgtattgcgaactgctaatacagaggctaacagggggaggaagttctataaatgccagaatcttgcatgcggctttttcgcgtatgtgaatccttttagtaacagtgttattttatcacacgatattgatctgcagggtgcatttgcatctgatctatccacttgaaactatctaagcatgcagagtatcactagttatgcagctatctcagttatgtttttcataaatcttatgtgcacatactcctattccgaactaggcaataaacagatttatcttagctttccccctggtgtgatattttgctctaatctctatcaagttaaatagctaaaaacataataaggaatatgatgcgaaaagagaagctgtcaattataggggtttgttttagctatctatgcattgcgttgcctgatgtctctgtgtgcaacgcagatgggaagacgatgtggagaactctgcgccgaggggccgtggcgggcgtgggcggggcgggcgcagtagcagcaggcaatcatctgcatctgcatctgcagggcggagaggcggcacccaagggcgaggcaggaggggcagaggacggaatgctgatggcatgatgttcgttgcggcgacgggcgagcccgtttacggcagctgcttcatctgcggcgaccctacccacttcgctaatgtctgccccaacctcgggagatagatctcaggccaattggtccgcgatgcccgtacagattggcagcgtaacggcgttggcacggtaagttgaccccccccccctcttatgcattagtaataatcatgatgactagtttatggtaaacttgttaatggttttctggaaattgggaaaaaaaattgagtatttatactgccgccgattcagaacatatgtgaaggtactgctcggaactgtcatgtggctatacagggcacatagccacaatggcagaaggcaatgtcaaccaggacctgtacctagacttgcaaacacgtgatgcgagagggaaaggcacttgcccacgcttcaaagttgaaaaatgctgcaaaccaaaagctgtatgagatgatcaaatgatggtatcttcgaaatgtacccacggtgggctgcgatgcacgtacgcagccttgtaaagtctttccaagcagtacccaatcccctcattgctcctgagaaatttcgtcactcaccaaaactttttagtcaaaagttcagcggaaaaaatggatcatgccgtcactcttttccttgccctattaccatcaacccgctgtttgtttcgtcttgtcactttcttgatatatgacgagttgtttctctaaatgatatgtttatcaactctttgttactgtaggtcacatcgttgtcataacacggccctcttttttctcagatcacacgtacaagcatgaagcatcactcgcaggaataaagccaatgctaaaaaaagcactgggttgatgagatcgttcagatgctggttgaacggttagatcaaggtaattgattagcatatcttttttcttttgtgttgaatctttctggtgtgaccaatctcagtttgaactccttgaataatcaactaagcctcctttttttcaacctttgctcttaaaactaagtattttctttagctagctaattagagagaagagagcataaaagaggaatgattgcatacgtgaggggctttgcatgctttggtgcttcggctccacctaacggtgtcggcaacggcatggctttgcagagatgcttcagttgtcacacatgcatgtagtctagttactctagtagtctactgaaaatcttggaagcgatctttccatgatcggaaagattcgtaacgaggacgacacgaaccgatcaagccctttgtttaccatcattgcccacacgcccacctagcagctgatagcatatatgctgctgcactggccgtaactttgtttgctactactatcagctgctatgattataggtgccaaaaggggctttaagttgcttatcatgtcctagttaatctctcttccctctccagcctctcttccctctatccacatagaggcttaattagcaaataatgagggatcggatagactatctagtgaagcttcattaattccttaacgggtgaacaacttcccaattaatgtatatacactgggaacaccaatacgctgagtttctgaacctttttcaaactccaagcaaccaagaacttaaccaccagaaattagtctaccaagacgaagatgacggaaggccatgagacaattcactggtactcaaacacaaccatggaacaacatcaactggcactacacataagttgatcgcttggtctcggtgcatatgtacacatccaaccgagtctgggatagagttataggaaatggagagcacttaccagtgagcgagatggaagatatatatcgatgcatggtgatggtggatggagcacggacggctggctgcacggccaaacatcgtcctacctgcagaagcttcacgctggcagtgtcgcccgccgatttgtgccgaagccgaagaactaaacagttgagttggggggaatgaagcctggtccgaaaccccccacctagcttgcttagctgcagctgaatccgccattccgcccggtgttaggtctcggaccagacaacattcccctcaactgccataaaaatgaatgaatgagagggagacagagagatatatatagagagattttcatgtataagctaggagcttgtatatatatggaggggcagcttgttagctcacggcagatgactctgctttgagcagctttatgtcatacaagtccacatgcttcttttggcaccttgttgctttcacatttacagcttggatgaacaacggttcatccaacctaaactgtactggctacttagtcttaaccactggctagtgcactcagtctgacaatgctatgtaatccaagtcaaacttgcaagacgtgacatagccatctattccaacatgaacacgtcagcaaatcatgagctcatgaccacttgctagcagctaagggcagccactgaattagtcatctagattcacaggatcatctcagacaagagatcagcattcagcaagctatatgagtattatgattaaccaagtggatgcaatgcatacatgaatatataagctaagctgttgaaattaattcacaacgcacagctgttgctgtgacatttgcatgcgtagtacatgattttattcgcaagcaaaggatttcttttgctttgcatgtaccgtgttgcatagccaagttgttttgattccaatcttagcacttaagaaactgtccaccccgggcaacctgcagctctgcaacaacaaagagaactttttatgtggggatgtgaaagagatctagcttgagcaaatggatttgatggggagattgtgaaaaaagacccaggtgactgaatccaatagttaattgggattgtgcaggtgtaacccgtactgaactactaatccttttttctcttagctcatcatgaaggtcaaagatggccgtgtgaatcatggaatagtaatgccaggttctggcagtttggctggctctttttatgacagaggctcatgggagagtttcttgattgatgtagggtaggaatttctattggaagattgtagagaggaacatgttacatatgctatattccttatgggcacggtgatctgtcgcatacctatgtctgcgaagaataagctgattggtttgcaactaaccggaccacacaaggtggaggtcctggaacactggtctccatgcctgattactagttctattatttaaggattttcttttctaaaataatagcacctgtagctcttacattttcagaattgcagaatctgattatcaaactttagtgtctttggttcattgcctcaaattttcagggaattatttgaaaataaaatgaaccagtcattatttcttcagtagttcagttcttctggctccttatcagctttgatggttttctttaccataacgtgaggctatgcttaaatctctcagcctcacatcacatgcaaaggattgtgttttgggaagagatggaggacatctgttcccctcttctctctcctctccaatcgtacagtgtgaggggagaatcgttttgcctcctgtgcaaccaagaaccattttttttccaaatttcatttggggatttttttttttcatttctgggccttttggttgatctttactacacggatttgttctgttcctctccaatatgctccagatttggtgattatgggaatcgcagcttcttggttgaagatctgctgcattggtacgttccagatatactcttttattctgaacaattttgtttgtacatgacaccctgcatgttcatctgtgcaattatttgcagggaagattggatccttgctccaattggtaaaaagattaggttattgcgatctatccgtatgatcattggcatatgaagaaaaaatgtcccgttcttggcttagcgcagctgaaggtactgctgcattgtagcattgtgaacttttctaggtgaaaggcctcatcttctggaaccacacgttggtatgggtgaccatgattttacaagcgcttcctcctcaacaatgtggtttgatctgattatctttgtgccacattaataggaattttgtggaaaggatttgatttttaatcaacctacatgcaaatcagcggtgcattgatcttcgatggcagcgaaggctcgtgcaaggtcgccggactttgcacggcaattctggcctgtgctgtgccatgccttcagcgaatgcagcctgatcataatgctctttgtgaccgccgtggtgtcattcacggccacaaggtttgcacgcatctggagcctacgaccaccgtgcatcctgtgctcaaggttggatcgcctcctgcatggaaacacctggttctctgaagatctgatctgtgctgcacacaagttggaaatctcgcaattggagtattgccagagtcacaacaagctcgcacactctgatgatctgtgtgaaaggtgcctactttcatgtgctggtttggatggtaagcccaataaactgaagagcatgagaaataaggacaaggtgaattctcaaccgaggtccaggcatacacatttatgctcttgttgttcagagacgtttaagaagacacggcatacacacaagctacctgagcttgcaaatggcatagttccagatgatgtgagcacagtgaaggagagaagcatagacatgactagtgtagggcattcttcagatgaaggttctgaggacttgtcttatggaggctacagtaagctgaatgtccgccatgattcagagtctgagaaccgcatctcggatgatgatgaagatgaagatggtaattcaatgattcacaaagctacgcagagaagcagagacttcttatttcatgattcgcaactacaacctatgatcagtgacaccaacagcttgtccatgcatccttctgagaatgttgttcttgcagagccgatgaataccgctcctgtgccagtgagtactgcagcaaaaactgacaatgtggccactggcaccaaccttgttagtgcagcgaaatcttcagagcatattgcgcaaggttcaagggaaattagcttgagcaatgtcaatgtaagtggaaacaatcatgacgtgcaaccgaagattgtgcctgaacaagtttgcgcagagcttccgaaagagaaaagtatgtatctttatccaaaatgctgcaatccttatataatttgaatttatctgagtatgtcaaatttgttctgtagcttttctggttggtattgaggaagttgacgattcagcgggtatttcaggaagccctgacgaggaagttgctaagggttttgttgcttctgcaaatgcaggaatgagttcagttttagatgcctgtatcaaccgcaaaaacagtatgaagagtgcttctcgtcgtagaagcaaccttcaatctcctcgatggtctgaaataatctctgctaaggataacagttcaagaactaaccaagaagtcaagacattcctgtcccagatgtcttctgcgcgaggctttgatggtccttggagtgaggtggccgctagtcctagaatcacacagattgatgataaacaatatgatgccactgggagcagacaatttcttgagactaactactcaaatatggaaccatttgatgtccatgctactagtgaagatgaaggtgatacctcactcgaaggcctgaagcagaaggttgagcttggcaagaaaaaaatgagtatcctttataaggagtttgaggcagagcggagtgcttcagcggtggctgcgagtgaagcaatggctatgatcaatagattgcaggaagaaaaggcttcaatgcacatggaggcacttcagtacctcaggatgatggaagagcaggctgatcatgaccaagaagcaattgaaaggctaaatgacttgcttacagaaagggagaaagaaatgcttgacctggaagctgaacttgacaattatcggaggcttcatgaaccatttggttgcaagtttgattttactgatggagatatggcatctggagtcttggatagctcagatttcatgagggataccatgtttgattttgaggatgaaaaggcaaatattttgaaatccttgagcaaattggaggaaacactgggcatgtcttccacagataggcataattttggtggcacatatgatagtctacagaacatgtcagtattgcatccggaacactggagcggtgagccggtttcttctcaacaaattgatgaaaatcaaagtgttgattccggctcatgttctcacctagatgatggcagaatcagttctatgacgagcgttaaacatgagatttcacttctaaatactagattcacggcacttgaaacagatcaaaagtttctcaaacagatattaagctctctaaaatgtagtgatgatggcgtacaatgtgttcaagagataactgcacatttgagagagttgcgaagaatcatgactgagcaaagagagagggcagttttatgatctcataattaatctctgaaggtaacaatagaccatagtagtagttaatatgaacattgcttccatgatgtacatgcaataggttactcttatactccctccgtcccacaaaaagctaacctattattgaataggtttttcctggtacaaactcctgtctagattcgttaggaaacatttcattgaatactaggttggttttttatgggatggagggagtatattgcaaatatctgctttgaactgtgccatcagagtttttattgacgatcctctactttcgtcaaaattccttagaatgcatggttaactaaaaggacactaaagtgtcttttgaatctgcattttcagcgctagctactctatcaacttcattgacttagtattatttaatcttcatatttccccttcttttagagaaatacttttccttgtatgcatagaatcacgctagttatgaaatgttaggccttgttctttgttcacttatatcaccttttgtaatcaagagatcctgattcggtctcttttgcagatctgaagttgctgccactgattgttacagcaccatgatgccttcatggtggcatctcgctcggagatttgacagggtcatttgtgacctgatctccctgaacataacatgggagaacacagattatatacacaccgatcttgttggatgagatctttcttgtacaaattgaaacggttgttattaggatttaggagtaaagctcttcgctgtaattatagtttccggcttctgccgagatgaggaaggaattcacttagtaagccagctactgttcatgtcagataagttcataccgtcttgaatttatccaaccacttctggagacaatctataggctatagcctagatgaacttgaaaatttttaaagtctagcggttgcaggagtgctggtcacaggttacctctgatgctcggagactcggacgtgtacagacacttgccattgatcagcacaattttgcagtaacgagcaagggttcaaaactacacacgaaagtaaaccttgcaaagtgttgtcttggctacagtcaacatcggcaaaattttccgttatcataataaactcgttgatacttcagaacaaaaacaagtttggttcaagaaccagaacagatggctccagaaaggggcaaaatatcattggcgcaaacagatgatcagtcgaagataacttggttagttaaagggacaccatgttccaacaaatagtgcaaaagttagggtaaaatacgatgtttctaggcgagaccactactgcacatttactaatagcttccaaaacatctttccaacaaatagctttccctggtggccagcctccaactatcactcgtcacatgaaatcagtgtgacggtctggcaaaagaagaatctatatgaatgatttaatggcaaaaaagggcccccatataccattcaagatgggattaagcctgaactgtgcttcgctccgacactgcctcaagcatagaaaggaggttggaaaccacattgcaagtaggaacatgcacaaggcggtcactgaaactattaactgctgtcttagacagcactgaaacttcagaacagaatgaacttgcttcaatcaactcgctccacggcgtatcgtcctcattgatattggattctctcaagagttgtaatactttatccaggtgagcaacattccgacctgccccacagccagtggcagttgcagcacccactgcatttgctagtgtcagtgtgctaactgctggcaagttgtggaggaacccaaaagctatagcagcagtaaagctatctccacatccaacggtgtccacaacgtcaatctaatgaaagtacagcacagtgaatattgacaaatgcagtaattacacaaagatcctttatcagcagaataaacataccttaaatgaaggtgcactggagacagcactcttcgtaaccatgattgatccctttgagcccatttttatgacaacccactttgtgcgaatccccctcttcagcaactcttgccctgcctggattgggtttctgatgttcgtcagggactcagcctgtcaaaccaataaacagatttatgagtgaaatgaagcaagaatacaacactaaatacaccacattgggttcactgttctctaaacaggccagattcagcaaacaggttttttttacaaaagcatattagtgttaggctgtaccctttaatcttattttggcataaatggtttatggttgaattgttaagtttggagaaaaggcaaagctgcagatgtgaagtcaagatcagccagctcaaatatcattataaaaaaacatgccatttatggttcgcttggcttttactaattacaattgaagctcacaaagcaaaaataaaactgtaaggcatctaacctcgtctgatgttaaaagcagaacatcactgagcctcagagaatgctcaagtgccctctgttcatcaagggtaccatgtaagagagattttcctcgaggaccaggatcaaaaaatactgctgttcccgcatcaattgcgcaatcaatagcggacgagatcacatcagggaaaagttcatcaaaagcatagccattacagaacaatattttggagtgatgaatagctgtcttggtttcagctgggagtttacgtatccaactgaaagctggctcatcactaaagtctgctcggctggcgtagatgaaaattgcaatgcaaagcacaacaagaatattagctcatgagaatttgaagctgaagttgacaatattcatgatgaaaataataagagcagtaaggcatgcatgagaacatgaagttctaacctgcaaaatccatgtctctgaaatgggtctacaagaacccagcaaagaagggtctcataggcatttcggcatgcaccagaatcagagttatcaagcatcccaacaacactaatgccctcctcctcaagcacatcaagaagaaacttcccataaatttcctctcctacatgccccagtgtggaacagcgaagcccaagcctagctgcagcaaaggccaagttgcagtttccaccagcctcccaaaatttctgttccaagtgacgaaagataaaatgttcagaatagctaataaccactgattgattgatcataatgttgttcaatttataactgggtttcttttctgggttctccatcttcccaagcagataaagtgcagcagaataagtaatactaaataactaaattgtcataaaaacattctcattttcaacacaaacagaacaaatgcaaacattcatgagatgtgtacatctaaaaccttccgttactcatcgaaagcctccacatttcttccaatccccaaatttatcagtagatacaattacgatacgctcgcttgaatccttcctatcacaacacaagcattttgaaccaaaccaaagtgactagagctataaatctcccaaaataaatccggctttgcggcatctaatgctgaattcacctgatgaataaccgagcccctagatttccaatcccaacaggcgaaagctctcggccccttacctggtcaggcggcgacgcggcgaggcgctccatgtaagcctcccgctcctcgcgcggcgccggcgggagctggggcacgctgagcacgacgtcgacgcagaggttcccgagcgtggcgaggtccgtctccttcccctcctcccctcccccctccgccggcggccaccgcctcctcgcctcgttgacagccaccgccacggcccgcggccgcgccgccccctcgagcctccgtcgcggaggcggcgggcggtggagcacgcggggccgcggcgcgcgccgccgaggcagcggcagcggcagcacgtgccgcgggtttagggtttggagcgccatgggagagcgagcgagagagaatggatggatcgcgaattcgagatgggtttgcataataatataattttatcattatttctcggaatagattcgattagagaagaaaaaggagggtttattattattttattccacgagatttggaatatgttgggaactttttgaagtttgtggttaggatttggaagtattttgctacaagtcgtcaaaagtaaaactgtgctcttgctaaaagcagtgaccgaaagaagggaggaatcgcactcaaactcaaggtctcaatgacaggttcaaatcctcctttttgtgagagaatggatggcatctgatctgactccacggtgcaaatcagacgatttggtggtggggaagcatcaaagaaggcccatgggccatcatggccttccacaacaaggaaaaagtacaccgaaggtccctcaacttgtcatcgagatacaaaatcatccttgaaccacgaaaacggatacaacgcatcctccaacttacaaaaccagtgcaaactaggtccctcgacggttttgaccgacgtggcagctgactcggcgtgggacccacgtgggccccacacgtcaatctgtccacgtcatcacccatctcttttccttcttctcttcgttccttctctcttctctccctgcgacgatgcggggcgcggccttgcggcggcgttgctctgcggtggccggcgggggataggtggcgccatcgacgctgtctttccccgttcccctttttttctcttttatttttggcttgtttctctccccgatgccgccgctttccatggtagctggcatggaggttcgcgctggcgcggccgagctcatggcgcggcggctggatgtggccgaatgcgaccggaggctaggacgacaccgctcgcagccgtcaagcccccacaccgtcaagcggctcgttggggatgtccctcgcggatgagcaagggcaagaaggacaacggcggctggggcggcggcgacagtgcgttggccgaccaactccctcctcgctgcctcgtcgactggggggacttcgacagtgcacgccgcgtcgtggacgccgtgctcgccgctgtagaccctttgggtgagcagacaaggaagtccatggcggcgcccgaccgcgatgtgctcctctacatgagtcgcgggggagcccggtgcggcatggcgccatccacggtggagacgtccgcgacgcgaagacggcctcggacgcaacgaccgctgacgtcgcacgcctcttcgccctctacccgccggcgcttacctatggcatccacaccaacctcctcctccgcctccccttctcccgcgtcgccgccgccgacctcatcctctcccgcctcgcgcccaccagctagctgcccagactggacagagaggacgaagggagagaaatgggaaggagagatgatgtggacaaactgacatgtggggcccacgtgggtcccacgctgagtcagctgccacgtagaccaaaaccggagtcaaaaccgccaaaggatttcaggtgaccggttttgtatagttaagggacctcgcatatctagttttgtggttcgaggatgtttttgtatccgatgacaagttgagagaccttcggtgtactttttccccacaacaacggggaagcctccgggacacgcggcccagccaccgaaaggcatcagcacacaagcccaattacctcctgggctttgcccagcaacgccggagtcacacgcagaattcgatcaaatcgaccagtccacgcgaccaaatcgatgggcagaacgagaccgaccaaattcgcaaacaccagcgtcacgtcatgcgctcgtgtgagaacagatacgactcattgttattgcacaagtatacacgataacggtttcagagtactagtaaattggtcgaactgtcgaagtagtcgcagccgttacgatcgaggaatgaattcatgtggtcgatttgatcgaaacgaacgaacgaacgtataggtacgtatatcaattcaagatttcaaggccgcacggtcggagtcaagatcgagttgctacatggactaatcagagtttcacacacacgatggacgcagtcagtaagctcatatagtgatatataggccgcatgactggcaatgtctgtacttacactgctactgcacctaactaattaattataatcattcaaccttaattaggatgcatggatcgaccgagctgaaaaccgcgtagtactagtacgtaggagtacgtacttaacgctgaaccggaaaaaaaaaaccccacgaattagttaatcgtagtaaacactaacgaatagacaatagacccggtccttaataatttgcttttctgatttctactccatacatacgcagttgaacgtacgtgttggccaacgtgagtatatacaacgagttggtataaaaggaagcccttcatgtcccatcacccccaacacaaaccaatatccttcctttaattaagatcattccacgtacttaattaattgtctgctgcattcagctcacgtacgtactcatcgatcgagcttaaattagctagctagctagctaaagttgaagagctagagatctctcacatacatggcgtcggcgaagttggtcatggcgttggtggcggcggccgtgctgatgcagtgctgcggcgtgctcctcgcggcgaggccgttggaaggggacgtcgccggaggcggcgggtggcggccaatgcagaccgccggcggcggcggcggaaagatgccggtcatgcagatcctacaagctgtcccaatacagccggggaacgggtgcaagcaagcccccagccctcccggcgcaccatgcttcggcagccgccggtagcttaattaattaactaattactgcttatataatattccatccgtttcaaaatatttgacaccgttgactttttagcacatgtttgaccgttcatcttatcaaaaaaaattttctgaaatatctaaaactacatgtgtacatgaaagtatatttaacaatgaatcaaatgatatgaaaagagtaaataattatttaaattttttaaataagacgaatggttaaacacgtactaaaaagtcaatggtgtcaaatattttgaaacggagggagtagtattaatcaatctcctttctcgcgaacacggtcgtccttgatcaagctgggttccgatcgagaccggttttacttaattgcgtagatgttggcatgcgtgtgtgtctggagattgtacttcgatttattcgttattattttggtttggtcgttttcatgatctgcagttaggatgatcgagcttctaatattaattccgtgcaaaattggagtgccggaagatgaatgtatagctgatcaaagttagctagaagtagtctataatcagtgcatgtcgtaatgcatggggtattgtaagttgtaatgttgtaagcaagtgaaaattgtttaattaattagctactaggctgttctggcctgtgcaatatggtcccaaaaatatggtttatccctgtcgcagtgccgctgcaggtaaaataaagagaaaaatccaagaaatatcattacaagtacctaaattcaagaaataccattggcgaatgcaagttttctaaaataccatcatacaaacgattttgttcaaaaaatgtcatcacagttatggtccgttcatcctacgccgttaaatacaccgttcatgcatcctatagaacttaacggaaggttgctaacgtaaccctaatggcgattgcgtttctgggacagccgttaaatacaccgttcatgcatcctatagaacttaacggaaggttgctaacgtaaccctaatggcgatggcgtttctgggacaaaatcacttgtacgataacatttcatgtaacttgtattcgtcgatggcattttttggatttgagtgtttgtcaatgtcatttcttgaattttctctaaaataattgacataagttccatttgactaaaatttaaaaatcgtattgcggtttctgtgttgctgtatgcctttatccattgtttgtgtcatatatataaaaacaaaaacgcgcgcgtctatgttctcattttttttaaaaaaaaatctacttcctgataatatgcaatctatacaccaaacatctttcacaccattttgtttgtactggcctatatttgttatacaacagtgcgtaggctaatcatagttaggttctttgtgtgatacatatccacccgaattcaggtccccgacgatgtgctcgttgacagtgagacatctcaagatatgttgactagtctttagaagatgtttataggagatgcatgagcgtgcacgcgcgggtatatgagaatctactacatttagtctgtgttcgttagctaaggttgtgaatctttcctcctaatacgtgaaacggagaggcacatgattaattaagtattagtcttaaaaattgaaatgaattaatataatttttcaaaataactttttatagattttttttaaaaaagacacaccgtttaacaatttaggaagcgtacgagtagaaaatgagtgaatgaaacttgggaaagtgttaaaaaaacacagccttaagaaaaaaaaatgttactgtgcaaaactggagctcaaaaaagaataagaaaacatcgagggccccttacgctgaaaatggaaagatcgaggttttcagcggtgagctaaacatattattgcacaagtgtgccttgccagtttcagagggaactactagtaaattggtcaagtcccagccgtttgcgaatcgaggaattcatcggccgatcgatcgaaacgaatgtgtcaattcaagatttcaaggctagctagctgcacggtcgactgtcggagtcaagatcgagttgcacatacatggactaatcagatagtcatacgcacgcagtcagtaaagcttggtcattattattgttgacacatatgagtatgaacatatatacgaggtttaatttctacatggcacatgtatatatgcggctttcatatatacatccatctgtacaatgaggatatgcatggaccgcgctgaaaatcgcatactaattagctattagtcatgagctcttttctcatctttaataaggtactatgaggtgtaatgaggtaccaggtactataaggtaacaatcaaatctagccattgattttgcaggggtacgatcggaaagaaattggtaagagactaattgggccttccggtcggcgccgcccaagcagccaatagcgaggcaatctgacaagggcgactcatccgcaaaattcgatttctctccgccagttccgccgccgtcgcccatgcgtggtgggaagtaattcctgcgccctcccccgccggcagagcagcggtggaggccgccgctggtagagctacggtggaggccgccgccgaccacacccgcccaatagccgccggcagagcagcgcaggaggccgcctgcttccatagccgcccaccgccgcaggcagagcagcgcaggaggccgccgccgagcaccggcgaccaccgcagacgaccgccgcccaccgccccaggcagagaagcgcaatcccctaccgctgcccaccgccgtccaccaccgcctttcttcgatccgtcgccacgccctcgcctgtgtcgccgtaagtccctgacccgactcgcattatagcatttagcccgcaccagtcgtatatcgatgagaagatttttttagttttgttttagcaattaggccgatacagtatgaacgtgcataattatttttattcttgatatgtgtttgacaggttgttcttgatataaaaaatgattggtgatggttcaagatttgaggatcaggatgagtattgtaagtttatggctatgaaattcagtagtgaggatgaaggttttgctttctataaccagtatgcgaaagagaaaggttttagtgtaaggaaggattatagtaggcgtgatcgttttagtggattgatatttcataagcgcttcacatgctcaagggaaggatttaggaaggaggtgtatatggattattctggcagaactagggaacccagagcactaactcattgtggatgcaatgctcattttgagattaaactcgatgagataaaaggccattggtatgtaacaaggtttgtggcagatcataatcatcctttgtgtaaagctgatgaagtggcatttctccgttcacatcgtagaattactccagcacaacaggcaaaattggtggaattgagagatttaggtttacatcagcaccaagtgatggatgtaatagagagagaccatggtggttttgaaggtgcaggatttgttacaagggatttgtacaatttttttgtgaaaatgaagaagaaacggattgatggtggagatgctgaccgtgttattaagtacatgcaagctcgtcagaaagatgatatggatttctattatgagtatgagaccgacgaagcaggatgcttgaagaggttattttgggcagatccacaatcaagaatagattatgatgcatttggtgatgttgtcgtgtttgacagcacctatcgagtgaacaaatacaatctccctttcattccttttgttggggtgaaccaccatgggtcgactgtgatttttggttgtgctgtagtttccgatgagagggttggtacttatgaatgggtacttaagcagtttttaagttgcatgtgtcagaaacatcccaagtctgttatcacagatggagacaatgcaatgcgtagagctatcttacttgtgtttccaaattctgaccatcggttgtgcacatggcatattgagcagaatatggcacgtaaccttagtccaactatgctttcagattttagggtccttgtgcatgctccacttgaagaagatgagtttgagagaaaatgggttgagttcaaggttaagcataaagtatcagatgagaacaggtggttgaataggatgtataatctaaggaaaaagtgggcagcagcatacactaaagggagggtttttcttggcatgaagagcaatcaaagaagtgaaagtcttaactcaaaactgcataggttgttggacagaaaaatgagccttgtcattttgattgagcactatgaacattgcttgtcacgtatgcgtcatcaagaggcagagttggatgcaaaagcatctcagtcagtaccatttacaagcaatgactctactctaatagagaaggatgcagctcgtgtttttacacctaaaattttcaagaaggttaaggtggagttatacatgggcatgaattgggaggtaatagatactatagaggaggacaattgtgtcaggtatgtattgcaaatgattggcaaggatggtgttgtcattttgaccggcatgtttgaggaagcattgttggttagcatctgctgcccttgtagaaaaatggagtgcgaatacattccatgcaatcatttatttgcagttctgaaattatttaaagttagacaccattccgaccttctgcatagcacgtagatggactatgaaagcaaagaatgcatttccttctgataggtatggttcaatttacacttggtcagaccaaatggaacgctatcggctgttgcgttgtttgggtagtgaagcttttttcaaatcatccatgacagaagagagcacggtgaaagtaatgaagatgttagagaatctaatgcttgaagaggatagtagtgaaaattatgaaaattttgacattgagtttggttatgtggttgggcaaagtagccggaatgatattgaaagtggtgacatggtgcttgatccgacacaaattgtccctaaaggagctccgacaaagagaatgaggggtttcttggagaaacgtaagaaaagatgtggtttttgccgcatcccagggcacagtattcgatcgtgccctatatacctaaggcaagttttaccaagtaatctttttttttttgttctgtggtgtactttacaaatatatatgaggttttttttattttttttacaggaaagtgaacgaagatgtgtgattttgctgtcccagagggtggagtacaggatggctgtggtgaacatggatgtttgtatggtccaacatgaagtatattgatgttgtgtgcgtacagtttatattgtttgaacatgttccaaaattgtaatggacctgaagtacttttttatatttgggttggatgattagcatcttaatatgttttgcaattgagtcaaactgctgatgatgttactcagtacttggaaaggttgcatgttggcttcaagtcgagtggatgctgatattgatagcatcatgtctccaggtttagtggatgtgctactgttactcagtactttggataattgtagtgcataccgaagaagtgtcgcaattgagtaatctgaagaataacatcgaagcatccagtgactgacacaacaacacatagatagttcctccatcttgacaagcatccattaacagatagttgacccacataatcaagtcttaactagcacataataagattgtactggaaaggtcaaccacataataaggtcttaactagctttacatcatacgaatttggatggcattacatattgccagacaaaatggtgattttcatccaccacactacttgagaacatgaaccttcagaacaagaacgtcgtcaacctccttgaaatggaaaagacaaacatcaccctcatcgaatgcttttgcatcaatcagttggttccatccagtggtcagcattgccctactgtccttggacctcttcagcctcatttgatatgactgtgttgttccagccatagacaccatcagatcatcaattggactcccaatgtacttgtttatgtaccgctcgctaaactggactgcaaaggtctgcaagaaaagttgattagccatagtacaaactacatgaagcaacaaagtcattttacataccattttcgcattggtcataagggttctcttgacagcggcaaatttactgcggcaacgtgagcaatttgaagatgcatactttttgttaatgtgacatcatttccataccagcagtacttgtcgaatccagagaaagtacgaggtccatattgtcctgttttttagagttcacatacacaagttcatatgacttttgtaatcattgaaagctaaaactgaaattaatgagaattaataaacacctgttgtaatagttgaacggcgcacgctttgataaatcttgtttatctcaatttgtacttgttctgctcgtgtttaatccaaacttgttagtaggtgtaatgctacgaaaaaaggataaaatcggaagataggcatcaccatcgtcactatctgatgaaatgtcaatgacctcatttccgtcccccattgctacttgtgtttcactctaagtgacaagataggcatcacgatacgcatcaaaaatggaatataatgggaggaagcagaacctgatatatggtgtcgtctccgaaatcggctcttaccacagctcacctcggcgactctagtcggcacactgcactgctcggagctggccgtcccaccgcgagctcgcctgcagccgtgcaaccggccgcagcgcctgcagtgccgaggacagcctggccgcctccagtgccaaaggaagaagaaagagcagaagaagaagaagaaagaggaagcagtaggaggagaatggttgaagaaataaggggacgaactgagttggctgctcaccttccatggttaatgcacaggggagtgggtggatggataagtattagtaattgtttggtggacagtgtaagtgcgtattggtaaccgtgtgcgcatgcaggaattaagtactgctgtctcaatttagtaacgtgacacaaatcttgtacatctgggcatgttatacacacttttgtacatctcgacacgtatagtaacgcgtaactttcgtgtaccagtactgaacagttgattttatagtccgatgacaagtaatagacttaggaaaacacctgcagagtctctatgtgttgcgcataggacacccggcatggtccgaaccaccgctcctagtctcgacgtctctagttaattataatttcattttatatgatttttttgtcaattccgttaattataatttcatttttttataatgccaggtcggatagtagtaaattcttgtattgatggttggactagcgaaccaaccaactacctcatttagtactcgtccatatatgctgcttcggttgtagctagttgctggtcacactagtgcatccatcaacctcatcctcactccacagataacagccatggtaacaagcaagaaggtacagaacaacgaagctgcaatggcggacggcgctgttaaggtaaatgaaaatacaagtacctttcaacgatttttcaatttttttttcttcaccgatctcgtgtttgtaggaatatcgccatggtctgtgcatggatgtcccgatgtacattgaagattcggagtattgtggagaggagcttggcaccagactaacttgcaggcatggcctcacgccgaaacggaggacagcttgggaaggacctgacacaggaagaaggttcttaggttgtccgctggaggtgagctcaaaagtccttgaaaacaaaagaaaattcattcggttggtttttacgaactgttattcgtttcaggaagaggatcagtgcgataaatttttttgggtcgacgaaccatggcacccaagagttcagaagacacttgagcagatgtggcatgcagtggaacgtgctaccaagctaaccggttcgaaacaatatgactggtgttgtttcgttcggaatacaaaggccgaggaagaaaaaatgaagttagagttagatacggctgaccatatctctgaactagaattggcgtataaaaaaaattaatgaaaaagaaaaaagagctcgacgatactcgtgcgtggttaatgggatcgtttgtagtaattgtcattatgttagtgaaaattagtgatctcatgtacaacaagtgattacattggatgtaatattttctttaaacttccaacttttccatcaaaattatcctacacaccctaatgttaatttttcgacggaactgcattcatacttaaaccgtgtaaatgcatagttttgttgactgctttcatacttgactgcagtgccgttcttgactgctttattataccgagtggaatgcacgcatgtatatcagttttatgtgtggtgtaccgaggaggccatgcaacaaaagcagcccatattcgctttggaaacagaatagactataatggcattgattgctacacggctgcatgcacctgacacagtggattgacgtataatatatgccgatgcacagtgagatgtgtacatttaaaaatcaaacgacacaaaacctgtacttaagttcaatacaagattattccggtgtcattaactcgtttttttgctacacacatataagtagagagtttcagttcaaatttcctacgcacatatctgttctaaacatttctatggcagacaacaacacttccactgctcgtcgccgcaaccctggcaaaagagggcgtcatggtaggaaactacctattctctccgtggtatgtatgttattttaaaatttatttgcttcttctcaacatactttttgctcttcacttcttgtacggtgatttacttgcatgcacttttctcattcttagaaaccaagggaactgaccattgctagctccccacataaatttgtaacaatggtgagaagtttgaatccactccagacagcggccatggaaaaaattggatttggaggcttgttagcaatgccagagattaacatcaaccgggtaatttgtatttggttagctgatcggtacgacgtcaaaagccaaacaatattgatccaagacaagagtttaccgatcacactttgggatgtccagtgtatattggatattccagccgaaggaccggtgatttccaaactgccgccattgatcacggaggattacaagatttattctaggcacaaggatggcgagagcaagaatatttcactcatatcattgcaagaagcaattttagaagaatcgaaacaatctgaaatcaacgaggaagatttcattagaaggatgatgtttttcaccattgggtacatcctttgtcctactacaaaggcccatgtcagctccagctatctacctttactgagagatgtaacaaaaattcacactatcaattgggcaagcttaacaagggaacatctctgcgattgcttgaaggaattcaagggaggactaaaaaatattgaaggcaatcttccattactgcaggtactatacaaacctatcacatgctgaatttattttcttattgtactcaaaatgcttattttttacattgcattcagtgttggtattgggaacatgtgaaggcagtaaactctgagttctgcaacatcaattacaatggacgtcagattcccctgatttcattctggaatgcagccaatgtcaggttgagaaacaaatatgactgcagaacagctgaaggggggggattggtaagttactgcacatacagaaatactagttgcagtagtagatcatatgctaattgctgccatatgttatacagattattgaacagatagaacatccagactttttgaatgatgaacagaggtatgagcatgacacgcatggctttgaagacagagaaaatgacttttatatcaatgaacagagaattgaggaagacactgcctttgaggaactagaaaatgactatcccatactttctgacaacgaagaaatagatgcacaacaatcttttgcatatgctaatgatcacatgccgtacggtactgacaatgagaaggaaaaagatgatgacagagagctaaatcagtgtgaggatgaccatgaaacgaaaatcaaatctccagcaaaaattgcagccgtagaggtaatacattcttagctcagtttttttgagtgcacattatcaacaaaaaattacttcctacacataatgtcataaccaactgcttctttcttgtagcattcaggtcacatcaaagtacttgttgacatgctccaacagttagaaaggtccattcagttcatggagaacaaattgacaaacaagttactttccgtggaacaaatatgccggaaaaacacactagccatcgaggtaagcataaagcagcactggctaaatgaactgcataatatatagcttttgttcataatatatagctaaatgaactgcaactcttacaggacatcaaaaacaccctgtccaaaaaaaggaagtcagtccctatacaagccgatgcatttagacccaaacaagaagctgatgtcaacaaagtcgaggataatcgaacattcgatttaggcaatgaaaggatgcctaccatactgaagagatgcatgaagataatacggtgagttgtactgaactaatttacaaaactattgttcgagcattcaattttttatgtcttcttctctaggatgagacaaatttagccaaagagattgatggtaatggaacagaggaagctccgttcataatcactggggatgaagcaactgagacagatgacaataacaaaaccattgcagaaagactaagaggtcagttcggaaggacagtcaagccatcatatcaaactcaaagtgatttcatattctacaaacataacaaaaaaacattcgagcccaaaattcaaatatccaattcaggatcagcgaaccttggtttgacattgaaagataaaataacaatcaattacatcctccagtcagaaaaaactaaggttcttgccagtatacaagacatagagctatcacgtgcacatctactgccacttgtaacgccgcttgatagttcatcaaaatcaaaatggttgaacacctcgttaagattatttttatctgttataataatttctacctttcccatacatttctatatttttttttattttgcaacaggtcattgaagcttacacagaactcataaacgacaatcaacaaggccacaccaggcagtacggttctgctctaattgagaaagaaacgcaagtccaggtttggtgtgccgttggtaagacaagaggaaagccaagtaaaagatacattgaatccagatcaacgtttgcccaaagatacatggtccatgatatggtactaaatcaggtcatcatttatttttatgcctttccaaaaactactttaacttatgctatttcctgaaggtcttcctaccaataaatagggacaaatcgcattggtacgtaattgttattaatgcaagatgccaagaaattcaaattcttgactcaatgcagatgcagccacaatggtacaatgcaagcgaagatattaaaaacctagtaagctccatcgcaataacagttcctatatgctataataacatatgttctaagtaattttaacacataacagatcaatggcgtggccaagtatattgattacacggtgaaagaacgtcctgttccaacatcctggactgacacaaatgttgcaaaatggccactgtgcccaaagagtgtacctcaacagaaagacaggtgaaatatcatcaatacgcttttaactaacaattattgctaactgacattctcaatttctatggttagttggtcatgtgggttaaatgctttgaagttcatggagacctgggatggaaaggaattaacgagcgacttcttaaatatggtactgctccgaaaagtactaagctactatgactcacattttattagtgttacacatctcttacacatatttttcactccctcttgacttcaggaaccgaatgaagttttcagactaaaggtcgccgccaacctaatcaacactactctaaatatagtgcttgctgtccacgacgacatcagacgtctacattcagaaaattcgtccacatctgaagttacaatgaagctttgaagccaattagtggcatctttgaaacactgtatttccatctaagtgtatctatctaaacttttatattatgcaacactgtttttccatctaggttatttccaatcaattatcagccatgtattcaaaactactatctctattttccaagctccagtcaattgcaacatttctttcaaactgaaaggaagaacaagtgcttgatgttaccttacccggcttagctttttccatctgcgcgaaaggaaatacgcccgcaacacctctaccttcgcagggactcaactcttcgcagtgtagcacattgatcttccggttcttctccgttttcctacgccacgacacccgcagcaccttatgcagccgcatctccccgccggtgcttggttctgaacaccacacccatccttccctccgcctaccacctccattgctccaaggggatcattgcgccggcggaaacaacggcacgcgccgatcgaccggacgagcggatggaggcgcgctcgttccagatctgagcgccatccccccatcccctgcgccggcggcagcaaaggcacgacgcatgcgccgatcgaccggacccatctttccttcccctgcgctggttctagagggggaaatccctatgcgtgggccaagaaatcgtcgagaatcagaacaaaacagggagaaaaggaaagagatggcgctcagagagaaagggaagagaagccccggtctgatcccggcaggaaatcacggacccctacctcgttacgcgaaaatacggttttaccccagcggtaccgccccaatctgcgcgtgcggtaccacgcggtaccatccaatctcagccgtccgatgaagctagatcgacggttcagatttggtaccgccccctttcaaggacagtaaaaactctcattagtcatagtaaatacttacgaatagacaatagacccggtcctttgtttgtttttctgatttttctgcatactccatatgcagttgaacgtgtggccaacgtacgtatacctgtacgatcgagttatctataaaaggaaacccatcctgtcccatgtcgttcaattaagacagtacgtccacgtacttaattaattggctgctacattcagatcatcacttactcatcgatcgatcggcactagtactctattaggaatactctagctgattacattgtataggcctgagattaattgtggatctctatattcctaatagtttcataacaatcagcttgatcgatcttacagcttaatatagctagctagctaaagttcaagatcagagatctcacaaacatggcatcgtcggcgtcggcgaagttggtgagggcgttggtggtggcggccgtgctgatgcagtgctgcggcgtgctcctcgcggcgaggccgttggccgcagccggcggcggcggcggggaggagatgttcgtcgtcacgccggagatcctgaagaccaccggcggtggcgccacaacgacgcctacgggcaatacgtgcaaggaaggcccgacccctcccagcagccccagcccaccatgcatcggcagtactcccggccgccggtagctagctagcttagcttgttacttagttttaattaattttctttgtcgcgaacacgacgacctcgatcgatcaagctgattccggccggtttttaattgttttccgtacgtagattttttttttcagttaatacaataaaatttctgtctttgctgcttagtattaatcagtagtgcatgtaattaacgatattggtaatggatatgacatattctattatcacaaatatgaatagatgttagttttttatgggacggagtgagtatgtattggtatatattgtcttgaaataaaaaaaaaacactgagactatcactctagagagaataagaatgcatttttcaaatacaatttgttaatcaccatgttacggagtactcctatgtagcaagggcttacggctcattgatttaaatgtttaccatcgttggtaggccgaaatgttttaaccatatccaacagtccagcttacacgtgagacgtgacttgccttgcggaggttcacagccagcccattaactttcggagtgggctaaataacctaataaatcgttcaaggacatggaccgtgtacttacacggctggaccgggggaaaaaaacaaattatttactagtagtgcctgcttacgaatggaatagaaaatagacttgttccttaattttttttagtttccaatgcatgcagttgaacgtggctaatatacgagttcgagcgtttttaacagtcttttcaattgattttgtaaaccaaattttaataattttagaaaaaaaaaatcctcctctaacacctctccatccagatgaccaagataatccacctgccaaagttctcccctcattggccaaattggctaatcatgggccccacgtcatagatgctcatttcccttctctctatccccgccctctctacatccaagggagggagggcgccattgctagggcggctcgacggcgagagaggagtgagggaggaaggctcgatggcttgtcagtcgagcctgccttgtgcacacggttgttgaggacgatgaggccaataggaggggacccgccattcgccttgccctcacggatccattgtcgcgtgcatgagtccgcctcgcacatccggatatgttgtcgctgttgtctcctgctgtcaccgtctcccttgcaaagcgacactgtgcgggaacgccgtcccctagcagagggagaaagcgaggagaaaaggatgagggggagaaagctaacacattctttatcattttggagatgtttcataaccgtattggattgatcaactagtttgactacctaaatcaattaaagagctaggtatacacatatttaaaaagtctagattttaggcaggtacctatgaaaagaaaccagtcatgtgttcagtggcggatccagaaagaaatagcactagagtctgagcaaactagatagagttaccgttccccctcccatttacatatggtaaaaaattttagtaaagtcttcgtgggggcgttttcacctaatagtggaggctcgaaaccctgtcgccttcgtgctggatctgcccctcatgcccccatctcctcgtccttaaaaaaaaagggtaatttaaattataatgagatggtttcaattttcccttaaaaaaatcccccagccgcggccccaaattctcagcccagttccctatccgcactggacgaccggcctggccgagcagacgcagagccttgtgccacggcctgctctaacgcatgcgcagcatcagtctgatccctgcaccacgcgcgcgcgcgcgcacgcacgcagaattcggcgaaaactgcagcatttacacatgaattcaaccagtcgtccacgcgccgcgactagctagcggcaggcatcaacttaattaaaccgctgaattagtaatccctcatactcgtaaagaaagacgtttagaatagcgacacggtcttcaaaacataaatttgacttcttttttctataaaaatatttattaaaaagtgatatatgtattatttttcaagacaaatctattcatataatttttatattttcaaactcaacaacttgagagttattcatgatttatattcctaaggtttgacttaaacgttgtcctaaacgatttttttatgtgtacgaaggtagtacgtagctgaacagagccgaccaaatcgcgttcgatcgatcgatgggcgataccgagccgtgcgtatgtacacaactcgtatatcattcttttcttgaaacccacgcaatcgtatcatgaaaacgtctacacaactcgtcgtatactcgtatgtgtgtaagtaacggtccggtctttcggcgaggcgtatagtacgtgcgtgtgcgtgtgtatgtacgagcttactagtagtagctactgatcgatcgagttaagttgcttgtttcagagggaactaattaattaactggtcgaacccggccgttacgatcgaggaagattcactggtcggtcggtccaaacgaatgtgtcaattcaagggcatggacgctcgatcgatcggggtcaaggtcgagttacacacggattaatcagaacgtccgtacggtcctacataggcacatgactagtacttcgtatgttttaactttgatcaaaattaaactgctttaactctgatcaagtttgtagagaaaagtagtagtaacatttttaacttaagacaaatttattatgaaatatattcaattattgattcgatgcaactaatttagtattataaatattactatatttatctagaaactcagttaaacttaaaataatttgactttgaccaaagtcaaaatatcttataacttgaaacggaaggagtatcatacacacactacctctatctcaaaataaatgcaaccgtggagattcatgtccaacggttgactatctgtcttatttaaaaaatttagtcacacataaagtaatattcatattttatcacctaataaaaataaaagtactaatcataaactttttttttcagataagacgaacagtcaaacgttgaatataaataatgtaaaactacattaattttgggacggaggggctactaggtctttgtaggagtgtaactgtatatacatgactgattaactttgccttaggagctgtttggttcgttgccatattttgtcacgccacactttagtcataccatagttttttaggcatgtgtttggttcgctgccgcaattatgttatgccacactttgggacccacgtgtcatgctctcaaatttagagctaagcatgccacacttgtggccaactatttctaagccatatttgtgccactatgccacaactagcctaaacttagttatggcaaagttaggcatcaaccaaacatccccttagcttccatagtaatactcacgcgtagcagcactacaactgctgctgcacgtcttcttgaacctaactagctattcgtgttcaaccttggacatggactgcgctgaaaaccgcgtacagtggcatgttatgttgttaattaattagtagtactactggtaaactcgtacgattagacccgttcatctgttaagatttttactagtacatgcagttcaacgtgtggtcaagtcacgaacatatatgaactgtactactataaaaggaagcccaggttgtctgatttcctccaacaaattaaacaagctattactcttttctttaatcaagctagctacccattcgacgtacagcaaacgcactttctgtctgctatattcaattcactcgtcgtctcactgagctttacaccattgccgagcacctagctagctagcttaattaagaattcatcaagaaatcatataattaatggcgtcagcgtcggcgaagacgatggtgagggcggtgatggtggcggccgtgttgctgcagtgctgcggcgtgctcctcgcggcgaggccgttgaagggcgacgtcgtcgccgccgccggcggtggcggaggcggtggcggcgagatgttcgtcatgcagatactgaagaccagcaccccaaccacgccggtaggcaatgggtgcaaacaaggcgagaccggcggcaacggcgcaccatgccacggcagcggctagctagcttaattatactactcgatcgccatctgctgcatgcggcgatctgacaccggctgcttctctgtttagttgtatgtagatgtcgacatgtatgcatgtaaatatatactagatgatctgtagagattgtttcattcattatttggtttttaatgatatatgcagtaattaggagcttccatatatgtaaagatggagtgtacgttggaagaagtcgaatgatgtatatatagttcatattattcataatcagtgtagtagtcaataattagagcatatcatgcatgcaagtagtatctctgtttttaaatataagactccattggcttcttgatatacacttaactattcatcttatttaataattttgtacaaatataaagaacatcggatgataaatcaaatcacgataaaataaataataattacataattttttaataaaacaaatgatcaatctatcttaaaaaattaacggatcatatattaaaaaacggagggagtatataggagagaaaatagtcagacaattgtaattaaattgtgtaaagtagttttcgccagatgataaagatatatagttttatttggattaattcaattaattttggtatttgatgatgatctatatatgcatttatattagttgaccgtttcaactttgaacactaataattattaaattgttagactacaatgaatgaaagtacatatatgtattgtgtaggacgtaatatatatatatatatatatatatatactttgatacgtatttatatatttatttaaaaaacaatttacaaagtgattgcaaacagaatgtaacagcaaggagaagaacaaaaggatatggattttcatctctcaagaggatatcctcttacatgtcatctaaatagttataaaaaaataaaaaaaaagttaacaacatagattaaatataatatacatcactctacaaacatgcgaaaccaaattcaacttttacaagttgcaaaaaaaaaactgaaagttatcattcattcacggttatatttgttatctttattaaacttgtagtagtttgaattttaacttttatgtttgtgaagtgatatattttatattaacctattttattaatttttataattttttataactatttaagtgacatacataaaacgaggggatggtgagatctatataatatatcctcttatgagatgaaaacaatacaacatgaggttgtctggcatgtaacgtgcatgcatatataatatatattaattgttcttacatatagcaaaacatgcctgctacatcttacacaatttgacttaactatagttagacttggtcaacattgaaatatataaaggtcaacatatatatgtactcaagacatagcatttgaccgtcaggacatgtgagacgagatcgagctaggtagtaactaaacaagcaactatagcatgcgtcaaatgggaaaaattttctaaactctcaagggacgtccccatgttatttacatatcacttaaatagttaatttttttaataaaatagattaatatatgatagatcactttgcaacctgcacagtaacttcaacatgttgcaatgaaaaaaatatatttgacttaaccagatatagtttaatttatctttttataacttgcaaaagttaaattttaacttgtatgttgtagagtgataacatgttaacacttcttctatttttctactatttttttataactatttgagtacaataaaacaacgaaaggacatcttccagagagtttaaaatccactctctctgcgttagattaagatctcgatatgtgcaacgtagagagtttaaaatccactctctctgcgtttgattaagatctcgatatgtgcaacgtagcaggctagctaattcagtttttttagatcgatcgatcaattgagtcggtggtgaattggtgatgagtctgcagcaggtgactcatcgatcgatcgatgcgcgtaaaataaacctgcccatgaaaccaaaccaatactaatataatcaaaatcaccgccactttctcggaagtcataaggactaatttagagcagatacaatagcaggctctaagctatttataaacatattttaaaaagataaaggaagagagaagagaagtgggctacagatctatagctagctgcagcatggactccaaaacgtaatatgtatatgacaggtgggaccaagtattaatagtatagtaagcaactattgtataaattggctattacattggctatagatgatttggagcgagcagtagactatattattaaacttgctcggcaaggcagccagcaagtctgatagagcaacatggactgacgacagcggccgggctagcttgcttcaccattcatatagtcatgcatatgcatgcaccaagtaagttcgctcgtaactgcgtacatagctagtaattaatactgtagattatgtaaagtactacgtagtaatcagtcagtcagttatttggtcatattatatcgcgatatccacggtagactagctcgtcgaatacgactagtagctaactagttcatctcttcatcgatcgatcgtacgtgtcgtctcggcaaaattgtgtgtagttacgagatcgacgtaagttatatgcaagccgggaagtatacggccggggtcgatcggtggattggtccaacaacgagagctatagctcgcgcaggcaaagttactattttattaaactcattaaattacatctagatgatatatttgttctacatataactgagatgcacacaattaaaaaaaaagattactaacgagtacgtacgtatacatgcgtacgaacatggacacacatggttttattttgatcgtacgtatgaatattatcttgaatgaatggtatttgtacttgtcaatgtcaaacatacgacgattgaattaaacgtgaccgcggctcgctcgctagctcaaaaaaaccgcgtttttccgcgaggcgaggatgacaataaaaaaaggcttaaaagtagcgccttttacatagcgccgacgaatagacccggtcccttttgtacgttacgttgcacaccaaactctcttccctcgctctctatatatagccagcccatcctgtctctcttccaacaaaccgcactatacactagctactaccttctccaattcatccattttcacgtagtaatatatacgcagcaaaattaagaggatttaattcttgtctgccatatctctgaaacaaattaaatctagtagttagtacacagtagtaattaactgcagctgaattcgatcatggcgtcgtcgtcggcgatggtggtgagggtggtggtggtgggcgtgctgctgatgcaatgctgcaacgcgatcatggcggcgaggctgctggaaggcgacttgtttggcagcagctggctgcagggcgaggacggcgtcgccgccggcgagctcatcttgcaggtgctcaaggtagtgccatcgggaccaccaggcaatgattgccaccaaggtggcgccggctccggaggccagtgctaccagccgcctaagtagccgcgccggccaccggcgcaccggccggcgccgccatggacgatatggatcgtggcccggttttgctcgtagagtagatcgatcgatcaactgttcatttgatacgatttatttgttctatatatacgcctgcacacgtagagctagttagcttccatgcatatgcagaaaatggagctttgcaaagctgttcatagttgtagttaggttagtcaatttaggcgtattgatttgtgtaatagcgtactagtccgtgacatatagctagctaggttgatcctcaatgtatatatgaatcatacacacttgtcaatacaagaagagatttacacagtgatcgtttcacacatgctgattaatttataaataaactatataagctgcaaattactcatcaacaacccaaaaaacaatttgtcaataaaaacttttgtatatgtgttcttaagcaatttagaagcaaaggctaaaaaataaactataataaaagaaccctttaatcaactccaaaattaagttttcaaattcaaatttgtgttgctgcttataagctggaatgtaccttactttccttttggttttcccttttaacacaatatatatatatatatatatattgtggtattgttggaagaaatgctatcttgacatggtactaagggaaggtatatatggaaactttgtggtattatttgatacctgtgaattttttataatatcaccgaagtttaatcttaaatgaggatggattgagaaaaggcgtaagattagttgaaaaataaatgagaggtgattgtatagtagcattgctaccgttgttccaaatagtttataaggcaacaaggtggcaaagagttccctccctacaagagagaaccgaagcttgaagacataggagaggagatgagttgggtgggacaggaaaagagggcaagttgagtcggctgactcgtgatagaaaatgagagggcaaggaaagacaggcgagcacggcctggtggatgttgaactcaattcctagatctagcatggcaaaacctatgcaccaaagaacgtggcgctaacatgttggacccaaggtttacaaaaccgtatggttaccacacgattatcacgtgcagtaatcttctcagtttttgaaaccacggtacatcttacggtaaccgcacgtttaccgtggccagtaacggccaaaccgtggggtggcggtaaccacggccaaaccgtggggtggcggtaaccaccgcaaaaacggtttgggggaaccctggttggacctgcgccatactcgatgaaaccaatgtcgcgtgtttttggttgaagatatattttggcatgatctattcttgttataataagtttttgcaactagctaaatggtcaaaaatgctataattacacgtagttatatgcaaaccgtgaagacgccggtcggtagtccagtaacgggagctatcgcaggcaaggaccggagtccggaggtcatatatttggttgatgggaatgtagctgggcacggtacgtagctaacaagcaacaacgtatgtgcgtacgagcctggctttggttgatcgtatcaatgatcttgaatacttactagacttgtcaatgtcaaacgtaggaaattgaattaattaagcgtacgtgaccgcggcccgctcgctcaaacaaaccgcgtttttccgcgcgcgagctgagacaaatatcaatcaaattaaagcctaaaagtagcactagttcgttgttttacatggcgctgaagaatagaccgacctggacagtcacttctgttgcacgtatatacacagccaccaaaactctatatataaccagccaatcgatcctgcctccccacaaccacacaaacaactatagtttcagttcttcagccattttctcgtacgtacgtacgcagccagcttggattcttgtctgccactccgaattaattaatttaaacaatctagccgattgatcgaatcaacagccgaattaatcaagctctagttaggttgctactactagtacagtagtacgtacgtactgcagctgaatatatatacatggcgtggtcgtcgtcgtcgtcggcgacggtgagggtggtggtggtggccgtgctgctgatgcagtgctgcaacgcgatcatggcggcgaggctgctggaaggtgacttatttggtagcagcagctggctgcagggccaggtcggcgccgccggcgagctcatcttgcaggtccttgacaatggagggtcgccgccgggaggcaatgattgccaccaaggtcccaatccaggcggctccggatccggaaaatgctggacgccgtaactagcctcgccgcgccggcggccggccggcgagcggcagcttatgtgcgcgccggtcggccgccatggatggattcccggaccggttttgctcgttcgctgcaggcgcgcgggacgttaattaacatgtacatgaagatctaattaagttcgacatatatatatactcagctcctgcatacgtagagattgttcatctgattcagttcttgcattctttttttccctgtaactgtaagagcttccatgtaaaagtggagctttgcaaagctgttcatagttgtagacagtagacttgtagtttagtctagtcaatttaggcgtactgatttggaacaaggtaagtcagggacatatatagctagctgggtcctgaaagtgtgtaatctgaggatcatgtgcatggatactgtccgacacattagaagaaatttactttccttttggttttccctttaatacaatagcgtgattcgcttttatatttgtgaagtttgcggtattgttggaagaaattaatgctgtcatgatgttgtagtgaagggtaaattttatggtattatatatggctgcaccgcaggcatattgttggaagttacgttagtcggaaatggttagtatgatatcattattttattatttttcggaaactggcaaaaatgattggaaaatttttatatttatgaattgaactatttagtgtcaacttcaatgccacgcttatagaaattgggaaaaataaaatttgaaaatggtaaccgtcgataaaaatattattagtttttcggaatatggtatcggtactgtcggaaaacttccataccacacatataaaacacacacacacacacacactacccttactattgactttatttgtcttaaaatacaaaagatttaggagctaataagcactactatggcatgtgtcatattaaaagtctgtgcaatgaacaatagctttgggcatgtttagattcccgggtaaaaatttttagcatgtcacattgaatgtttagacacatgcatgaagtattaaacataggaaaaaaactaattacacagatcacgtgtaaattgcgagacaaatattttaatcctaattgctccatgatctgacaatgtggtgctacaataaatatttgctaatgacggattaattaggcttaataagttcgtctcacagtttatcggcggaatctgtaatttgttttgttattagtctatatttaatacttcaaatatgtatccatatatccgatgtgacacgctaaaacttttcacccctaaatctaaacacagcctttatcggttggctaagaaccaattatatatcaaagcgacttatcaaggaaaagattatggctaaagcttttatatgttgttaacaacttaaaagacgatcttaaaaaatatatcctaaaatgaactctataattaaagtttaaagtttaaaatttagcatcagttgaagcgtacgatgaggccctaattcaatttgagatcgatgggtgagtctggtggtgaattggtgatgtggattgaagtcagcaggtgactgatgcatgcgcgtaaactaattaaacctgccggtactatacgcacgcactgcacgtccggccgtagacggtgtgatcgatttgatcgaatgaacatatgaatttcacagacgatatcgatcgatcaaagtcgccgtcactttctcggaaagttattataaacgacctaggtttcaggtaggttggccaatgcagcggccgggccggcaacggcagtcagagagcaacacctgaagtttgctaagagcaagggtaataatatagccagctgcttacttatagcctatctatcagctcactcatatagtggttaactcttcactgtaaacatatggtccacctgtctgtctcacagattttcttggttcctgtgcctaagccggctgtaaacttatagtccgcttctcatctctctcctctcctctctcatccacctcagtattcagccttcttatagctctctattatacttgctctaactctagctcacaattcatgcatatacaacaactagatcagaggcggatcaagagcatgagtacaatggggactcgagcattcactactcacaataacaccatggaattcttcatgaagttttcactacaaattttgtatatacatatgaaagaaagctatagatttatcttagtttattcagacctttactgttttttttttggagccagtccagtcggtccgatcgatcatatcgattggcggctgactaagtgactagctagctcgttgaatacgacgccctcttgctcatctgtcgattgaaaccgtctcgatcagccaaaacgtgtagttgattacatgcaagccgtgaagtacgccggtcggttggtccgacaacgtacatgagctgacgcagaaaaggaggtcaaacaacgatcgagttgattatcgtgaattcgtgatgatatttgaactactccttcatgggaatgtagtaggcaagtgaacaacgtactgtatctcaaaatcccttgaaatggcacgagctactactacagttcttgtcaatgtcaaacgtaggaaattgaattaaacgagaccgcggcccgctcgcacgctagctcaaaaaattgaaaccgcgtttttctttttgttccgcgaggcgatcgagactgacaaatcaaaagcttaatagtagtattataattagttggttgttttacatggcgccgaagaatagatccggtcacttttgttgcacatacctttttactttcaacgtacgtatgtatacacagccaccaaactctatatatataaccaacccaatcctgtctctcttccaacaaccttactactagcttcaattcttcagccattttaattcacgtaggcagcagccagcttgaattcttgtctgccatctctgaaacaaatctagttagtacagtattgtagtaactgcatctgaattatattcatggcgtcgtcgtcggcaatggtgagggtggtgttggtgtccgtgctgctgatgcagtgctgcaacgcgatcatggcggcgaggctgctggaaggtgatctgggcagctggctgcagggtcagggcggcgtcgccggcgagctcatcttgcaggtgctcaagggagggtcgccgccgggaggcaatggttgtcaccaaggtcccggaggcggctccggaggcaactgctaccaaccgtaactagcctcgccggccggccaacgcgcatctgtcgcatccatgggtggatcgcggccggttttgctcgatcgctagctgcagctggcgtgcgagccgttaacatgtagtagtgatgaagattggagatctgcgtagagattgatcaactgttcatttggttgaattcctttaattctttttttttcttctatgagagcttcatccatgcaaaaatgctggaaagcctcgcaaagctagctgctgttcatccatgtagaaatgagtagtttaattagtcaatttaggattgatttggaataattaaggtgatcctgacatctaggtcctgaaagtatgtaattagtcatgtttaatgcttgatacttgtataggtcatgaagtcacaatgaaacaagagatgctatactttgagaaacgtccacggccgggttttccagctagcttcacaagatggtgggctagctaacctggatttaaagcctcatctcttttatttatctgatattagattattctctaatattcgtgtttttttaaacaagagatgctactcctttgtattttatctttcctgttggtctccaacacactactactccacatgcatacacccaggcagatttactgccactatcaatataattaccaatgtatgcatttatgccatattacagatgaacagatttaatttgcaatcaaaagtaatatttatatccaaaactcataagcattatcttaaaaatttcttcgaacatttcctgatatgatggaaatcattgaggataatatcaatatcaatctcatctaataatttctttttattaaaaacatttatcaatttctcgaaagttataaattaacgacctataggcgcttcatgtaggttggcggttggccaaacgcactgcaatggggaaggggggggggtgctgacaaaccctgataacgtgtgaaccgggactaaagatgatcatctttagtcccggttggtgttaccaatcggcactaataattaaatagtgatgttgctcttataaatttggatttaaaaattatttttagtcccggtttttaataatggtttctccagtagtgagcagacagaccggcaacggcaggcatgaactaacctgaagtacagttctagctaactctagctcacaatataattcaagtatatgtagcagctagccagctaactctatatcgattggatgatcagtgatgagattgtgtgcgtaattatttaacttcgtcgtatacaacagctagctagatcagtcagtccagttcggctgactatagctctcgttgaatacccccctctcttgctcatcgatcgattgaaatcgtctcgatcagccaaaacgtgtagttagttactccctccgtttcgaaatgtttgacgccgttgactttttagcacatgtttgaccgtttgtcttattcaaaaaatttaagtaattattaattattttcttatcatttgattcattgttaaatatatttttatgtaggcatataattttatatatttcacaaaagtaagtttttgaataggatgaacggtcaaatatgtgctaaaaagtcaacggtgttaaatattttgaaacggagggagtacatgcaagtcgggaagtacgggtcgaacgtacgccggtcggttggtccgacaacgaacgggagctgacgcaggcaaggaggttaaacaatcgagttcatgatgatactattttaactaactactccttcatgagaatgtagttagcaaacgaacaacgtactgtaacctggctttgttggttgatcgtatctcaaaatcccttgaaatggccatacgtacagtacttgtagtcaatgtcaaacgtaggaaattgaattaaacgagaccgcggcccgctcgcacgctagctcaaaaaaaccgcgtttttctttttgttccgcgaggcgaaactgacaaatcaaaagcttaataatagtagtattagttcgttgttttacatggcgccgaagaaatgaagaatagacccggtcacttttgttgcacaccgcctttttaccaccaaactctatatataaccaacccccgtcctgtctctcttccaacaaacctagctagctaagcttcaatattaatttcttcatccattttcacgtacgtaggcagccagcttgaattcttgtctgccatctctgaaacaaatctagttagtaacttagtacagtagtaactgcagctgaattcgatcatggcgtcgtcgtcggcgatggtgagggtggtggtggtggccgtgctgctgatgcaatgctgcaacgcgatcatggcggcgaggctgctggaaggtgacttgtttggcagcagctggctgcagggcctgcagggcggcgtcgccaccggcgagctcatcttgcaggtccttgacaagggcacgtcggattcggaaggcaatggttgtcaccaaggtcccggaggcggctccggagccagctgccaccaaccgtaactagccgcgccggcgcgccgccggccggccaacgcgcatcgtcccgtccatgggtggatcgcggccggttttgctcgatcgctagctgcagctgccgtgcgagctgttaacatgtagacatgaagattggagatcttcatagacattgatcaactgttcattattggttaaatttattctttttcttcttcttcttttatctgtgagagagcttcatccatgcaaaaatgctggaaagcctcgcaaagctagctgttcatccatgtagaaatggagtagtttagtcagtttaggattgatttggaataattaaggtgatcctgacagctactagctagctacctctaggtcctaaaaatctgtaattagtcatgttggatgcttgatatatacttgtacgtacgtatagatcgatcatggagtcacaatgaaacaagatgctactcctatatattttacctttcctgttgattcttaatacaacagcgcaattcccttttatgcatggtttactccttgattctcactccttcaacacacaattttctctttttttaaatcagaagaaaaacaacgcactattatgtactccactgcatacacgtacacccacgcagatttactgccactatcaatatcttcttataaaagagtgtttactaaggtcacgaatttattttttgcaaataccctcatcgtgccaccttacctacccatttgtattttattaattattccttaaaatttttaatatcaagaaacaaacaaatcttaatgtatagccgcatgtaaaattaaataagacgaatattccccgtaacaaaaagataggcagtacatatttcgtaagaaatatatttttatgtattttagataatattataatatattttcttttagtatgcagtaaagtatggatattcaactagtttatatgaaaagtatactcacgcatgtttatatcaaaactaatgtattatcaataccgatcgtaacaccaaccgagattaaagatcataaagtcccgttgaagtttttaactgggactacaaatgatctttagtcccggttcttatttgaaacggaactaacgtgatttttgcatgacccggtaaagatcacttctccagtagggctagctaactctctaatatcgattggatgatcagtgatgagattgcgtgcgtaattaattaacttcgtcgtatacaaagctagctagatcagtcagtccagtcggtccgatcgatcataacaatcggcggctgactatagctcgttgaatacgaccctctcttgctcatcgatccattgaaatcgtctcgatcagccaaaacgtgtagttagttaattaagtacatatttacatgcaagccgggaagtacgggtcgaacgtacgggagctgacgcaggcaaggaggtcaaacaatcgagttcatgatgatactattttaaactacttgatgagaatgtagttagctaacgaacagcgtactgtacgtacgaattgaacctggctttaattaatttgttggttgatcgtatctcaaaatcccttgaaatggcactactacagtagtatacttgtcaatgtcaaacgtaggaaattgaattaaacgagaccgcggcccgctcgcacgctatcgctaaaaaaaaaaccgcgtttttctttttgttccgcgcgcgaggcgagactgacaaatcaaaagcttaataatagtagtattagttggttgttttacatggcaccgaagaatagacccggtcacttttgttgcacaccctttttactttcaaacgtatgtacacagtcaccaaactctccatatataaccagcccatcctgtctctcttccaacaatcctagcttagcttcaattcttcagccacttcaattcaaggaggcagccagctcttgaataattcttgtctgccatctctgaaacaaatctagttagtacagtattatagtaactgcagctgaattcgatcatggcttcgtcgtcggcggcgatggtgagggtggtgctggtggccgtgctgctgatgcagtgctgcaatgcgatcatggcggcgaggctgctggaaggcgacttgggcagctggttgcagggccagggcggcgtcgccggcgagctcatcttgcaggtgctcaagggagggtcgccaccggtaggcaatgattgccaccaaggtcccggaggcggctccggagccacctgctacccgccgtaactagcctcgccggccaccggcgcaccggcgcgccgccggccggccggccaacgcgcatccatgggtggatcgcggccggttttgcttgttcgcgtgcgagccgttaacatgtagacatggagatttggagagccgagtagagatccactgttcattttggttcaattcctttattcttttttttttcttccctgatgtgtgagtgcttcgtctgtccatgcaaaaatgctggagcctctcaaaggtagctgttcatccatgtagaaatggagtagtttagtcgatttaggcgcattgatttggaataattaagggtgatcctgacatctactaggagtctaggtgaaagtctgtgtaattagtcatgttgaatgcttgataattgtatataagaatcatggagtcacaatgaaacaagagatacactcctatatattttacctttcctgttggtttcctttaatacaacagcagatttcgcttttatgcatggtttactccgttgattctcacttaaacacacaattttctctttttataatcacaagaaaaacacacacactactactccacatgcacacacccctacacaaatttactgccaccatcaatatcttcttctagcagagtgtttactaagatcacgaatttattttttgcaaaaacccacattgtgccaccttacctgaaaaacttttttacaaacattaattggtggtgtattagcaaacgatatatatatcggtttacgatgcattgccactcgaaatttactccttaaaccttttaatattaaaaaaacaaatcttaatgtacagccacatataaggtgaatattggcctataactaaaagatagataacatatttcataagaaatatatattttttattttaaataatattataatatattttcttttttatatgtagtaaattacaagtattcaactagtttatatgaaaagtacacttgcgtgcgcgtgaacgtaggcataaaaaattagaaacttggtgaatggagccatacactcgcatcacaagtccatcacgtacgacatccgagatgctttacaaaactacaaatagtatgactaaactattgaaaagctacagataaatttattgagcttatcacgaaactatagatttaagacatactatcccaaaattacatatttagcactaaatctatcataaaactatagttttgcgatactctattctaaatctatgtaatttcgtcataaattttgtattaataaatttataattcagttattaagaatgtatctttactgttgatcaaaatatattgttttgtgaaatttactcattttttatcataaaatgttggatgaacttaaataatttcaatataatataatcgttttgatattatcattctattgctattgtgccattctataattctcaccccaaaaatttatatatatgtggattattaattgtacggtgtgatatattaatcaaaactagttgacgtggtaggcgacatacccgtcgacagcgaggcgcctatgataacttcgtcaatctccaggatttgccgtcccaatctttgaagatgctcataggggtagaatttgcatgcgtgcgtttataggggtgagtgtgcatgtgttgtaagtgtctgcgttgtactgtgtaattataatagaaaatattaatcaaaactagttaacctattagtttatccgtgtgcatctaacatgcaaatatcacgcagccagcaagctggccgtctagtctttatgttaacgtaatggcttgacgttggacttgatcaacaatatcaaaaaggtcagcatatacgagccgtggccacagaatgcattatataatttgaattgtttcagtacggtacattatataaatgaattaattaattattagaaatttgatgaattaatttgaaaaaaaataagaaattccaacgaagaatttttttgataaaattgtattatttcaggagtttcggaaccatactttcaacaatccataatccataagctataaacaacgcacccttaattcacagcagattatcccgcacataagtactcgatcctactgtaaaaccataccgtaaaacttcttcacattaaaagaattgggtaacgatacagtaccgttgcccaatcatcgttagccaattatctctcaatcatcgttagccaattcttttatttcacttttagatgacgtagtaacaaccaatgtcgtgcttaaatgtatgtgattttggattttttttttcagttgaaacttttctagagggagttaaggggtttctcccatcacttatgtctctatttttttatcagaactcaatagttgtgtgtctaatggctgtggccggagatgtaaacaatttttattatctaaaataatgaataaacataatgagaaaaagatcaatgtataaaattaaagattgtacatcgatctttttgcgagtcatatgtctatttcacccgttgccccgtaggcttgttaattaatttggctggtcaggcattttgactctccagccgagccaaaatgttcagaccaggaaagaattgacttcagacgtacatgctttgaataaaataaaataaactttgatttgaaagattcaatatgcagtctttggaattagaccgactattcacatactcctactacgtactctgtacttacgttgaggaatctaaattcagacaaaaacagtgaccggccagtatgtaagtactactacactatttgttcatttttcatctagtgatgattgagagatgtgtcaaacaaatgaccgtgatcaagagaagtacttgcagtcaggtgaaaatttaatggacctaatccaagtcattacaaatcctagctagctaggcacacaaagcaaccttatgcttggaaattgaagcagtacatgatagttgatggtggcagagtcttggcatgcctactaatcctttcggtaaaatttgacggctgcaggcagcagaccattgaagcacaactgggatgaaaacggtacggaaacgaagtgaaaccatctttatcgttttcgttttcatatttttttcggaatcagaatcgaaaaccccggatacgaaaacggaatcaaatattatcgaaaccgaaaacgaagcaaaaatgaatcggcgcgaatacggtgactaaaatttatcgaaataaaaaacccctcaaactgataaatccaattctcaagtctcaacggtcaacaattcatcataaaacataatcatataagtttaattgttaagtctcaaacagtacatcacaaaacacaatctatgaaataaattatctatatttaagagagtaatgttgttgataaatcctaatgcagaaaaaaaattcttatgcaacttcatatttgcataacaaatatttttttaaaaaaaataaaagccaaacaccatggtattcactattcagtacttaaaaaaagaatccagggtatttcagtcacaaaattttcggaaattccgaggaaatttctggaaagtttccgaccgattccgagttccgacagaaactgcccttatcattttcgattcattttccgagaaaatatttccaaattaatttccgtttctgaaaaaaaaaccaaccgtcagattccgttttcgaaaataggtctggaatccggaaagtttccgtactattttcacccctgcaactgagtgaactgactactgtactaaggtttgtaaattgtgatactgcatccgttccaaaattgtgtatacagtagtaccttttggatatttatgctatacactatacagtttctaatacacgcacctgatcattaatccctacattttgattatttactatgtactagtatatcgcttggttaaaaaaaaatagagaaataattttcaagtgttctgatcaagtcaaagtaaaattagcttggttcgttcgcatgaaattgtaaagtatggctgcagtcgagactcgcgagagtacgaatgcatgactaccgtgtagaagcagtagcacaggcttgagtagtcacaggtttttggtgtttgttggtgatcgatgcactctacacgtacgacgagtcactgccgctgcgtgaattgaaattttgaatcgcggtggcctatcgagcagggcacgactgcttctacctctacttgtgctccctatagttcctcaccggcaagaacggaacgagagacaaaacgaaacgacttcaaaagttcaaaccaaactctgccaattctgaggcgacatacgtgcggagaagatgggcatcaagcaccgcagcttcaccggaattagccgggatgattgcaaagcgacgtgtttcggctacgttcttggaacaaacgggtgctcgtgtgttgattaatttggttcgaggagtagcagatcgcaagtacgcacggcacggcacgaccactactcctgctcgctctgtcccattaagaaaaatactttttttttagtttttactccctcctccgtcctaaaataaaataaatgcagttttgcactattcacgtacaacgtttgaccgttcgtcctatttaatttttttttctatgattagtatttttattgctattagatgataaaatatgaatagtactttatgtgtgactaaatatttttaattttttcacaaaaatttcaaataagacgggcggtcaaacgttgggcacgaatatctatggttgcacttattttgggacagatgtagtatataatgttttgacactgtcttatttgaaaatttttatgattagtatttttattattattaaatgataaaacatgaaaatgtttgatttatcttcttcaatttttccatattttttaaaataaggtggtcagtcaaacggtgcaatgcatataaacgtttctttgtgggatggaagagtatagtgcaacgaatggccaagggacctgaaaaccgaaacgatcaaggtcgcagggttgaaacttgaaaggagaggctgaaatttggagtacacctggcagatccaccacggcgtatttgtttcagcggtccattcagacgtccaacaccaacagcacgttggccgcttaccaggactccaggagattttgcagatgtcaacactttgttacagcatgattagaattctatggaatcccatgttcttgatgcaggttagcaggcttttacgttaagcagcacagaaatactagtaacatgatctttatgtcactttggaagatgcatttgagacaaaagaaaaaaaaagaagaaaatatcaagtcaggttatcaaatttaaaaagattgacggtggcatataaaacctgttattgacacctgtgctgtaggtgttcgaccagaagaagaacacgactggaaaatagcaattcaaactatagtactaatcaagactgaagattaaaaacttgacctattcatatgtctgtttagaaattgaggtggaaggtctgacactggcagtttccaaaggacattttcagcagcgcaatgacaatttatttacaaaggcaaacattcctaaccttaatcagctaaaatccttcagccttctcttcagaacatccatggacctcttgcgagcatcctgcttgttgcggtttgaaaggcttccaaacaacccatctgcaaaatccttgtacttgtcacaaacgatggcaaccttcttgtagtctaatgacccatagttcctcccccttatcactggattcatgaaattctctggctggctgctaaggaggagattgactagctgccttatttcaaccaaacaatcggcgaatgttgtttccttacccaaatccaccaaaccggtcctataaaatttctcttccgcgaatgcctccagtaatttcaagtcaatgtcaaggcccataactgcattgacagtgaaccttttcacgccttcgttaagaagtgttgtcatgatagagtccgagatgtggctcattgcaccagaaaccatcttgtatagagcttctagcggtaaaatctcctgcgctgttgatactagcgtttcaagatagataaggacctcattcatatattcatttggattatctggggcttcctccactatccagttgacatcgtccaagagcaccataaattcatcaatcttgaaattggccaaatttatcaaagagttatatgctgcattctgggaggcttttaagacagcttttgcagtcaaaccggaatgagatctctgcgcaatacgctttggaatgccacacagttgagcagaatacaagaggaacatatcgcaggattgctcaagaacagaaatatttcctgcaagttgcatcatctgtgacatggctaacgagcgagcataaaccatgttcagaagactatcatttaacacctcaatcaatagcctgtctaggtaacccttcacaatttcatagatgtttgtgcgagcactgtaagaaaaatagctgacagaatccccaatgaaggaccggacgatacgacaaatatctggaacaccagaggaaaatggagccacatatggaaactccgggactacatcatcaggttcaaaatggaatgccgtgacattcatgttatactcatattccttctttataatcatctgctcatatgagtcattagcaaggatatcatctatctgctttcgactctcaataagaagcaactggtggtatttgtctttgtatttcgcaatgacttgaatcaattgtgcgatttgatagccatacttactaacagttgtgcctaacaaagtgacataatctttaacgaggaggaggtggctggctatactcatgcgagcaaattgatcctccagtatagatgtgatcttagcaatagcagtctcccatgttgattcaacttggctttcagacaacaaaccatcagcacttcgaagtacacgttgttctacaatgaaaaatccagctacctgagcaagtaagggttgatgggactcaaggaagggttgagaggtggagatttgcatgtccaagttgagctgcattagcctattcttgtagtaataatctcgaaacttctccccaataccaaggcatatgtgcatgtgatgtgcccggtacactggcgtgagatcaaaatttagtgttgattcctcatctgtattctccacatccaaggtgtacacatgctcatcagatctagcatcactatgtgcttcagcctctctcttccgggcacgcatttcctcatctttttgtcgagccatagaggcctgacttattgagacctgtccaatctgcttagccatccttctgatatgaacaagccaatcattaaactcactgcaaactttcttctcaatgtgcatctttatcaatggtatatgttttgcaactaccttcttcagaagtttcaaaggaatatttttcaagtagcccttctcgatcgtgtcgagagtcttaagcgcaggatgaaacttagcttctgcaatataaccattgcatgccatgcataaactgatgactttcacacatatcttcaacgttgttatggcttctcctatgtttttcttaatcgaatataactcaaaaagctcatcaagattcaacaatgtggcactagaaaccttttgcaggtgtatgttctcaccagttagcatgccctttagctcatcagcatcaaccaacacaccacgtagttcatcgacggccaggatgaaatcctcgtaatgaagtctacaaagctcttcgatctcaacttcctttttctttacaatactcctgaggttttgcatgagagcttcaggtttaccagaatcaaatccatgccgaatgatagggcccaaatcttcaccatttgagataaataaagcaaggccaagaccaagacctccatctccactttctattacactcctcttctttggctgagcagtcatgattcaactgtaaaatgaaagcaacataggtaataaagttcagtagaggttggaaattaaaggtcatatgataagtactatcaattataatgtgtagcatgttcagacaaaataaagcaacggtcaggccagcagaagagcctatttgttacttccttcttttaacaacattgtcatgcttttttttttaaggttaacattgtcatgctcatcacgcagacagatcatgttgagttcagcattactttgaactaaacaagcatgaagatcactatacagtcactaaactagtatggaggtcgtcctacagatggtgatattcttgtcatatgaaatcctaaatatgagtacataatatgtacagtccacattacagaaatagatacggatcagcactaatttcgtgcatcctcccttccttggcatttggcagtaaggagcttggcaccttaacattgccccaggaaattttggaaagatctccatcatggcgctgcaactaattggcaacgaaaatggatgcaacaggagaatttcatagagaaacgcaagaattgaatttaaaaaatcacttcccaaaagtatggaagagaggacattgtacaaacagaatatacagggagatgaatagagaatctggagaggggtgggactaaaactaaactcaatgtgattatgcatggctaatttaaaccattattgctattactgtaacatgacagcatgtaaatcattgtcactatcatcaatggtcaatccccataccaattaagaaaataccatacactcaacaccaccaatcaattgaaatgacaccgcatatcaaagtaaccatgaagtatcatcttcgaaattgaacgtaacttgatttattcagattatataggttcgaattaacaagagaagacaggagggattacaaattacctgcttgtgacacgggaatcgtgcagaggttctcaacgagcaagcgatcaaacccaaacagaaaagaacagagagaaaagagtggtgtggggaatatcaaacgacgatgaaagaaagaatcacagggcaatagaaagagatccttgttatcacccaaggcgcagagggaagcaaaaccaatgcaagaacagagagctatcctatgaaattggctgtggctctctctctctctctctctcgctctgcatgcatgaaatggaatacaaaaatagtgagttagccgtgcctctctccgcggcagatcttgactccttaatagcaggaactaagggtgagtttgagagataggggattgagaagattgggaagatacgcaaaatgagataagccattagcgcatatattttactatagaaaatttttaaaaaaacgcatcgtttagtagtttggggagtgtgcgcggaaaacgtgttttctcaccctatctcacacaaacgaacacagcctaaataacgttgtcagatgcagttttttttttttttttgactaacctgtgatgtcgccacctatctagctgatgacgcggatctcaaaaaaccgccatccccatccgttccaccatccatgggtgagggtgaggtcgccgctgctcaccggactaccctggggctcgcgcccactcgccggggcgccgctcctctgcggtcgcaggcgtgaggacccaaaccatggcgccgctgctcctcgctcgcccgcggcacatcgcgctcgctggaccaaaacacgccacctgccgccgccgccgcccgcggccggcgcttcctcagatctccgagcgcaccggatgccgccgccgctcccccgagcgctccggctcgtcgtctgctggtaaactcggcgtcggcgtgcctctctaggatttaccgcagttgagcgttagattaaatctcagccacaaatccaagttgggacggctgtgattctccggatatttctttgcataaggcgtggcgtaggaagggtaattttatcatcctactccgattcctagtagtctcctagtgcaagttaaatcgagaaactgtaagaacccaacggcccatattaatgcccaccgatccctctgtctcgatcccacctccttcgtctccgccgccttttacttgctcgtcgcgtctctctcaacgttcatctgctcgaggtgcatacatgtgatttgctttgctcctttttcttttattgcccctgattctgattctcatatgaagacttgtcgatctaagctcatattttttagataataaaaataatttacatctccgatctctgctataagacacacaaccaataaattttagtacttgaaaataaagccgtaaagtgatgggataaaacccccagctccctttaaacaagtttaactaaaaacatcccaaaatcatagactactagtagattctagcacgtcatacagtaggtactacctcatccaaaatagaataaaaaccccttggctaccgattctaaaaatatagcaccactacacaatactaggatgatttaagttcatgtaggtgcatacatgctattgggaatggatttggctataagttgtaggcgtgggattgtggtggattggttctttttccgcaattagttttgtcgggtattatgcttttccgatttaaggtagaggtaggattggagatggattaatccttattttaccgctcatcgtatgctttttccggtttaagttggaccatgaaagaggaattgaatctttttgtgacttggtttcgaatttcagggtggttggagcattatgttggggtggaagggaaactacttccccaacgaaaagcggcgacacctttatcttgtacttgatgactggtcacggggatacagcattcgcaagatcgatttgtcggttggcaatgacggtgatggggagcacagcatgccaccggccatattcagtttcgaggcaccccgtgctggtcccaagtactttgctggtgcctttgactccaagattttggcaatgcagcccgtggatccccagttcagcttcaatcccatggctggtatccctatctatgacgttcgcatgcggagcctggtggttggccctcggcaaaggccggatccagttgaccccatctacatccctgttggtggaaggctctttgctctctctgtcggttcatttcagctgctctacccgccgccagatgacgagtctgatgatcaagaggaggaggaggactttgtatgggggtggcacgctcttcctaatcctccattccagcatgagcatgtcacctcctacgctgtgcacagggatgggcgaactatctttgtcagcattggcggtgagtcctctgccacctttagctttgacacagcggagtctgtgaggaatggttgtatgtggaagaaccatggccagtggcagctgccgttctccggtcgtgcttacttcatcgctgagttggacgcctgggttgggctcagcagaaaacctggcaccaccaccagttggcgcatatgctcaatggatgtgatatctgacgattgcgagaatggccaggcggtgaaatacaccagggaggaactagctactactgtgtctgatcatgagttggtcacgggtgtcaccctcgttagcatgggtggtggaagcaaattctgcgtcgtggagtgctgcctggatcactcagtctcggtgccgtttattcaattggtgacattttctatgatgtatggtaagaatggagaacttacgactggcaatagccgccaatttcgagagtacaaaaacattcctcaaggagttagtagtgaaatgcttgagaatcctgtggcattctggatgtagagaccttgataatgttttatactggtaccctagcgtgtctggaactctgaatccatgctactttataagagcaagtttaatagtgtagccaaatactagctccaaatcatttatagtcaatttaatagccaatagttacgtataaacatatactacactattgatatctggtctcacctgtcatacacacattgcgtcttgcagttcgtgctgcagatggctataaatatgtagcccgttgctcttctctctattcttttatcttctcgatatatgtttatagctaagttataatcagctattgtacttgctctaaatctgaggaaatttaactatttgccactcttgtgacatggcaattaacgatttgccacaccgtgtttatgacatgtgggccctcatgtgtctatgacatgtaggtctagtggcaaatcgttaagcaccactcgtaagagtggcaaatagttaaaagccccctaaatctgcatctctatctctactttatttagttaaaaaatgaaacatgtttgcatcatccgccaccgtatgcttgagtcatttgattttgcttcgtgttcaccttgcgcgtccacaacctccatccgattcttatcaatcaaaaagaaaacaggcataatcgcacccctaatcgcaccatcgagtagagaggggacggcacaagctggtggactcgcacccctaatcgccagtaacttccagcaaacgggcatatcatcatacagacagaaaataactcaaaaagaaatatgcatcttttgctgcaaaatttcaacatattaggaaatgctagcacagatatgatgtaaaattcagattaggctgagttgtactaccaaaataatatttcttttttttcttacaaaatttccaggctgtggtactcacatggtgcagcacttatttcaaccaagagaaggaaaacagcagctaatagtgtatcaccgtgttcaagctacaatagatgcaaaaaggggatcagagaatgccagtcagcgctatgatacaagtttgctggcttcctgtcatgggtttcctttccgtggataccgctacaaaaaaaaattgtccgcccagtgtaaatcagctgctcggaagtagagaagtccctctgagaatgcctgcaacataagctagataagagattatgatgacgctgaaccaatgcacattccgtggatgcttacaatgaaagatatctgaatacagatttgaacttatgtgattctgcctaacaaagcaaataaatataggtccgaaatatcctcccacattaacaacaaaatattcagtattcaaacaagtagatagaattccagcaaaaagagggggagagaggggatagaagccattcaattagtcaaagatgtcacttgactgaattttgctacatcttggcatgtgaaacaaccataaatcaacactacatttgaactatactgggcagtgggaacaagatattattgtgaagtaaacaagttatggacaatactatcattgctccacgatcaaatgtgcattgcaaagaccaagagcaagtgccagtgtaaatggactgtacttacctcctatctgtactagttctgagtaacaaccttatctttagattctacctggaatgcagaagggataacatgtaagcacaatataaacaaatagctacaggcaattctagttgaaaatggatagttttaagaaaatactatcattgtttaaagggtattatcctgcacctcatctgttgtgcttctccgaacttttctagttgcatttctcattgtgacaaattcctctgcagatgttgggtgaatgccaatagtggcatcaaaatcttgctttgtcagcccagctttaacagcaattgcaactccctgtcaaaatgtagtaaattcatcagcagtatgtcaggaataaagctgaaatggagagtaagaatataaaacaatgcagacctgaattatctcaggtgcgtcttcaccacacatgtgtactcctacaactttgtttgttgtagcacacacaatgagtttcatgaaaatgcgatcaggtaatccagagagagttgccctaagtggcctgaagtttgctgtatagatatcaacatctccatactcctcaatagcctgcacaaaatacaaatttaattgactttcttttgtgcatcactttatatagatgcgcgtcgtatgctatacctgctcttcagtaagaccaacttgtccgatgggtggttgggagaaaacggcagatggtacagctctgtcaaatttgtgcaattcacaatcaaggagcatccaatggaacaacaataaccaaaaccaaataaaatttaactgataaacagtgaaatactgaaatgaatcaataatttcagtacaaagtcagtcatggcctcctaggagcttcaaggactactagaacacatcacaaaaacaagaacatcacgacaaatgatcaataacaagataattctagataagcaagaaatcatccaaactaatctgtattagcatatcaaacatggaagtggaagaatggggtatttactcctcaaaatgttccactagagattactgcaagcataaaaatacacaggaatactagcatgtttaaacaaggaaatagaggttatatctgcaatcaagctattcaagcccatctcctgcaaattatacattaggatgtgaccaagtaacaaagttctctaatgaaatgcaacagagatacccgttcactgtcaaaaatatgcagctcaagtgtacactgtacagcaacaacaaacattccctcaaacatgcgatgtaactgaggtattcttgatagggatatcctacatacctgtaatctggtttggtaggttcatcaccaaacactgtttttgcaaatgcaccaccttccataagtgcaactggtgtcaggttgaccctatcagtaacatctcccactgcccaaattgaatcaactgaggttcgagaatactcatcaacctagcaaacataaatacagtgcagaagctcaacatgttaaagagtcgcaaagctgagaaactcgaagtcaagtatcacttgattgattgcttaacctaccattattgctccgttcttgtccaatttcaccccaacctcctctagtccaaggttctacaagttaaagaacaacatcagcaacaaaggatggatgcatcaacaaatggagatgcaagatctaacaaagtgaaaacaaaaggcgcatatggtgcagacctttgtgtttggtttacgacctgttgcgaacataacatgtgagaacccaccaatagtttctttgtttgtcttcagagatagcaaaccatcatttgatttggttatagcttgaggactctgttcagtatgaaatgtgatgccccttagagacatctgttcagcgatgaaatctctgacctgcaaatccacaaccgacaaaaataactccagtgaacagatcacttcatctactgtgaatatgattttgttgttcccaatatttgctcacctcttcatcaaaccctcttaaaactttcttctgccgaataaacacatgtacctcactttttaagccattgaaaattccagcaaactccagagcaatatatccacctcccactattgcaattttctcaggttttgaaggtagatccagtgcagcatcagaatctataacatgctctattcctgggatatttggcatcgatggtcgcccaccaacagctataagtatgttcctagcagtgtagagctttccatctacacttacagtatgtggatcaactatctgtactaagtaaacaaagttacatcaacagctgcaccttaccatagtatttgtttagggaaacagtctattcaaagtttaacttgatttacgaacatcacccaacctttccacggccttcaattagagtaactcctgagttgtttaaaatattcttgtaaatgccaacaaggcgctgcagctctgtatttttgttggcaatcagagtgttccagtcatgctttggatcagtttcatacacccacccaaagccatgagactcttcaaactcatgagagtacttggatccatacactaataatttctttggaacacacccacgaagcacacatctgtgacaaaaacaaataacagttcttatgcatatgcatatccttctaggcactggtattacagcaaggtggtagctattaaaagcatgcccatcttttaggcttcatatgctggtatgttatgccaaactgcttacatattattggaaatctattgtctaatattgtacagggtcattaaaacgcatgggtttagctctggtattcataatgattcaaattgtaaatcccagtaaatactgaaataagccacattatgccggtatagcagcgcaaatcgtgcattggagtcattgcgttgtatacattcaaacaatttcttcaataatactgaataagaaaccatataaaaccttgaaacttggtgagagcggtaaaggcaacaaatggtgcaaatgtaaattacttaaaagtactaataataacaaacaagtgcatatcactggaaacacacattccccaccagatttgtgcctctaacccctaaaatgagcaaacaccactgagataacagcccgtgaggatgttctcactcaaaagtaccccgttcaaatgcagtatatgatagtgagtaacaatgtacccaaccacaaaaattctctagaatgtagtaacaaaaatgagttagcgaagccattcctatcacaaaaacatcacagaacaaaacatcagcaaagatggaacccgcgacaaaattggaaatgattcctggctagtcattcacaaatcacaaggaagcgctccaattacggtgcatgcaaaaaagtaaagccaaaagccaacgatgctaagttgctaaccttcctacgaatcaaggggaaaatgtgatgaactaatagactagtctatatagtagcaagagaagcgtccacttacgtgccgccgactccaccgaggtcgtccgaggcgacggtggcgaagggcatctcgcagacggcggcgcgggcgccgtagagcgtggaggcgaagcgcgaggcccggaccccgccgctcccggcgccgatggtgaagaggtcgtagtcgtactccccctcggaggacgcgccgttgggcgccgcggacgccgagacgtggcggcgcgcgtgggggaggaggggaggtcgcgggagcgggagcctcgggagggcagcgagggaggggaggtggtggaggaagcggcggcggtggaggcggaggcggagggggatggtgcgggttagggtttggagggtggaggagcaggagaaggggagggtcgcggtcgtcgccatgcctctctcgcgcggtgccgccgctttgcttccgacttccgacagtgtggggcggagagaggagaagcgaaggcgatgatgtgtggagagtggagacgatgagcttgtttgattcctttttccgatcgaaggcgtatttgccactttacgtattcgaagagtggagctgtaaagcctgtatgactgaaggcgtcattccggacgatggtgaatagtttgaggctttgggcctgtttgcggaggttctgctgctggaaattctcctattagctgctactgctagaagcttcctaaacagtaaagattttcacttataagctgttactgctagaagcttcccaaacagtaaggattttcactcagattctgagaagctgtagatgtagaatctagaaaataaactagaagcttctcacaaactgtttctcagaatcttaacctcctctaaatagggtctttgagcacttgtttgaatatggagattttaggaacactgttggtttgccttaattatttgattggaagcaagccgccatgtttcagtcatctctccttttaaaatcctgcaaattcctatggagtatctaaacagctcattttctcaattactgatcccaaataaccatttttttacccgcaagaaaaaactttttttccattacacagcagacgcacaccttaaacttgctattttttttttattgaaagcatgtttacatgtatgtaatatctatagaaaccaaggttaaatattttaatggttggagtcatacaccatccatcatacaccactggtgctttccccaaaggaccttactgatcccaaatgacccattgtggagtcagattggcaaaggctacaccatactgaaatctctgaaacatcctctttctgtttacaaagataacacagcgaaactgtgcagattctctgtccctccacctccaatcaagtcctcttcaacagatgcgtgacaatccacaatttcgcacaacattggtactatcttgtttcgtgaaggagcaaaggacccgcttaacagccaacagaacgtaacaacagcaaaagttagaaaaccaccatccactttcatagtatcatcaagaaacgatgtaccaacagaaggccagcaaaacatacgccgtcacagccagcaccgcgaagaacgcggtgtccgatatcggcgtctgcgtcttcttcctgctggccctcgcctccttgtacaggactacgtccaccatcatccggctgaggtagttctccgacgacggatcgacgtcctgcttgcaccgccttctcagggagagctcaggctgggcaggggtgaactggacgtcgaagatactcctcttacgcagcaattccgtgtcatggtgatccgaattcagagcgtccatgaaggcagcgtagttggccacatgggacgtggtgccctggtagcatttctcgaacgcgatcaggttctgcagcagctggatgctggcatcgctgacctccagctgagggatccgcaccttgccatggctgaagacgatgtcaaggaaggtgaagggctcctggaaatggctcaacggccaccaataccattgctgcctcctggtgatgcgaaccccatcggtgtcaagcttcttggcaggatcaatgccggttcttggtggctttggtggtgtcttcatcagatcactgtgtagctttggatttggaaggagtgaccggtagagcagctgcagaaggcagcgcacgtcctggcagcggattgggcgtgttgatgtgcacattccagctggcaggtacttgttgaacatgttcctcgcgcatgccgtcaggtcaacagctttgtcatgctccgtcttcagaatgtcaaacaggatcctgacagcgacgaaaggtatttggttctctagcaggagcatgtcgatggcgaccaggctccattcccagggtctctcccactggagtgtctcgtactcatgatcgagaagcccagcatccagctttgtccagtattcatgctccgcacctttgttcgggtcatgcctcagcaagaaatgcagaatgaagcagccgtcaaacagcagcatcatgccgattccctcctctgtcatatcaactggttttgcgtatagctgctggaaagactttgttttgattgtctttgacagtctaagcaggaaggcctgaaccaaaggttcaaggctgtggttgctacgctccagcaatctgttgacacaccagtgcttatgttgttccattcgcctgaagcttggtgaatttctccctgaatggaagtagggaccgatgcagacagccttaggatggtaagcctctgggtcgcgcaaccgagtttcttcagggatacgggtgataccattttcatatgaagaacacagcggtacttcacagctccggggagttgttaagcctgaagtttcatcggtatccccatttgcactcgctgtcatcttcctcatccttgtgttctgccctgcatgcatgaatgtacagatgcaagtaattacaggtgagaaataaggaaaaaccgaagacaacaaagaactcacctcttggttgctctggagaagacatctcatgaagccaaatcagaagatttcccgtagttgatggtgcacgaagaaacaatctgaagaaaacttttagtagtgatggagaagaatgtctcctacaaacaacaagaaggttgcctcccacttgatcaaatcaaactcaaaagaatagttatatatggttttattcaatagtcaaaaggcaacatcaaagaactttcctttccatttctttatgcaagattgctacatcagacaagttgactatgtgaatcaactatgtttacaataaacagaaaagattctgcagtttagctgcagataaataaaagaaaagctcaaaaggttctacagctattaaggcatatatgatattttactaaatggcctttatgactttttttttatttccctttgaacccaggggaaagaatgattaacatctaacgtgatacaagacctcatcataatagatgaagctactgaaatttcagcagaacatcaagctggaaattttatgtggaagtgtctccaccccttacaactggctgttcaccttcaaactcagatatcacaatgagttgatctgtcatttcaaaagaaagtagctccaacttgttcgtaggatttatatactgcatggcatacaaaatataaattagttggtggttattaacaacacttgattcatggactgctattcacaacgccaaaagaacctcatgtcaatacaaatcaggtccataaagctagatggcaaagttaagaaggacctgatcttaacaaggtcttatgtacttcgaaaatatcacacccttataaggctacagaataacatagagaatcttaacctgcttcttgcccttgacatagccaaccgcaacttcacgacgcaaaatcgccctttcagtgagctctgaaaatgatatcttctccccttctttcatgtagaatcctatttcctagaaaatgtgcagcaaaaaagttccttgaactatcacaaaaatacaagaattggtcagaaacaccgattgtgctcatattaccttgatgtagatctcatctccttcagcgttcagaatatccttccatacttcattcaactcactacttcccgcaactacatcacattttcttttatcatgcgatagatttcagagaaaataaaataaccaagattgattaaaaaaaaaactaaccctgtgctgttacaaggctcataacttcctctgctccaataaatgagagggatggttttattctagacatctgcaaaaaatgaaaggctaaaagatttgcttccaaattaaagtaatttgatgaatttagtaatagccaacaagcgaattctcacttgctttcccagtcccgtgtctacaatttctgatacaagatgctcaacctgtaggaacacattcagataaaatacaaaattcaattatattttattatttataagaaaactattgaacgagatgactagttgaaccacatcatattcaagaagaaaacaaaatagcattgaaccattcatattttattgaaccattagtaatgcaaaacaacaggataatgattttatggattttagacaaagtgtatcacagtattccaaaaggaaatgtgttgcatgctgatgagagaatggaggttcacttagtgtgtttcaagcactataaataatgggaacttgagaagaactgaccttaatgtcatgtttctggcaaatgttttcagcaaggagaagagtatacgctaactgtttatcaacctgtgcagtatctgcagaatccattagcaggtgaacttcaattttatatataacagggaaatagcatggttctgttactggcatgtaacccatacctccacctagccagtctttgtcagatattacgacaactgaaaacggaacattttggtcatgcttcctggatttcttaaatttaattattgcttcctttagagtatcatagttcataggacatcccacctgcattaatgctatcgcataaaaattagcgaataacaatagtagagttatttttctgcctgtgcaagcatattatcagtggacatcagaggttactattcacatagagggtttaagagacctgatggttaactttaatatttttcagttgtttctgcatgagggggttgacaatactgctccgctctttaataggggtttctgacaatatttcctgcacatcaaagttaacttattagacatgaacatacgtatggatgtggcaatgtagtcataaactcctcattttctactgcagctaatatttttatcgttcctattatccctacacataccaatacactgccaggtccaaggtaattatcatattcccgaatcatatcagtaacttttggccgccaaccaacaataagcacgtgctctcttggtcctagcgtgtaatcattgctctgcatacagtcaaccacttatgaacccagtaatctgacggagaggggatggatttccattggtacatcattacactagcatttaccttggagagcgtttttgaggggcgctttctgatgctatttagccgtgtttcattcacctcaagagccatactagacgatctttgtccctctgttgactctgagtaatgacttgaattttgtgctccatttggagaatttgagaatgtagactgtgctcttctcctccaggaaacaggagcaataagtagtagctgtgaattaaaggaatcaagaatgtatgacatcatcagctacaaaactcaattgtcaagtactatgttctcctgattgatgatataactggaaatcacaaccgcattatctcttgtagggaatgcaggtaattccagtggaccttttagaagaaaaatgcctactagtaaaatattcagaaactaacagatacttaaacttatgctaactttagtaattaacaagataagaacctaatcagtatctatttaacagaacaatggaataagctcactttggtaatggcttaggacggtggttagaagggctttaagacttcaatgaaaagataattcttctggaataatatgttgagaaatgttttctactagttgtcctaacatgaaaaggaaaacaacaacaaaagaaagaaaaacttactttgtctttctctgtcagcacttcatcctcacatgggtgaaagtgcatcattccagatcggaaaataccacaaacaactgcctggtcatgaacacaaagcagagaaatcacgaaaatgaagtcatacagatctgcagagtttagacatccacttatttgaagtaatattacatctgggatcctacgcctcacatccacatacttcatgcctactacttcccgaaagctgaaaaggttgaagacgttttctgcatgataagaacaacataa

SEQ ID NO: 79102 - DNA, 15865 bp, Oryza sativa
gtcaggaggacacagaagctgccggtgacgcggcctccccgtaccaagcaagctccgcccacagcgcccgcgcccgggcctccgccgccgccgccgcagccggcgtcgccgaagacgaagacgaaggcgaaggcgaagaagccgaagaggaagagaagctgcgtgcactgcggctcgacggagacgccgcagtggcgggaggggccgacggggcgcggcacgctgtgcaacgcgtgcggcgtgcggtacaggcaagggaggctgctgccggagtaccgccccaaggggagccccaccttctcgccgtccgtgcacgccgccaaccaccgccaggtgctcgagctccgccgccagcagcggcagagcaccaacccctccactccaccgccgccgccggtgtccgccgccgagccaatccccgacgagcaaaaagaagaggtggtaagcgtgccagtcgccgccgccgcgcccgccaccgacggcggcgcggcgagctcgctggacgcgctgctgctcgacgggccgtcggcgccgctcatcgtggacggcgacgatttcttggttagttaggtagccagaaaaaaaaaagaggaataatttcagctgagaatgagatgaggaataccaatttttcgtttgatttttcaggaaaaacagttttaccacctgacattgtgaatactcgtcgatcctggggaaaatctttgcgtgaaatttagctagttttgctgcccagatgaactagttctggtgcttggtagctgatgaagttgaaaccggttttaatggatcaagggggatggatgttcaatgccaaagtatgctgcacttggtcccatttttagttaaactcaacttgtcatgatagttcattggttctaaaccacatttaggagatattatcctctttgttatagatttattggtcagtatttccaatgaaaactagatagcttcttacctctgttagttttaagtgattttttcccgtcgcgctctgcggtttctcgtatcctgtggacctccagcatggtgagcgaagttgtccccatgttttatttcgttgagcatgaaatttaatacacctttttatatggtatgtgatcgtcgttatgttttgccgccataatactggtggaattaaagcatataaaagtaagtggcatcatcttgttttgctcactacaatggaattaaagtgggtaaaagcggaaggtgaaagtaggtcgaggtaaggttgcaaggagcaactttgctcactacaatggagacccatggggcgcgaaaaaatgctgaaaaccagaaagaggaaggtatttgaattttcccaatttacgtacatttaagtcggcgtacgacaaaactacagatttagaaatgatttataaaaagctatatatttcaaaagtttttgtcaagacaacaatgttaggacaaaacatccacgcgtgcttttgtgataaacacttagttctgtgatactataccttaatatattataccgttcttttgatatgatggtattgtaaaatttcgccaatcatggattactttttttttcatctagacatcgacgtgtgatgtcttataacttgaaagttgaacttttgtaataaatttttgttgggaactcttgagctaaaggctgggatctaattccattattcaaagtagcttaaatatatcattttgggatattttacaccattatgatttagatctgtattttggtttgttcaagtatgcttgatgtaacatatcatagtactacaaaattgaataggtgccttttcatatttatggtattaggatataccactctcgtactagattaacttattttgaaacagatgaagatggagtatatatatttgtgtccttctgagcactatttaggtaagttgaatgcctcaatgtcataaaattcaaatcccaaggatgaatatgagcatatactatgtttagattcactactatgtctaaatttctccctggatctgatttttcatgggagggaggaaatacatgtcaattgccctggttgctctttttatccgaaatcaggatttgcgacgcaaggcattcaagagacaaatcgggactgtgcaagtgcgtggactttacattcttcagatagggcaagatgattgcagctagattctccaaactgaggcggcctatccaatttgtggattgtcccaaactgaggcggcctacccaatttgtagagattgcccaatcgcacaaaagcaatctgccaggcttgtcagatgaggaaactgctgtactaggaaccttttggaacttgcagtaggaactactcgtaaaagtagaaagatattattggttgagacgagagagcgatggagaagttttatattctctcatctcaaaaaaaaaaagtggctgtattctgaaacaaaatttatcgtaagaaattgctgtattttaagacaattgaaataaatatccttccagtgacacgctgaatttctacaagttgtatgtcaacaacatggtgatagaaggaatgtacgaaaactgtaccagactgaaaacaaccatgtgcgaatttaccttgcagaaatcaggaatcacaactcaatgacgaataaaaagaatagaggattgagtgaacaaaagagtctcatgctcccattgcattacgaattatttgcttattcaccagattacatcactgtctagccagacccaaaaaaactgtgcataaataagattcagaccgccgccagcaccaccatagcgaaaaagaatggcaccacaagggcaaacatcccttggatacagatgtttttttgttcatgacccaacagaagaacagaaactaagacagaataaacccctagagctcagcttgtagtttcaggaatatgaaacaagaacccactaagggtttgcgtgttgaaacatgcctaatccgcacgagattggccagcgcgggatgacaggatgatgccgacgatgagcccatagagagcaagcgcttcggcaaaaatgaggatgaggatcatacccacgaacagctttggttgctgggcgttcgccctgaagacaaagaatatgattagaagtcaaatattataagtagtaaaatcatcattgctattgcatacatgccaacaacttcacatatcaagccacaaactactacaaaagtaaaacatgtttattctagataagactttgaggctaacgcagttcttaatatcctcagtacaaaatatcaagccacaaacaagttgaagaaaacttttgtgttgacttttagaaaaatttaaagcctcaaataactccacttatagttacacgctactctaaagaaggggtttctttgacaagaatatctaaacaattttaggtgagaatgttctcacgtgctgatgtgcggaacctctcttcaggtaatcaatcgtaaacatacaaataataaattcaagccttgtccagtgttcaaaactttgaatatgtttagaagaatagagttaacaaattacaaagcaacaaaaatgtacagaaaagatgccatatgaactatagaatttattacaaacaggtatgaaacaaaagttgaaatagtggtataaatcagcacatcataattcacaattccactgaacactgtattagtcataattcacaattccactgaacactgtattagtcataattcacgattgcacaatttcactgaacactgtattagtcagtcacacagagaaaataaaaggataacatattgtgctactggacccctaacctcaaaagaagaatctagggaataagtgagcctcttttagtcagatttgtatgaattaggaaaggtttctaaaataccaaatctaatattcatgatgtatatttaaatagctgtatgaatactatggaacatttcatatcttttggtccatggtggataaatacatagaatgatcctattataagcatcagaaactttgggtcgataaagaatgatccatggtgtcaatgtcatcagccctgtgaagatgttaacaccgaagggatttaatccacagtttgacagcatggtcctaaaacagctatagcacagtaaagcctgtgcaatttaatagattgaagccatgattaaacacacattcaagcttagcatttgacagtgatagcagaaagtctgctagttaacacacactttttaacacacaaaagtgtgaatttgatatatcaatgtaataggcaaagcataagacagaagctcccagaaatgcatagtttgtcatatacaacgtgttccctaaaataaaatgcatagtttgtcatatacgacgtgttcgctaaaatgataaaatctaaaacatatacaattaggtacttgacggcctaaaagattgttttcgcatattcacataaacaagtatacacttgcaaatgtaatacttcactaatagtttggtgcacttttcatctcctgatctaatcacatgcagatagattgacaataggcaaattaactatactaacaactagcaaaacaaagttaatgataatcacaaataataaatcagcgtgtatgatagcaaagtgccttatacctgactccggcgtcaccaacgatgccaatggccattccggcagcgagaccggcgagaccacaggcgaggccagatgagaggtgcgcgtagccgtcgaagaggtagtagggcttggccttggggttgatccccgtgctgatgatgactgcgatgatgaggccgtagatacccagcacaccagccatgaccacgggcacgatggacttcatcacgagctccgggcgcatcacccccatcgacgccaccccgacgccgctcttcgccgtcccgtacgccgcccccatgcctgcaaaaaccacacccataagcgagatctcgatctcgtcagaaaccgcatcgcggatccgatcgcttcacagatcggatcgggatcgggatcaaagcgcgtggatcacggcggatcgaggagggagggagagagtacatgagaagacgagggcggagcggcgccgaggagccgaagaagggggcggtctcatcgccgctgaacaccgacgacatcttcgcctctcctcctgctctaccgccgctgctgctgctgcgatccttcacccgccgacgaggtcgagctctctctctctctccttctccggtggccgcgagcagcaggaatggatcgatcggtggtgggattggggctctcgcgatccgatctgaggagaggagaggagaggagtgcttcgatttggggattgaggaggaggaagacggaggtgggagaagaggaaaaacgagaggcgcacgcggcggcgtggctgggtttggacggttttgccctcgtgaggcaggtagaggcaaggctggtggtttgtcttgggttagtaagggcatcactgtcttttttctttttcttttttttttgccccatgtcacaaagagataaaaagttctttttggctagctactactagttcgagataataaaatcctttgttaggccatcttccattttcaatgtgcatgagtttaaaatagtaagacctcacttatgctatgtacaacagtaattaaaaacgtgtttttttatttttaacaaaaataagttgctcgttattctttcaacgatccaactttaccgattttacgttggtgcaagaaaatttttataatggtacatatgagatagaatgttaacctcaattgttggactaattttgaattttaactgttttgtagggtatctatagttcatttcccatatttgacgtgcaaattgttgcatttttttttaaaaaatgcatacttagtgcatatgtcaaaagttgttgtcttttggccttgtgttatttataaatctaaatctaaatgaagttctactaggttcagttataagtttataataatgttgctttcaagttgcaccaacatattattaccttccttctcaatttaagatagcaattggtttcagatgttataagatggaccatatatctgtagacaattttgcccctctgaaagagacgtatttgctggtgcctgggcatcaggggcagtatcgtcaactcacaaaatgatttattggggttactcgtcgccacgtccgtggtttgccccctgcgcccacgtgtatgcgcggccaccgcgctgacaatccgattgggtccatgggacccacatggcagaggccccacatgcagctgatgcagcagaaatgctactaaaatttcacacatatatatttttgcccttttttttggcaccatcatacagaaactatttgtcatataatgcatacattttcacttaatttttgttccgctaatcaaacagtttctgcaattgatctaattttgctctcgtccttctggtcatgtagctacattgttctccctgacacaaatggaagaacagcttccgtgctaacttaaaatggattctcttcaatgttggagacttgatcgaagcaatgatctgaattttctgaattctgacatacatacagcctacggatttaatctttcttgaggagatcgtagaacacttcaggcttcttgtagtgcttcttgcacgcctcctgcaaaaataccaaattccagagtaatgataaacacaactcacatttttcaggtgtctgttcaaaacaaatgcaaatactaatttcagcttgaaaggaaaaaggctgttaattttcacttgcctgcattgcaaatgctatgtggagcagagtcgcctcggaccacggcctgccgatgaactggaggccgatgggcagcccggctttgtcatacccaacctgacagattgatcacaacgttgtagattcagatatgtaggtttgttcatgctgatagaagctgtaaaacaagttcagttatttgctaccatgacggtgatggccggcaaaccaaggaagtttcctgcaattgagtaccggaccaacgcggctttgatccaaaatgcatggggaacacggttaggataaattgtactaggtgtgaaattattgagtatttttctcctgaaagtttggttcattacctccatttatgtagtccagttctccgctttttagcgcgtcgtcttgcagcttgtaggcagtcacactgcagaaagatttaaataaggtaggatgaacacactctagtgaaaacaaaaaagtacacagagttttgaatcatgcatattatggcataatgcttttctgaattcagaaacggtcactgtagcttatcatgacaatgtcgcgagtgccaaaattgctttccagatttgatgagtgagaaatgtttcatgccaagtgattcatgtgaggttatctgaacagaatgggtagaggagaaagatgaaaatacccggtcattggtgagacgatcacgtctgccgtcttgaatatctccttgtggaagtacatctgacgattcctgcaaacatggataggctagcagttcagtactaatataaacactggatcactaaattgtcatgtttacaaggtattctgttctgatgatagcttcatctgacaaatgtgaactcaccggagccgttgcgaattcaggtaggctctactgctgaaggaaccatacacgccaagtgcgacccttacatcccaaccgatttcagatctcttcctgacataattcacacaagttatggtcagatcatccacaggtttattgcatcaaagccatacaaataacattattctgataactcacagcttgtcaagatatttagcaagtgatgcagtgcattctgaaccaattgtcacatagtgcgcaaggcgcatctcttcgatctccggtatggttacatccagagtcttgcagcgagaaaaaaagaatcacaagaacaaattaatgagttcttcttctgccaaaccaattgagctatcatagaattcttgacaaaattgctagtactaaatttctaaatgccaattcaattagtacttttggccacagtaatcttccttacctcccaaccatagtgcgcatgcagcatctgaagagatttgtcgcagcagcttctgatgtcctctgaactgtcattgaaccactgtttccatcgcacaattaccacaatgttcagagttaattcgtaccaaatttatttgcccacttcactcgtgcaataatctcactgacctttgcatattttgcaagcttgatgttcttgatggagagtgaagacttcagcaagggcagattcaactcaggctgtagaatcaaaggaaccaactaagtcagcaattctgtatagattaatcagtactcaccaaaactgtaattagcaaggtcaattacccgcaagtaggatggctgagactgatcaacaattgctgagtatctggaatcaaagaaccaaaaacaccacaacatttcaactcaactcctttgagagcacgcaatgtagtacaatgtacatcaatcagcacatgtacaactagttaatcgcaataattaaagatggatttgtgaaaaaaaatactacatcatgtttttttttaaatatatgacgccgttgactttttacaaacatttgtccattcatttttattcaaaatttttgtgcaagtataaaataatttaagtcatgattaaaaaacatttaatgataaattaaggtacagtaaaataatagataattatatattttttttaataaaataaatgttaaaacatatcgcaaaaatcgcgtcatatattaaaaaacggagagacagtaattaattaagaggtgtagtgtgtcactgacgcgacggcggcgtcctcgaccgtcccagcgaggatcccgggcatcccgaccgtccagttcagcggcagaactccggcgttcgacagccgccccgccgtcggcttgaacccgaccacgccgcacagcgccgccggcattcgcacggaccctgcaaaaccgcggcggcggcggcggcggcggtcagcgcatgtgcaagtcatcgaagagatcgagaccgagcgtgggagtacgacggtttgtttacctccgccgtcgacgccgagggcgacggggcagaggccggcgcagacggcggcggcggagccgctggacgagccgccggagacgcggccggggttgtgggggttcctggtggagccgtggtgcgggttgatgccgctggtccccgcgccgagctcgtgcatgttggtcttgccggcgagcaccgcgccgcacgcgcgcagctgcgccaccaccgccgcgtccgccgcgcacgcccgcgcccgccccagccaccgcgtcccgcctgcatcaccgtccgatcttcatctcaccgtccagtttaatcagagcatatatattactcgctctctttgttcatattataagtttgcttttattttttaaaaagttaaactttttgaaagaatttgtaaaaatatatagtacgaagtaacatttatagcatcaaattaattttattaaatttaacattaaatatattctaatagttttctttagttcaaaaatattgctatattcttttgtcaaaacttaagaagtttgaaacggaagtagtaattagtactaattgttttttaataatggaatgaatttcacccttgcttcaagaaagctatagccaattattacaaaatccgttcaacaaagagcatgaaaaattcagaaaataactatacacaaagtaatgaccaccgacactaaacaaagacaaatattattgaaatctatttataaatctttaccagtagttgtcaaatatctgcataacactttaggtttttgcatgcaggatgcataagtttattgtccatgtcacgctattgtagttaattactgtgattaattagttaattactcacctgtggttgggtagggcaaacagtcgatctcgtccttgacagcgaccagtatcccgtccatggcagacagaggtgtccctgcgattaatgtcgaaattaacagatcatcagtaaatataattatcacaagattaacgcacaattaagctatatgtcatgtcctgtctgtctgtctggcaccattctactgcactgcattgtgatgcaaatagctcttcttttgtcacaatttatgtagtggagtatcatactagttcataactgtccatttctaatcagattttgcatctgaatgtgatcaccgacaagcctaagaactaaccttgctagccataataactctggaagaacactgattgatctgcaaaccaatcgtatgcaaagttaacagctaactaatcggtgagacggccaggcaatgaatgcttgtcttcttagccgtctttacagttggatcaaaacatcaaatacagccagctccaagcctcccctgtcaggctgtcactgttcccttaatctcttccatcataatctccctgtaaatgtaaatgatctgaaccataccataatgtgacatatgtgatgctaattaccaacattaacatatctccattgataatgtcgttgccctttttcttgttcagagaacaataaatgtaaccagctccagcagcattaatttctgcagctccctttcctttctgtcttcctgtcttccttccattgtggatcaaccattgtgatgttttttttttcaagatgtcaaaacagaagaaaaaaaactgaagaaattgtttggagtgttgcttgtgtatgtagctgtagttgtactgcctcctggttgttaccaagtgggtacaaaaaagtttggttggctggctagaggtcaagacagaaaggtggtggtgagttggtttgagagggacaagttcaggccattcctgtgtgctgctgcttctgctgatgataattgcaacttccatgcattgctcttgcttcagatactgttactgccaactgtaacttacatgtcagtgtaaaagaatgttctttttttttacctctctggtatctcagggtggattcttcagcctgcctgatgatgtcttcagggctgtagctgatgaagaaggccatgttgaggcctgggcctgagcactccttcactgcagccaagaacctctttgcaacctgcaacaatgtagctgttcttgatcatttcttgcaatttctagtattttatcatgtgttgctacaattgccaattactaactactagtactcttcagtaatgtattcagacatgataattcagttactagtcaaggaaagagacatgtaaccatattattaggcctaataagtttagctactaatattttaaattgagaacattgtagctatccatgcaaagattgattacaaaacctgaacaggagtgacctcccctgagctgtacgccctgttgaaatccctgatcgtccagcgtttcgggctcgacggcggcgagccggcgagggtcgattcgaggctcgcagggaggcagctgacggcttcctggacacgctccggcggcgacaggtccggcttcgtcaggcacacattctgctctggaatgtctgcaggagatggatggatcaaacagtgtgtgtggttgttttcatcagattaactgaagaagattttgtttgtcagagcaggaaatttctcgcagagttcagagaagttcagagaaacaaccttcccagctgtgtgtggaagtgaacagtggaggctctgggatttcagcatcttggacaagctgcagatgatgaacagtagttggtgagatcacaaagacagcagaaagctgtgtcaaatcagagaattattcctgtctgcctgacactgctcaacgaaagctcagaacgcaactaacacactaagtaccagttgctgatgttctgctactactagttgagatgatgaaaaaaaagagcatttctttttgggtgaaactcctcaatagttctcgctgaaacctagtagtaacagttttgcatgcaagatcattgccagaatcaaaaggagtttttttttctctgaaaaaaagagcaaacttttgaggagaatttgagcagtgttgcaccttgttgatgagattatccttcttgaggatgtaaagcaccattgagccgatgatcggcatctcaagaatccacacgaagatcttcaccagcagccctgctacccgaggagctgaagaacaagaagaagaaaccaaaaaaagaagaaaattcagactcaacttcaagaacagagaattcagaatttccaagaaccgaactccagaatcaagaactagctggatgcaagggaggatcgaacctttgacgttagggctgatgtagaactcgtcgctgtccgggccgagattgacctcggcggccggcttgtacaccttggcggccatggatggcaacttgggaagcaaaggagactctcctctgcacaacgactgctgctaagctcctcccttcctgtctgattactgacaagaattggtgccttttatacgacgacaagacccaagatgaacggcaaaaacgaggagaaaagagaaaaaaaaaaggtaattgatttcttggtgaagaattaattaatcagagagcaatggacaaaggcatagattgtgacagagagagagagagaaagagagagagaggtagtggcttggattatgtatgataaacatacatacataaagtgtttggtgtgtgtgtctgtcagtgtgcagcaagagagaggaagagagaatcactgaacttttcaggttccaaaaaaaaacaggaaagaatcagtgaagtttcttgctgcaaatttggcggggattttggaggagaaatggttgcttcaatgcttggtttggcttgtgccaaagagaagctagatctgaattgtgtattactcctacatcagtattaggtactcatcaatgttagtaccatcaaatttaatagagcccaaattgttggaggcctagtttaatctttaattttttaaaacatcatttaagtatgagtatattactagtctgttcttgtgtacaagctaggacgatgtgtaatcaatcttaccatcaaatttgtcaaaattatgggtggctagtttaatctttatatttacacatcaattaagtacgagtatagtaccagtctattcttttgtacaagtaagttaggacaagatgtaaaatgtaaataaagatgagcattggcttcatcctaagctctttacactccaaagatgttatatgtttataatgtttataaacggagaggtttaaatttttttaaatgaaaataagtcagaatttgaccaagaaaattataggtgaaaatagtgtaaaatcagctacatgtacgcaaaattacaccggctttactgttatcgtttggtaatattacgcttaatttatacgctaagtttcttggtcaatttctatcggctttggtccatctcaaaagatgatgcccaatagtttttcaggttcatgttactgtcaaaccgaaccttctattttggttctggagaataatttttatgtcaactatattcaagataagcaaaaaagaaggcattaaaggaacatctctgtgctacggttgcattacgtcgattcatatcgcatcaaattaatacaacttctttcaaataaaaggatgattaattgagtcaacgtagagattaggatgagatgttgagtgtgtgacctaaattcattagccacttgacaggatttattacgtttagtgtcaccatctcttgattttggaatctgtccattactaaatgtttttttaatgctaaacaagagaaacaggtgaagcttaaaattcctaggaaacccagatgaacaattgtgaatatcttgacatgaggaaaggcctttttttttatcaatggaagtaattattttatttgaggtgaaacaccattaaagaagaccctaggtcattatccaccttcaacatgtccctaaagtaagaagtttaacaacctctctcccaccaaactcattcacaagttgtaaaagaaaaaacaataaaaacctatatgctgcacccatattctacatgaatcagcaaccaataaatgttgctggttttctagacgtgtagcatacagaaaatataggcatgaaattatgcaaaggagatcgatcttctggaagctcacataaaattaaaaagaaaaaagaaaaactgagcaaaagggatgcacggatggaagctaggaaaaggaagatttgggaaaaaaaatcagcaaccaactattccagcaattgattgggctcacttgcatcgcatgctcaattaattcctctctttcacatcctatccttccaaagatggttaacctaaaaccattcaattagtacctcttctctcaggcattaacttgcctactatgattaaaccctattgtatgctcacccaaaatggaggctggtttatgcttgtactgctatactttttgttgatttgagctatccttaattcattattgaccattgattgcagacagatccaacccttgctacgacaagagtaattcttgccttcttggatgcattgatgcatggaagctgcggtgtggtgctcactcattttggcaatgatttgtgattctccatctggttccaaatatatgacttctagatgcagttgaatttaaaaaataacataaataactttgtttccatttgtttatactacattgaaaatataaatagtacaatttatttagcaagggaaaacaagaaaacaataaaaaatatatccaaaaaaatcctaaaacatctcatatttaaaaaagagatgagaggatcagagtacaacttacatttaaaattagaggaagtgtggggtggcacttcagcacaggctgaatgctactggagccaaatttgcatcatgctacagactgctacttataccggccggtagaactacgtccttctcaaaattaatgtttgtccatttttcccattatgtgtacttccagtatttatcaatgtagagaaaattttaatagaagcgtctaatatttcagtcttaaagaaaaggacatatttccacctcatacacgttttcttgaaaagttcaacacttaaatctcatgcaataaaagatgcaactatttaggcaaatgtggtatactatcaattaataggtacatttatgaacattccctacaattttttttgtcttaattagattctagtgcttagtgggcatggtgccgactcctttcgttacttataaaccttatctattatatttttaaaacaacttgaaaggaggcactatatttgctgcggaggctagaaatttccacattaatcggagaaaaagaaaagaagagtccaacttaaaatacaatttaaaaataattgaaattcggaattaaaaataagcactattgaaaggagagtccttataagaacccaatacgagattaattaatattcggtataaaaaataaaataaaatccaaaattagaaaaaaaaggaaaagaagagtttgagtagaaataaaatttaaaaataactaaaactttgaattaaaattaagcaatagtgaaagaagagtccatatagaaacccaatacgagattactaaaattcggaataaaaaaataaaaagtcaaaattagaaaaaagaaaagaaaggaagagttcgagtagaaatacaatttaaaattaactaaaattcggaattaaatataagcaatattgaaataagagtacgtataagaacccaatacgagattaactaaaattcggaataaaaaataaaataaaatccaaaattagacaaattaaaaagaaagttcaagtatgaatgcaattttgaaacaactgaaattaaaaatacaaaataaaaatattaaaaggacacaatacgatattagttaaaattcgaaacaaaaaatagaataaattctgaaag

SEQ ID NO: 79103 - DNA, 30457 bp, Oryza sativa
cacccttaaggtatcagcaaactgacctgagagtgttaagaagcgaacttgcttctgaggtgagtggggattgaccttcacacattgtgcatcctggaacacgtcgagtctccccagctggtgaatgttttaaacattccacatcaatgaagaaacataagcaaataaacagtggttaaacaacaataccaagaaatgatgtgtaagaggcttgaagggcaacaagggaaatccaacaaggagcccatgtactatgtagaagcagacatcaagaataaacagaccatgttcgctataaagtaataggagtacagatctaaagtacatcatatttggataaactgaacacagtttcaaaggaccaacataatttgtaatgtaggtttcacaccaattctgcatctcaggtgcttgcctgtaatctgtatgtgctagccattctttatgacacatcaggtgaagccagaatttttcactcatccagaccaacagaccccaatggcttgtaaatatacccccacaccatcttgaaagtcgaaaccgtgttcatttgggactgatgtttcagggatcgaaccagacaacgattctgcatgttattcggactttgactcctttctgatacatatcatcaaacacaggtgcgcatgttgcaatcccatcccctacaactggaaatttatgatgacatggttcccaatcacccatcactactagcaaccgaagatgtgattcagatgcgattgcattttttttatgcgtattacatatttcgtatcagtagttcgacacacagcctacagcactggtgcactacgagtctacgactacaagcagcatccccaaatccagaagttaacgcaggcgatacagaaattcagaaatgaagccagaacagaaaagggcatctaggtttacagttacaggagggaatggatgcatcatgtaatcatgtatgggcgagagagagagagagagagagagagagagagagagagagagagagagaggagagagaccgagacagcacgcgcgtaccgagtccgcggcggctgcggcgccatcgaagttggggatgcggtggtggacggggcgcgggtcgcgcgcgacgccctccgcctccagcgcgtcccacacccgcttccgtatcgcccacttccacgccttggggtccgccgcctccgcccccgccaccgccgccgcggacgccatcccggcccgcgcctctgcgtcgaggcggagccgctcggcctcgaaccccgccgcgtcgaacgaggccgacgaagacgaagccgcgcccctcgcagctgcgcacgtcacggcgcggccgcgacgagaggctgccgccgccgcagccaacgaccgagacagcgacagcggcggcggcgacgccggcaggagaggcatggccactcgcgtgtggacgccgtgaaggtgagcacgtgtgctaatcgagcaccttacccacaatctcctttggacactgacaggtgggaccaataacaaggcgagtacgctcacagctgacatgtgggaccactagctcagagagaaagcgtgaagtgcaacgagagcatcgagctgatgcaacactccaccaaaacaaatttcaaatttgattcaaccaattggtagctgaaagatgcaaggcaggcgaaaaaacataactatcgagttcaaaattcataaatctcaacagtttgatcatccgcagcaccagcagctcagagtagcaaagcatttaaactgggtactcaaaatatctgccacaaaactcaggacaagtacagaaactgggaaagctatcaggtgaggttcgattgaattctgatggcctaggccttgagcttgccgaagaacctctgcttctcgtcggtggtctggaagcgaccgtgcccgaacttggacgaggtgtcgatgaacttgagcttgatctcctccagggcgagccgcgaggtctgcttcagcagcgactggcggagggtgacgactctcttcttcggaccgacgcagcaacccttgatcatgaggtagtcgcccttcaccacaccgtagtgcgggaagccgcccatcggggtgatgtccttctcagtcctgcaagggagaaaggtcagatgtcatcacaaccttagaatggaatgcacataacattactcaaggccttcaaacgttctaaagatgtatacctgtcgaactcggtgcaggccgcatgagactcctgaccagacttgccaatcttgtaaaccttcttgttcatctcagtgcggtggtggtatccgttctgaccagcacgggcaacagtgtaggacaccctggctggatgccaggcaccaatacaagcaaccttgcggagacccctgtgggtcttgcgaggaaggcgggtgacaccccaacgagtgacgacaccttcataacccttacccttagtgacaccaatgatgtcaatcatctcgtccttctggaagactgcatcaacagggatttccttctcaaagaacttgtagccatagtccaccttgtcggcgatagtgccaccgttgatctggatctccatgaggtgagccttcttctgcttcaagcccttcatctttctgatctgaattttgacaagaaatggtcagcaaaacatgataactcttcagaattcagaagagtacaagaggcaatggcaatctcacctgagtgtgggcaataacacgaacaatagatgcgtacttcttcatcttctcaagttgcatctggatttctttcttgccagcatcactgtcatacttaagggcatacttagtgaaagccttcttcttgcttttgcaccagttcttgtagaaccttctccgcacctcctcgctaaggtgctgggcccagacagagttgagagagcgaagtccacgaggtgtcttgacataggccacgagtccaacaatgacaagcggaggggtctcgatgatggtaacagcctcgcaggtttccttcttgtggagctctgcacattgtcaacatatggtgttaatatgttcaaggcatacctccaatgaacacgaatgcaagatgcagagcaacttactggagccaggcttctcgacctcacgcacaatgtgtgtcattccagccttgtagccaacgaaggaagtaaggtggcagggctttgatacgtcatccttggggaaggacttcactgcaaaaacataggatctagtgtcagcgtacaactgaatagtaactaaattctccaagttccacagaagcaatatatatcccattgggttatgcctatgtcctgaaattttaagttgggttacatccatgtacagacattttaaagacaggtgcattcttaactatttatgtaccacatcaataaaacaaaaaatctatgagcatgtgtcaatctaggtatgttagcagcatatataccaaaaggattagaaaataaagcgctatatttaggaacacatagccaaacgaacatccaaatgattgcgaaaatactctaataagaaacacctgtatctacctaacagaaaacatacgaaccatatcacgcgtacacacttagatagctgaatctattagctgcacaatatggattactacatcatgccgcactagattatgattcgcagagcataacgaaatccctcgtcagatcaatacggacagtgaaactcgcaatcaactcgctgggcataaacgaaatccgtcttcagatcaatacggacagtgaaactcgcaattcatgcatcaccaatcaagcgtgtggaaggcaaaggattcacgtacccttgccgcggtggcgggaggagcgcttcctcgggaggaagccgagggatccatgcctcgggtgctcgaacttcctgtgcgacatcttcctcctccttacctgcaaacgaaacccacacaagccatgagatccgcaaccaagaaaatgcccgtaaaatcaccaatcgcaagccacagcgatcaaactacagcaccagcgacgagaattcgatctcccagctagctcactaacaactaatggcggattgcggacacggagcggaggcaaaatctgaatcgaagcggggattggaggatgaggaggggaggagcttacctgaggagagtgacggcgacggcggcggcggcgcgagctgagtgcagaggcgagggaggtaaaccctaggggtggtatttataggcggctaccgaatggagggtttcgctgggtcgggcggaaatgtaggaatgggcttgaatgctagggctttgtgtggaggtcgcagactgggcctcacactaggtaaagcgaatgggcttttggactggatcgcttggacacgaccacaccaacttgcttacggcccaaatacgtctctttctgagtgttttgtattatgacagtggaatattgtgtactttatctgttcacaaatataaacattttatgttttttaaatttgttcacagatataaagatttttagaatagtaattgcttcatcaatcacctcacgttttaatttctttccatcttactctcagtaatccttctaatcccaaacatacttcattttatgatacatgtcaaagcctttttatcctcaagtctaatatctgctaaaaaaaactaaaattgtttatattctgttggaataaataggttaggccaaatttaatttaattaaaatcttaagatcccataagtattgttagagacaataatactaccttgaaaatttatgtggaataacctcaacttaaatagagtgatattggagaatccatgttgaccggttgaggtgatggttggactgccacacgcgcgcgcgccgagtcggcctcggccgtgggcgtggcgaggcgaggcggcctgccgagccaagcctcttgttgctcttccgttttgtaacagacgaaaataaagtcaccattaacaaatgaaattcattgtgtgttgtaacctacacaacaaatgagagattcattgtgttgtaacctccacaacaaatagagatttatttgttgtaacctctacaacaaatagattcattgtgtggtaaccttcacaacaaatgagatttatttgtgtggtaatggagatctctctatataaataacgcaaaggaaaaggctctcaaagattgagtcttcctcctgctgatgttccttggcgatattctccttttgttcctgcgttgtctctctgtttccccggttctgtccatcccgcacgtacggtagatcggaacgagcaggtgcctccgaaacttcatccgcttgagaacctgcacgggtaggcgggcgattaagtttttggggagcgctacgtgcgactgcttttgttcgtctccctctgcatcatcctcgccaacatgacgaacaccggcgacaacagtaacactggagacaaggagaaggaggctcccgttaacaccaacggaggcaatactgcctcaaactccagcggagagccattctcggggtataacgatttactattaccgtttgttcttcgtttcctactactgtcagtcgcaatgttattgcgttgccttgtctatgttgatgcttattttatattaagcacactcatattgtacacatttagcactgccactagatcttctcaaattgcaaatgtcatgttgaaaggaccttgatgtcgcctagagggggagtgaataggcggttttaaaaaataaatgtggaagctaagacaaaacagggtcggattgtctgatatcaggtcggatagtcctatgtgatcagatagtctgaactgagatcagactatctgacctgcacaacaacaatacaaacaagaaacaacctaaaagctctagatccaatccacaagcaaggaggtgagctcaaccaacaacagtaaaagcatggcacaaagcaatgcaacaagaaggtaaatatagtgagaatatcaccgaggtttacgcgatgatgtatttcccggagttcaaatccttgaggggattctagtctccgttgaggggctcgcaaagagacgggtctttttcaaccctatcctcgtgagattgcacaaatgcactcctccttccactaaggatatctctttccttgcggaggcgagatccggccttcacaaacttctcttggccaaccacatgtagatcggtggcccaagaacaacacctagccatctaggagtcctcaacctccaagagtaataaacaccacacaactcttggacaaatcctagtgctcaagatcaagagaaacacacactaggctcccaaactccaaatccacacacaaagatctaagtcacaaaaaacaagagagatttcagatagagagggagagagctcaaagatccaaagcatttagcacaaagcttaacccaaaacaagatttgaatgaaatgtattttgggagaccctagaaaagggttggtggggggtttatatagatcccccaaaatgtgaccgttggaggggaatctttcagcccacgtcggatagtccgatacaagatcggatagtccaatattttaaacctccaaggcaatgagaaacagagaatgaagttccatgaaatttcggacttaccgagacatcggactatctgatgttaaattggagtatctgatattttagaagtaaaaacttcgtcctcaaacaaagactcaagttccatgaaatttcggagtctctgtatcatcggactatctgatctaacatcggatactccgacacctagaaaaactcactcgaaaggatttttcaaacaaagacagagagtgaagttctgtgaaaaatcggatagttcgatacatcggatagtctgatttcaaatcggatagtctgatgttgctcaagtaaaaatgcaataactttttactccgaactccgatttcgaagatcttggactctatagaaagctagtttcgtgggctatcaaacccaacataaaaaatggtccaaaaccttcaagagtatataaaaaacttgcaaagaaacccggtgtaagtgttgtgacaagtgaaacaactcgggattgaaattttggcttaggtttttcaactcacacaaagatgaagcattttgagcactaatattcaaccaattatatgcatgtggtatccctcttaatagtacggcatcctaaactcaaatttaaaaggcaaagttataccaataggagtgccttcacaccatattgtttcttcacttggagggttaccaacgtcaaggtcatttgatcatcgaaaagatctcatcttcttgatctttgacatttcatcttccatttctcaaatgattgatgtggataatccatggcttcaaatggcctcgcacggttcatcacgacacagtcttcactcgcccttcaccaccggtttcggttcgtcggcgccaagccccttgcttgcccttcaccaccgcatggtctattgcagctgagtgtcgcttgcgcttcaccgtcttgccataagtagtcacttcatacccgcatcttcaatatcttctctttaattctcatccatcaataagtccatttcctagcttcttcatcggactaatcacttgcttatacactcaataagtgcattagtcccttaatcgtttgtcatcaataaatcaaaacccactaggggcataaatgctctttcacatgtgttttgtcttaatattttagattaaaatatgtcgaattatgaccaaatttccaacatattcatggactgtgtgggagtacatctctatacattgttaaaggcatactcactctgtcgaaaattaaatcaaattttatcatcccgagccaagtttagtgatgatatagaaatatttaagtgggcttcattaatagaaaattctaattgatgggttgataggtatgtgatattgataggataaacttcttgatttacggagtgaggataagtaaatggataaaaatcgacttattttgaaacaaaatatgaactcttgtaggatcgagatgtcgactagaggggggagggtgaataggtgatttaaaactaaatgacacctaatcaaaactaacctaagttgctaggcttggtgagggtcaactctaactaagcaactaagttatgttttgcaaacctagggtgatagtggctcaattatatctctaggaaagtaaatcacactcctatgtcaatgtttagcaatcctagggtgatatgatctcaagtttgtctctagaaatataaattgcacaaatgtaaatgcgacaatcaaatgagacaaggagacaagagatttttcaccgaggttcggaaactcgtcggtttcctactccccgttgaggcgagcccaactccaccgctcaaccacgaagccaccgcacgcccccttcgtctaggggtgggcaaggcgggagccggcccacggagaggactacccaagcctcgatcactcggggtagttcttccttcactccgaaggtggtgaactccaaaccactcacaaaccggcaccgggcctcctccataatcttctcggagaggtcaccaggcaacttctccacaagccgtctaggaggcggcaacctccaagagtaacaagcaatgacctggcgtggagatgatcaatcaagtgccacactagctctacaaatggaagcaaatgcacttgactcttggctaatcaaccctctaacacactagatggatgaacacaaagctcaagtgagtgtgagagaggtgcaaggggtgtatgcaattgaattgggtgccaagagagtccccttgctgctggtgggggagtatttatactctcacccaccaaaactagccgttgggggcgaaatcccccaactttgtgctctgccggtctgaccggaggtatgtggccgatcagaccgtgctactctgcagcggctagaaaactagccgttgaagtgctgtcattgggccccatcggcctggccggtcagaccgacatggggtgggcggtcagaccggcctcggcttggtcagactatggctccgtcggctctgtatcgaatacggctccgaacagcatcatctcggcctccagggggccggtctgaccgcacatgtgccaccggtcagaccagcccacacctgccggtcagaccgcccgcttggggccggtcagaccggccagggcacgccggtcagaccgccactatgtggccggtctgaccgcccctggtcaggccgaacccagtgcaaacagggaacaacaatatatagcaagtgtgtgttgtgaaatgtgagcagaagtctaaatgcataatgacctaatgtggcaattaaaatcatctctttgctaggtcattacccctcttaatagtacggcgaaactaaaaataaactagcacaattttgatcgccctacacctcgatcaattctaaattaaagcgctagttttaccatcttctttccctttgctttgcgccgtcaattttaatccatcgataatcatccatgcgcagatatgatgtggacctaacttaaaatatatagctcaaagacaatggttagtccaaaattagcgcttgtcattaattaccaaaattaacaacgggggcctagatgcttaacctccttcgtcaaggggtgggcaaggtgggagccggcccacgaagtggactacccaagcctcgatcactaggggtagttcttctttcactttgaaggtggtgaactccaaaccactcacaattggcgcggggccttctccacaatctccttggagaggtcaccgggcaacacctccacaagccttctaggaggcggcaacctccaatagtaacaagcgatgatccgactcgaagatgatcaagtgccacactagctctcacaatgaagcaatgcacttgactcttggctaatcaactctcaaacacaacaaatggatgaacacaagcactagagagtgtgagagtagttgcaaggggtgtatgcaaataaagcaagtgccaagagaatccccttgttgttggtgggtgtcagggttacgggttaggcataccctttacccttcgatatacgttacatatcgatatggcatacccacgcgcatgcggatatttcctgtatattctaaggaaacctttcacggaatatacagacgggaagaatcctactcgggcagaactgggtcgttggcgtatcgtatagggtctgatacctccaagttctacgtggagacctctagatctgcgatataaaagggaccccccggggagggtttaggacatcgaatctcagagccaacacaacctacacagcctacgaagccggagcctacgaggagccaagtcgtcgagggctagttgaaacaactcgactacaatctcgctggatccgacaagttcccttgttccctttgtaacctatgttttctaccatataatcccacatcaactggattagggttattacctatcaaggggcctgaaccagtataattcttatcttttgtttgcttgatgtcgtactacgtagatccttgtaccaacgtaccccaataccctctatatccggtctacgggtatcacccgtcgacagtgggggatagcccatcccacaaaaactagccgttggggtcaaaatccccaactctgtgccttgccggtcagaccaccattgggtggctggtcagaccggcctacattgtaaaggctagaaaactagcagttatagtgcattaaatgcactgacagcggggggggggggggaggcagtcagaccgccatagggcggtcggtcagactaccaggggctcggtctgaccggctgtggctctagatcaccaacccatacgagaccaaccggctaggaggggcctggtcagaccggccaacaccctccagtcagaccgaccctggtcaaacaatgcaattcaatttaaaagcgaaccaagtctaaatggaaatgacctaatctggcattttgatcatctctttgtttaggtcattacccctcttgatagtatggcaaagctttaaacaaatctggcaaatttgcatgcccaaactcctcgatcaattaaaataaaacacgctagtttcatcgtctttgttccttttgctttgcatcatcgattttaatcctcggtgatcattcatggcttgcacattatgtggtcctatctcaaaatgtataactcaagataatagttagtccacaattaacacttatcattaattatcaaaatcaacgatgggggtgttgatgcgaaaaacacacactggcctgggagatttgcttaactccagtgcaggtcctaaattttgctctcgggttcaaaggcgtgccagttaatttgatcctgcaatcaacaagaaagaaagacaagaaaaccaaggttaaatccatacacgatagccgatcggctggggccgatgacatatcgttcaaactctgagtcgatgttattggcaatagatcggcgatgaagaataaagtaatataaggttaaatatattcgatcagctgtagatattaacaatatataatcatcttcttgaaatatatttaggctaagtaattgggatagattgaacagcaagtcgagatagtataaatcacttatgctcaaaagtactttaagatgaagattatatatgcgtttatagcatagccgatcaaaaagacctaacatgtgtcggctaatactccaataccactctatattaagatattaaaacaaacaagatatatcagacaacgaccataatatactttaatgcaataagatcttaatataaagggcatatttagcatgtcaatcaagcatacaaggaataaagtagctaaatcaagtaatcataaaacaagtaatcatataaaggctgaaaccccgattgctatctccattagtaatcataaaacaagctagatattgcagttatgaatattacttaatagatcaaactcaaccgatgcaacattaagcataggaataaatacaagatctaagcaagatgatgaaaacatcagaaagatggtatatatgctatataatttagactaataacgaaatctaactctatcggctactctccagtgataaatactagccaatcataggttaaatcgtgaaactaataaagattatgaagcatatatatgataactcgacgattcacataaacaagattatagtatcatgaagatggaagcactaatcctgagaacgcaagccgccatgacaagtttacctcttgttgaagatcgaaatcgatgcagcacaacctgaaagcaagaactcgtcgaaacaatgaaagtagaaaaatggtggtgatgcgtcgaaagtgttattgagttgttgttgtaaattacatgggttcgggttatatttatacccgagataaataaacggtccttgccggacacgactcttatctctaacaaactctaagatacgaacaagactttacggcagactcttgccgaaacatatctctaaagaacctatttaaaatatcctaattaatagatacagttgcctatctgtgagcttatctccatcgaggcaatcctcatgaagcacgttggttgatcccgaagacgatcctacgaccatcttcaacgaaatcggctacatcggctgtatcggctatcctctgtcatatccatcttagctgatacagtcttcagccgatgctctcgcagctgatgcgcactctgttcttcgaatacaattctccaccgaatccactttgattccgttcttgaacctgattcatgattaccaaatttggtcattaacagggggcctagatggttcaatctcctcctttttggtaattgatgacagacaccacagatacatataataaccatgaatcacatagatacaaatgtgcaaaacagagagacggattaacgcatgattaattaagtattagcttaaaaaataaaaaatagattaatatagattaatatgatctttttacaacaatttttgtatataaaatgtttgcaaaaagtacatcatttagtagttcgagaaacgtgcttgcgggaaataaaggaatggagattgggaaccttgagttctatatagaaggaattagaaaatatatgtgaattttaatctaaggggcttaattacaaccaaatcatactctaaccttacaggagcccttttttttttgcgtgattacaggagcttaaacatgcatctacacggacgcgccaccgtccggccgtgtcaggatgccggcactgtagactagcgcccaaagatgcgtcatgaactcgccgcctgcgccgagcatctcgacgtggatgtccacgttgtccgatggcgcgaggaacagtatgaactcaacccagaactcggccagcatctgccacagccgctcctcgttgtccatagccatcctgagctggccgccgagcagcgccgccttctcgatgatggtggagctgacttgtctctcggacgcgggcaccgcatctctccttgtcttggatctcctgtagcctcgcgagcacggagctcgtcgtcctacatccgtcgaagtggtcccgcgcttgctgcaccgtcgtgtcgaagatctgctgggcgatgtagctcgggtccgggagcatctctggcacgaatgccaccaagtaggcgcagtagttgaacagcctcctcgccacgagcctgttatggtggtcgtcgtcgcggcggctacggccacggccactcgcccagtcgcagcgcgtggtgacgacgtgccacacaaggatctggtcagtgaggtttgggaaagtgcacgcccaccccagccgagacgacaggccgtgccttcgcaaggtggagatgccattggtgagccgcccagagctagacttgaaggagaggagcacggctccgctgacctcccgtgtcaggtgcttggtccgtcccctcttctggccctgcctccgtggctccaccaggcacagcgtcagccacgacagcaggttccacacccacggtcggtggttgaacccctcgaggagcacatattcgccgagattgtcctcccagtaattcatcttgggcggcgcgatgtactccttccaccagaggtggcggcggcgcctgttgtaccagggccgctcgtcgcgcacgcagccgtacacggtcttgatgtacatcatccagttgctgttgaagacgataaccgcctggaaaagctcgagcgaagatgagatctttcgccttctgcgacccagccgctgcgtgaatgtacccgtagagccgtagcttcagcagtttgtacagcgtgaacgcgaggcatatgtccctggccaaatccttctccaactcggagtacccgacctgatcgtcgatccacgggtagacccagtcaatggtgacgaccgacttgctggagctgatctgcgccaggatgtcgccgtcccggctcatgggcgccacggtggcctccccgtggaagatgtacttgtaccctttcatcgtcctggggttagccggttggtctcccgcggcgagggactcctcgatttccatgtaccgcgcgatcacctccactcccatgcgccgccgcgaggccacatcgttgctccgcccaacgaggaattcggcgaccatcgccgccgccttgaacacgctgaggctccagaacgcccaggtgaccacccgatagctcatgttgtggcctctcgtcgtgttgacgatgagccagagcacgaagatggtctggaggagatgctgccgcaccacgttcttcctctggtcgaattcgggggtaatataattaagcctccatctccttggatcgattcactggtgttttttgtggtgcgatcgatcgatgtgtaatgggggtgaactaactcgtaacaggaaagtacgtagtaaggattttgctagctcggctcatttgttctctctccaattaaaaggtgagagacggatcgaggaggaacttgaggattgttgctcatgcatttttgttctagtgcgagaatgaagtggtctccaagtaaaatgtgagagacgaaagaacaatcaaagtgttgcgcgaagccgaagaatagaatgcattcacgagctagggcaacctaaagttcttttctctcgatcggactatatgtttttgcgtgccttgagccgttcatcctcgtcgcctccaatcctccatggctgacggtcaccgggcccaatcccagagagtgggccagccctaacgaagactatatgggccatgatggtgactgttcttctatcctatctaaataggaataagttcaccggaggtcccttaacttaatagcgagattttttttgaagtcctttaaccacaaaaccagaaatgtgtacccctaaactccctcaaaccgttcaccggagttccctcggcagtatttttgcccggttttactgacgtggcatcctagtcagcaaaaaaaaatttaaaaaaaatacgtagggctcacatgtcagctgcacatatttttttcttctattttcttctccttctctcctcttctccttcaggctacgggcggaggctgcgggcggagcagccacgcgccgtggccgcggtcgtcgtcggctctccaccgtcgtcgttgctgtgagcgaggctacgcggcgcggccgtccggcggcggagcggaggcagcggagcggaggctgcgggcggagcagccgcgcgccgtggccgccgtcgtcgtcggctctccaccgtcgtcgtcgccgtgggcgaggcctagagttacatgcatatatgcattcattcatgaatatatacatatatattcgatcgatcgatcttgtcactttcaacccgtgcagcctgcaaatcaatcacaagctgcttttgctttggtctttttctctctactgcatgcatgtatccctcacttgagaacccatagctagcatgcatgcgttcacgggcttttggcctttcctctctcgcgcgcggagggacgccattgccgcctacaagctcgcgagtgaagctcggctggctctctctcctctccggcaagaagggcgccaaggccgccctgcccgacgacgacgattacaagccccccgcgccgctgctcccacccggggacggcaacgacgacgaggagcccatcaacctcgtcgcatcatcggcgaagatgaggccggcgggagagggggtggtgcgccccatcggcgaagaggtcgccgccgaccgcctgccaccgctccgcagccacacttgtccccccgccgctcgccgaccaggcccctcgctccgtcgtaattgcccgccgccctccgcccaccgctgctccgcctaccgcgctcgtggaggtcaaccaacacgacgaagacgccggcggtgaagagctggagcatgacgagcgccgccgctccgctgccactctcgcccgctgccctgcccaccgctcccgccgtcccagccgcctctctcccactctcccgccaccgctggcgcgctcgctccacgccgcccgcctcctctcccctcccccgcttcttccccgcgcgccgctgtgcccgcatcgccgcctgttgccacgccctcatctacccggccgcctcactgaaaaagagatgagaaaagagaatgtgcagctgacatatgggccccacgtactttttaatatattttttctgactaggatgccacgtcagtaaaaccggacaaaaatactgccgagggacctccggtgaacggtttaagggagtttaggggtacacatttctggttttgtggtcaagggacctcaaaaaatctcgctgttaagttgagggacctctggtgaacttattccatctaaatatggcccataatcccgttttgctgtccctcacctttacgttgagtttgataaatttgtattcctactaaaccgcacaaaccatctaaattagatcccatagtaatatgaatgagtggttcgccgacgtggcatctagtcagcaaatgaataaataaaaaacatgtgtggtccacgtgtaagtggccaaccaaattaaatttgaaaatatactgttcattctttttcttttagaaataaaaaacatgtgtggtccacgtgtaagtggccaaccaaattaaatttgaaaatatactgttcattctttttcttttagaaatattgggttgcattctaaagaaaagaaatattcgggttgtaaatttttttttacaaataaatcgtcgatcttgcacaatcattgatgaaaatgatgagtgcgtacgtcacggatggtatcgtgtggggaaagtacaagaccgtctcgcgggacggaagagcgagaccgaacggttcggtctcattgattgaaacatcggcaccgtctcgctgatgcaacggtcccccatcattaggcccctcgcctcgctccccccgtcgccgagctgctcagctagctgcctgacctgatttggaaggagagaccgggagcacgtgaaaggagaggagaacagagagagggagaagatgggaggagagtgagggttgacatgtggggctcacttccgtttttgatacgtaagcgctagatcagtgaaaccggtcatttatactgtggaaggatttaatttaacccgattttataagtaggtatggctgttaaggatgtctaagacgtaaagatgaggaatgacaagtgaacttattccaaacggtgatacggttgtccagtttgggccgaggaatccaggcccaacaaggacaagagaagattggtttggtggggccccctcggcggttgagggctgctgataaaactcaacctatacttcagggacattaaatggacttgttctttaggccgcggaaggcaggcccagtgaaagaggaaggagaagatttggtttggtggggccagcacaaacgccggccgcaaacgaatccatcatctcgcaccacgcaacgccaactctccacgcgccgccgcccacgccgacgcgaggagcactcgccgcccgccaccgcgctctccctctccccccaattccatccctccacgccacgatcgccttccgcaaggtaaccgccctcccctcgccgccgcggctcggagcttgcatgcatgcacgcatcatcatcatcggctcatcgcagatgtagggtagggacggtggtaagtgcagcgccagcttgtgtggcgaaacctagagagagaacactgttacctgcagttccaactacccgttggattaactatccctctctgtcccataatactgttcatttttttggcctcttctgtttgtcccaaaataagtttattttgatttttgagtgatcattgcatcggagtttataaaaatagagaataaatgtattgagagtaagataaagttagcaataattgcattgtgattcgataaattatgggtattttagattttttggttttgtattttggtacgtgtgggatgaatgaaaaatgggatggaggtagtagcttttgtcaaattctcttcttttgggggcattgcatcgcgtcctacatgctttgatacattgccaaagcaatcacctagtcaatttttattttgtaatgagtcaatcagtaagtggagtggttgcacaattacgatgggccgcccaaagaacgaaccttgcagtttgtttgtttgtttgttgcatatatggattttcctttacatattgcaattctaacctaaaagttcactatacaatgggcccaaaggaggagccttgcaggctgcagcctgtttgttgcacgtggaatttgtttgcatattgcaatctgacctacttgaaatttcagttatttatttatgattctgttcctttaccttgtgagattcatatctttactatgcaggtttcttcttcagtgcacatgtgaaactgtacttcacctcccatatataattcagtgcagagagcattcttgaataagtatgaacccttattttgttggtcttctcgtcccaattgcggtatctcttctcctacggaagaggagaatggttgggaagatgagggcactgccagttgatgtgggtggagagcccgggtatgcaatccgcaactatcgattcaagcaaccggttgaaactcactgggaaggtgtcaccacgctcgccgagttgtttgagcagtcctgcaaggattatgtcaacatgccgctcctcggcaccaggaagctcatctccagggaacaggaatcatcactagatgggaggtcctttgagaagcttcatcttggagagtatgactggaagtgctacgctgaggtattcaagagtgtttgcaacttcgcatctggactaattcggctaggccatcagaagactgatcgtgttgctattttcgccgagacgcgggctgagtggcaaattgctctgcaggtaggcccctgtttcttcttctgtaattgtttcatatgctaatcttgtgtgttctatttctgtggagatgtgaagaaggaatgcaatggataaatacatagagcaaaattcctacgtagtgaaacatgcatagatagaaatgagtgttccagacaaggtttgtcctaagaaaccctgcaattgcaggtgttctgctctgctaatatgcttatctaaatagcggacaaccaacagtattcaactagtaacatcgtggcaaaaaaagtattgaagtagtaatacagaatgatagtgcagttctttatttaacgtaatcatgtaaattgagtaacggggtattcagatttgtcaatgggtggcacaacatttgattattatggtatgtgtgtaactgacagtggtaggttcgtaggtgtgacagcagcagacacaggaatggtatgggttaccgagcgtatatgtacatgctgtcataccgtgaaaagtatagtgcctcatgaagatactagtcattggaaatattgcacatgctgcatgcttatataaatcttaattggtttgtttaacatacatccaccctgactctgtttcctatttttcccccctattgctctctaatgttgagatcaaccttgttcctgttccattgagatctgaacttgagtttctctaagttactgttcttctatttgcaaggcatgcttcaggcaaaatattacagttgtcacaatctacgcctccttgggagaggaagcactgtgccactcactaaatgaggtaagtagacagtacagtcacttgtgtctcaccttgtctgtactgtagtctctgtcactaaatgagctaatttgcccttatgttctccagacagaggttactactgttgtatgtggtcagaaagaactgaaaaaaatgattgatataagtgggcagcttgacacagtaaagcgagttatctatatcaatgaggaaggaatctcagctgaagtttctttagctcaaaaaagcactagctggataattgagccgtttgaggatgtaggtagattgggagatacagcacctgttgatgcaaacatgcctctcccatctgacgtagcagtgataatgtatacaagcggtagcaccggattgcctaaggtttgcccaagcccacctgtttttccagtgttctcattttggaatatctttatgctacaaatttgccttttacttccaggactcatgttggcaattacttcatgatacacataccatgtgaaatatcagttaactgtattttctgcaaataaactaacatatactaaaaatgttttatagggagtaatgatgacccatcggaacgtcctggctacactttcagcagttatgaccattgtgcctgaaattggtaaaaaggatgtatacctggcctacctgccacttgcacacattcttgagttggcagctgaggtgactctaaaatagcatctatttacatcatcggttacttaagattaataactcactgtatggatttttttttcaggcactcatagctgctgttggggcttccataggatatggatcacccttgaccctgactgatacatcaaacaaaataaaaaagggaacactgggtgatgcttctgcactcaagccaacactgatgaccgctgtacctgctatacttgatcgtgttcgtgatggtgtgagaaagaaggtactgcactttaagctgtttcgtccaatgttcttcatctctttcttaatttactgattgttatttttcatattgggatggctttaggtggatacaaagggtggtgtagcaaagcagttatttgatgttgcctataatcgtcgacttgccgcagtcaatggaagttggctgggtgcatggggattagagaaactcttgtgggatatgcttgtcttcaaaaaggtgcgagcagttttgggaggaaaaattcgctttgtactttcaggtggagcacctctatcaggagatacccagagatttatcaatatatgccttgggtaagattatgaataccatcatcccatgttgttagttgccatccttgtttaatgaactatgtttaaacacaatgaaatcataaatttaaacacaatgaagaatgaactatgcttatttgtttcaacatgcatagagacctgggaattaacaagtttatgcaatttcagggttccaatagggcaagggtatggtcttactgagacatgtgctggaggaacattttctgagtatgatgacccatctgttggtcgcgttggtgctccactaccttgttcgtacattaaggtaagttttgtttttcttacccatattctaatttcagatgaattcgtttttggtagaaaccactgtgagttgaagtcttgaagatcgtccatatatgaaagaatatgttcactgttttggtttttgtgatcactgacaagctcatgctttgatatttgtaacacgctgatcttttttcagtaatctgattgatctccatattattctagtcactattatctgttggcatcacaccgatgcttgacatttttgtaattatattatccagctgattgactggtcagaaggtggatacttaacaagtgactccccaatgcctcgaggagagattgtcattggtggtcccaatgtaactaaaggctatttcaagaatgaagctaaaacaaatgaagtctataaggtatgttgtcttgttaccaatatgttcgatgactacttcacggctcatagtaataaccttctatccacaataatttacataacctttgtacctcatttatcttgtgaaggatgacgaaaaaggtatgcgatggttctattctggtgacatcgggcgcttccacccagatggctgccttgaaatcattgaccgtaaaaaggatattgtgaagcttcaacatggtgaatatgtgtctctcgggaaggtcagcaatagtcatgttctgttcagactagtagttgttagcccttcttaactgattggaccatcacaggtggaggctgctctgattgtgagcccatatgtggagaacatcatgatccatgctgatcctttccacagttactgtgttgcacttgtggtagctgcacacaatgagctggaaaactgggcttcgcagcagggagttacatacaccgatttcgtagatttgtgccagaagccagaggctgttaaagaagtgcttggatctctatcaaaggtttgtattctccactcacctcgtccatcaataatgtagggtgcatccttggatgaactctagacctggccctttgcggcatactaatttgaacgtaagctgaaaatttgcaaaccacgtccacttttagaatgaaaaattcaactctaatgacataaacttgctatttcaggctgcgaagcaagcgcgactggagaagtttgagatcccggccaagatcaagctgatatctgagccatggaccccggagtctggccttgtcactgctgccctcaagctcaagagggaagtgctcaggaagacatatgaggatgatcttgctaaactatacgcctgatgatcaatgctgaattgctgattaagcctactcgacgttttgacacaaccagctaccgtaggacagagctcttgtgagcaaactgaagatgctgataccggcaggaggtagcctgaaattttggagctgtggttgtttgatcttttggagctagcacaattatgtgtagcctcatttcacacttacttctgtgtctctgccatattctcttgtgaatttacattgttcaaaggaaaaaaaaaaggcattctacatattatggggctattatgatcacgaagataattactccctccagccaagaagacaagtcgttttgtagttgtacatgttcgagttaaactttttaaactttaaatatcttttttttaaaaaaaatatatttagattgaatgtattatgtattagaaaaaaaataaacatcatgcttgtagatttgcctcaaaacattttaaggctattatagttttgtgggtttttcatatattttaccatataaattagcggtcaagcctaatgtaatccgtatgccatcgctccggagcagccatgcgtagcacatagaaaattcaaacctcctttggaatggaggaatgtttaaggaattttggagaaattgaacaaaaaaaatcctataaagttcctaattgccaaatgaacctgaatttgccatccctccacagtagccaaccgtagcatatcaaaagattcagtccacctttctaaaataataataataaaaagattcaatccaggtgttctgagaaggaatcaggtaataacagtcatgttgtaccttatcccttttcaaaaacttattactgaacatatcccttttcatgtggcatacccctttgatttcctctcaatgagattaggactccaaatatgccatttaattaatagggatggaatggatcagatagggatggttgataaatatattgtatttttaacatatttctaagtagattttaactttgtggatatggaacagattactttgaattttgtaaatactatggaatcagagtggactcaacttataaatgaaccaataggcacgtacatataagtacaaaagtgataacaagcaatgatctgacatcaagcaaggatccaattagactctctggctcgcgagaaatctatatgatagaagcgacaaaacattagatatactatagaagcgacaaatggaatattggatatgctatgatggtgtacaatctattctatggtatatagaaaaattggattaacttggtcggacaatccacatccgacaaaatgaataccatattcggatcttaatatatccgttactacctgccgaatttttaaaaaggcagtcttattgaatcagaaaccgaatgaatcagaaactatccaatccgttttcattcataatggtgtgtaaatttttttcgatatatattccatgcatggttgtattactgaagaattccttgttcatgttcatatgagaacaaatgcgatgactagacaacttgcactcaccgaatctggctacttcaggagaggatgtcgagaagcaaaggcgtgccgaggttgtaggtttttctttttgattgttgtatgttctcctctgtgctcttgtatctcttttggctatgtatatcctttgtgcatatagatattagattaatgaaaatccactattaaaaaatgagaacaaatgcagctgtggcaagaaatttgcaatgtactactccctccgtctaaaaaaacttaacctaggaggctaggactatgaatctggactacccttatccagatttgttgtcctaggagtagtccctcctaggttgagtttttttagatgaagggaatatatgacaaagaattgaatccaactaattgtaccaactttaatacaagagacaactacaacggccaaaataaaactgaaaaaaagctttcttttcccatttttgcatcactcgagacggaaaagagagagagagagagagcaaactaaggtggtaaactattaacatatttcctaatttattaggaaagtacaacgcccttttcactttctttttccaaattgagacacgggagcagaacagttctagctgtccatcaacctgctgctctctcctataaatacattatagagaaattcatacttaaaaatcgctggtctgtgtgtgtttagtgtggaagcgcttaaagtgtaaagacatttttatgttaaaaaaaaaagagaaagggttgtcgttgtatctggctatctatatttgtacacatatcattacttaatgtgaagtcatgtgacatccctttaatttcctcccaatgatactgggactctccgaatgtgccatacaattgtttgggatgaaacggatgtgatgaggatggatgatcaatataacgtatttttaagtggattttactttgcggatatgggacaattactttggattttgaaacagtatgaagtcaaagtggactcaacttataaatgaaccaatatgtgcacatgcatataatacaacagtggtaacaaacaacaacctgacatcgagtaagggatccaattagactactaggttcgtgggaaatctatatgctagctagaagcgacaaaagaaacaatagacatgttagaagcgacaaatggaaccgtggatatgctatgatagtgtatgatccaatctatggtataaaagaacttggataacttgatcggataatccgcatacgacaaaaataaataccatatccgaatcatcatccatccgttgtaacctgtcgaaagaggcttttcaaatcctcactcggccacatctatccgaatctaaatcggattgaaccaaaaattatgccatccgatttcatgtatagtgacgcgtaaacttattcgatatatatttcatgtgattatattgatgaaatattctaaatttatgttcatacgacaacaaatgcagtcatggtaagatttagacaaataaactttataacatataacatagaagtaaactccacctaattctaccaactttaataatacaagagacaactatagcgggaacaaaaacctaagggaaaaaaaaagttccttctcccatttttgcgtcactcgagaaggagaaaaaagaggaagaaagaaagagagcaaacatctttgcgacattaccttttactgaagcacccctctttccctctcctgctggcatggctgtccgctagccacggccaacggcccacagctggctcgctcgctcgccgtccatgatatttttcctttttttttttttcatattactcccgatgatcatcctgtcccaaaccgcaccttattatcaaatgagtaaattttgtacaacttcatcatgtaagttatataaaaccgtgaacattttgacatgtaataaataacctttattacgatattaaagttttacaaaaccacaccattaaccgatttagcatactcctatatcaattttcttttgaaaaatattcatatagatgtaatatttatataatggataaagaacgtataaatttgatgtgtaattatagaacttgaatatacggtagactaaagtaaaaaaaatgatcaatggcatgttcgataaactttatgaccataatgtatggggttatgtgccgcgcgccaaaacagttatggttttgtgcaatttaggggttgtttagatgctatactaacattatcaccatttcccatactttcgtgccacactttagctaagttatggccaataaaaagtaggccacactttaattagctagcaaaataagagtgtattcttatactaatagttcatctcattttacatattctatcaatcttccctctttctctaaaacacaaccttagtatctccaaatgaatctaaaatcaccaatgttaataaacagaggggagggaccttttatctatatgatgtggtatgtacggatatgctataagaaaagtaagagtacactcgttgtatcttgctatctacatttgcacatatcaaaactttaccataccatattagacatctccaatcatccaaatatcttactaaagttatgtgacatatccctttgatttcctcccaatgagattggtacgaataaaatggatagaataagaatggatgataaatattataccattgaagtggattttaactttacggatatggaacggattacttcggattttgagaaacactatacagtcaaagtggacttaacttagagatggaccaatatgtgcaaatgtacaaagtacaacagtggtaacaaacaacaacctgatatcgagcaggttagactcccaggcttgcaaaaagtctgaatggtagaagcgacaaatgaacacaggatatgctatagaagcgacaaacataatagtggatatgctatgagcgtgtacgatccaaatcattgatatgatatatagaagattttgattaacttggtcggataatccgtacccgacaaaaaagaataccatatatgaatctttattggtacgtactaaccgtcggattcttgaaaagacattactggatccttgcttggtcattcttgtccgaattcggaatgaactgaatcggaaactatcccgttcgttttttatgtacagtgatatgtaaacttattcgatattcgtttcatacgtgatcgtattaattaagaaattgaaatttacgttcatactgcaacaaatacagttgtggaagagacttatagacttgtatactttatagcacaaaattaaattccacctaattctaccaactttaatactacaagagacaactacaacgggaacaaaaactgaaaaaaaaaggggctttatttttcctgtgtttgcgtcactccagacaccagaaaatgaagagagaaagagagccaaaatcttgcatcgtcatcttcagctgacactctttccctccccagctgaccctcccagccgagcagccacaggccacagccgtccatggtactggtagtcatctttttcccctttccatattactcccgatgatcatcatcccgtcgccaaccatattttatttataagaaatattatactctcctcaatctcttcttaatctcttgaaaaaaaaaatctagaatcactttcgttctgaaatggagggagtaactgtttaaccttatctttatagtgtgatatgtacagatatattatttaaaaatttaagagtatcctcgtaacttcgttctatcttgctacctacatttgcacatgtcattacttgacttataccatatcaggcatcccctatcatcaaaatatctcactgaagttatctgacatatggcatatccctttgattttctccccaagagataaggactctccaaatatgccacataattggtagggatgaaatggatgggatgaggatggatgatgaatattataccatatttttaagtggattttaactttgcaaatatggaatgaattacttcagactttgaaaacactaaggagtccgagtggactcaacttagaaatggaccaatacgcacatatgtataaagtatgagagtggtaacaagcagcaacctaacgtcaaacaaggtagttagttagactcacgggctcgcaaaaagtctatgagatagaagcgacaaatagaacactagatatactatagaagcgacaaactaaatagtggatatgctatgatggtgtatgatccaaccaatggtatatcaaaagttttggattaacttggtcggataatctgcatccgacaaaatgaataccacaacctaatcttcatccgtacgttactatctattggatcttaatttaaaagttaaaaaggcattaccgaaattctcatttgactactcttgtctgaatctaaaatggattgaaccggaacattttcatgccatcagagataaacttattcaatgtacgttacgtacacagtagttccgcatacatataaagtacaacggtacggtggtaacaagcaacaacctgacataaagcaagggtccaattagactcctagattcgtgagaagcctattgaatagaaatgataaatggaacactggatatactatagaagtgacaaatgaaacaataatatatgctatgatggtgcatgatccagtctataatataaagaaaacttggattaacttggtcgaataatccgcatccgacaaaatgaatatcgtgaccaaattttcatccttccgttactatctgcggatctttaaaaaaccgttaccaggtcctcattcggtcactcgtccgaatccgagacagaattaatcaaaaactatccatttcatttcatttcctacatatgggcacgtaaacttattcgatatacattccatgcatggaagtatcacatacatataaactacaatggtggcaaacaaacgacaaccaagcatcaaacaagggatccaattttacttctagacacacgggaagtctataggatagaaacgacaataccgaatatactgtagaaacgacaaatggaacactaatatgctaatgatggtacatgaatcgaatctatgaaagctagaaaacttggattaacttggtcggataatccacatccgacaaaatgaataccgtgaccgaatcttcattcgtccgttacaatccgtcggacctttaaaaagccgttaccagatcctcactcggtcactcttatccgaatccgagacggactgaatcataaactatccattccatctccatacgtattgacacgtaaacttcctcgatagacattccacacatgttgttcatgttaaccaaggaacccaagttcgcattcacatatgaacaaatgcagttgaggcaaagagatttggacaattatactttatgacacaaaattgaatccacctcatttctaccaaccttaaatacaagagacaaatacaacagaaacagaaaggaaaaaaagaaaaaaaaagcttcttttccccattttaacgtcactagagacgccccaaataagaagacccacatcctgcgtcggcatctctcacggaagaaggaaaaaaaaaaaaaagctcccctctttccctctcctgctgacgcgccccgtcgccgccgctcgcttgccgcgcgcggccaaagcaagcaagctcgccgccggccatccatggcggcggtggagggcggaataggagaggtacaagtatccgtcaatctcttggcttcttgtttttcttttctttttcttttatgggtttgatttttgttgcaaaacgagagggagttgtctaaagatagcatttcgttgccgagcagccgcccggattagccagggaaaggcgcctacggctccggcgatctgtggcggcgaccggcgacatggacggcgacggcgacgttggcggcggcggcggcggtggtggtggtggtggtgttaggtacgtcctcgcgctcccggccatggcgtcgctggccgtcctcatcgcccacctcgacgccgccgtgcccgtgccccgtaggcctcgcagctacctcccccgcgccgtgcccatggcgtggtgggccttccgg

SEQ ID NO: 79104 - DNA, 6143 bp, Oryza sativa
cctgtccattgccgcaccatctggctgttgtgccgtgccaccagcctggccgccccgcgctgcgccgcctggctgctgagccgtgccgccgcctggcctccctgtacggtgccgctacctggcaaccacctagccgctgtgccgcaccgtcgcctagacggcccgcactgtgcatcggcgcctccccgcctgcgcttggtacctctgcccggccgagctcctcctccgctcggcctcgccccgccgcaccagcattgccgctgtgccgttcccggcaaagtcaatggaaaggggaaaataaggaaagagaaggagaaaaagaaggaaagagaaggggcaatccgggtatttagaaaaatatctcacctatttggcctggaaataataaaataatacaacctatgtcctacggccaattatacgtttttttaagtgtccatcagccgtgtcacgtttttgcggtctcccagccaattacacttttttacgtgtcctatagcaaattttgccaaaaaaaagcatgcttgtctgttcaagaaagtggacaaaagaggaggaaaaaagaactgattgagcagctattgatggaaactgatagaaaggaaagtcagctgagaaggatgtatttgagcaagaatggaggaagagatataaattagaggataaaatggaggtctatgaacaagaggagagattttggtagagggatgtggagaacaatgtatcttgaagggcgattctaattctaataactcatttttcatggattggaaaataggggaaggaagagtcacattttctcactacaaaagggttataagctactaacagaatcccagagcatacaggacacctatgggtactatggccttatttggcaaattggcagggagaagagactgcaaatgcacttgaaagagggagtgtgggctaatggagggggtttgacagaggaggatgctaagtttactacaaacttgacaacagtagagctataagtgcagataaactaactagctaactgatttacctaatggcacacgtagacccttttttaataaaaccaaaagaaaaggaatgccttcagcatctgttcttatgatgacactataacattgtaggccattccacatttctctacacaatgatcataagtcactgcatttctgaataactttaccacaaccttcatacctgcaacactctgacacctcaattaaactggagaaaacataaactgaaacgcatggtaatatacagaaacatgtggatccttttaagcatgagcatattcaggggggcttctggtctcaagttcaattgggagtccaagaacaggtatcggaacaggatctttcctgtaaccttcttcttcgcagcacaatttccacctgaactgcctcactagttagtgcatggttaccaatatctcggtcctcgcaaactcgtttccagggcacattcttgggcctcccccaaatggcacgaagcaataaggtgggattgaagtgtggttgtcaaatctagtagggtcaaacttgaccgggtcattgaaaaaatttccatccaaatgtgtgatacgttgagcagtgaagacctagcatcgcaagatgtatgtgagagtaataaaaagaaatttaggagttgggtacattgttcagatcgaaacatcactgcgacactaacggcataattggaatggaaaagatatccaatcgaaaaataaattggttaatataaaaatacttacttgccagcctttcggaatgtgatagccatggtattcgatgtctttgacagctgttcggaagcttccaaatattgggggaacagtccgcagcgtctccaatgccaccttccatgtgtacttcatccttgagacatcatcccaggttaaaggttcattaggccctttcctcctagctatctcctcttgttctgtggttcatgataggtgcaaatgataccgtgctactcagaagattaaaacaccaaaatataggcacacgatacaatatagagtactaggtgctcaccctcggttatcttgccaaggatgtctggatcattagctaggtaccggagcaagaaggtgataagaacagccgaattcccataaccggcagtcaggagtacgattgcattgtccacaatgtcctccactgtgagcgagtgtgtgccttcagagcgcaaaacaagcatgtatgtgaagaaatcatcagctgaactggaatggccttgctgcaatgctgcttccctttcgcgagcaatttgcctgaggaccttcctgatcctccggctcgctctcaggcccttgatgaacttggtgaagggtatattcactggcagagatagcaaagcctgcacaagtgtctcaaagtcggtggcaagggcttctctgatgggacctatcccttgtccaaagacgactgagcagatgatgtcaaaggtgagcctcttcgccaagggtgcagcctataatcaccaaagtagctcacaaacatgtccatactacaaaaagttgtttttactatacataaaggtctaacaattcaaacaacagtaacacaatgttcataccttgacagttttatgaccaacccagttcaggtcaatgtgcctcctgacctcctcatccatcttacgcatatacttcgtcaccatctctagcctcagatagccctgtagagcactgcggactcgctttagctcctcacctgagagtgtcagaatggaccgcccaaggatggtgttgatcgcctttgtctgggtgaaaatgaggtcctggttgctgaatacaaagtgattggccgccgggccagccataagcactgttggtgagccaaaaagtgacatcttgaacacaggaccatacttcttgatcctgtcctggtaccactggtaatcagtattactgcggagggcacgaagaagggagatgctctggccaatcaatgggaagccaagagaacctggagggagattataggatgagtacttgcgcctgatgacaaagcggaggagggtgggtatgagcaaggcaagcagcagagcaaaaggcatggaggaatccattgatggagtatgttgttatgcactatgaaggttggctgatcagcttgtggatttgtctacatgtatgtatataggcaaaccagagttgttttctttctgcatgatagacaagggagtatgattgaacaaatttgatattttctttagaactcaataaatggcctagttggcaaagctgaatatatcactttctcaaaagtcatacaacaaacaagcaaagattacaaattgagataagggaacaacccctcattgtcaccagagtaatgagtctgattcatgataacttacaatattagtttataagtaaacaattctatcaccccacatgataggagcagcttagcacgacataggtgaattactggaaataaatggaagccagctcaaagaatcacatttatgctagccaatagaatttctggatttatgctagtcaaataattgcatttcctcctcaaatgaaagacacaaaaacgaattccctaaaaaaactaaaaagggaagtacatagacaagcaaataatgagaagaactgattcctttggatctaatattagctcgaggaaagatgctacatacaacagaattaaattttgcaaagcaagcaaagcaaaccattgaaaagatctggttacaacaatttggtcatccctaacgaaacgatccatgtcctatcctatgtaataagaaattttgaacaatattctagatttaattcttctgcataactgcaggactctcaatcgacaagtatagttttagccttggcacaggccatgtatgcaggaaacatcctttttttttggcatattattatgcagaatatctgccaagaaaaacaggtagacatttcaaaaattagaagcaaattacatacttagtggtcagaaaaggttaactccagttctatatatgtgcctgtgcacaaaatgacacatttactgtagccgcaattcttctgaaaatggcatggccctgcaatatagattacagaacagtacttaagaaataagcagatgattcctcccaaatatagcatggccgtttatttaataacgttggcaaaatcaatgcattatcaggatatacacgacaatgacctcgagggcaacttagatcctaaaaaactgggcaaaaagggaaaggaaaacgacaggtcggataacatattctgaaaatccactatggtcaacttccaagaacaaaaaaaatgtatacagacagatagacttcgaagggatagactctatccaatatagatttggagatcacatcacgaatgcagatttgatttaataatatagtttgtccaccgatcgaaatcggcaataatcaggccaggagatcattattctcctataccgactttaggcagtgatcattttacactaatccacaccaccagacctgactgaaacccacccaaattccatctgtgccatcacagattcacagctcgttcagccccccatcaacaaatcgaacaacatctcaccaatcaattgcaaagctagaaatcaagaatcccaggacacctaagagctagtgaccaaacctcttagcgcgctgcctgcttgttggggggcgtcttgcaagtaggatgcaggaggggaagcttgcccactggcgcaccgccaccggccgacggtgcgcgccgccgacggggagccccgcgcaaagctgcgcagctgacggctgccgaatgcggaagatcgagccggagaatgtgggagaccagcctaggcccatgcccggatgaccagccttccagcccaacctccttagagcaggaacaatagcaggctaatgctattagccaactataaatatattttaatgagacaatagcaggctattagctagctagaaatatattttaatgagataaaagatgtgagagaaaagcagtgagctacagatttacagatttatagctagctgtagcacggactccaatacacaatgtgtgtatgacaggtgggaccatatattaatagtatagtaagcaactattatatgagttgactattagattggttatagttgaattggagctagttgtgggctatactattaaacttgctcttagggcatccacattgtaagccacgggtaagagtggtctcatgtgggccatactacctaaggctacacataaagcaactctacccccaatggaagataatctcaaatggattcttaaaatctgagggtactgtgtaaagatactacaacccacaatgcatgccctaatccacaaatccacaggagttgttttcctcttctacccttttttatattttcttcggccacagcacagtgctactacttcctcctctttctcgtcaccactcaccccaccgacgccccctccgactccgtcccggtgtgccctcttgtacgtcgccgctggtggccgacggcgagcggagcgcggggtggccgacagcgagcgagctaccgccgctctctctccctctctctttcaatgtgcggggcaaccgacgatagcgcaagtgtcgaagggacgcggggcagccgacgacggcggcagtgtggaaggcgaggaccgcaaggagcacaagcaggaggaggacgcggcggagctcctcttcctcaagtcgtcgccgcctctctctctctccctccgcccgccgctgccggattcggtgggcagcgcgagttcctaccgcgccgccgccaccggatctggtgggaagcgcgagctcccacctcgtcgccgccaccggatctggtgggaagcgtgtcgccgtcccgccaccgccggctcctccacctctccaccgacggctggcgcctgtttcactcccttctttgtcccaggtcgtcgccgtcacgccatcgttggctcctccaccacctctccgcctccgaatcctttccaccgtcggccaagggtgaaaggggaacttttgttgcgggagccgtgtccacaagacacgacaccacccaacgcgaggcctagctcagtggctttggctgaggagcaggggggacacgtccctcggagaggagtcgtgcccctctgctgggagacggctttg

SEQ ID NO: 79105 - DNA, 12185 bp, Oryza sativa
ccaaaaaaaaacccacggtgggtgttttcctatactacccctctcttctccccccctctctctctcctcttttttctccacctcattcccctcctcttctttttttcttcgctctctccgccgggtttcactcctttcgctcggcggcgtcgctgtcctccccctccctctccctttctctcccacgagcgctggcgccaccttcctcctcgccctccccagctaccgccgccgccgctttctcctctctctttctctcgccgccgctacttgcctctctcttactgccgcgcggaggaggccaaggcagaggaggtcgcgacgacggcgaccaccaccacgacgtcgtcctcgtgctcctcggtggcgagcacgggcgcctcaagtggtggctacggcggcaccgccgcagatccgtcgtcaccgtcgcctctctcttctctctctctcgcctgcgcctctctctctctctcgccgccacctcgggttcctccccaccgccgtcggtcttttcctagcgacgaggtcgagggtagaaggggaattcacaggtgtggtagccgtatccacgagcgccccaagcccccaatgtgtcacctggcagcgactccccatgaaaagttggcgaggtgcggagagagctgcatcccctagcagagggacgcgttctatcgcgggggaacggcgcggacggaaaagcgaatggccatcgctaggggtacgacctggggataccgattgtagatggccttatggcatgtctatagttacgagacaaaacttttcacgttgtcacatcgaatgtttggcacatgcatgaaacattaaataaaaaaaactaattacacagttcaccatgaaattgcgagacgaatcttttaagtctaattgcgtcatgatttgataatgtggtgctacagtaaacatttgctaacgacagattaattaggcttaataaattcatctcacagtttcctgacggaatctgtaatttgttttgttattagaccacatttaatacttaaatgtgtatccgtatatctgatgtcatatgcagagtcaaattttttttccaactaaacatgcccttagaaggccggttttatgtccaaaactgatggaaattaactctcctcataaatatgctacagtatcaaactttttaactttgaccatggtttttaaagtaaattttataaaactccatctagtatagtctaggcacaaaaacacatgaattttggcacataacacatatcctcgcgtattatggtcataaagtttcacaaaatcacaccattaaccattttgacatattcctatatcaaaatttgactctctcaaatataacttcaatctaattcatatcctgaatcgctatgccagatatcttgatcctcaacaattaaggccagtgttatttgattccctcagcaattttggaggtttgtttacgttgacgtggcgctttacttggtctaacctgctgagtcatcctgtaggtcctacccgtcagtgacccttatatttgttctcttccttccgcctcttctccgctaccactgcgtggccaatttcaccaagctcatccatggcgcccacgattgaatgcaagagaggtaggggaagagaagagaatagaatatgactaaaagcttcttggcctgctcgagggcatagtgtggtcgaagtggaagagatcaaagatgatgttggtgtagacgtggataggacggtcggggtgctccgtctctgacagtgacagtgttggtatttcttaatgacattactagaaatataattcccagcaatggtgcagaaatacttctggtatattatggttacagagttcatccgtaagcgcacggatataccattgtagtatttcacccgagagtattccaatgatatcgtatttgtttaatctcgtgggaagattataatagagagaaccgtactaataatttatatattacttgcaacaatcaaagtctaagcaggggttaatataattcaagagtagagtgacactaagcagaaacattcatacactcattcataattatctaaattaagtggaaagaatatagaaagatctattcatatacttctagtatacaggcatattatacatacatcctagttatatcattacttagctaataccctctttctgatgccctcctggtgcttcgagaagccacccatgattgccgagttccttacgacaatccgtcatgaccatccaaccgggactaaatatggagaagtaccatccccaggaaattaacttaggactatatacacgcgcgaaagaatacccgtactgagctgtcaccatcagcgacccacctcgcttccgcaacatataatctcaaataatgatatccagtaatctaaacaccacgcttaaattacgaaatactactctaatgtcatcgtcatgacatagagtcatcgtaaatacgatcactatacccacaccattgcatctcccagataagctagcatcataataaatataacttggacatataataaagttggtattcataaactcgaaaaatagtacaataccaaagtagtaaaaagaagaatattctaaataaagtacaagtcttacaaaagaaggaaaagctactaaagccataccaccatcccctcctcaccgccgcggcggcgggggtggctctgctgcctcgggcaccgccgccctgcgcggatccggcaccaagggcggcgggggcggccgatccggtgcctgccatcccctcctcaccgccacacccccctcctcaccgcccctcctcccctcttcactgccgcggcggcgggggcggctctgctgccttgggtggccccgccctgcgcgaattcgacgccaagggcggcgggggcggccgatccggtgccgctgacgacggcgggcggcgagggcgacggatccagtgccagcgatgacggcgggtggcagggacgacggatcgcggtggcgggctagggtttgggattttttttatttttattttttgtttgctaaatttatttttgcatgcggccggtataagcaaccgcatacgaaaatgggatttttgcatgtggttgcaccggccgcatgtgaaaagcttgatttttgcagaccttctcgcccttacgtttggggcaatcgtatgcaaagatgcccttcgcccgcatgcaaaaagcctttctgtagtagtaccgggtggtctgaccaagtagcctgacggtcaaaccgacaaactctaggagggaatcagtttcgggttgttttcatggattttctagattgcttcatgcttatgacttatagatggcttctatacatatgtgatattgttttgtgtgctgatttgagtcaagttggtgcaaacttatactcggatatgaagtttctttgttgttcatgtgtaggtgttgcttgaggttatgggagtttagctggtaatggttcgggactaggcttggtagaatttgagatccagacagtcaagttgatcacacaacatgctcagactagagaacaatgcacgtggaggtgaaagttttcatatgtcatacacatggtgttacatgcttatggacggatgagtcaaatttggataagagtctaagtttggtaagtttggagtgtggagttatatgggaatgttgtttcctggtttggtaggtttcctatgtgattatgagttctagttatagttgaattcgtggttagggtcagccatgttttgggtataaataaaagaggggttgaggttagaagtatatcaactttttgggagagaaaagttagggtttgcttcgagacttcgattctagtttgttcgtgaattgagagaagagtgctttagacacatcgatgtaataaagttaatttaattttaagagtttcgttgatttatgtttcccggatcccgatggtccgactgaagtacaatgagcggttagatcggcgacggtggtggcagcaagcaaataaggagaccgacaggtggtccaaccggtggcgatctgaccaacgactagggttaggactgactcgcattgatctggcggtgtgatcgaagcaacttcatcaggttcgagggtgatcttttaattctgaaaaaagatttggttttagtgttcctctggtaaacttggttcttgtatttgatcccacatcaatatttggtagaaaacacccaaaattttatgtctagattttcaaatataatttgtatcttttcttttttcttatctgcatgtataataatggatttgtaagcagtattcgaaaatatattgttcatttctggtgtattattttcttcttttttttgctcgtataatgaatacaatagggaaacaatattccaaaaaacctttgtctgtttcaatgtcctaatattttttcccgtttccactcctaatctctttttttctattctttcgattaacgtgggattttgtaaaccgtgaaagccaacctaaagactctttttctactactttctaagttaatagatcacggcttaaaagtttatacacaagaaaagtttatatatctgatttggattcatattcaaatgtttctaataaaatgtttgtatattaaagtatttttacgaagcttgtatagtttttctcgatgtaaagtttgtacttataaacttatattaactttcatggatagcatttcgtggtgggttacatgcccggatgcacgtgcgcgaacaccccccattagacccacccgaagctattgtagtatagatttactccctcggttcttaaaaaagtcaatttaagggctcctttggatgcacggggagaaaacccctaggaaaaaaccccatacagggattttccctgtaccaagtgaatccccccccaaatctctagggaagcactttccgctaagggagatttccctgctaccatttggaagcagctcacgggactgggggatgattagggtttttaagttttgagcctactctaccaaataatggctagttggagcgcacccaacaagataaaaaatgtctaaataaacataaccgagcacaaaaatagaataattaagttaaaaatgcaagaaaaaaaaaatctgaaaatcatatgaactccaagtagagcaataaattctagctaaaatagagaacattatagatacaagcatcaacttagttcatgagatgatcaaattgaggtaccatctacagtatttagccaagtattatatgagcatccaagaaatatcactttcagcaaatacaagatgtaattcatacaattatcatttacaaatatcttggaagtgttttcctcctgcattcatgagcatcaactatctccatcgctgctccaaattgagaacaaggctgaatatacaagggcaaggcctgttgcctacatccaagaattaaaaacacaagtaagggtgcaacctgtaaggcttattcgtttaaaaggaattgcaaagaaaaagcataggaataggaatatgttctaaactaccatttgtttcataggaatgcaccataggaaaattataggaaaattttcaattcctccattttcgaaggaaaagcataggaaaaaataatccactccaacctaatgtttgcattcctttggttggcttgctcaacaacataggaaaaattcctgtgtttttcaatccatagatttgcacatgtattcctatagtattcctacgtttttcctattactacgttttgaaaatccagtgaaccgaatgagcccgtagtgttggtagaaaaaaaagcattcaaatacttcttgtatagaaaatgcagactagagtatagctctgtgtgggacaatctttgtttatgccaatccagagattcaaattgaatcatggcaagaggaagagtgcaagaggacaattatcattatggacatgacaaggaaaagaagtgcatctcatatatataccccctatgtgagtcctcattaggtaaacttttgcaacattttcagctgaactgcagtgccgttgagctgctgtttaggcgcaaactgattagacagattaaagcctcatgctactacagtttgagatgcaaattaatgcgcaatgcttcagacggaccgtggccatttccagctaactctgtctcttagttttatgcccccaagcaagcacacaaacactgtcattagtgtagatagttatggttagcacttagcaatactaattagtagtagtagtagttgttttaattaactagtcttgcacgtcgatactattgaatggagttaattttgaaagagtattcagtcttggtactaacaaaaatatgtgtattcataaatatgtgattaattttgaatggagttaattttgattgagccactgagccaaagatctaaggggaaaccctagaggagaagaagagcagaaaccctaggaggaggaggagaggaggggaaagagaagaaggcttaccatggtacggtggcagcgctggtggtgtctcgccggaggagtcccggcggtggcgcgtctcgccggaggaggaggcgcggcggtgcccaacattggtcgcgcgcgagagagaagcggcggcggatcgcgcgaggaaaaattccttccctagggtttccccgcggattgggctgggaaatccctgcctcgtgggcttccaaatggacaggaaataagcctgtggaaattttcaccgcgggcctttctcccaggggaatgggcggggatcccccgggatcccaagttgccaaaggaggcctaaaagggaatgtgacccctcctagtacaacgaatctgaataatcgagataaagaaatgtccagattcgttgtattaggagggatcacatttttttcctaggttgacttttattttttggaactgatggagtatgtgactactgactagtgtagctatagatggccatatggcccgaggcccgtggcttagcccaaggcacgtcattttggcctggcccaagcatggcacagcccgactcggggtcgtgcccgtgccagcccggcctggtagctgggccgtgcttgggccgcacacttggcacggtgggctagcccggcacggcatgaccgaataaaaaaatcgaggatgtcaaatagacttaattaacatataagacaaggcccaaagagaagagaaatacaaaatagacttattttctagccatatggacccagcccacagagttgagcaacgtaaaatagacttattatgtggaaaagaacagtgaaccatcgtgccttctggccggcccggcacggcccgagtcgtgttgggccatgcctgggccgtgtttgcggcttgtgggctggcacggcacagcccagtgtaggtcgggccgtgccgcccgtttggccatctgtaagtgtagctaccagagaggggcaatgcggtcgagctccacagggaggccgttgagcggcgtcggcagcgggtccctgacgaacgtgttctcctccccgcaggccgcagcacagctgccacctgaaatgcctcacaaggtagtgcgtcgtcaccagcgtctccaccctcgcaagctccatcccggggcataccctcggcccgccgccgaacgccacgaacgattagggcagcggcggcggtggcgccgccgacgccgcctgggcgtcgaaccgggacggcaagaacttggccgggtccatgtgcgtcacgcatggcgaccagaacgcctgccaccctttcgggatgacgtagccgtcgacctcgatgtcctcgggtgctctcctgcgcgacgcgccacgacagcttcatcctcgtgacgtcctcccgtgtcagggcctcgccttcttgcttgctcttggctatctcgtcatgctctgcatccatcaatcgtggccggctatggcggttgttagggtgttcgatctttttttggcgaaaggaaatgttagtcttggggttggattattacttgccttggaccatggcggcgagtgtggctgggtcgttggcgaggtggcggaccatgaaggtcaagaggatggcggaggtgtcgtggccggcgacgagggcgttcgagcacggagttatcgacgatctcctcctccatcggtcagcagccgccggccgccgtcgccgtctcaatcggaggctcacgaggcagctgatgggatcgtccgttggggacgacttgccctgctcctccaggttggccttcttctccctcagctcacggtcgcctcgagcagccggcgcgccgtcgcgctcgatcgccttgaggccgttgcggaacgcggtgaacggcagatgagatccaccggcaccgattgcgtgccctccagcatgccggtgtacgcgtcggcgagctgctcccggatggcgccgcgctcgagcccgaacagcagggtggcgatgatgtcgaacgtcagcgtcttcatcagcgggagcaccgtgacggtgcggcggccggcccacctgtcggcgaggtggcgcctgacctcacctcgccgtcgatctttcccacgtaccgccgcagcatctccggcttgaggaactgcatcagcgcgctgacgagctccaggatgttcttcctcccgaggatatcgtcgccaggctccgtggctgcttgggcgccagcgcctcgtggaggaacaccaccttgttcgccgccggcccggcgaggagcaccgtcggcgcgccgaacagcgacagcttcgacacggggccgtacctgtcgatcctgtcctgcagccatcgctcggcggtgttgcgcccggcatggcgcgcagcagggccaggctctgcccgatcagcggcaggccgagggatcccggcggtatagatggctaaaaggcccgcccggtacggcccggcccaggcatggctaggcacggcccaccagctgtcgggccgtgctgtgccggcccgaaggcacaggtggcccatcgggcctttttttaaaataagtctattttctttccctcctctttgggctgttacatatgtatagctaaaaaataagtctattttccatctcctctttgggctgacatatgtatagttaaaataagtatattttacgtccctcctatttgggctgacatatgaatagataataagtctattttatatccttattctttcgtccatggcatatatatgtctatttttactcccttttttttatatcgggcctggctgccggcccggtcatgccgggccggcccaacgtgccagtggaggggccaggcacggcccggtggtcaggtcgtgccatgcttgggccatctatacccggcggcaagttgcaccgccgcggcgacgccctcctcgctctccccgccaggtgcacggccagcggcgtcactcaggagggcgacgaggagcgcgacgatgacggcgatcgccatcgcagcagtaggaaggggccaagtaggtggctaggagaacgagtgcgactgtgtgtgtgtgtggctaagcttggattgacacaaacaagaaagaaatctacccaacatcattgtagccttataagaggatcattagttgttacttcgtttcatattataaattactttataacttttaaatttaattaagtttatagaaaaatatagtaacattttcaacacaaaactaacatattatcaaagctagatttaatgaaatcaatttgatattttagacgttgataaatatttttaaaaatttagttaaacttaatagagttcaacttagaaaaaaaattaaaacgacttgccacggagcgagtaagagttatagtatgtgtactttgttttcaatagttacgactttgaccaatgaaattatttacaaacatttgacaacgcatggaaccaactatatactccctcatcttttctttttaaatattttataaaaatatatcatattattaaagcattttgcatcctaaacaattatagtacttacattaaccaaaacataaaagtttttattggtgaaagataaaattataggggtcaagtgtcaaattataagggtgattgccctgaaggtaactgcgtgcttggtctgtcacgtgggtgcacaaatgatctaatcactaataaagatttggccgtacgcagaaaacaagattttaatagtgatgggttgggaagggagagccacagatcgaagtcctgtctctcagccaacaccaatttctacatcacgtgggctgcggaccggcttacttgggggagtacttcgtttactgtgacatattttccaaaccgttaaaagatatatcttttaaaaaattaaaataaaattattattttttattattttaaaattagaataacaaattatatgcaaatcatctttatcttactcgtttttgtgtgtggtttacaaattccctctaaactatgtttttctatcgaagactaattcttgtttcatgcttaaaaaaactaagagaaaattgagagaggtgaggatactgtttgtgaaaaaaaaaagcatgcttgtctgttcaagaaagtggacaaaagaagaggaaaaaagaattgattgagcagcaactgatggaaactgatagaaaggaaagtcagacgaggatgatctatttgagcaagaatggaggaagagaatataaattatattagaggataaaatggagatctatgaacaagaggagagattttggcagaggagatgaggaggatctatgaacaagaggagagattttggcagaggagatgtggaggatctatgaacaagaggagagattttggcataggagatgtggagaacaatgtatcttgaaggacgattctaattctaataactcctttttcatggattggaaaataggagaagaaagagtcacactttctcactacaaacaaagggaaaattggaattccttaggcatctgtttttatgataaacactaacattgtaggccattccacatttttctacataatgatcttaagtcactccatttctgaataactttaccacagccttcatacctgcaacactcttgacacctcaactaaactggagaaaacataaactgaaacgcatggtaatagacagaaacatgtggatcattttaagcatgagcatattcaaggggggcttctggtctcaagttccattgggagtccaagaacaggcatcggaagaggatctttcctgtaaccttcttctttgcagcacaatttccacctgaactgcctcactaggtagtgcatggttaccaatgtctcggtccttgcaaactcgtttccagggcacattcttgggcctcccccaaatggcacaaagcaataaggtgggattgaagtctggttgtcaaatctagtagggtcaaacttgaccgggtcattgaaaaaatttccgtccaaatgtgtgatactttgagcagtgaagacctagcatcgcaagatgtatgtgagagtaataaaaaggaatatagcagttgggtacattaatcagatcgaaatatcactgcgacactaatggcattattggaatggaaaagatatccaatgacaaaagaaattggatcatagaaaaatgcttactttccagccttttggaatgtgatagcctcggtattcgatgtctttgatagctgttcggaagcttccaaatattgggggaacagtccgtagtgtctccaatgccaccttccatgtgtacttcatccttgagacatcatcccaggttaaaggttcattaggtcctctgctactagctatctcctcttgttctgtggttcacgataggtgcaaatgataccgtgctactcagaagattaaaacaccaaaatacaggcacacgatacaatatagagtactaggtgctcaccctcggttatcttgccaaggatgtctggatcattagctaggtaccggagcaagaaggtgataagaacagccgaattcccataaccggcagtcaggagtacgattgcattgtccacaatgtcctccactgtgagcgagtgtgtgccttcagagcgcaaaacaagcatgtatgtgaagaaatcatcagctgaactagaatggccttgctgcaatgctgcttccctttcgcgagcaatttgcctgagtacctttctgatcctccggctcgcactcaggcccttgttgaacttggtgaagggtatattcactggtagtgatagcaaagcctgcaccaa

SEQ ID NO: 79106 - DNA, 10779 bp, Oryza sativa
cctccccgtgatgggacatcggaggcggcttgggggcgcctacgtccgtgcgggtacgcgcatgggtgcagcagtgctgcgctttgcttgcttgcgggcttcttttctcctccagatgaggtgtgccatccacctgctcgacgaaatgcgccccccacccccacccccggctgataaccatatgtatgtccttcgcaaggcaatggatggcgtcatggcgcaggacgaacctccgtggactaaccatgttgaaccttctcctcccggacctctggtgcccgtcctgatggcctcatggctcaacgaagtgttaaggtacacgtcagttgtgggcacgctgcctttcttttattatttaactaggaaggtggcccgcgcgcatgcgaattattgtttgtttaaaaattttgtcataatagattaagagcaaactaaagttcggataatgttattttataatattttaagggttctatttttcttaaggtatgacttttaaatcattttttctcgagtaaataagaaactattgctagttaattatcatacaacataccgtgtagtatggccacggatgaaaaatgtgaaagcaagatactcaaaattcttatgattaaatcatctaagaaggcgcatgatgtagtaaaaagggagggaagtgtatgcatggaaaaaaaagaagaaagggaaaaataaaaaagggaggggaagcatacgtacccatgtacgtaggtgcatacctatgccacgggacgagaggtgagaccttatagtatttagttttttcaaagatcaatttaatctaacagtttataatattggacatactgattaagtgaatactttgctcttttttcccttagaatttctaatatttgctctaatttattagagcaccacgtggcagtttgagagcattttaagaaattttaaaggacttaacaatgcaattagaatattaaccgcttaatatatatgtatagggcatataataatatttgttccagtttcgtgcatgtttatatacatgttgagagaaattaattatgtggttagcaagctattagatgtctaattagtagcaattaattttgacacctatttacaattgttcatagtagctcttacatattcatcttacgactttgattatccgttgattcccaatttactgatcaccatgactcgcataaaataatatgtactacttagggtctagggcagctgaaattgatgaattatctgatttatctgatagctatttgagggtataaacgaatgaattgacttttaaaaagttaaaatgttgtttaaaaaagacaccattttaaaacttggaaagcgtgcaaacgaaaatccaactatggaatcgggaaaaaagcggatcttaaactcccttataacaccctagtctttgtaagagtgctattgatatttgttaatattgtgctcacatttataacataatgatttctttcacctatacgaacaaatagtacaaaatccaaatacgacatatataacacaatacattataattattctgtaattaactctcggtttcagtttaaacagagctaagtattggaaaaaaatacacaacccatagtgcttaattcatctctcgctgcatcacacttttaattttcttttcatgttattaacaaaattaatcatctccatatatgatttgatatgtggcaaagtggtagtgctgcggtagtcgtgatcaccttagatgcctcagacacgacgctttgtcaagcgtgcaaaaggcaaagctgcagacgtgcattgtgcagcgggcaaaaaagagaacttcggacgctttatttattagcaaataatatatcagatgatttaaataatgggtccaccggttctagtgtaagtgtacatttgttaatatagattttaaattgttaatttaatgggtacataatataatataatggtgtagactttattttgaaaccatgcattatttgagaataatagtccaatgtaacaaaaaatagttccgatgatttaaataatgggtcctcggtttaagtgcacgtataaatcaattaatatagatcttaaactgtttatttgataggtacacaatataattgtgtaaaattatttgaaaataatagtacaaaataatgagtacccatgtttaagtggaaactatattacattattaatttaatggtcacatataatagtttaaattttatttttaaaaatggtagagctaatttaattacccgagagttgcatgatggtagattctttgtgttgtaaatttatgattatttaaaaaagtatatatccatattatataaatggaaaaggaagaaaaaaagaaaaaaaaaagaaaagaagggcgtacgtacatggtacgtacgtatatatacccatgtacacatgcacgggagaaggagagctggggtccatagtatttggtttgtttaaagatcaatttcatctaatggtgtgtaataatggacccactaatttaagtgaaaatcaagggtagatgttttgctttttttcttatttctaagattttctataatttattagagtgccacgtgacagcttgagagtgtttgtatgaagtgtaatggacttttagtatataatagatagattggagccatgtcctaataactttactaatttgggatagaaggaaatactgtgatgttgttgtagcctattgttaatccggtctggagcaggtctgtgccgtgaactagtattgttcaattgtttgtgagtaaattctatactataaaacctcacttattatgatccaaattatacaaaatcatacagattttggtatgtgatacgtaagctcaggttttatggtcataatgtttcacaaaccacgttattgatcattttgattttaatctttcacacttttgggttctaccatcacatctcaaatttataagaattttattcatcatataaatattacatccattttcttaaattttgatatatgagtatatcaaaatggttaacattgtgattttgtgaaactttagatataatacccgtggttatgtgttagaacaaagtccaacaagtatggcaaacgcacccccttctcttgcagggagccttagtttagatccatgggggataagataagaggaagagagtgctgctaaatgaatgtaatgggaagatgcctccgccttcttgctcttggaggactccttttattcatatgtaatggaaaattgcagtattacccttgatcggttgcatcataggggcattgtcctaggggcgtttgagcccattattacattaatttatacaacaccctagatgtgaggggtcctttccaaccgtacacgctggcatggggttattccccaacattatgtgtcacgtgtcaaaatcgctgtggttttgtaaaatttggatcataataggtggggtcattgttttatagatattttttttattagtgtaatcaaatatatataatcaggttttctattggcaagcagaaatcaaactatcgagaacccgcgtcttggttaaaggagagatagtgagagaattttttttatttttaatttttttattaaaagttttacaaaaataatttttcattttgaaaattgacggatgtagtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctctgctagggcgattttgtactgtggggggggccgcctgcaaatgggcggcggggggcctggaattttgcaggcggcccccttgccgccctccgctacggcgattttgtactgtgggggggggccgcctacaaatgggcggcggggggcctggaattttgcaggcggcccccttgccgcccttggggagggcgattttatactgtgctttatatttttgtataaatattaatagttatcaaatctttttatattgaaaactatacaagattaaaatctccaagactggtaaaatacaattttattatttttagggcctatttggaatgttaccgtacaaatattttgttagtgccaaaatataagctgttctagcaccatatgaatgaaaagaactatgtagacgagacaaacacaagtagtactgcagtagtaatagcaaaagtagtactgctttacaagtttgtaagccaaaagaaacggtcacataaggtctgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcggaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaaaaggtgccgtaggtcgaggtcctgctccgacagtaggcgcgcgaggccgtggttgtaccggaccagctggaggtacgacgtccacggcgctgctacaggagaagacgcgcatgaccgcacgcatcttctcctgcatccggttgaaggtcaccctctgctcaacgtcagtcaagtgcaaacctctgttcaacctcacttggactgcggtgatatcggcactgatatcccatgcggcatcagcctatgcaagatggaaataaaaaaattcagtagttgtcctatattatgcaagataaatgaaataattgtgagaactaatacaaattcgacgtacccccacgaagtagtctcggtcacggtgcgtgggatacgcgtccgtgacagcggcaacgtgcggctctagggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacactccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgatgtcgctcggctggagacggtcaaacttgaacacgaagtccgggtagcctcgtctcacttggacgtgagcgtaacgacgctgcaataaacatgatcggaattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacgatacgtggctgctagcacggcagaaccccagctccactgcggcacgtcctgtggctgagcatccgcgatggaccgttagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactagagcaaccaagccttgctaggcccgactatagagtacggaggaagggtgttggccggtcctaggtgtggaaggcgcatcaccttctcgaagcgcgcagtgatatcctccttccacccaaaaacaccgtccacgggaccaactggtgctcccgccagcggtagcccgagcaggtacgacacgtcctgtagtgtcggagccatctccccacagggaaggtggaacgtgtgcgtctcaggtctccagcggtctaccagagcggcaagaagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagcgaattagtaacacatattaaacaagagtacaaacaaacaaaattgtcaccagacggaatatttctgattacaacaataactgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacactcatcacatcacaacagcattttatttcctaaatcgataacattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcatcgtaaagtcctcccacctgcttctgactcatccatatcatttctgatgcgtcgagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacagcagcaagaacgtgtgagcaaggaaggtgatgaagcttcggcttcatacaactgcaggtacatccaccatccgccttcaagacaccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgtgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgtttgtagaaatttgcacccatgtgacgcatgcaccaccgactccgaacatcaggccacttagctagaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaagtgtatgtaggtcatagtaagtattattattcctctgggcaatggtggctaacaaacgaggcaaattatcataagaagcttcaaatgtgccatacctcatctcaataatcttttgtttggctctccagacctttgcatagcttatggtgtacttgaatttgttctcgatgtgcctaataattgattttggttcaaaaccaatgttactaacaacactgctgtacatctcacttgccacaaaagctgaagtgatgtttcggtgacacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccatgaactatctgaaatgtgaccttatttgacattgtgcctgatgaaaacaataactgcgttaacctcgcatttctgtactacgccctaagttacattctctacaatattgttctccaaaattctaaaagtatgttacattctccatatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcgccccccccccacagtacaaaatcgccctagcggagggcggcaagggggccgcctgcaaaattccatgccccctcgccgcccatttgcaggcggcccc

SEQ ID NO: 79107 - DNA, 2592 bp, Oryza sativa
tgtcacagcccttcttgtggaaaacaggctggtctgaccaccatatcctgactgcttacggtcataacggcgctttccctgggcagacaggctgtccttacccttcttgtactgagtgaccttgtgaagggtgtgcttcctgcactccttgttcttgcagtaggtcttcttggtcttgggaacgttcacctatacaaaacaaatttgaaacaaaagcagtcagcttaacaaatactgaatgtggaatggacatcgcaggcctataaacaacagtcgaatgtgcataatttgaagcaaatgtgtccaaatttttcaacactgaagacacattcagcaaaccaatggttaaaacctcaattgggtcctcaggaaatatgcttatgtttgtcatcacaagaatgtcaggtctcaaagatttcatgccatcattggagcccatcagtcaaagccagacaagattaccgaacaattttagaacaagaagagaaaaaaaaaggaactcatccgatgtcctcacaggaagatgatgaaaatgtttatgctacagaagtttaagtgctaattgaatgacaacaatacacatataatctagatataacccactacaaaattttcagcatgcagagggtcagctcggaaaatacgtcgatcttcacgacaataatctggtctataccggcgattcaaagcatttaagtcttgaagataaaaatgacataactagaacaatcaccgtggacatcaacatgaacaaaaaaaaatgtcgctaaagagaaaccatctcatgttaaaatccgctagaccccaaaacgcataatcaaagaaactagctactcctccggctcaagatccccccatctacggcagatcaacatgaataaagaacgcatcctacccatcgagaaagaccatgagaaagacggcgcgcgcggagccgtggactggcacgaggacaagcacgcgtgcgatcttcccgtcgtgcggcggaggggaggaggaggaggaggaggaggagggagaagcgtaccattttcacggccgcggggagggggcggctagggtttcggaggcaagtggcggcggcgggggaggagaaggagagagaggtctgcggctttatacgggtgcggtcttggaggctagggctttactggtgagggagatagagcccatgggccgtggtgccccggctaagccccgcaagatattgtgggcttgtggccgcactttcagcccaagggcagtagtgccccggataagccctgcgcgacattgtggccgtttggttggtaaaaattttactcttgtgacaatagtttctagattttcaatgtacatgtgatttgcactatatatttttttacgcagatatgcattatccttgttcacaaaatcttactactaccagtttatcgcaacttaaaaattcgcttctcgttgattcttgtatagtagtatctcctataagtgcagtcaaatcttgaaaccttaaaaatttaatagacgtaaaaatatttaaaatatgaaaagttatattggtatatttttatgagaaactctctttcataaagttatattcgtaatgttttttaaatatataatttagactttagagactagtggccctgcggcgatcgcggcgacggatctggtctcccccgtcgttgcggcggcagatccggcctccgccgtcgtcgcagcggccgaatccggcccgagctcatggcggctagcggcggagaggaggaggccacgccccaccgccgcggagaggcggtagaggcgacggcagccgacggcggtggagaagggaggaagaaggtgaaaccgagagagaaggaagagaggcggcggaggggccacgcggtgggggaagggagaagggagcggtgggggtgggggacggtagatttatatattcgcccaaaactttttttgcagcggtcctccttacctactgccagtgaaaatgagatttttcgctggcggacgcctaagaggtccgcctagaaaaactggcggacacttaagaggcccgcctcgaaaaatagagtagttttttaggcgtttctcttagcgtggttaccagcaaaaattggtttttgctggtggtccgtagccccccacctattgttatgtttttgttgacggtttttgcatatggccgccagcgtaaattatagggtaacatcatgaaaaatcgttttttatagtgtaaaattgttatgatgataaaatgtgtattgcggactatgctgatgatgtcactcatctgaaaacagagatagtaacaaggagtgaacacgttacatatgcccacttaacccttacgaaaatgtattcgagaattactaatctaaatgctccactacgtacagtacatcgtcggagattaattgtgtgatgggccacaagaatgagctgccatgcactcgactgaattctgatggaacaggaacaccatacagtattggtaccggcgacagcaacagcaattggtttctgcttctcgcgttgacaatttcactatgctaaccaccactttgtccactaaaacgcgctcatgaccaatgtcaaatcaaaccggtggat

SEQ ID NO: 79108 - DNA, 2293 bp, Oryza sativa
aactcggtggggttgacgctcccgtcatacttctcagcgatggtgggtcggaaccttgggggccaacggacattccgaagactcgccacaaaggctctacagccgacaccaccagccgggggcacggagggctggtcctcgtgtccatgtcgaggcgacactctggacgaagaggcgccctccgtcgcgtggggagcacgccggtcattacgccggcgctcgatgtcgaggcgggcatccggctctccacgctgatcgtcccgagtcgaaggcgccgacgagggagtagcagccgaatggcgtgcaacagccgccgctcgccgcgccctccgccttgacgacacggagccagtggtagcggcgccggaggtcctggtggtggaggaccgtccaccagcacccaggcgctgctgtgccgtcatgaccaagttggccacgtcgtccagccatcgctgggctggagactccgggtcagggacgacgggcgagtgacgtaggagcgcgccagcagcctgaagcgcgccctggggcgtgctgccgtcgccatagacgaggaggcaacgctccccatctcgccgttctcctccatcgcccgcgatcggtgaagccgcggatctatcgaccctctcgagcgcctccccctgcttaggactttggtgtggaggaggcggtggagtacgagctcgacggcgtgggtttggctccccgtcgtcgccgctcacactcggagagaggtcgtgcgcctttgcttgcccggccattaggctgaacaagaaaaacttggcgcacacagaaaagtgcgagagctcagaaaacacacgctgagccccctacctggcgcgccagatgacggagtgtgggggctcctcaccgggagaccgcacaggcccccctatgccggttcggccgggggctcagggtgaaatcccaagctctgtctatatgtggaaagatcgcgacctctcgaaagagcatgaaacaccagcgatgtatacaggttcgggccgctgagaagcgtaataccctactcatgtgttttggtggatctgtgtatgaaggagctacaaagtatcagccagcctctccctccttctgggttcccgatctgggaaggtccagtcccagcccaagcctgctctccctatgggcaaggtcctccttttatatttcaaggggataccacatgcacccctctctctcttttcataaatggacggagatttgtatggttgccgtctgaatgaccttttatgggacagcccacacctacctccacttccgccggaagcaggcgcgacgtgggaacatggctgtctgctgacgatatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaggaggtaacacgccggctccggctagggacgagtgcttggaggctctcgtcctgacgggatggggcgaggcgtgcgtcagaccgcctgtcgccacctaacccacgatctgaccggtttgtgactgatcacagaccggatgaacgagcgcgctgtactgcattacgtgtggcgtgacgtgctcacccaaaccgcaataaatgcggttaggtgagccccgctgcgctcacctaacccatacacgcggcgcaaaacccacaaggggtcggggcgcctcggccctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggtcccatgtcaccgacagtagcccccggcgttatgccagggcgatcgccctccccgagggaagcggtcgggcgtgacgccacttctaaggcctggtgacaggtggggccggttcctacaggtgccgtcgaactacatcacccaaagggcggtgtgaggcagctgcgatgggctcgagctggcctcgggggcggagacaagctcgggagctggggtccactccaccacaaagtcggcgagggcctggctcttgatcgcgtggcttggttcaaagcgcaaatcgaattcagagagttcgattgcccatttcaccacccgtccagtaccctctcggttatacaagatttggccgaggggataagacgtaaccaccgtgacccgatgcgcc

SEQ ID NO: 79109 - DNA, 785 bp, Oryza sativa
ataaatgtgccgtaagcatgcatcatatatagattagctagccagctagctgccacaaaattaaatcatgaacatgtagttgtgtgtagtatgttattagcacaagaaatcatgtactaggtgtcatgtactgtttagtatatatgtgcatcttatgtatgcaaacatgaatgcatgcgtggaatattcaggatatggaagattgtcttcatgcaccttgcgatctacaggtgcagctgatgcactgtcgttgctaatccctttgtgacacgtggcatggtgacgtgtacctaaccgatcagacagacactcaggaccccatggctcgctagctagttgccactctacctcttacactgtactctgtcgtcatgattgtggacaaatgggacgataattctctccaaaaaaatagaaaaacatatatagggaaacaaatacttcctccgtcccaaaaaaaaaagacaaacactggtttctgtgcccaacgtttgaccgtccgtcttatttaaaaaaattatgaaaaaaaattaaaaagacaagtcacgtataaaatattaatcatgttttatcatccaacaacaataaaaatacgaattatgaaaaaatttcatataagacggacagtcaaagttggacaaaaaacccagggtttacttttttttgacagagggagtaggtagcaaaatgtttaaattaattacgatatacgcagttataaatgcaggagagtcttttaaccctccatgccgatgtcccctcatttctccacggcattaaaataa

SEQ ID NO: 79110 - DNA, 4151 bp, Oryza sativa
ccaattaagatatgaagtagtagaatttatcttgactttcgttagtatacattttaattactaaatgatacatttcataccaattatgtagaagttatttaacatactagacacattcattttttttcaatttaaactgactaaaacttaattcatcatacactaacgactctcttattttacatgtccgtatctgatctttatatttagacggagccttagtcacttaatggcaataccgcaatagcgtacagaatctcatactctgcgcgtatgcgtagctggttgtcactattcgcaggcagcaaaacgcatctcaacttatcgctccagcgtgcgatgcgacgtgtcgacacggtgggcatcttctgggacgctgtaaaaaccaatagcaaaagcacacctagctttcgttttattcgacagaggcctcgtttagttcccaaaataaaaaattatcatatatcatattaaatgttcggacacatgtatgatatattaaatgtgaaaaaaactaattacataatttacgtttaaatatgcgagacgaatcttttaagtctaattgaaccatgatttgataatgtggtgctacagtaaatatttgctaataacgaattaattaggcttaataaattcgtctcgcagtttcctagcggaatctgtaatttgttttgttattagactacgtttaatactttaaatatgtgtccgaatattcgatgtgacaaccaaatctaaaagttttccctaactaagcaaggccagaatactcaagataaactcaggttacgatttttttcctaggaagtaattcaggattgtaaaaaatcaatcctaagaacatgttcatatgtgtacaggtttaagatttgatgttctatgacactccataaccagacagttatgcatgcatgtggccatgtcccagacgacaccgagctgagaaagcctgaaaccgaaatgacaaagatgccggttgctctgagattcgctcgcggaacacgagcatatgcatgccgatcatcttcgcgtcttcacccccgttttgtttctttccccgggccggaatattggccccgcccgcctgccaaccaatccaaccgagccacatgcgcaatcacgcaacacatgttctcaaattactacttcctctttttaagttgaacacggttattaaaaaatacgtagaattaaataggaatagattgtaattggttggaaaggaaaggtaagtcgaaaaaataaatggtgaatggttgtgattggttgaaaaatgaatgtttgtgaagaaattattatattttagaacaaatgttaagtggtaaaattattatattttggaacagagcgtaccagatttacaatcatcaacgcgagagatccgattgtacgtacacaagcacgtacgtacaaccggtacttgcatcattgcatgataccacctgtgttattgcgtttatttttccatgtcgttttcagggttttgattagcaatctgttgtacacttgtgtactgtatttgtaatgcgggtgtgtgtatgattggtgtttgctactagtgtgcgcccccagatctcgatctggaacatgcacacatgatggatcatggatggatggatggaccagggcaccaaaggctcaatcatcttgatttgataggccgttttttgggtcgatgtacgtgtcgatggacatctgtacacttgcaaatccgtagcgaatcgattgatggatctgttatggattgatgatatattacaccgacatgacttgtgtgtagttttctctttttttctaaaaaaaaatcatcggtgtgttaatgtgtttcgtggtggattatttgattcgccagatttgacgaaagttaaatttggactcttcgtggactcgagttgggtctacatttgtctgggcttgatttgttcaagagccccatggcccattcaccaaagcagtttgtttgtggaataagtccagtttgactcccttagttagtggctgattcgtaccccagaaccacgatacggatatctcgatcccccattcccccaactattcaaactggtacaatttgacttcctcgacggttttggaggacggtttcgctaatgtgacccctttgtagcagtgttgacttggtcttcgtccaacgtggcgttgacatagcgcttacgtgacattagatttttttaaaaaaaatatgtggggtcccattttgtctcacaaaaaattacgggacccactaacacgtggggcttaaatgtcatcctcttaccggtgcacgcacgagctcggcggcaccgcctctcccctttcccttctcaaccccctccccccgctctatagcatcggatggcgagattcgaggtggtgctagcgcaggtagagacggaggagtcggcggcggcagaggagaaggccgcgtgccccgaacatgattccggcgctgcggcggaagagggagatgatggcacacctcgtcccctccctgaccacatcttgtggcatgcagggaggctgatgcaaacgacccctccccgaccacttccgcagcgagatcctggagacacaataggcgagatgcagtcgctctctctcgtcctccactcttgctctcaacgacgtaacaaaagaagtagacatgggcattgtggtcagaacacatgccaaacaatagtttggcatcggttgggagtgactttaacaatccgcggagtggcatttgagtaaaactctcttttagcagtgggagaatgtcctatttccttgttattttctcatgcggattaagattttatctcggtttccgttagcacgcttttcaagctattaaacgacatgtttcgtgaaaaaaaaattcttgatgaaagttgctttaaaatatcaaatatatcatctttcatgtttgtagtaattaaaactcaatttatcacacgttaatagctttctcgttttacatgcccgctttaaatcttaatttaaagtagaaacgaacggaccgacgtctaggactacatctgggttttctcggttattttcgttaaacggcacacactccctctataaaaaaacaaacttcgaagtctttgatctttggacatacagattcatttccagaagttttttttattgagaccaagagtgtatggttgaatttactgtaataaatttggtcaattccttaatacgtaacgtaacatgaccaataaactattttagtagctgtagcactggttaattttttctccatccaacatgtgacatttcgatggcttcgccagccatgcatatttcgaataccctcaatttatcataatcgcctatccacaacataaatagtaatcatgcttcaattatatcttcgttataaaatacagctctctgtcttatctcataaaaatacttcaaacgtgctgatattttatagtgacggagagagtaccaatttgtcaatgacagatatagtacgatgaaagctatcggatcggtgataattgtgcaaacatctcgcgagagctatcagctactacgtactatgcattatttcagttgatgtgcactttttctgaccaaaatgcatatacactgaaagaatttctctctcgtcctaccgaaaatagagtactactgcactacattcagattcgcaaaatcgcaactcgaccgttcaaatcaaaatcctaaaaatttctacgggacggaacacgccaacctgacttttgttcgtgtttgggggcgcttttccacagtataaaatcacagatacccttttgattttgataaaatcccctatgtacctatgaacagagttcacccttccccgcaaaaaaaaaaaaacataattcacctaatcctttctatactcttgaattttgctcaatcccttacatacccctgaattttagtttggatcccttccatgcccttttcgctagttgaccgttaaatttttttaaaaaagtccattttaccctttgctatgaagaaacataataaattaatgaagtatattgttggaatgtaaaaatttattggatgagactattatatttatgagtatgtaatgcaccatattatttgtgacaaatttacttttacatatgatataaaaagttaatacttatttattagttattaaaagtcctttt

SEQ ID NO: 79111 - DNA, 4919 bp, Oryza sativa
  unsure (1)..(4919): unsure at all n locations
tattcatgcctgaacaactatcgatttgcctcgtgcatgtcatgtacgggagcaattccttctctatccaaattctaccatatgagcgggagcaatccccacaattcttgaagacaacaaaaacaatgctagctaggagggcgaggcatgcagatttaaaatacacgtcgacaccatggccgagtatcgacgagatgaaatggtcgatttatcaatatttgtgctacgtccgagaccgacgaggccggacaacatattagctaaagctaacaagattggagccattcactcattccatctgtctatgactgacgaggctagacgaaaccatggccgagtgccaacatggccaggtcactatactattaacacgtctaaattggacaggaaacggatacaccgttgctgggcaccgacgaggcaaaagcaaccacaaaatccatgtttgatgaaggctagggtacatgactgggcaccgacgaggcaaaggtcacccgcttcaccaaattctctccgcacaccgacgtgatggtagtgtattgtgaccgggttttggcgaaacaaagccacctgttccacattcactatattcaacgttaaatctgcaccaacctcaaccttcggcgagtaattaattttgaagacaacgatcctaaagcgcagcttaatcggaggtgttccataggctcgctcatgtggatgtaattaaccggtagccttattgctaggcgccgggaatcagcggactgtacgcaatctcgagtcagcatacctttccattaagcatttctcgtgaaggcaaaaggcgaactcctgcgggagccatcatgtatttgtaaatattcatgttaatgaatcatgattaataaaatacagggttttcctattttctgtgtgttcgtggttttgttttcatcaaacaccaataaactcctcagctatatatagatcgtttctttaacatatgataaattagaagtagataaataaaagaataaagggtgatccaaagtgtcgctgagataaaattgtctagtctaaaattaaaacattggtttgaaggatgatccaaaataaaacatcgggaataaaaaagatagtatgaagtgaaatttactcgtaaacaaatctaatactaatactccctccgggtttataatactcgtcgttttgaacaagagcacggtcttcaaaaacaactttaatcattattatttattataatatgtatataaatgttaacaaatatataatttaattgaagtatttttaagattaatatatacatatagtcaccatagtttaaagacaaatattttagaaaattttcataatcaaagattttaaagtttgatatcattcttgtccaaaactttaaagtttgatatcattcttgtccaaaacgatacgtaaactactctcagctcggagggagtacgaaatatgttagtacgatgcagttttttctcatttttacgctactaatacatcagtggggccaaatgaaaccgcatacagtgctaatcaccagaaaattcacaaagcaccagcacctcctccagtaactgccgatgccgacggtttcgatcggtagtcctgccgatgccgacggttgagaattgtggtactggtggcaggtgtgtgtgtgtgtgttgcggcggtcggagcgtgaccagctcagcttcccccggcccccggggaagtaaccggccagctgaagtgcgctcggcccgcggttctccaccggtgcgcaacggcaaagtcgacggttcggctgggttgctgggccgctcatcgcacgaggccgttcgactgcctctccccctcaggattttgcctgtttgggccgtgcacatcaagcccgcgaactctgccgcggcgagtagttcgcttcaggttggtttggttcggttccaaattccgccctactaatttattggtaatttttaatagtatttctagtttttttattaatgctaaattttaacaatatatctctttagatagtaaaagttttagccatctaaatttagtagtgccaaaaattatctaaactttgataattttagtatggcaccaaaccaaacttgcccttcatcttcaatccccccatccccatcggtgccacgccgccagtcgtatccaaacttttctcggaccacaatcccgatgacggtcgcgtacggcgggacggcgacggctactggaaagcccacgaggaaataacgtacaagttcacggtgacacggtcgcgcacacagccacacacacacagggtcgcaggcacagcaccccggttgcgtcacggaaccgaccggtcaccgcgtccgcacgtacggagaggatggcatactggcatattccccgcgcggtgctctactgctcttctctccggaagcgccggatttcgtcgaacgggtcgaaacacgcgggcgacatcaatacatcatatccgcacgccatttggcttttgcttccttcgcgcaccattccatcgcgcgcacgagcggggagacgacgaagacgaagacgagccaggccgcgagggcaggatggtgatttccgcggtcgcggtctcgtgagtacaaacgattaacaaagttcgacgtttaggttaggtaggtcaaacgcgtgcgacaacaataatgacaagaccaatcagggacgtgtacttttttttaacagaacataagcactcacaattacaccctcaccctcatcactatgaatacatactgacatgctccttccgtctcaaaaaatactccataacaacttctcaattaacattcatttcctaaccaatcacaaccatctattattcagtttttccacctacctctacttctcaaccaatcacaatcactttctatttaattttacctattttttaataaccgtgtccaactctaaaactagcaatattctagaacaaagggagtactccacagtgtatatcatcatgttatctattattaaaaaataattaattataaatacaaataatcatatcgaatctaatattacttaaaaataactgaatatattttaaaaagaacctaaataattagggtgtagctatatatatggcgccatatttttcatcaaaaaaaagtcagcatgtatttacattgtaagtccctaaattacatatgtaattttagtgtatttacaatgtaagtctcaaaattaaattacatatgtaagtactaaaattacatatgtaaattcgaaaattacataccaattacatacgtaagtggggtgtaaatgaggtgtaactactctgtaagtggctgaaaaaaaatcgactgtagtatatggcgccatatttctagcaaatccgaataattaagctacgttttattcacagcaacgttgtatttcgttatactagtatactaatgctccaaaaggcagtttacaaaaataaaaaaacaacattatcttgtcagtactaaagtttttacacgtggacaccccatcgcacaaatcttgtggggcgcacgatgccaggctcacgtgacccgaatttttttaagcctactttggttaatctgtcccatcaccagaacattttggcgtgttatacgtcgccagaaatctctacggccacctatagcatcacgagccccagtctatggcacgtggtcccggaggacatcgtggcccacgtgccagtgacacgagcgtgcggtgcaggcggttcgcgagggtgtggatcgcatgtgtgccccacgcgatgcctcccatccaacggccacctgtccatccccaattccaacctcgacatggaaggttccagaagcttccggaaacgaccttccccatgttcgcgtcgcgtggcttctcgtcgaaggaaattttgccagaattttcgcggatatttccttcacgaaaccttggtgggagaagggagatggaattcccaatggcgtgtagaatttcaatttcgaattatgttttaaaaacggcgagaaaatgtggaatgacgcaaatgcccttctgcctcctcgcttcttttattgtcctcctccctcctctctgtcggtggtggctcctcccctctcgttgcttgcctccccccgatctgcaaagccggaggcgctcccccggcggcgaggcaggcacggcgtggacggcctcccccatctccngtcgccaccgcgccctagccttctcactccctcccggcccccgcgcgcgcgcgcgcggccgaccagccggtggtcggcttccgtctccactcgaatcgaattcgaggtatcatccattcccctcccgtatcccgccctcgtctccctccgccgcttcacgtgcccggcgtggcgtggactggagacccctccggcttggattggattggattggtttggttttccttgttctggaattttttaaaaatttttgatgcgtggtgcgctgctgattttttgcagtttgtttggagagaaatcgggggttctaggtgaacccccatgcccgacgttggcgcggtgatcgaaggatcctcgcggcggagatgaacgtggttgggcgggtagggtcgctgatctcgcagggggtgtactccgtcgcgacgccgttccacccgttcggcggcgcggtcgacatcatcgcggtcgagcagcctgacggctcgtacaggagcacgccctggtacgtccggttcggcaagttccagggcgttctcaagggcgcggagaaggtggtcaccatcaccgtcaatggcgtggacgccagcttccacatgcagctcgacaactctgggcaagcctacttcatgcgggagcttgtgcctggcagtgaaaattctgggacaagttcggaggaagaggaagctagctgtgagccctgaacctccggcgcggagtaagagcgacggggatctttacatcggagcgaaaggcagaccaggt

SEQ ID NO: 79112 - DNA, 3130 bp, Oryza sativa
gcaccccgatcgttttccttccgtcttgatccacccacacacacgatatgacgtttctacccctcacaagtacaagtataatgcatgtcaatgaggggtataaatgtcatatcatgtgtgtgactggatcaataacgatcaagacggacggaaaaattgacggaagtgctaaaaataggaagatggtgaactttggatgctattaaagtgaaccggtaactttcggtgctataaaaccaaaaacgtgaactttcgatactatataatcaattttgccttaaaattatccggtttctttatttgccattcaaaattgactctttgctttattgctattggacaaaattttgctacacctaatatgccactaccgttagcccctgcacgtgaactcgccgttagttcctcggatcatgtcaaggttttctcagaaatgtcgatcctactctcatggccttgtcattcttcctctctttaagttgtcctggcaagcgccaactatcattcttgcgcgactactatcctcttagctagaaaggtaagtgcatgcctagacctataggctacaacatcagatctatgtccttgttccgatagttattttcggataatttgagacttagtggaaagagataaacaaggatattttggtctttttactgttcatctaacggaccgttgatgcaagattgacggtaatggcatataaggatagcaaagtttcgcctaatgtcacgtaagagaaaagtccattctcaatggcatataaggaaactggagaactaataaatttcgtcttgtaagaatgtatattagacgcgcacacgtgtacatgatatcatgggacaacgtgtgcgtccaatcgtactcttggtaaaaagggacacacatgttggtggtctcgtagctgctgcagcccgacgcttccatgcccgatcgacgtcaggatgttcatctcgtgggctcgcggccgatgtgaaaccgcggcgccggccagtgcccccagccaggcggccatcaacgcatgcggcacgcacgcacgcacgcacgcacgcacgcacgcacgccacatcacgcagcctcggcgtggacggctctgacatgagccgggacgtcgcggccttcgcgtacttattaatctcccctccccgggggggaacaccgactcaccaagttcgcgtcctgctcccgcgtcgcgcgcgtgcacacacacacccacagctagcgcaaactaaggctaggctcgccgcgagaggaaggtaagtaagtacgtacatttgcgcgaggtggacgagcttgacgatggcgagtgggcaacgagcggtcggcgaggggagcggtggcctccgcccgacgacgcacgtcgcgggcggcggcgggagcgcgcgcggggagtatttcaggtgcaagacgtgcagcaagacgttcacgtcgttccaggcgctcggcgggcaccggacggggcacacgcggatggcggcgcggcagcggcaggagcacggcgccgcgggggccgccgtcgtgggggctaccaacaaccagcggcgggtggtttccgcccaccagtggcacctgtgcgccgtgtgcggggtcgagttccgcatggggcaggcgctcggcgggcacatgcggcggcacagaggcgaggcggcagcggcgacgccgccgccggcggctgcggctgcgagcgccggcgccgtgtccagcatggagccgccggagatgatcgacttgaacagcccgccggcggtcgaggaggccggtgaaggtgatcagaggttgagcgtgcggaacaggagccccatctgcttaatctgctcgtgtagggtggtgttctctgtttggtgattgtgtgcgcgcggttgcgtttccaatgccattctagtgggaccaaggaagttataaaataaagtgggaccaaggatctcgatccgtcttaaaaaaaacttaatctagtaattggataggacataatctggatatccagattcgttgtattagattatgtcctatccaagtactaggttgagttttttttggacggagggagtatgtagtataatatgtttgtgcattttccgtgtaaaaaaaaagatgcactagcaatttgtacattggttgaaactgcatcattgtgcttatggtgttcttattttctatatctaatttcagtttcttatatatagattctaatatttttaagtatatgctgattgtactttatcttctgcatttcgaaataacatactcatcctgtataccatagacacatcacttatacacatgttgagcagtgatgatattgtgtgtttaagtctcaatagtgtacaagttactatgattccgtcaagaagtggttcctaccataacttaacgcactagattgtgtatatcatattgttgatgttttgcattcggcagaaatgtgtgaggaacgcgacattcgggacattcggcaataagggtttacgactataatcactcgtctaaaccatataaagcacatgattttacctagattcacacctactaaagaagaaagttaacatgtcgaacgacgagaagctgatcataagcaatgtttatccggcatggtccacattggagtgtgcccagagatgaggccgggcactcccagacttgctcagtagtagtcctgtgtggtttaggtcactgggctaccatttgtgggtccctagtccaagctttaggacgggatgaggtgtgtcacctgcacctcattctgtattaagtgtagggtagggatgtgcgttcggtctaaatcgagagttcaatctagttttttgggtctaaaaaagttcggcctttcaaaatagattaccaaactcatcctcacaaatcttgaggaaagtgggaagttaggctgatgggctgcagtttgaagatgggctacaaagccagtagcacaatccctggttttttacatagttcaggtcttcgggcatttcgggtacccgaggaggatggccgaactacccaaaaaaagatcggtctttccacttgcccgatgtaactacaaaccaataaccaacacttcaggttcttcaggtccggttttggttttttggtctcggtttttttgcctatccctaattaagtggggctgcag

SEQ ID NO: 79113 - DNA, 4181 bp, Oryza sativa
tgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgttcatccggtctgtgatcagtcacagaccggtcagatcgtgggttaggtggcgacaggcggtctgacgcacgcctcgccccatcccgtcaggacgagagcctccaagcactcgtccctagccggagccggcgtgttacctcctggagatggcacgttggttccggtcagatatatgccaggcttcatcctaaccattacaggcaagatattgtatgaagaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtgtgggctgtcccatcagaaggtcattcagacggcaaccatacaaatctccgtccatttatgaaaagataggataagtccccacacaaaagagagagaggggtgcatgtggtatccccttgaaatataaaaggaggaccttgcccatagggagagcaggcttgggttgggactggaccttcccagatcgggaacccagaaggagggagaggctggctgatactttgtagctccttcatacacagatccaccaaaacacaggagtagggtattacgcttctcagcggcccgaacctgtatacatcgctggtgtttcatgctctttcgagaggtcgcgatctttccacatatagacagagcttgggatttcaccctgagcccccggccgaaccggcataggggggcctgtgcggtctcccggtgaggagcccccacactccgtcacggttggtaacacaaaccgggactaaagatcaaatatgcccgttacccttttgaaccgggactaaagatcatctttagccctggtttttattgcatccgggactattgtggaaatcggccgaccgacgaaagatggtttctccaccagtgatacatgccgatgtactagcaacgatataaatttaacatacactataaattgttgcattgcgtttgtatatcataaccagacaacacagagaggcagggggacgtagttttttgtatggctgcgaatcagttttgatatatattactatctcatataattatttgatggttggaacaatataaatggcttatgtttatatatagacaagattatcttacgattcgcacagttttttatagggagtaattttcacgcctcgtgtttttatatatggataaaaaaatactatatgaattggaaagggcatatttacggtgactctaatttacaggttaagtcatagacttatgagcattcgtatttacggctatttatccttttagtagtaagacggcgtatttgtcaacaacgagatgtccatataacttcgtcaactagtctagtttttttaatatgcttataaagatatggtgtgtgtatatgttcatatcggtaagtgtttgcgttgtactgtgtaattctaaaaaaaagtgagctaggtagcgttacgagtatattgttgggaaaattgatctctcggtttgaaagatcacgctagaccgttttccacccgttgtctacgcaaaatcagagcgatccaatctgttaattcccgattaactatgcgccgtgatcggtggcacccaatttatttcctattgagtcgcccccgattccccacagtgctaaatataaaaggggaggccggcccaacagtagatgacaatctctctcggtctcaatctaaacccaatcaacattggcgctggaggggaaacgtgtggcggttctaggatagtgtaggtggcaaccggaaggctgccgctaccccgcaaccggcgttctcactgctacgactacttcccttacgccgacgatcacggagcagttcgagggacttcatcctctacttccactccggttgatggtattggagagggaacaacaagaatcgcaacggtggtttcaaataacggtcagtaatcgtaaaattccgtattagggtgatcatgtttagactaagcactcatgttaatagatcagtagaatctacatatatgtgttcgtatcgggtttctagaaaattttacaacgaatagggtaatactccctccgtttctaaatatttgacgctgttgacttttttaaatatgtttaaccgttcgtcttatttaaaaaatttaagtaattattttttttcctatcatttgattaattgttaaatatacttatatgtatatatatagttttacatatttcacaaaagtttttgaataagacgaacggtcaaatatgtgataaaaagttaatggtgttaaatatttagaaatagagggagaggaagtactgatatacggagtaatcagcaaaaagatggaccatagccgtcgtgttggactcctccatgtaagacgacccggaacagcgaaaagaagaagcgcacgtaagaatcggcagggtcaaagctagtttctcaaaaaaaaaaagataataagaataatataataagaaaataaaaagaaaaaaaatccccatggagacgaaacgtggacaaaaatcgcagccgtcacgtccatctccgcaagaccgcggcgccaaacgggtcaaccacccacctctcttctcctcatccccatcccattcccatttctctcgcgcgcacggcgccgcgcgcgacgcgagacgcgacgcaagccatcaccaacacaaaaacatggcgtccaccacctcctcgcccacgcgcgcaccctcctcctacccgtaaacgacacccacaccgacccgcctccgcctgcgcggcgagaaaacccaagaaccccccacgtaggcaagacgaggagaaagaggattgcaagacgctgtccatcgaagcatgccatccatggcgcctcctcggctataaccaggcgagagagagagagacgagacgagacagccaagaacacgcgcgtgcgcgcgtgcgtgattcttagtttagcgccttcccccccgcggccgataataacacggtggtgggggaggtgttcgtccgtggcgcgttcttttgtcccaggcgtgcatggccgagacgccatgacgacgacgacggcgacgaacacggcgacgaacacggcggcagccatggaggtgaccaaggcggtcacgcagctctgcgcgcagggtgggggcggcggcgggaggaggagggggaggggcaggccggccgtgctgcggctcgacctccgctggggccgcctgctccgcctcgccgtcatcagcagggtcgtccgcctcgtctgggaccagctcctcgcctgctcctcctgcgccggcggcggcggcggccgctaccgcaggctcggcccgccgccgcagggcgtcgccgccggtgccgtcctctccccgctccccagggacgccgacgacgacgctgccgccgccgaccgcgacgcggccgatgtcgaggacgtcgtcagcctcaaggtcagcctgctcggcgattgccagatcggcaagaccagcttcatggtaacttctcccatctcctcctcctctttcaaccaagaagcaatcaaattctgaaactcgagtcagcaatcgaacacaagaatcatttcttcttgaattcagaatagtcaatccagatagtaaaaagtaaattaatctattgggtaattgattctgcaggttaagtatgttggggacgacgaggagcagaacggcttgcagatgacgggcctgaatctgatggacaagaccttggcagttcggggagctcgaattgccttcagcatttgggatgtggcaggtaatttgcacaagcatatgaactacaaatgcaggatttgtttccccctttatacttgcattggttgaagaatcagattttttaaaaaggggatccactagt

SEQ ID NO: 79114 - DNA, 2562 bp, Oryza sativa
attcgcaactgggccggcctaggaacgaagtaggaattgggcctccagcaacttccccccggcgtatcttgccgcgctctcggccaccgccacgcctcccgctccgatgctccaccgcgcagaccttgcgccggcgagaaacggcgaaacccaaatcctctctcgaatccccgcgcccgcgcttgctcgatgcaccaatggcagcaggggggggtggggggggcgcggctcgggatcctggggacctgcgccatctggcagccacgaagcgaacccaccgtccactcgccgagttcaggcggcttcgtcctgggcgaggaacgcacgccgcctgctcgacgaaatgcgcgggaaagacgggagcggaccatatgtcccacgagatcgaggaaaaggtgcgcgcgcgtcgcagacgcagatctactcccccgccgcgcccgcgcccctgccgtgaggcaagggagttgaacagtacacaggaaatgggaggaagacccgtctcgcctagcgctccaagacccaagtgagtcaactcttgtgctctgtaaatttccggtacacgttcgttggttgtccaggcctgggaattgcttgtatctgaagaaaagttgctcgtctgatccacgaatttctgtccttatctttgtggtatagtttcacacacgggtgaggtgataggactccaagaagaactggagaatggattatcataatttctggtatacgtttactcgaatgcgtgactacaatttggaaatttccttgtttcacactaaggtctggtttagttcccaactttttcttcaaacttccaactttttcatcgcatcaaaactttcctacacacacaaacttccaacttttccatcacatcgttccaatttcaatcaaacttctaattttggcgtgaactaaacacaccctaaggtatggaatacccccaaactttttataagaaaatgaacatctaacagcacacgcttttgttttggatgaaagctcatgtgaagtttctaatcaagacaccagacacatctaaagtgtgcctggaaggtttgatcttatttaagaaccattagttacatagggtccagtgacttggacttatgtcacccaaataatcttatcttatgttccagtggtggttagtgccatataccaaaaacacaatttccccgccactacctccagtcctccaccagtccaaccctccaactatattgtcatctacatcatacgttttcacagttttgcagtctgacttgctcttagttgttgcagagaattggatttacaaactgagcatagcctagaaggatctccaccacctttcccttggcaaaacagaaggtcagttcaatgtttctactccatatgtccatatgtgtggatgtccactaaatttgtgctttggtcatgcctattctgctctattcttacgtatttgctcttctacaataaaattaggatggcaggagtaggactggtagttggaggatggattgcaaaggcagtgattgccaatatcttgtccagagtacgctccctcctccacgataatttcagtctgcaaaaggacactgaaaaaatgctgaatgacttggaggttgcgcttcctcgcattgaggcggtgattgaagcagcggagcggagatcaattgaaagcagtgccctttccacatggttgcagcagttgaaggatgctgtttcccatgcaggagatgttgttgatgattttgaagccaagacaattaaagatcaggtcgaaagcaagagcaaggtcagtgcaaaggcatactctaccgtcaaggctttaaaggctttggtcttttctgatagtgaattgaagaagctgaagcatgctgtaagaagacttgaaaatgtatcagcgagagttgattctttcattgaattgatcaggctaaatgatgatgatacagtgggaaggattggccatagcttgcatagtgagaccagctctttacttggtgacaccaaagtaattggtcgggatgaagaaattaacctgatattggacatcatattgggttaccgctaccacttgccaagaactagtgagcatgcacgacctgatgatcaaccaaaatttggtcaaaggggaacactttttgataaattacggaagattttccttactggaactgctgaatctagtaaatcgagtgataaggctaaacttgaagaattagaagcaagaaagaaggggaacaaaattgaagaagaagatcctagcaaagattgcatagaaattggagaatacgaacctaatcagaagggacaaactgaaagattagattataatagttctgatgtacatgaaaccagtggttcatctcaaaaccttggcatccttcccatagttggcattaatggagtgggaaaaacaactgtggctcaagctgtcttcaacaataagagggtaaaaatgtgctttgatctaacagcatgggtttatgtgtcagacaacataagtgggaaacaaattatacaaaggatcatcatgtctttggaaccatggagtggactaactgatgatgcact

SEQ ID NO: 79115 - DNA, 1167 bp, Oryza sativa
aaaaaatagttcgagaaccgtggtatatccccccccccaaaacctccccaacccacccataaaaaaccggatggcagcaatcacaacttagcattgcttctcatagcaatgttcgtatactataagtgcaggttagttcagacttcagacacctatggtaattgttttttattttgttcgttaggtggtgtttgggtccatggattaaactttagcctttatgtttagacactaatttagactaaatatagattacttacaaaaataattaaataaatgagagctaattcgcgagacaaattttttaagcctaattaattcataattagagaatgtttactgtagcatcacataggctaatcatggattaattaggcttaatagattcgtctcgcgaattagtccaagattatggatatgttttgttaatagtctatatttaatacttctaattagtgtacaaacatccaatttggaaagtgctaaaaaattttagtcccttccaaacacccccttattatttttatcaaatagccacgtaagcgtcatctcaatagcacgtgggacaaagacccctagtcaaaggcgtcatgtcagccaaaaccagagacattgctaccgagggagctcgtttgcatagttgaagaaggcgccatgtcagccaaaaccggagacatttttatcgagggacctcgtttgcatagttgggttgtactccctccatattttaatgtatgacgccgttgactttttaatcaacgcttgaccattcgtcttattcaaaaaattatgtaattatcatttattttattatggcttgatttatcatcaaatattctttaagtatgacataaatatttttatatttgcacaaaaaatttgaataagacgaatagtcaaacattattcgaaaagtcaacggtgtcatacattaaaatacggagcgagtatatggttttcggataaggatgaaaaacagacttagcgactataagggaataagttaactaatcataaaccgtgcgaaaaagatccaaaaacatacggagcgacaaagtaagggacctattgtgaacttatttgagggataaagtcacttccttaactacaagggaataagttcacctgacgtccctcaactttatgttgagtttgtctgcggtcccc

SEQ ID NO: 79116 - DNA, 8642 bp, Oryza sativa
tttttgcttgcactgtttgaccactcatcttattcaaaaaaatttagaattattatttattttttgtgtgacttactttattatccaaagtactttaagcacaacttttcgttttttatatttgcacaatttttttaataagacgagtggtcaaacaataaaaaaaaactcaaaatcccttatattatgggacggagagagtatgtattttaagggcatgtttagtttccaaacaaaatttttcacgctattacatcgaatgtttgaatacatgtatggagtattaaatgtagaaaaaaataattacacagattgcgtgtaaattgcgagacgaatcttttaagcctaattgcaccatgatttgacaatgtggtgctacagtaaacatttgctaatgatgtattaattaggtttaataaattcgtctcgcagtttcatggcaaaatttgtaatttattttgttattagaatacatttaatactttaaatgtgtgtccgtatatccaatgtgatatgcatgggcaaaatttttgccaccaaaacaggccctaatcacaacagaaataggagtacatagcatttacacagctggatctcaatgcaaagtaacacggtccagattgatctagctatcctacctgtacatggtacgagtatgacgtgctatagtgccaagtaactagtgctgtaataatagtttaatatgatgtttaggctgagtttatgacccacacatataaataagataataagtgattaaaatatgattaatacaaacttaaaaactaatttatttaattttttttaaattttttttaaaaaatatcgtttaataatttaggaagcgtacgtgcttgtgcttatggtaaataagggagttaaaaaaccaaactcattttgaacgactcagccaaattaactaaccatcgtgggctactacttcagaaacagacaacgagatcaggtactcaccatttccaaacatataaattgccctgcaggtggcacgtaccacgtacgtacgtccaattccagcaggcagcactaatcagtcacaactactacaaggaccaatctcattaacaccaatctaattattattaacaaattaaagcaggtaacatgaggccatcgttgacttgcattagagagcgtatcaaaacaattaatcaacgtgcagggcaaacaccaattaacggatgggaaagtgatggtgccgtagttacggtaaactacgaattgtaaacagaacgtacgctgtctgatataatcttgcttaattagtttaagtccttgcatgtccaagcaactatcatttcaagccgatcaaaattcagaacacgcgtacggtgcactgattaaactagtactaaccagaatttttcaaaattgatttgccgatgatttgatcgtaattaatggcgcttgatttatatctttaatttgctcatgccggcttgataatgaagtagcgtgcaacatttcactgcagctccctctgggaaaaaaaaggacttgttcactttactactatttctaatcttaacaagttttggtactgttgaatttccattaggcagtttaaaaaaattccattaggtagctagtaatccaaacacatatctaaaataatactataccaaatctttttcatatagcttcacacgaaataattgctaagtaccaaatcaaacaacaaccacatatctctaccttaccatttttttggcatttcccagactttgctaaattctggttatgcatcaaactgaacatgcccttaaacttatctataaatgttgaccatttaacaaaatattgataatcaaaattttcatcaaatcttatctataaatgtcaaatatttttatcacgaaaagtcaagatgattaaaattagaacatgaaatcaatctttattttttgaataaatgagtatcaaagcaatcatgaacatctcccatttgagaggcaaaacgcaggttgcggtccacaactccatacatgtgtttgactgtcgcctttctgcgctctccacaatagctcctttctaatatatttttttaatcaaactttcttgtcttttaagcgagttctctttcttttagacctttttaagtttttcatatccatttgaataagcagtcttgctcggaaatcgaattttgggaagacaagctcagcacaattgcgcaaatacgtagagaaaaacatccatttgcaaatgacctgatatcagccgacaggctgtttaattttcctgtttggagctcgttcatgacgtgcccatctccacattaactggatgtgtcagagttttaagtgttttttcttaaaaaaaatccggttcttatgtgaagatttctcctaaattacagctgaaaaacattttttttgtgaaataggaaaattataataaattgtcctttccatgtcacaaacacataaacctattaattgatataccatacaaacaactattacactacatacacttaaggggtagtaaataaaaaaattgctgcaatatcttcattcttgaattactcaaagggcaaatattttttttaaaaaaaggacaagtattttgatacgccgcatcctaaataaaaattgatactactaagttataaaatgaagtaacatcccaagatgctactagtatttagaattggttctgcttagctgaaacagtaagcatatgccatgtttgttgttgtgatagtcaaaacacacacggacatataattagcctgaaatttcaactcaggcatgtggaaagctttaaaaaatcttttatgtcaccgaggtggaatctgtccaaaaccccaaatacctccaagtactgaattctttaattccaagaaagcccaatttgcatgtaaccccttcacaaatatactattcttttcttgaaatgccttactagaaaataccaaatggaaaaaagaataatttgttcacaacacacaaatgacatttgacactattctcttcgtcccagaaaaaagtaactttcatacatatatcaaataacttatatatataaagcacatatactaaataacttttatacatgtccagtctaaatttacacttaagagttgtttttttatggccaagtttagtttcaaacttccaatttttttatcacatcaaaacttttctacacacataaattttcaacttctccgtcacgtcattctaatttcaaccaaacttctaattttaacgtgtactaaacacctatagacagggaattcgagtcagaatgacagagaagagagcgaagagaagaagaagcagccggcaggcaataaatggggagaggtgtataagttgcacccttcaaggcacacaaacaggtcatttgaatgtgacctactctcccctcaccccttcatcaattcggctcagaggctgctcctcctcagtcctgagtctcctgtcctcatctccattttgttttctcctcctcctcctctctctctctctctctctctctctctctctctgtctctctggtggagtgcagtgcagagattcaagaagttcaagatcgaacaggcctgctggtatgaaccctgttcatgttttttgcttgctctgtgtaatctctctgggctctggccatctggtgctggagagattggagatttgctgcataatcattggttcattactaccagttgtttgttgaagctccattaattggggattcagtggttcttgttttggtatttcctcttaccatttcttagggtggttttggttgatgtattttcccacaaattcattccatgcgtggagttcttgatggctaatccatagtggtttcaggctttcagctgctattcttctttttgttttttctcctcccccaaattgtctgctgtatggaacagagagcagttcattatgttttctggatgctcttgtatgcctttttttaatcaaactgtcagcttctgttctctgtccatgcttcttctgggctttgacctgaaagattgtggtttagaacattaaatctgcaccccaaaaaccatatattgtccgacatgcagaagtggaaatgtgagctcttgtttaatgctgctcatttgttgcctcttttcaagaaaatgaaaatttgttacaattgcgtggtctagttcttgttttcttccatccctgtattagataaggagtttggtaggcactgtcacatgattttgtgccgcaattgattttattcattagattagtaacctaaggaatccaagaacattagggtacattaataaaatgcaaagaaacagggacagaagagagtaggttctttactttgcccagttggcatcccctgaagtgatgcttgatgcttccttccattttgattatctcttgctgctgttggtggtaaatcattattattagtactaccttttttatttttcggaagaagaaaaagaggaacaagccaatgtggcctacataatatgtggtctagaaagttggcatcagtagtgtgtagatgcaatttgaggaaattaaggcagaaaggaagggacaggaaaaggggctgaaaggtttgcttgagcatagtgcatctccacaccttaaaattgctggtcaaattgtccttaaaatcgtttatatcacgcagacggcatatcgttttcgacattgccttccttaactcctgtgttaattcgaccacaactttagaacagcttgttgagatttcttaatcccagtgttgtatgtcaacattgcattgattgtagtattattatgagaagattagatactgtaacccctccagagagtgacatccattgccttctgttactggatttctgccaattcttagttagatttatggataaaaagtttttaaccaagtagacttaacaggaccaaaggttgaatttgttcacctaagaaaaatgtacaatttgttgaacaaacagcacaattcttgaatgaggagatttttagtagtcaggtttgttgtttggatatcatagtttttgaatgaggagaacatattggttggatttactgcgtggacatcacaattattgaatttggagaacaaattggttagatttgttgtgtggatatcatacttcttgaattagaagaccaaactagttgtttctttgaacaaattggttagaattattttttttttaaaaaaatcatttttcccttcatgaattaggaacagacagattgatgcccatgttaccatggtggtgtctgactcattgcagtcttatctttttacactctctagttttcccaagctgcaatcatggtggccaagtgcatgccatgatgcacctctcatataccaccatctctgcatgctcaagaacatcatgattttttgttcttcttgtcaccaactttttttttgtttttccccctaacttcttttcacccttgcaacgcacttctcactcgtagctttagttttcctcttgtcagtagcatatgtttgtttagttgtgataaattatcttttttttccagatcatgccttgtgctgcggccgagctcgccaatggcgaggcggcggcagcagcagcatgcgcggtgaaggtcggcacgaccggcaccatcggctcgctgatgacgagggagctggaggccatcaaggccgcgccgccgcacgccacagccgcggcgacgacgccgcggcggctgaggcggcagagcagcccggtgtcggtgccatgcggagccagcccgaggaagatcgccgcgctgaggaagagctcgtccagcctctccaccaccagcagcggcggcggcagcgggcggcgcactgaccgcgtgagcgccgaggagtcgtcggcgtgcaagacggcggcgtgcaggaggagctctagtaccacgccggccagctccccgatgctcgcggcggacgtcgaccggagcggcggcggcggcaaggcgaagaaggcggcggcgagggggcgccgcggcgtcggcggcgtggaggtggtggacgtgaggtgcgggaacccgatgagcagccggctgaggaggctgggattctccaagctgtcggagacgttcgcgtgagcagaatcagatcgtcttcagtcctgacggcgagctgtgtcgcgaattgcaattcggaattgcattatgtttgctatagtaattatattgttgttattaaaattttcttttgctggtttctctcgtgtatgggtatgaccaaattaagttaatttatgagaagcgttttgccatcgtcgcaatgcaagttcttcgtggtgatgtgtatgatgtacccgtaattgcgtattttaacttttggagtgaatgtctcctcgtttttttatgccgtccaaatagttattttttttaaacaaggtaatatgatagattaatatatgatatattacactaaaaacatgcatgttaaaattatatctccacaaattgcaaacataaacactagctagttaacgtatactactactactcacaattaaatttgttttgccaattcaaaattatatgtttacgaagtaatatatcatatattaatttatcttattagttttttttaaaaaaattataaccatttggatgagttcaagatcgtttttccatgttttttagcctatagactggcgcgttgagcgttgctggatctcgaatcaacggtagatcttgcacaaacgattcttgaaacttttttcccgtgtcacgtcgaggtactgtagaaagacagaagtgaactacaaaattggatgcaatttttagtaattgattagctaacatggtgatttaccacttcaccgtattaggaaggaaaaaaaaaggactcattggcttataagattcagcgaaagatagaaacacacccactgtttggttttacatcatggagggtgtatgtcatcttggaaatacaaacttgatgggaaagtaggaaatcttgttgggtgtgttcgctattcctggatcccaaccggatccctccgcacggaaaacggagcggtttattagcgtgtaattaataagtattagctattttgttaaaaaaatggattaatttgattttttaaacaactttcatatagaaatttttttttttaaaaaacgcaccgtttagcagtttgaaaagcgtacgtgtggaaaataagggagatgagatgggaaaggggcatccgaagtctggaatggaagtagggatttctagactgttgattgatgtttgaaataaccaagctcaatgcatccaaaatgaggctagatttgagctgttcatgattgaatgcaatgtcagaagatctgagatcactactactcactgtactaactccctcacagttgcatatcatctgaaggagacaagagggaagatctttgattggatgctggatgatgagctagtttaatagccctacttgacaggataaccgtgtgaagtgttttgttggagcaaacaggaactttctctgtttgaaggttaagcaatcattaatcataatatatgtaaaaaaaccaatcattaatcaaataatggtgaggatattcaagacccatgccaaatgatttgggcttgggactgagatattggcagggatttattgggcttcccaaacaggacctaactgtgttcctagcttttttagaacttctaactgtttctagctggcttattattctacaagcctactggttattctaccaactggttcacaattctggaaaagtgccaagaagcaaatacccggcaagatactgtccgttcattcctgagatataataaaatagatttatttaaattttttaaagaattttttatataaaaagtttttggacgaaatacatcatttaatcgggaaaacgagcttacagagaacgagataacaactttagcccaaatgaaggtcaaaacgccgcaagctaatagtgagttcaaagcagcttaatagactggcttttccatggcacgtttaacgagaaaaaactattagcgtacaattaattaagtattaactattatattttttaaaaaataatttttaaaatttttaaaatattttttttataaaaaagtttatagaaaaaaatactgtgagcaacttagaaaacatggttatggctgtgtttgctgggggaggttgggaacaaatcttcttcgcacggaaaacggagcggtccattaacacgtgattaattagaaattagctaatttttttttaaaatgaatcaatatgattttttaagcaatttttgtatagaaactttttgcaaaaaacacattgtttaacagtttaaaaagcgtgcacgcggaaaacgatggagaggtgctgggaacccttgggtccgaacacaccctaggatcttagggaaaacaagtcctactagcggccaactcacaaaaggctgattcagactcagcctaaagggaaagaaaaaacacttccgaatgaaacaataatatgattcacatggcaaagctgccgccatatgttttgcaggtggtagctgccaaaagctcaaagctgagagcggagcacacagattcctttttccaggaatatgcaggaggcagtgtgctgttgtcccagtatggcacggatcaaatttatccatcttttttttcaccttacttttactgaaatt

SEQ ID NO: 79117 - DNA, 1716 bp, Oryza sativa
tagtatttctatacatctaaagtttatacacctaaagtttagtttatagatccaaagtttataagtcaaaagtttacatacccgattcaaatttaaatttgaattatgtccgattcaaatttgaatttgaattcaaatattttctatatatagtatttctatacatctaaagtttatacacttaaagtttatagacctaaagtttataagtcaaaagtttacatactcgattcaaatttgaatttgaattcaattttttttatatatagtatttctatacataaatttttttaacttttgttttttttaaaaaaattgtgtggtatactgtagtagaaagagaagaaggggaggaggaagggggagaagagggaggagtatagggggaggcggggccaaccgatcgctgggcgattgcctgtcggagtctgaaactaaaaacttgcatccgaattaatgtatcaatccctggatcagtaaatattgatacatacaatataactggttcttcattgcatatgttaaagttttacaatactaagggttttacaataatacgtactcgcctaactaattaatacacagcggaagtttctatacattctgactagggaggtataaccttaagggattctctaagttatcggggtcatcgtattaatagtcataggggtcctccttgacccaaatctgaaaaaggggttataagagcaaggatgagtattcgcaatactcagcaagttatcatggaaatatgttatgcattaatacatagtagggttctttgcaaaaagcagtaataaacaatctggaaaagttatagaaagaatttataaaacgtatagactttagatttctaaccagggtaccatatgagtcccgatactcaattccatgagtacggctattcgaatagtttcaaagatattctactgcagcagatgtacgttttacccgtagtccaggacttgctgataatcatcggctttagtcatggcccagtattaagtcattaacaattgtggcacctgttccatgaacttatatcctcatatgctctgaatgtattgttaacagcagcaagaggagttctggcgttcccgaggtatttaagggggaactgatcgtatgacaccacgtcatctcgatcagggtttagaaatataccatatagtttatactcgagtatcacaaaccatttacctgtacatggtaatggttaaagttgcccttcgcggctatagttgcctcctgcgcgaggatttaaaaataagaaccactatacagagatgccatattgctaattaacataatagctaggtctgtccccgttctagaaactgcggtcgtacccgttcgttcgacataagtacctggtaataactatatcgattgagacagtacttgacggagcgtggggctcctcaccgggagaccgcgtaggtccccctttgccggttcggccgggggcgctgagtgaggttcttcaccctcgatctgtggaacgttcgcgagagagcaaatgcacaagacacgggcgatgtatacaggttcgggccgctgagaagcgtaataccctactcctgtgttctggtggatctgtgtatgaaggagttacagagcaaatggagagcaagagagttcaagctctagaacccctctttttccttctcttctggttcttttttttctctcaatctcctcctcccttttttg

SEQ ID NO: 79118 - DNA, 738 bp, Oryza sativa
cattggctcagttaatcagtgattagcagtttagcactactaagtaatttcgaaatcgaaatctttgtaaattaaacattttgaatttgaaatggtgacatagctcattccccaagaacaatgaggagaggaaaaaaaaaacaaagcatggagtggtgcagtgatgttctacagtacttcgattgagcttgtaggcgtgtgcattctctgaattttttagacccttcttcgtgtcaacatgttggagtgtgtgaaggtgtcattcatgtagtacagtacaaaatggcctggctgactgtctcgtcggattctgaatttcaggtcagcaaccatcgattcagaattcagagagagagagagagagagagagtgagagaaagacagcatttccatgaattttctagagcaaatcattttatttcgattcctactagcacgtttttcaagctattcataaaaaactttctatataaaagttgttttagaatatcaaatatattcactttttaagtttataataattaattatgtgctaatatttctctttttatgtgtgtcactttaattttcatctttatcattttcaaacaccacctgaatgcatgtgtgacttcgatgtattcaagggattgaggtaaaactgcacaacagcaattgtacacaatctaaagatttaacggccaaaaccgattcaccacattaaaatcgaaacaatacattttcatagtagggctgcag

SEQ ID NO: 79119 - DNA, 7544 bp, Oryza sativa
tcggtgtgtcgcagggcgatggatcaccacttcattcactcccacgggaattcaccaccaaactcgacgactggtgaagtactaaccttttgaagcctgaatcgaaagatcaccggtcggctgcggcggctgctgctactttactgctcagtttcagatcgaactcacaaaaccacatgatttaacgtgaagctagttatcaaactgttaacaatgcgtatcggtaaaaaaaaagaaaaaacttgtatataaaaccttcaaatttataatagtaaaaacttgattaatcatgtactaataacagctcgtctcgttttcatgttatggactagtcaagtccaattataccttggaatgcagcttgggtgcgtccttttgattatggttttagagcagcaacatattttaaagagataaaagaagagagagaatagcaacgagctatagatctgtagctagctgtagtacggattttaagacgtaatgagtatatgacatgtgggaccaggtattagttactccctccgtactcataaaggaagtcatttaggacaatgtttaagtcgaaccttgggaataaaaaacataaataactcttaagttgttgcattgaaaatgtaaaaattatatgaatagatttgtcttgaaaaatattttcataaaagtatacatatatcacttttaaaaaacaagaagtcaaagttgtgttttgaagaccatgtcgctgtcctaaacgacttcctttacgagtatggagggagtatatagtaagtaactattatatgaattggctattacattggctatagatgatttggagttggtagtgggctatactattaaacttgctcttagttgattagctgcacgcaaaacgagaaatatcggatagtgtataattaattgagtattaattattaaaaaatttaaaaaatctatttaattttttttacagaatattcaatatataaagttttgatgcgtttaatagtttgaaaaacgtgctaatgaaaaaggagaagtagctaagagcaaggttaataatacagctaacctgttggctataaggttccttgcagtcttctctcagcctacccatataatagatagctctttacaattaatatagggcacacttgtctctctcacagagtttcttggttattgtgtctaagccggctgtaagtttatagcccttttcttatctctctcctctcttctctcctccatctcggcatttagccagagcaagtataatagtaggctataagaaggctgaatgcttaggtggatgggagaaaagaggatagagatgagaagcgggctataagtttacagccggcttaggaacaggaaccaaaaaaatctgtgagacagacatatgaaccatatatttatagtgaagaattaaccactatatttaaccactatatgataggctataagtaaacagcttgctgtattattatccttgctctaaaaccaatttctcggcgacatgaagacatcagagtacgagacatcccgttgaaacatgaaacacaatagtgataggaccaaagtgggtggcggtccggctgttataggacccggccaagacatgactgaaaactttggccagagtccagacggttccaggtgtcaatgtgtcaatgcttttggaagctgctgatttcatgtttccgtcccgtttttcttcaggagatctagccaggagggacagctaccacaaagttaggcgttctaagatttgtttgtcactcgtttagtcgtgtcttcaacatgagtcaacaccatattgtcagtgatcagaaagaaaggagagttaaaccatccctattaatttagtatatataccaagttaggctgagattagtttcaaacttccaatttttctatcccatcaaaactttcctaaacacaaacttccaacttttctgtcacatcatttcaattttaaccaaacttctaattttgacgtgaactatgcacacccttattaccaacccaacccaagtaggctagtagtacacataacgttgaccaagccattcaacattttttttagaacagccaagcagcatgttgaatctatgtgctactctacctgaagtcaagctgatgagctactccactcgatatgccaccaaccctagtgtgaaaaaaaaaactgaaacagccggacgccactcgagctaacggacccgaccatgtaatcggagaatataaaggacggcgggatgggcgctcgctcgctgcgtccacgtcggattttgctacagtagggtggaaattatgcgaaaaagccctccgatttttcgtaataatgtataggtccctagtgtaacattgccggccgggcggctggcagcaggaaggagcacaaacttggcgatccgacggggcccgcacgtcagcggccggatcacattagctccctatttgctgagctgctggaaggccaaagggcccgcccggcacggcccggcccaggaacagctgggcacgggctagcagccatcgggccggcacggcccgataggcacttcgtgccgggccatgccggcccatgggctgcacctcccgcccaggcacggcccaccagctgtcgggccgtgccgttccggctcgaaggtatgggtggcccatcgggcctttttttaaataagtctatttttttccctcctctttgggctatatcatatgtatagctaaagtaagtctatattccatccctcttctttgggctgacatatgtatagctaaaataagtctattttctatccctcctcttcggctgacttatgtatagataaaaaaagtctattttagatccctattctttcatccatggcacataatatgtctatttttactcccatatttttttttgtatcggcctagctgccggcccatcgtgccgggccggcctaacatgccggtggaggggcccaagcacggcccgatggtcgggccgggccagcatgggcccgacctccgtcgggccgtgccgtgcttaggccggaccaaaatgccgtaccatgggtcgggccgtcgggcctcggaccttttggccatctgcctgctggttaatcaatcccttcaaaccacagcgtagaaatgtacaccgacatctagaaaacctcctaattacgagtactactcgagcccagtgaaccagtcagtcagtactctgtagcagctttggtctacctaggattattactaggaaacacaggtattctgttccaaaaaaaacacacacactcgtgttgggctataaatactcgtgcacaacgcatgccttctgcgacagaaaagagctggacgtggtcacgtagagtgcaccactgattttctacagcgactcttgagtggtggcaatgagcaagcggcagtttggagagatggacggcggcatcgacacggcccgcgtcctcatgctcctctcccggcggcggcggcagcacggcgacgtcgggcacgcgcgcgcggcccgcgtgttcgagtgcaggacgtgcgggaggcggttcccgacgttccaggcgctgggcggccaccgcgccagccacaagcgcccgcgccacggcgccgagcgcgcgccgcggccagcaggcgacgacgacgtcggcgccggcgccggcgccgcgctccgcctcgtcggcgcggcgtcgtcgttgtcgacggacgaggcgcgcgcgggaggcggcggccgcaggacgaggggcgccggcgccgcgcacgggtgccccgtctgcgggctggagttcgccgtcgggcaggcgctcggcgggcacatgcggcggcaccgcgccgccgccggcgacgtcgcggcgccgcgtgtgaagaccgacgacgttgtcgttggagacgagtgcaccggcgggatttgcttggacctgaacctgacgccgtcggagaactgcgacaagtgccggcacgcccagctcggcgtcgccgtgaactctgtgcaaagaacgatactactggaccgtcccctttgagctgacccattattgtactgatttctatacgttttcgttgtatttatctagcctttatatgttttgttgcacgctatagaatcatataaagatttttctatatattttttgaacctttcaatcttaaaattttacaaatagactatcccgaaacttatttctaaagctgaaccaagagtttaaatttgaagttttgaggtggtttacttttaaaattaaaaaggttcaaaagatatataataaacctctataagttactgaagaagaggagccaaaatgcaggaacagcatcactctattccatgcatccattgattaactgaaaacccaatagcaatacagcatggactacgttacacactgtagcttgcagttcaacggattgaaatccagcgtacagtagtagccccccaggcaattgcaacagctacgtcaaaagcatgagtagttgcttcaaagaatggaagcaaagataggtacaaccagatccgtatcatagtgtgtcttcttgacattcttcctataacagcaagacagggaacaaacaatgtcaaataataaacgatggaggccgagaaggcgaacgtctcctcaggagccgcagcatgcagatccagaagctgctggtttgtcggcaccctgatccgtcttgttgttaatcttgattgtcttgtcctacagtgcaggagcatatgtttcttagaacaaagagcaagatgatgtttgagacataattcagtatgtacagttatctgtacctcaggcttggagtcggtctcagcaagcctctgcttaatgtcacgtgcaatggagaaaaaaacttgctccacgttgaggtttgtcttcgcactctggaatacacagtgcagtgtaaaatcaaaacaattgtcactgcaaaggccactttcttttcaaaaaaaatgacagtgaaaagaacaaacaattcaggcagcaacatacagtttcgaaaaatttgatgccatactcatcagccagtgcttggcctttcgcagtagggacagcctggagaaataacaagaacaggaaacaaataagcttctaactagtaatcctcagggaaaactgagcatttgaccacaacttcaaagtggggatacggtatgaatgaacaccaaggataaaaactgtgatgtacccttttactctcatccatatcagccttgttgccaaccaaaattttgttgacattatcagaggcatgttgctcaatattccgaatccagttccgaatgtctgtattgtcaaataaaacagcagtgacaaaatagttcaaaatggaataattaaggaaggtatatatgtaaggagacagtactgttgaaagatgactcgtcggtgacatcataaacaagcaggatacccatggctccacggtagtacgtgaggtaaaatgagatttacttgatcaaaaggttctcatttaacttcacagggttagtatgctgaatggaacaataattataccagtggtaattgtccggaaacgttcttggccagctgtgtcccaaatttgtagcttaatacgcttcccgtccagctctattgttctaattttgaagtcaatactgcacaaacacaaatactgcaatcagcgtggagaagataataaattgaaaagcttgcgggcaggagccatagagcggtcttcccaacatcagagaacatacccaattgtggtaataaagcttgtagtgaaggaaccatcagaaaaccgcaggagaaggcaactcttgccaacacctagaaatggaaaaatgagaaaaaagaattcttataagaaaattggccagcacaaaacttgcctgaggaactgccattagctactaaataattagttcaacagaatacactaacaaaagtgaatttgtaaatattatggactttaaaacagtacaactgctagagaaatagcatgctaccaaaggttatgcctaaaaatttgaactaatagacttacattggatactagaaagaaccaaaaacaatttgtaaaagactaaatcatagatagtcataattaaaaacaagtagtcatcactgagcaaaagaatccaagatcaagacctattagagcacgagctttatgttacagacaatcatgaataatctggcaattgtcatgaaaacaatcacttatttgatcctatcaatgaataagtctcgacaaggaatatagtggaagctctacgggtagtggctcaaagcgagagcacaaaatgcccctggttgatttgagctattggtataaaaatataaatttctgctatgaacttttaaacaattacgctatttcatatagctgtaatgtttgacccattagtttcacccctcactccaactttcttccaacagctacacatttggagcatacaccctcacgagcaaggaactatctagttccactctcaacaacatgtagcacaaattccatggcatgcactaacgaatgaaaattatagaggaaagaatagcacataacatactctctttaactctatctcctattgcatgattgagtgccaaaaaagaaagcattgcttcatgcttatgtgcaacgtttctcagatggccttgcacactgtcgaaataaccttagtatcagcttaatcagaaaagcctgcaattccagttgaccatttccaaggttcttccatccaaggaaaaacttactgaaccacgaaattcatttttttttctcctcgccattttcataactcctaactttgcttcttcttcttctttttcttttttttttacataaagcacagtagtggtagttcctgcctgtatgtactaggcaagtaggcattatgtatattgtaggttgaacagaaaccaaattcacatgaaagacagatcatgcacacaagcgcacaccaaaggcaaatcctttgcaggatcctagttgctcgcgtggcccaatccacctgcgatccaaccaacaccgaggcgcgggaaaacccacacgacatcactcgccgtggaatggaaatgggaaggcaagatctaagctcgaggtggtgtcaccaaccgctgtccccgatgaggaggagcttgatgaggtagtcgtagtccgcccgagccctcgccggcggcgcagccatctcgtcgctccgcttcacaccctcctcctcctcctccccctactccacagcccacccggcgcgcctcctccaccaatccccgacctgcagcgaacggaaaaaaaaaaaaacagacaccgtgagaatggcagcacgacggcggcggcggatcccgcgcgggtggcggccggatcggagaccgcaccggtaggcgcggcggaggatcgcgcggcggcggcggtggcggtgcggatctggagaacggggaggagggagttggttttttttttctctccttttttcccttcgcttttttagtttgctggttgattcgtcgccggccgcatgagcgagcgagcgactgatcagcgcgtgcaagatcagagctgggttttgtaatttgttcggtttttttatggggtccggttcggtcggt

SEQ ID NO: 79120 - DNA, 713 bp, Oryza sativa
tgcacccctttatttgctttgacgaagctctcatgatcatacatcttttagggagtgatctgtgatactcttcgtcgaacttacggccttagcttgtcagctttccaagttgtatcagcagctgctagtcagcaatttttctctttgtgttcttgtagctgcagctcctctatgattagattactcctggttcatggaagcaacaggcaacccaaaactgtcaaaacacgctgtatgttgtacaagagaaaaacattgtacatttcctaccccattttcaccttctccttgtgctgtatgtaacattcaatgcctgtaactggtaaaagtttcatgtgctcgtcatctgatattttggatggaatgaattactctatagctgatcattttatgatgtgaaacccatctaattttgctagagcatggctcactttgtcttgtgattggtcagattatggcctcccgcggtgaggtcttctgttgctgatgaagaaaagttaggccttgtctagattccaacttttttcttcaaacctccaacttttctgtagcattgaacttttctaaacatgcaaacttctaacttttgtcgtcacatcgtttcaatttcttcaaactttcaattttagcgtggaactaaacacagccttagcatcagttgtcagaacttcctgggtgcatcacctgccacaaccaccaagaacttaaaactc

SEQ ID NO: 79121 - DNA, 1226 bp, Oryza sativa
ttccgactagcttcacaaggtgatgggctagatgacttgggttcgaagcctcaccccttctaattatttgatattaggtcatttcctaatattcacgttgaattactcattattgctgtaagtcattttagttttgttgtaagcaaacttacgtaactttgactgagggcttgtttggttcgtgccctgggcatctagcatgagaaatttgcatgcctgagaggcacgagaaaagttgattacattgcctggtcaggttgtgcacagctacctgagaggaaagaaacactattagcagattcatgaacaaactaattgcatatattaaggatgaaaaacaagcggaacacaagggaaaaaaaatccccaaatccatctactatatgtctttctttatagacatatcaatcacataattagataagatagatcaattgcataagttaaaaagagagcaggagaaaagaacgcaaggacagaaatcccccagatccaagcattcatcaaatcgctttggcacaccggcgacggctgctgcttcgtgctgaagatgggcccggccggcgacctcgcagtagcttcgtgtgacactgtgccggatctgacgacgacggcgccggcaaagacgaggcttcgagcgaattagaaggcagcgacggtttccgagtgtccgcgacaacaacggcatcagaggttgggatttcgagagacgatggcggcggaggaggaggcaaggtcgtgcgcgaacgacgacgccgacggaggctggggttccgcgcgacgacggcggcagcaaatagcgatggctcattggctttgtgctacatgaaagaagataatacacgttcgctgctacgcctgaaggtcaggctaatcacgagacagcatgcatcaggtcaggcaagggcaaagaaccttcaggctggtaaccaaacaacacttaaaatgtgccaggctagtcttaggtcaggccacttcttctcagggtagcaaccaaacagcccatgagtctataaaagaaatacggcaacatctgtaatactccgaatataacaaataagagaactataacacatatttcaaggtggatttaatggtactaatttaatattatagctgattgtgtatttttctttaaactcaattagaattagagaagtttgatttaggatcaaattaaaatgacttgagttcacacaatatggaaaggaatggatacaatggtt

SEQ ID NO: 79122 - DNA, 4541 bp, Oryza sativa
acaggcgaacatacaaaaccacactcaaaaggaaaaaagaatggcatggagtactgaggaccatcaatctaaagattaaattgccacccatgaacaactccttggccatctcctccaaaagcatagagttttaagggccacaaattctaagattagatcgccacccatatccctgagtaaaaaactccttgaccaccttctccaaatgttgacatgccacaactaccatatcccgcgaaccaggcttcaggcttctgtaggatagcccatgtacgaagtcaatggataagagaatatataacctgcaaaggtaaagatatcactttttttttataaaaaaaccacattattcctacatagccaaagcgaccaacaagtagcagctgctcctaacaaaacatgtgctttcaaattattataaattccatcaagccagctcccaaatatatgcgctacacaatgtggtggaggaaatccagatgctacttggatgatggaccaagcaaaatgggaaaaacgacatttgaagaaaagatgtctaattgtctcgtcattgcaacaaaaacaacaattcttattcccttgccattttctttttgtcaaattgtcctttgttaacaccactccacggtgcaagtaccagagaaaaatcttaacttttaagagtatctttaatttccaaatacgcttattaatgttgggaacattgctgtgaattagagctagataatgagacttcatcgagaactcctcatttgaggttaagttcctatgaaactcatcttgctcctgagttaattgaaaaccagtgatacgtggtaataaattattccacgctgctagttttgatcctataaggtctcttctccatgaaaaagatagaggattgttttcgaagatttgtgcaactgtagccttcttatacctaactatgttgtaaaggcaaggatactgttctttcaagattgaattgcccaaccattcatcttcccaaaacctcaaactaaggcaaggatattgtttccaaagttttttgagacaaaaaatatttacaatcgttgtttctccatcaggtgtgcttctgcatttctgcaagctagaaaacctacattcctacaatgctacacttgcaacatttattttgttttttctttgaactttgtttatattctgtaaattaaggaggatgctcgatacccatttaatccattgtgttgtcatacgctggtacttctatgagaagtctaaacttctcaaccacaactaacttttttcatttcattttctcagcatgtccttgtaaacgcatggtaacacttaatttgatggagctgtttcctccatgaagaagctgttattttcctatgaatatctcatcaggttaacaggtttcttgcaagttcagaacaagaaagttgcctgagatgatgcaaactgactgcacaaacagaaaggcaaccagttggttacttcatcgatattacaggctagatcgatgtagcctggagactctgcaagtatgcatagaaacagagtggtctttactcttgttcattaatcaggatagccttgctgatgctgaagcagcaaaacggaagccggttagagattgcagcataaattggattcagtaatgctttgcacttctttcgtgggaccgcactttaatctgtactacttcctccgtttcacaatataagtcattctagcatttcccacatctatctatctattatattattaaaacagctttgaaaggaggcaccacgttcgctgtgggggctagaaattcccacattaatcgaagaaaaagtgaaaaaagaaaaaggagagtccaaatagaagtccaatttaaaaatagctgaaattcggaattaaaaataagcaatattgaaaaaagtttccatataagaacctaatacgagattaatcaaaattcaaaataaaaataaaataaaatccaaaattagaagaggaaaggagagtccaagtagaaatacaatttaaaaatagctgaaattcggaattaaaaataagcaatattgaaagaagtttccatataagaacccaatacgagattaatcaaaattctaaataaaaataaaataaaatccaaaattagaaaagtaaagaagagtccaagtaggaatacaattttaaaatagctgaaatttggaattaaaaataaggaatattaaaagaagagtccatataagaatccaatacaagattaattaaaattcggaataaaaacaaaaataaatctgaaattagcaaaagaaaataaaagaagagttcaagtaggaatacaatttaaaattagctagaattcagaattaaatttaagcaatattgaaagaagaatccatataagaatccaatacgagattaattaaaattttgaataaaaaataaaataatatccaaaattataaaaattaaaagagatttcaagtaggaataccattttgaaacaactgaaattgaaaataaaaaataaaaacattaaaagaacacaatacggtattaactaaaaattttttaaaaataaattctgaaattagaaaaggaaataagatttcaattagtaatacaatttataaataactaaaatttgtgataaaaataaagactattgaaaaaaagaccatctaaaacacatgacgagataaattaagtaacatgcctataaaggagtagagtggtggcggttgatacgacatataaaaattgttaataaaacacaaaaaagaatcctaatgacgattaaaaggagggacgtcaggcaagtcgtgaagcaaacaagtaaggcggttgccgggatttctagacagtaaaaaaataaaccccattaataatcatattcgatttttaaaatctcaatgacaataaaagggagaagcagcgggcggggtatataagagtatagttgcagagccgccgacggttgacgggacttctagaaaataaaaaatgaattccaacgatagttatgtttgatttttaaaatcatagtgtaataaagagtaggcggcggacgggctgtagaggggcattgtggcatcgttcgatgggacttctaaaaattataaaaaatgaaaatacaagtccaatttttaaaggttcggaacttccaaaaattaaaaaaacccaatgataatcatgttcgatttaaaaatctcaatgacaataaagaacggaggcagtgcgcgagccgtagaagagtacagtggcaaagccgctgacggtttggcgggacttctagaaagtaaaaatgaacccaaacgataattatgttcgatttttgaaatctcaatgataataaagagaagaaacagtggacgggccatagaggagtataatggcaacgtttgacgggacatctagaaattataaaaacaaaacccaatgtgacaataaactctaaaaactataaaatccaatttttaaaggttccaagaagaatgaatagaaatagtggtagatcaagcaagcaaataaagaaggggtagcaactggtgtgacttttaaaaactatatgtagaaacacgaggatgataaagtttggtcttttaaagtcttaagataataagatagctatttaataaattttaagtaaaatcatcctaaaaaatatatgaatttgtttgggtgctagccgcgcaattgcgcgggccacccagctagtttatattgattttagtgaatctagatagatatatatgtctagattcattaacatcaatatgaatgtaggaaatgttagaatgacttatattgtaaaacggagagagtagatgttatcttgtgaggcggtctggtgattgtgtttacacagtaataaaactgtagctctgtatgctatctcaggtactgtagtttgctgtttgcagttgttccaatcttgccaaatcttttgttacgatgtacatacactgtccgcatatctttgtccaatgtgatctgtatgagtttccacggactgtatctactgatatacagtaattgtgagcgccgctatttgaatcttcagcgacttgattggaagtaaaatcaacgatcttttttttagctcaagccaggccagcattgatagttactcccttcgtttcaaaatgtttgacaccgttgactttttagcctatgtttgaccgttcgtcttatttaaaaaaaatttgtgaaatatgaaaaattatatatgtacatgaaagtttatttaacaatgaatcaaatgatatgaaaagaataaataattacttaatttttttaataagacgaatggtcaaacacgtattaaaaagtcaatggtgtcaaacattttgaaacggagggagtaacttaccatctgacagaaccaccagctagagaaacgcaaggccgatgcaagtatgcaaaacatcttccgtcgtaactgttgtctgttgatcgtacagcccattacccagaggcgaaacccatgacgcgctgggcgaacactcccctctcctccgttccaatctgtagccgtgaagaccggacgaggtgaggggggggggggggag

SEQ ID NO: 79123 - DNA, 3215 bp, Oryza sativa
aaggaaatggaataaggttggtacattgttcttctataatcgtgtggttttcattttttctggatgtgttctttaggattatagctgaaccataggtagactgtgcactgaaaaattgttacagtattacaagttgctgctaaaacagtaactagcagatgggttcccacaatccaacatatgtcagagcatgcctgcagatcactgtttctgaacaatttagtaatgctgatacttgttcatatgtttttatcggtgctctagctgaacagtgaaatggtgtccttggttcttggtattgtagctgaacagtttttatctctcttttgttttctgacagacggctattccaatcctaattgggacgaagtttgatgacttcgctcagcttcctcttgagatgcaatggaccatcgttaacgaggtacgtttattaatagtttcttgcaatcaaaatattgttcccccttgcctttctttggttcttggatatgcagccttcagcatctccaatgtttgttagcatagaaagatgagaccttttcttggttctgacgatatgggtttgggctacacatgtttcttttatctcaaacgctgcaaattaaccagataggtcagaactttaatcttgaattagccttttcatggctaccaagtgctaatagcaaatcagaaatattcgaaagccaaccatcccctgaaaactcccattttgaggttcagatttctgaaaactgctactgaatcaaaattttctcatcaaagatttgagcttctttctgtaggccatgaacacgaaatttttttagcttgatcgcatctgcaattaattaagaatacctatgtgaaaacgacaagagagcccaaatcaaacctgaatcgagtacagcatgctaccaattatgtttgtgcagaccgtgctgacctgatagcaccatatatgaatgcctattactattgcaacattgaatacagtggaccttggttgatcagggggagcattcgttaagtaggcccaaacacgtcttgtcttcgtcttcgtctccggggaaggaggctcgccagtcaccactaacaacagccgggatgatcgagtcaaacgatagaaaatttattaggcaatggatataatttctgttttgtttgtgcccatttgtttgcatcttgtccaaaccatacgacgatcatcgatccctgtgggccttacaacatacagaatgtagatcgatggtcactaatcactcgacatgctaaaagcaaggaaaagctacatcacaactaaccgaaaataactcctcgtgctactgggagccctcatgcttgaaaatgtagttgcgtttcttttcagccacagtgaatatcagttcactgaaaagtttttgtaactaatcctagaaactactgtttgaccaggtttaattctgacaaagaattcgagaacacaaaaccatatgcttcgcatttggtttactgttgttaaaaaaacatgttgtattcgaaagaaactcctctgatgtaatgccctctgacatgtgggtccacgagttatgggctccatatgtcagtcccttaaagtcggaggacagtaagttagaaggtttttttccgttgtattcttgtttctgatggaggattttttttttctgaaatttcaggccagggcatacgcgagagcgatgaaggcgaccctcttcttctccagctcgacgcacaacatcaacgtgaacaagatcttcaagttcatcacggccaagctcttcaacctgccgtggacggtggagcgcaacctcaccgtcggcgagcccatcatagacttctgaagactctacacccttacactgacaaaatgctaggcaaaaaaacgtacacgagcccttccttccctccccttcgtcgtcttcctcctgacctttctctcccggtaatggaggccggccatggccatggctgagcagaactgagctcttgcatgtacatataggtgaaagaaaaaagaaaaaaaaaagaaagaaaaaggatcaagttgagttcgtcgttgtcgaggtgttatcccttcccttgtgcagtgcaggcaagggcagaagaggaaaccgtgagatgttgtctgtaaccctcgtcacagtgtatagtagagtaggagtttaaccgatccatgtaatataatcctcaccgtttttttaacaccagttttagatatgggtactcatcgaaccattcgatcagtttaattttttttttttgcggggaaaccattaattcgatcagttcatctaaagtctaaatgaactaaaatctacatagtccctcgtttcaaactaagtatatgtccaggcctccagggatacttgtactacttctatcctaatataagagcatttttagacgtgagagaaaaataagaagagaaaattacctaaatgttctatattaaacgagagatgatggaaagtgcgagggtaattgaggataagatttttttttgactaattcaccaggagggagagattccccacctgaatatattgcgtcaaacgaaattacacagggcaggcttcacctacgcaagtgcaggaaccctggaggataatagcaaaaaatacacggggagtcctgagaagagaatacaaaagagaggccaccttcccaaaataacagcaattgaagtttgcacttgcaagaaacccaaccgaaaaccagagcaacctaaagctaacaccctagctcatcaacaaccatatcgttatgcaaacttggaaacgccagagtccacgccggagggcctttttgccacaagcatgtcagctatggattaacggcaaccaaaagactgaggaagtcataaaccacccgcattaagccgtcaaaatccaacttaatcttgttgctgcttggatcagtgcccgccgacaccatttgggggaaggaagcctcagagaagggagggccactaaaggttgcggccatagagaccgcccgcatcgagtcttcttcaatccgactataacaaattgctagctagttccacgccctccaacgcccttttagggaaggaagcctcaaaggagggagggccgccgaacaatgtggttgaggacaatccaaggaaaagggtggagacgaagagggagctggacaaaagataagtggtagaggggggaatcctacagctgaaagaacgtcaaccgcgtcaacagggaaggctgcaagaatag
